United States Patent 10,900,036 (RNA INTERACTOME OF POLYCOMB REPRESSIVE COMPLEX 1 (PRC1)) - sequence listing, part 2

SEQ ID NO: 2282 - DNA, 1174 bp, Homo sapiens
acagggacttgaaactttcaagcctgactatagtgaacaaaagggaaatcgagtagatggttcgaagcccatttggaagtatgaaactgggcctggaggaacaagtcgaggaaaacctgctgtgggtgatatgcttcggaaaagctcagatagtaaacctggtgtgagcagcaaaaagtttgatgatcggcccaaaggaaagcatgcttcagctgttgcctccaaagaggactcgtggaccctatttaaaccacccccagtttttccagtggacaatagcagtgctaaaatagttcctaaaataagttatgcaagcaaagttaaggaaaacctcaacaaaactatacagaactcttctgtgtcaccaacttcatcttcatcatcttcatcatctaccggggaaactcagacccaatcatcaagtcgcttatcccaggtccctatgtcagcgctgaaatctgttacttctgccaacttttctaatgggcctgttttagcagggactgatggaaatgtttatcctccagggggtcagccactgctaactactgctgctaatactctaacacccatctcttctgggacagattcagttctccaggacatgagtctaacttcagcagctgttgaacaaattaagactagcctttttatctatccttcaaatatgcaaactatgctgttgagcacagcacaagtggatctgccctctcagacagatcagcaaaacctgggggatatcttccagaatcagtggggtttatcatttataaatgagcccagtgctggccctgagactgttactgggaagtcatcagagcataaagtgatggaggtgacatttcaaggagaatatcctgctactttggtttcacagggtgctgaaataattccctcaggaactgagcatcctgtgtttcccaaggcttacgagctggagaaacggactagtcctcaagttctgggtagcattctaaaatctgggactactagtgagagtggagccttatccttggaacccagtcatataggtgacctgcagaaagcagacaccagtagtcaaggtgctttagtgtttctctcaaaggactacgagatagaaagtcaaaatcctctggcctctcctacgaacactttgttaggctctgccaaagaacagagataccagagaggc

SEQ ID NO: 2283 - DNA, 1179 bp, Homo sapiens
cggcagcggcgaaggggaaggaaagaggatttgagctgggggcggggcttgcggcacagcgtggctcctgattgttggagtgcggctgccaatctcgcagaatcgctcggttaaccagtgcgctggcgagacgcgctcagatatactgagtgagccctgagaagcagtctcagatcctgacggtgcagcagcccgcagcctcagccagggagtcccagccgctttcaatggaggagaagcccggccagccacagcctcagcaccatcacagccaccaccatccgcaccatcaccctcagcagcagcagcagcagccgcaccaccaccaccattattatttctacaaccacagccacaaccaccaccaccaccatcatcaccagcagcctcaccaatacctgcagcatggagccgagggcagccccaaggcccagccaaagccgctgaaacatgagcagaaacacaccctccagcagcaccaggaaacgccgaagaagaaaacaggtctgggagggaggacgggtgggggaagggggttgggggtggaggacaggagagatgggggtggggctggatccgaaaagcgcggacggggtcggggtgtgtgtgtgtgtgtcccctccggctctggggatgcccctttcattctagagctcgggctgagcaatggggtttgcagcgccctctccttccctccagcatgggagaggcccagccaggccagcgtgaccttcctggccccggccccggctgaagggagacctgctgggtcggccttgcaagtccaacctcattattcttttcccattcacctccctgcgtccctggagttacctcaatttgggggccctgagatggggtaaacctacccccccaaaaaatccctcgaggtgtaactcaggaaggcctagcgaatcccgactcggatggtgtcgcgagacccttttgcaggcggcgaggagtgggtaggtagggtgagttgaggaagtgcccctcacccgccaccccaagcccacctgtggccttggggctccccgtctcggtggggggggctgttgggacccctcatctcacgggtcatttccaccactaaacgccctttttgggcgccggaccccgcagtcttgtcccgcggctcctcccgaggccggcgccccgcgcccgctccccccagagccg

SEQ ID NO: 2284 - DNA, 1218 bp, Homo sapiens
agtttatatataacttaccaagatgttggctgtcctggtgtattgccagacagctctcttttggttcccattccaaatgtgctgctgtccttctttgcatttcacaatatcaaagaaaccaccacccttcttcctaacagcattttatgccttttattccacattaaatgggaattgtgcctacttaggagtgcccctccaattaattacatgtgtccaagaataatccaagctagagacacaaggtgggaaaacatttcaaaaaaaaaaagtcctcttaaggccagtaatttatctgaaaaggtattttatcacaccttgacaccttatatatgagcctattaggagctgcaggtggtttcatagggtaaaatccaagaaaagagaaggatgtgtggggtttctattagaagataattttgttctcattttaccttttcttttatgatccttctctgctagaacaggttaattctccaaatttgttttgttttgttttgttattttttagggaactcttttgcaaaagcaatggtcggatgtaaataacatttaaagtatagtgcacataacttccccggactgttccaatctgataatttgtaaatgctttagagtttttttaattaacacttgtgttgctaaattctatttatgtaagtctgctaaagttttttagcccacttaaaacttaagacaaccatttaaaataatggatgggttactatgagcaatttcgctttcagaacccccttgttttagtatatgaaaaagcctaatgcgcattaatgaggttgaagagactatgagaaatatgtatagtgtatattttaaaacagctttgcttgtattgtgaagatttaaaaacaaacttgagatttttaacgtaactattaacacagttttaacataagttatcccactgggtttaagagcatcttgaatgtataatcctttttgtaacccaggttggtttctacttttaccagtcacccaaacatatttatgtttttagttttatgtactcatttccctttgttttcctcaaacagcatgatttttttgcacatgtagaaattttttaaaagaaagaaattagtacatcattttctctggattttcttcacttccctcttcctttctactaactccttccttaaaggccatatcactccatttgcattatttgtgcaaatgccagggttggtttttattttt

SEQ ID NO: 2285 - DNA, 1244 bp, Homo sapiens
ctgaacttatactaaatcaggggaccaaaaaacttgctcttatcttctcaaattgtattctatatccattaatgtatcagttatcccaaagccttcaggtggaggggtttaccaccttcctaggtcgttcaaccaggttttgtgaggaatgcattcaaagtggctttataaaagaagattttctttagcaagaataatgaggtcatgtcatttgttaataagtatctgtgataaatccgtggttcaaggttaagccattctggtattctggtattagcaactgtaaattctgccacctcatacatggaacagagcttgtgggatgctaatagttagtgaagtatacatgatttaatttctaataatctttatgttttctttaaggatggtggtgtattgctctttttcagctttatttttaagagtacagtcaggaaaccaacaaggggcctaagagtggctgcccctgcttgggacattacagcaagtgaaacaaagttaatgtgacaagctttgctttgttatcattggtcttcactagaggataccttttacatgtacttctctcttggatcaaatatgtctttaactgtacatctcagtggctggaggccatgccttttaagcatgtgtaaaatttttaaagaaatgaacatacacatagttattttagtaatatttcctgaaagaaaaaccaaattctgctataagtcttgatcttcaatgaacttttaaataatgcatttagctggaaaacaagactttcccagcttgtattacctagaagcgtgaatgtataggatacctgactactaagactatattctcagccctgccctgtcttttatttgcgggtctaatctaatattagaatatattaaccgcttaaggcattgaagccatatgggatggggaatgcatttcttcagtgtttctccgagagactttccatttccttggagttatggcggcaagtaagtatcatagtattaagaaatttgcctaaatctgagttgtgcctttctttactcacaaggcatgggctttgtcctggtgatcagtttgtaagccttcttccttcccagctccttaataaaagcaaagtgattgagtaggtaatgttcaaagtgtctgcctgtgtacatgtacttgtattgattatgtagttcagtaagatgtgcccaagtcatttcagaaagaaagacccttcagttttgatgcattttgctgaacacttgggtagt

SEQ ID NO: 2286 - DNA, 1216 bp, Homo sapiens
cgggctcaagcgatccactgggaccacaggcgtgctccactacgtgttgctagtagtagcagtagtagtagtagtaatagtaatagtagtagtatttttggtgagagagggtttcgccgtgttgcccaggctgggtctcgaactccagagctcaagggatccgcccgcctcggcctcccaaagtgctgggactgcaggcgtgagccaccgcgcccggccgattcccccctttatccctcaatttcctcatctgagcaatggagatacaggtagggctgaaggtcaggcaagaatgcgatgagctgtgagaagcacttggcaaggtgcgggttatcaaccttgccaggcctcagcacgtttcccaaggaggcccaaccagcggcgctgtgccgcagcacggaagaggcggggtgagccgcggggcgggcggcgctgggacccggacgccacccgcgcgaggcgccgccgtgcgcccgtcaatcaaggtcgtcgtggggcatggggcggcggggctgggcggtgcttccgcctgcgcgaggccgcgccgggccgcttggaggcgcccggtgcagtcgggaacccgcgctaggtttcgccggccgcgcggccagatgaggggggcgatggagctggagcctgagctgctgttgcaggaggcccgcgagaacgtggaggcagcgcagagctaccggcgggagctgggtcaccggcttgaggggctgcgtgaggcgcggaggcaggtcggagggccacacccacaggggcgctgtgggcccgggggtggcgcggatgccgggcgaaggctgggagggctttgaggggtgggactgtccgaaaactctggagtagggaagaggcattcatttgaaaggagacctaatggagtctgggaacggggaaggtgggagttggggaggtcgtaaggggaagttttgggggtggagggagggtgtgaggagcgttcactaaactgtggggcagcgatgggagtagcggtggcctccgaagtttgggagagtgagggaccagagcagaatccgagggggtcatgcgggtagtgatgagtcgggggaggaggagactggtaaaaaacctgcggtgggtaggcggggaggcattgattttagagagcctgaggaagaggtgggacagtgacctgggagagctgaaagtggagacaaaatggatattggaaggggaggactaaggggcgaga

SEQ ID NO: 2287 - DNA, 1219 bp, Homo sapiens
gtccccgcccccggccgcgccgcccttcttggcttgcgccctggtccccaccaaccccgcccgagcccccacggaccctgcccggcccgacggaaatgacccggccagggtcacacacggcccctgcccgctccgctgcggccatctccgcttccgcttccgcttccgccgaggcttctttccgactcaggcacggctctgtgccgtagctttcgaccccaccgccaggccgctgcccgctctaggcgtgggctgggtctcggggcatcgctcgcggcgggcgcggggcgagagaggagggaggagggccgggcttctcaagacgccggttcgggtcccgcaggcggcgggcgcgggacctgcccctgaccgggcgggagcggtgctcgcagagtcaagcccgggcttgcgggtggggcttgcgggggcgggaccgggggcggggccgaggccgcagctcccagccggtaccacctcccctccactgagagattccaccggtccctgggctgtcaggcgcggtggccaagtggtaaggcgtcggtctcgtaaaccgaagatcgcgggttcgaaccccgtccgtgcctgagacccgaggtagggctttggctgtggggaagtcgggttttctccacgtacgccgtcccttctacgtggcattttttccattttcggattctgctcagtcgccctccagttcgtctcctgccccgggctccgcggtcggcgggggccggtgcacctgggcttcgagactccagggtccaccttacaggtgagctcggcccccgccgcgccgcgtgcgccctcgccgccggtccccgcgtctcctttcccccagccgcatttcgcagagccggagtcgtcttcactgcttcgccaatggggacactaaggtccaggtggcccgcggggactcgggtcccgcccgatttgcgagtgttatggcggggcaactttccagagagggtgcctgagtttcccgaacggtggtttctggattgttctttggaaggtgaattatgcaggccatgcgcactgcctgtcttcctgtctacaaagcaaaccagattgttcaactggtgggtgcttcttttccagtcctggtgaactgatcctttgaatctgcccccagccagttatgacactccccacatcatctctaggataaacagtctgatttaacatattaataacatgacattgagcgcctcctccc

SEQ ID NO: 2288 - DNA, 1322 bp, Homo sapiens
ctcttttatattgaaaaaatccaaattttgcatttgactccataatgtatcactgttttaaagtcaaaactgttactctctccaaaaatctctgctatgaattgagcagctgcagatagaagtgctgtgttatccagtttgcttcttcactgctaagaacccttgtctgagaagcatagcttctcagctgttccgaatgaacgcatttacaattcttcaggaaaggagaactgtgtgtgtttttaaacaaaataagtgcaaggatctgtcccctagacatacctttttggctgtccgtttttaccttccttccttccctccttccttcccttaatctgtcttttaaaactgcctgcagatgctgacgacatccaggagagcatttctcaagagcttaaaccttgggtgtgctgtgccccacaaggagacatgatctatgaccccagctggcaccatccgcctccactgataccctattattccaagatggtctttgaaacaggacagtttgacgatgctgaagattgagtgtggagctttctgccttgtaggtgggcgggcctccacgtcaagatctcttttcctgtcttggaggtgaaaagtcatatctgagaaaatgtttgcagtgacccctagtctggggtacacagaccagtgttccttattgacagtgttcaataaggccccgtcattctcgccagtctgttgttgttcttaatgggctcctccttgaaatgtgtgtgtgtttgtgtcaagaggagttgtgttctttgtaaataaaggttaaaaagagaaaccagtatgcttcgtctgcttttttcccatttatttatttatggagacagtctcactgtgtcacgcaggctggagtgcagcagcgcgaacttggctcgttggaacctccacctcctgggtttaagcgatttttgtgcctcagcctcctgagtagctgggactataggtgctcgccaccacacccggctaattttttgtatttttagtagagatggggtttcaccacgttggccaggctgttctcaaattcctggcctcaagtaatccacccgccttggcctcccaaagtgctgggattacaggtgtgagccaccgtgcccagccttcactacttcatttaaagtccctgaatgacattttaaagattcaaacgcttggaggcttaaaactactctgtgaaagaaaaaaaattttagttttgcttctgtagatctagcactgttgaccaaggattggaatccaggagacactggtgattttgtagctgattgttttcctgttgatagaaaatggaacatttacttagt

SEQ ID NO: 2289 - DNA, 1099 bp, Homo sapiens
aacaagagcaaaacttcgtctcaaataataataatagtaataaaaaaattacaaagagggaatttttaatcttagtaaaactgaaaaaatttttaaggcaggtgtatgcatatgtaaccagtgttaacggcttttctgctttgtgaatatacatgagttagaatacacagttttgacatgtaggattttatatgcatattcctatctgaatgtgccctaactagcacttcatttctttttcctcctttttaactgtaacttttcacacccagaaagacagtttgtgtttgaattaatatgtaataggtttgatttacattatgtaccaaaagaaaataactagtgggggtgtgcctctaatactattgttttatggttagttttataaaagggtgatgttgcagattatcacagatctcaactcctagtcgtgaggttagatggtatacatgtagaggccataaatcaacatttatttcttttcattaggccaaaacgaacaaaagcaagcatgtctgaatttcttgaatctgaagatggggaagtagaacagcaaagaacatatagtagtggccacaatcgtctgtatttccatagtgatacctgcttacctctccgtccacaagaaatggaagtagatagtgaagatgaaaaggatcctgaatggctaagagaaaaaaccattacagtaattattattatctttattggcaattatcttggaatattattttgttttgaaaattgcttactatgaactagacttttattgtaaaggaactttttttaaaaaaaaaaaaaggaatccggaaatgtacaggttttaaaattatgtcactttaaaagttaaccaagttaggctggtggcggtcgctcacacctgtaatcctagcactttgcgaggcaggcgcattgcctgagttcaggagttcaagaccagtctggacagcatggtgaaacccggtctctactaaaaatacaaaaaattagccaggcatggtggcatgcacttgtagtcccagctattcagttggctgaggcaggagagtcgcttaaccccaggagatggaggttgcagtgagccaagattgcaccactg

SEQ ID NO: 2290 - DNA, 1202 bp, Homo sapiens
ggaatatggattttcttcaagtaaatttgtattgtgtgttttcatttctatatttataggtaatcgtaatttaggctttccctttttaaatgacggcaggtgtgctggctcacacctgtaatcccaacactttggtagggcgagttgggctgatcacctgaggtcaggagtttgagaccagcctggccaacatggcaaaaccccatctctactaaaagaaaatacaagagttagctgggcatggtagagcgtgcttgtgatcccagctactcgggaggctgagacaggagaattgcttgaacccgggaggtcaaggtttcagtgaactgagatcgtgccactgtacttcagcctgggcgatagagcaagactctgtctctaactaaataaataaattaaattaaatgactacttaaatagaagttaattttaagaaatgttgccactttgctgtataaatatgttgtatttttagttccaaaacattctgtttttgacattctcacaagtttttcttaaaatatgtgtttaataggtgtttttctttctttttcccagcaaattgaagagttttctgatgttaatgaaggagagaaagaagtgatgaaactctggaatctccatgtcatgaagcatgggtagggtatttctaaattaatttaaatattttattattctttatggtcttttgctgtttcacattctagaaatcttacgtgtgttagaatcttatttaaaattccattaatgtatatttgtcccaaattttattctattccaatgttttttggtttggcaggttttttttaggtacaaagacgttccttttggtattatttataacaatgaattaatattatattcattagtattaataaaatcaaggcaaaaaccgggccttgcctttagaacttgttgcacagatgtgagtcatcgcagcattatttatcagggttgttgattctgtcagctttcaagaggaaacaggctgctgcaaccctggtgtccgtaggaaagggtgtcatcatcatagaacctcctcagaaatcactggtgcccatcctaactctcgtagtagtgtttctcccatgcttgcaaactctatcagggttgactcgttcacactcaaaacattttatagagctgggtacagtggctcatgcctgtaatcccagtactttgggaggccaaggtgggtggat

SEQ ID NO: 2291 - DNA, 1203 bp, Homo sapiens
tgttatatgtgtttcacgcacatatttgcagttggattttctccaacagaaagtggattcactactggcacattaacaagcaccaataggtttttattccaactccgagcactgtggttgagtaacatcacctcaattttttattatccttaaagatattgcattttcatattctttatttataaaggatcaatgctgctgtaaatacaggtatttttaattttaaaatttcattccaccaccatcagatgcagttccctattttgtttaatgaagggatatataagctttctaatggtgtcttcagaaatttataaaatgtaaatactgatttgactggtctttaagatgtgtttaactgtgaggctatttaacgaatagtgtggatgtgatttgtcatccagtattaagttcttagtcattgatttttgtgtttaaaaaaaaataggaaagagggaaactgcagctttcattacagattccttgattggtaagctctccaaatgatgagttctagtaaactctgatttttgcctctggatagtagatctcgagcgtttatctcgggctttaatttgctaaagctgtgcacatatgtaaaaaaaaaaaaaaaaagattattttaggggagatgtaggtgtagaattattgcttatgtcatttcttaagcagttatgctcttaatgcttaaaagaaggctagcattgtttgcacaaaaagttggtgattcccaccccaaatagtaataaaattacttctgttgagtaaactttttatgtcatcgtaaaagctgaaaaaatccctttgtttctatttataaaaaaagtgcttttctatatgtacccttgataacagattttgaagaaatcctgtaagatgataaagcatttgaatggtacagtagatgtaaaaaaaattcagtttaaaagaacatttgtttttacattaaatgtttatttgaaatcaaatgattttgtacataaagttcaataatataaaagctgtattctgttttggggtttttttgttattatgcattgttaacatgtacattaaaattttgatttagatagcatagtaagatttcagcctcaaatgagtcagagctaataagaaattaggaaaatcttaatgtgaaatcctgctttcagcagttacaactaatatgtcatttatggtattacataaatatttaaaaattta

SEQ ID NO: 2292 - DNA, 1359 bp, Homo sapiens
ttacagacctttcagcatggatggattactaattttcaggtatcgaaactgaaatttgatacctgatcctgtggtaaagtatgttaaactatggttttggagtgattattttgaggttcattttcagcctcactgaacagtgttttacgcacatgtgaaaagtatccacatttgtttccaactaaaatttgcttttatttggtgagaaaagttgtgtgcgtgtgtttgttgtagggaataattagggaattggaagagaggccaaaaacaaacctgaattacttttgtttcttgtgtttgagccacgattctatccagatagcagtttactctgagcagtaacaatgaacaagcagtatagcatttagcaaacctggaattgtttgtatatggttttcattcttggaagcataaagaaaaaatatgcattaaatgaattgtaaattttgacttgttaaataacatgtttttcactataactaataggattttaatatttaaagaattttgttgcttccatgacaaaatatcccattggactattttataacctcagtaatcaacatttaagagtccttaattggagatctgttttctctattacctaccatcctgcaatatgctgaaatctttctaagttgcttatcttaattctaatggtgataattgaaaaaagtgtgctggaaatacaggctcttatctggttgagtactgggggtgggaaggatttagtaatgtcataatctgttgaaggtaatatctatagataactaagatagttcctttttttttgtagttctgtgactcagacaaataagattttgagaattatgtagtttttaggtgtctgtaacatccactagtaaaacttggcaaatgaaagaaaattgtgaagtcaccactttaactgagtcaaaattttgtttgaataagctgatgaaaatagacatgtaccctagaagtagatactctaaaattatacagacatgaatgtcttttttaaaaggttgtcattattgacctaatattgagtaatctttctgcgttattccaaattgaaatttgtttgctcttcattgtaacttttatgtaaaagtcctttaaaaggggattcaattataaggctatttgactatagggcagatttttataagtaaacattcccccaattccacttatgctaactgtctcatgacagtaaagtttactcctttttagaaaccctttctcagtattttaatttctgtcattgaatcatttaaataataaccttttgtttttatagcaaagaaatcatctgacttttctgtgtgatgtttcttggcaaaataagcacttgatgtatggtcatgtacataa

SEQ ID NO: 2293 - DNA, 1224 bp, Homo sapiens
agttttattcttattgcccaggatgaagtgcagtggcgcgatctcagctcactgcaacttccaccttccagtttcaagcaattcttctgccctagcctcttgagtagctgggattacaggcatgtgccaccatgcctggctaattttttttgtatttttattggagacggggtttcaccatgttggccaggctgtctggagctcctgacttcaggtgatctgccgacttcgacctcccaaaatactgggattataggcgtgagccaccacacccagtccacttttcatactttctaaaacaatatttagggatttttgtgttagccactctcctatctcatttctccaattgaagtaatgcataaatcttccattctcttttttctctcattcatggatagaatgaatgtctataatgaaaagagcttcttatcaatagccctctcagatttgttctgaattttgccaaatatttgtataactctgcaaaagactttctttccctgccttctcctttagagggaaaaacaaactgtaggtgtgacagcttacctcctagcattgttgtgaggtttggctggcacaagataaagtgctgtgtaattactctgaaatgtttgtaattaataaagaaatgaattgtaggcactttgtcagtagaaaccactgtgatttggaaacgcaatgtttcaataataaagactataaaatttaaaaaagaaaaaaattaattctctccaaattataaattaaatggtatacctaatgactttccttagaacttgaaaagcttaacccaaaatttatatgaaaaggcaagagcctggaatggttaagacaacgttaaagaagaagaagaatgtgagacttacccttatagagaccgcaattaaccataaagccatagatgttctcaagcctagtatagcgcctgacacacagtagttaatgaatgtttgctcagtagactgatgggtggaacaatgagttgcttgggggtcaggattaactctggaagtggtagttgtgggaagggttgaacctgaagattagggcgactcagaactgcaaagaccagggaagttgggttctgagaaggggcaggacagagagctgactaatttgtttcatttgtctacacatacccttaagcaaattttatcttgtacagtttgagtatggggtttatgttttcttaaaattcagcaagcctttaacaggaat

SEQ ID NO: 2294 - DNA, 1201 bp, Homo sapiens
cctttgtagggacatggatgaagctggaaaccatcattctcagcaaactatcgcaaggacagaaaaccaaacaccgcatgttctcactcataggtgggaattgaacaatgagaacacttggacacaggaaggggaacatcacacactggggcctgttgtggggtagggggaggggggagggataacgcgtccagcgccgtccgtccgttcgtcttcctccctcccggcctctcccgccgaccacgggcagtggtggggggcggggggcgcgcgtccccggtcggcgcgccgcttcttcggttcccgcctcctccccgttcactgccggggcggctcgggacggggcccggggagcgtgggtgggaaccgcggaggcggccgcgccgagccgggcccgtggcccgccggcccccgtcccggggggtggccgcgcgggccccggtggggcggccacccggggttccggccctcgcgcgtccctcctcctctttcctccgcacgggtcgaccagcagaccgcgggtggcgggcagcaggcggcgaggcccggggcgtccccgcacccggccgacctccgctcgcgaccgctcctcagtcgggcctccggggtcgaccggctgccgcccgcgggcgtgagactcagccggcgtctcgcatacctaatgtaaatgacgagttaaggggtgcagcacaccaacatggcacatgtatacatatgtaacaaacctgcacgttgtgcacatgtaccctaaaacttaaagtataataaaaataaataaataaaattagtggttttaaccatgacttttacttggtctggtaaaattatcatggtaaatattcttgttttatttcccacattcaggaaggggtgatcatgtgacctagttctggacaatgagatgtaagttgagggtttctagtaaagttttgcttcctcagtataggcaccccttttcctcgttttctttctgtctagaatgctgatgagaggttggaggtggagtaactatcatatgaccacaagacaagcatgagcacaaaagtcacaagccaaggatagactgagtgagcacccagggtcagggcactgatgacactacgcagctacaagatcagcccaactactaacctctgcagcattcattttatatacatatatatataaaatattttacagagaaggaaactgaggcatagtg

SEQ ID NO: 2295 - DNA, 1188 bp, Homo sapiens
tagtttgtgagatagcagaggggtcccccatgatccctgactttattaaatggaggatatgtttatagataaagccttgtgatccttaatgaaccattcatcacagttccatttctatctaaacttttctgaaccagttttatctttttagcctgttctgcctcaggggataatgagtccctacgtgccactcacacactcactatattacagccccaacagtctgaaaattatttcttttaagctttgagaactttgccttagttctcatgttctgggatgtgtctgatccacaagtgctgtgtacttttcaaatctttacctgttggaggggatgaagtgtggattaaacaagtaaccagagttggttattgaggaaatgtttcctcggaggagctctatttgagggaagcatgtgcactgagactttgtttacaatgtacctgttatctcccacctccctcccccagtcacccctatacacttaagacattctcctcactcctctgcccctttttttctgccctgtgtgtttgtacagggggagcagtaccatcaggcttggaggagaacctgtgtaagatctgcatggactcacccattgactgtgttcttctggagtgtggccacatggtaacctgtaccaagtgtggcaagcgcatgaatgaatgtcccatctgccggcagtatgtaatccgagctgtgcatgtcttccggtcctgagagcttgcatcggtttcttcagtgccttacagggaaatagcctggggtgtctgggctcagggttggccagcttgcagaggagcaagctagtagaaatattgcagggttcccaaaaccaggtcaagcaagatgccatgtcacccctgagcatgcctgtcttcccaggggtgtacctcttggctggcaaagcccaaggccagtgggaacttgtataaatcacatgggtatgttcttggttcagtgatcttggagtgatgatggtaactgatgaacagagaactttccagaacttgggtcctgtcttcctccctgaacctagacagtttcacccctcctcctgtacccaacccatccccaccccatatgggagatgcttgcccatgtgtttcatcaatcagaagtcctcctccccagcacattcggatttaaatttctggtctctccggctttctgtgctttaactat

SEQ ID NO: 2296 - DNA, 1188 bp, Homo sapiens; identical to SEQ ID NO: 2295

SEQ ID NO: 2297 - DNA, 1245 bp, Homo sapiens
cacacccagccttgtgctcatttcctttgggggtgcggagaggtctttccttcgcctatccctctctgaatctctccttagtttatatttcctcagtccttgagtctgcaccctggacagcatgctgtggtcctaccacagggcttctccagatgtgtagaagttattgagtcttggagcaaggggctgagtgatcaattaccttatggctcttacagagaggaaaccaacaccccaagagatgccccacaaaaactagcagctgagccaggactagggttcaggatttctcacctctggtccaggttctccgcatcctactccatttcctagaaaatattttatgctcctggctcacatcagtaatcccagcactttgggaggctgaggtgggtggatcacatgaggccaggagttcgagagagtctggccaacatggtgaaaccccatctctatcaaaaatacaaaaattagaatccccgccccgcggtggggcgcgggaaatgtggcgtacggaagacccactccccggcgccgctcgtgtggggcccaagtccttctgatcgaggcccgcgacctcagatcagacgtggcgacccgctgaatttaagcatatttgtcagcggaggaaaagaaactaaccaggattccctcagtaatggcgagtgaacagggaagagcccagcgccgaatccccgccccgcggtggggcgcgggaaatgtggcgtacggaaaaatacaaaaattagccaggtgtggtggtgcacgtctgtaatcctaggtacttgggaggctgaggcacaagaattgcttaaacccaggagaaagaggttggagtgaggagctgagatcatgccactgtactccagcctgggcaacaaagcaagaatctgtctcaaaaaaagcaatcatgctcctaatggggcctggctctcctctatccctcatcgatgtcttcaattcccatgtattttataatacatagaaagagagagagatcatgttgcagacatactaagttataataatatttctaagcctccatctggaatttttttggggggggcgggggtgggagagacagagtcttgctctgtcgcccaggctgaagtgcaatggcacatgatctcagctcactgcaacctccacctcccaggttcaaacaattatcctgcctcagcctcttgagtagctgggattacaggcgcccccaccacatccggctattttttgtatttttagtag

SEQ ID NO: 2298 - DNA, 1246 bp, Homo sapiens
catttctgatatgatttacttttttttattatttctttcctgagttagattggctccctttaccttttcctgttgtcttgccctcacctcacattatctggtcatcccttccccagatgttttcttttactgttgtgtggtcttccttggtagctagcattgttgtttgtttgtttgtttgttttgttttttcaagtatgttttgtttgtcattaaggaagttgtactgctgtctttccacttttttataatagggctttgaacagttgctgtgttttttaccattatgatacttatatttgaatgagttggaatttgcaggactagctattagtagacttctatagaaaaggaagctaggcgggtagttttttagactttgctcctcaagaacgtttccttcgttgctctggtgtagccacagcttcttagcctctctgaatctaacttgattctagagggctgatctttgccttcaagccctgtctttcaaggaagccctgtcttccaaggtgtttgttttctctttagaaggtggtgctttttgagctctttcatctccagggcccccttggtagaaagggacttgctaccttttttttttttttccagccttattcatatgctgctcctgtttgatcttggtctactctgggaatggggctgtcttctgagaatgaatatttgtggtcagtctctaagacctactactactggtttcctctgaactccttgtgcctgcctactgtatcaccagagcatctcaccagttctgtggactttctttgacagtagttttggagaaggtgaaattacagctttatagggactttttcccccttgtttgtttcctctatttcatttcttaaatgagcacttggaagatttggaaccatgctgctgccatgtttcccaatattgacttaatgacagagttttgatgactgtgagagcaaaatcaaaagagtaaaattttttttgccttataactattatgcctaaatgagtgatgtgaattctcaagatcatttcattattacaatttggtagtcttaagatgtagtttatctaggaaaaggaaaatatttctttagccactctaactcttggaagagtatgtgtgtaaactcttttttttttttttttgagacagagtttcgctcttgttgcccaggctgcagtgcattggcatgatcttggctcactgcaacctccgcctcccgggttccaagtagctgggaattac

SEQ ID NO: 2299 - DNA, 1148 bp, Homo sapiens
tctcctgccttttctgtgcctagtttttggctcttcacatattccatattgattttgacgctctgtatattggcatcaggtggcagctgaatatcttttgaattactcgaaggtaaagccagatgccagaatgaaggtgtagccagtgtttcccatatgcccctggagccccacttattgaggccagcagaataggtgcagagatgaagtgagcttagagatgttgcaaatgctctttatcccttcagctctctgatctgctctttcttcatgatacttagtctgcagggcatattaagatcatcccagaggttcaggcagttcctgtcatctctgaaaagactgggggatatgaaatcttccccctaccccacttaatgcgttggatatgatttttcaaagaatgcttcatgcccaaaataccagcctgtttagcagtgttacactgtttgatctgcgggcacttgttgcattgcctggcacccaatattcagggtccatgactaagactggtcttctcagatgccctgcttaaatcaggggcacttcaggctccacaggcgtcatgttggactgagacctaactcactggactcagaggaggaatcgtggaaaacaagagcaaaactaccccacacccctatttcatgtctgaaataaccctgtttcataccagttgcaaagcttgtggggagcggtcccacaaagcactttcttaaaccttgagaatctccaagagaaaaatatttggggaaggagggaggaaatatgtcccttgcacaccacccctgaagcacatggcagtaggaaacagcataggattgtatgtgggaggtggataggtcggtgatgtgtggagcggaaaagcaggttggtaaagttcccttcttgggacttattcctggagtcagtggatacaagtagtgcagaaggttcacactgcaaatagtgttctcatctcaaagcaaactatcattccagaaggaaaagtgtgtcagggcaagcagacaacacaatttcctatcagaatatgtccctcaacccccgaaacaaggcttctctcagcctccccaccagtgatggataacagctcctattctcagctgacctgactgagccaacccatgaactcttcactccttggggaa

SEQ ID NO: 2300 - DNA, 1234 bp, Homo sapiens
ggggatgaaatcataaggagttgaagctatcctcttgcactgagttggttcctgggtgggggccagaagaccagatgagccagtttactggtctgggtggtgccagctgatccatcagaaggcagggtctgaaaaatacctcaaacacccatgttaggttttacaataataatattatctacaggagcaattggggaggttcatgatctcgaggcctttggctgcatgactcctgagccgtcatttctaatcttgtggccaatgtgttagttttacaaaggctttctggtccccaggcaaggagtgggttggtctcagggaggggctgttatcatctttgtttcaaagttaaactataaactaaatcctcccaaagttagtgctccctatgcccaggaatgaacaagggcagctgggaggttagaagcaagatggagtcaattaggtcagatttctttcactgtcataattttctcactgctataatttttgcaaaggtagtttcagaagaggacaaccttccccaatagaggaggactgttctttggtcaagggtatacgagtagctgcgctcccctgctagaacctccaaacaagctctcaaggtccatttgtaggagaatgtagggtagtcaaacttccaagactccagacacatccaaatgaggtgttgcatgcggcagtgtgcctttcttaaaaaaaaaaaaataataatctcatgaaagctgtgaacacttccaccaatctgtagagacctacacagacagacacatgtaattttgcatgtaaggagttcatagaccctgcaggctcactgatgggcctcttgatccacagggcttgttcctatcagctttcacgcctctggcaccccttttcctagcataatcctctaaagccaggcccatatcccctccagcctagtgtagcccctctcctcccctcccttcctggcacagtctttttttttttttttccccatcattcactcttttccaaagctaagctggctgctagccaaggctcacattgtgatgttaggaaaccaaatgcaggcagagaaaatgaaaccttactccatctggattccaaagcttttatctgacatggagttcccctcctgacttcagactgtgggcagcagctctggctgttccagtgctcttaaaaacatgcccaaagcagggacattccccccatcctctagaaatctgggatcccaagagaagcctga

SEQ ID NO: 2301 - DNA, 1364 bp, Homo sapiens
gccacttaagtttggcagagatgacgggcagccctttgcatagagcttttccctggacttggagttggtctttccctgaggatctaggactttgggcccctctgggctacctccaaggaatcagtcacctctgttctgctgagtctggagaccaggtggtggggtggacggggcataaggaagagtgatgcatacacagtgctagagtacagaatgcagtaagtgatccatgggggcagagagcaaggtaccgcatgatcagaagagagaactagtgctaccgccttgcttgtctagtacattaaaacttacaagtcatgttcacacttctctgctcacttagttttttaaacagtcctctgtgtgtgtttatttccctttatgcctgagaaaaccagagaggtaaagtgacgtgcccaaggtcagataccactaagtggtgatacagagtaccagacatagtaattccaagttcctaccctctctgtcttcccccaacccgtgccccgtcgtcctctggaacatgagactgccccaggtgagctgggctcctctcagtcacactaggggggcctcccttctgtctttgctgacagagctgactacctcctctcatcttcctcaccctctagagcagcaggaggggatagataggatggcctggcagtcgagaaagggaggccacttcagggaggtagcaatgcagtggaaagtgaccctcacctccagatgggggctgctcagacactgccaggtaagaacttgacagaaggacagtacctggggacaagcccaggataagtggacaacactgggagtcggggcaggagtgctttgggggtgggcatgaccctctgccacagcccttctgcctggtgggcatggcagtcttctggagcaagttgtggccggaagaccagtagcacatggaggcaccctgcctgggaccatataggaatggtgggtggggtccctgtgtcaggtctgagggtggtggttttttcttttttttttttttttttgagatggagttttactctagttgcccagtctagagtgcagtggcacaatctcagctcactgcaacctcctcttcccgggttcaagtgattctcctacctcagcctccgagtagctgggattacaggcatgtgccaccacacccagctaattttgtgtgtgtgtgtgtgtgtgtgtgtgtgtgtgtgtgtgtgtgtgtttatttttagtagagatggaggttcaccatattggtcaggctggtcttaaacttctgacttcaagtgatccacctgcctcagcctcccagagtgctggaattacaagcgtgtgccaccatgcctagctgggtctgagggttttga

SEQ ID NO: 2302 - DNA, 1151 bp, Homo sapiens
caaggccaggagcagggagagtggctgtggagcgggacggccttgctagcctggcctcttgagtgctgtgacctgaggtcctctcctggatccttcccctcctcttgtgttcagagagaaatgacaaatcaatttagatggagagagaactgtccagcccaagtgtgaagcaattgtaagttccccactgtccctctctctcaaaatgaagagcacctgggcaaaggagccgcttaggggaacttgttcttagttgtggccctgttcccaggcagctgggcagcctgccatgcagcaccgcactgcgcccacacagaacatgccctgactgcctgccacagggagcagcagcatggactgagtgagcactgctgctggcccttgcctggtccttctaggcctgcccacacccaccatgccttcagggtcaaggttgccccaggtgcagatatggagcattgtggtggcaggtgaggatacgcttctctgtaaaaatcttcaggaatgccttcctcccaagccttctctagcagccagaatgacaggaaaaggactgttccctgggctaaggggacttaagggttaagctgcttttctggcagaggtgatcaaagtatctgagctgtgtttttccaactcttatgtccatcttcgagaggctgaaagctgaaaagagccagagttgcttgtttgaggcagaaagtatgtctttgcctggaaagttaagactaggaaagaaagaagttccgatacgcatgccttagtgagtggtctttcacctctcacctgttgaacttggagtgtcctcactgacactatggccactgtgtcctttgcggtaaggaggctgatgagaaataacacgaggctttctatcacgaaggtagatatgggatcttgcctcctctcttttgttagcagtagctgaaaacctacccctcacactgattcagaagctatttggctcggtgaagtttagtgcaatagtgacaaaattttctgagaagagaaaggggtcattttagtttgatcctttaatctgattgtatttataaaagcacctgggcttgcctcccccaaggaagcagtgtttcacaattctgtatggccagagggacctggcaggcatttagttagagggaacccaagag

SEQ ID NO: 2303 - DNA, 1198 bp, Homo sapiens
tccctctcttgaatgcacatgaatgagcacacttgacatgtgcacccttatttgtttttggaactgcctctctcccttccctctcaagattccaaaggaatgaaacagttctttcttttatttttatttttatttttttggggggacagagtctcgctctgtcgcccaggctagagtgcagtggcgtgatctctgctcactgcaagctccgcctcccgggttcacgccattctcctgcctcagcctcccgagtagctgggactacaggcgcccgccaccacgcctggctaattttttgtatttttagtagagacagggtctcaccgtgttagccaggatggtctcaatctcctgacttcgtgatccgccttgtcttggcctcccaaagtgttaggattacaggcgtgagccaccatgcctggccaaacagatctttaaaattattgaaaaacattaaagtgtttgttgctgaaacagattggcttctgttctcccagaaacatggtggtggctttgaaggagctgtctattcggggtgactttcgaactacagttgaatacctgatcaaattgttagagactgaaagctttcagatgaacagaattgatactggctggctggacagactgatagcagaaaaagtacaggtgtgtatttctccacaaacagatgctgggattgggtttttatagacttgtgtactcaatccctgccactacatgaaatttatttgattctaatgtaaatggttcttgatctacctggaaaaatctaggagtcagtgtaattttagcactctgatggttcctgtgcttgtgtcacacagtcattttatgttctagcattacttcctgaggtatatttgaagtgaggcatgcagggatttaattactttctttttcttcatttaatgttaaacctggtccatagttgccaacttctgtatctaccagatgctgaagagagaggcctcatttagatcaagagttatcacttattccttaattcctggggctatgctaaattatccaagattttgtataaaatcgttagattcatataatttggaggtccaaattttggctatacaccgtttttctttgagattatcagtagccaaatcgttgtgtctttttaaatttatttctgtcagaagcctatttttgagctattcaatgattggctaagtggaagtct

SEQ ID NO: 2304 - DNA, 1159 bp, Homo sapiens
tagcttatttattcactccagaaatcctgcgtttactgtgtaccaggcacttgcctaggctcggaatattcactggcccacaacagtgcctagtatataggaggcgcccattaaatggaaatttaatgatgcaggtgggaaggggaaggcgtcgcgtgtaggcgtcgcgggtattttgcggctgcaggggttcagctgtgaaagggagtttggaagccgaagcttgttctgatttgggggacttcctgcggcccgacttcacgtatcctcaatctcaggtcaccctaaaaagggacgttccgcgcctctccacgtttgaggtagaacctgaggatagccagagtcgacctctcgccgttccaatggaggaagggcgtgcacgtcccgcgtcctctcctcccaagctctttcgcctccctcccccatcaggatccttccctttctcccccgggttccacttatttcgcccgatggcggcatctcttacggcgtctgcgccgtccaggctcgctcccattgactcggctcactactacgccggtagtcgactcggtctctgtggcgcaatcggttagcgcgttcggctgttaaccgaaaggttggtggttcgagcccacccagggacgctatgaccttttttttttttttttttgtcttttgggttttttttttctccccggaagataaaaacctaagccttttactcaaaagccaaattttgcattgaaatggcagcagcaatactttttctaggagaatcactgttcttgaaaattctttgctgctcagtcaataatgggataatttctccagcacttccctccacacccccccaacccgcctccaagctagatcgcaggaaacctaaagacacaggtttttgtctcactgtgcatgcaacacgtttcaggatgcattttttcataggattaagaatgaatttacagtggaggttcgacagttttctattgtctgcctcaatcgatattacagtctccaaatactacatttggaagggaagagaatgagagagacacagagagagaaacaagtatgaagagaaacaaaggtgagaaagggagaacattgttgtgatacagggaaagaagggacgtgacagaactaggcagggtgggtaggggaagacctcaagacaatg

SEQ ID NO: 2305 - DNA, 1114 bp, Homo sapiens
tccgaagcaggaaccagcactgtctctgtgcctgactcacagcatataggtcaggaaagaatggagacggcattcttggacttcactggggctgctggattggatgggaaaccttctggaagaggcagatgggggtcaaaccactgccttggccccaggaaggggccataggtaggtctgaacaactgccgcaagaccactacatgacttagggaacttgaaaccaactggctcatggagaaaacaaatttgacttgggaaagggattatgtaggaataatgtttggacttgatttccccacgtcataatgaagaatggaagtttggatctgctcctcgtcaggcgcagcatctctgaagcttggaaagctgtcttccagcagcctccgtggcctcgggttcctaccggcttctctgcatttggtctgctgatcatgttgccataatgtgtatggaaagtgtaacacattcttactggttaaagacgactaccaggtatctaacttgtttaacattgagtttgtgtgtgtgtgtgtatgtttgtgtgttttgtatattgtttacattttgagaggtagcattctgtttcaaatgctttttgtttttctgacagtattgttgactgggtcataacattttgagctgtggtttggtggattttcaatttttttttttaaaggtcattcgctgtgctatcttcaaaaccttgagtttggcccccaatttttggcattcaaatgtttaaaagctatttatcttggtttatacaagtttcctttctcttctttttgtcatggtattctatttggtctgcagtttgaatgtagagaaagtggactgatcccccaagcgttgtctgcccccactctttcctccttgggtcccgccattcttttactgggcagtcgagggcattggaggggaagtgactgccctcagcctcactccctggggccatgaagaaaagctaaacagtctcatggcatctcagaataatgttgggtctcccaagaagaaaggtgtaagaataacgacatggctgattaggcgaggccaggatagggctaaggccaggattcctggctggcatccagtcaccccttctcccatcctt

SEQ ID NO: 2306 - DNA, 1258 bp, Homo sapiens
agtaaatgaacaaggtgctgcctcctggcccctctaggactctaacaagcctacttgagttcacctgctggctctcccatgtttgctcatgcagtcgactttgcctcagcttgacttcccctgatggctcttatcctttcagggttctacggttgccagagaagcgagcgacaaggagaaggtatgctggtgctgagcaggaatggaagggtcgcttggagtcagaaacaactcctgtcggccatcctgtccctcgcccaccccagcccctagcccagctcccagacatgccgtctgtcaacatgaaatgccgtgtgtcatgaatcacctgtctgtccttgtgctaggcctagaccttggtctctggtcttttacctctgccctcactacgttcttcatagtcctgctgggatggcagacatttctatctcatagtccagcctgagtcagtcagtggctgcctgagccctgagctggtccaggctcaacaggaaagaatcctttagtcattcctcatctttcatgtgtttgccctccctgcccacccaaagcctgggactagaggctcctgcactgctgatttagcaggttgagggtcggtacactgacaacccctccttcccctttctgtatagttgctcccggcagaacagttgggtgtccctggggtgaattaatcaggcttacccagcctaactgctgttgctctcctaggccaaggacttgccaacattcaaagacaatgacttcctcaatgaagggcagaagctgcatgtgggagaggagagtaaaaagaacttcctggagaaactgaagcgggacgttgaggtacttactaaccttcattttcacctgcaaggctccttctgtacctagagtaggcgcctcttaaaccttaagaagaatggaattcagtactttccaggagtatggacaaaagggtggtgatttgagcagcgtgggcacttatgggcacctaaagcaagtgcaaatgatcattccacctgacggagcatagttggcgccagtaggacctttgtaatttagtttagaatgcttttcccttttcactaattcattccaacacctttttcaaactcccttctgctgttgtccctacaatggagagggcatctggccatcagagctgtaggaacccagctattaaggtcctgtaaccccaacattttgggaggctgaggtgggaggatcgcttgagctcagcagttcaataccagcctaggcaacatagcaagac

SEQ ID NO: 2307 - DNA, 1495 bp, Homo sapiens
gccctaggcagctggggcgctttgctctccttcaggccggagagagagagccaggccaccgcgagagcactgccagggccctcgaaagtggcagtggggtgctggagagttgagatggcaggatcccgacgtgaatgtagtctggataccgcgagatcgctccgcgaatagggctatcgtaatggggttgaagttagactggattaggccctggtttgcgcgacctctgcggttttatgccttgcaggagtaattgcgttttgcgaaagttagagcaagggttgagtcgtctaggtttcttaatttcgatgtcagagtgttaatagtaagaaataggctactttccgtgagaatcgggtggcacatggggacggcataagtaaaatccgagcgagctaatctatagcgtacagtctatcaaagcatgtgcggtgaattacagcttgagtatgagggggaactccgaaccatgtctagattgtgatctctttatcctgtttcccttccctttatatccacaggacgtggtgggtcctctggtgcgaaattccggatttccttgggtcttccggtaggagctgtaatcaattgtgctgacaacacaggtgaggtctttgcacgttgctatactcccccttttaaaagcactcaatgggcctgtggctaatgacctattgagccgtcaagaaaggggagagtgaaaacatcgcttttgggtgaagtggcaacatgtgttgtttgcttcaatcggtggtgtgacaaggcgttcttgcggactaactgcttgggcagtgagtggagggaggggctttggaagtgtttgggaaatgttatactgatggaacggcctgatggccctcaacattttttatttttatttacattcttttgtaggagccaaaaacctgtatatcatctccgtgaaggggatcaagggacggctgaacagacttcccgctgctggtgtgggtgacatggtgatggccacagtcaagaaaggcaaaccagagctcagaaaaaagggtgagtaaacactgagcccaccttaatactgatgagtagtggggggacgctttcctttattggaaaatggatcagttttcaaggcctcaagtttgttttccattgagaggcagtgtgagataagtatcttaagtttttgctcatattgtgttggaggggggaccatcatcttgtcacttccataccttagttgtttttttgttgttgtttttgttttgttttgttttgttttttgagatggagtctctctctgtcgcccagcccatactggagtgcaatggcacgatcttggctcactgcaacctccgcctcctgggctctcaaaaaaaaatatattacaaaacgaaaacaagctgcccgttgcttattttattatttgtttttgagatggagtctcacttgttgcccaggctggagtgcagtggcacatatctgttcactgcaacctccacctcccgggctcaagagattg

SEQ ID NO: 2308 - DNA, 1495 bp, Homo sapiens; identical to SEQ ID NO: 2307

SEQ ID NO: 2309 - DNA, 1304 bp, Homo sapiens
tttctcaagccagtcagtggacatttgggggagagtctaggcacggatatagaggacccaatattcctttttttttgagacagagtctcgctctgttgcccaggctggagtgcagtggcgcgatctcggctcactgcaagctccgcctccagggttcacgccattctcctgcctcagcctcccgagtagctgggactacaggcgcccgccaccacacccggctaatttttgtatttttagtagagacggggtttcactgtgttagccaggaggtctcgatgtcctgaccttgtgatccacccgcctcggcctcccaaagtgctgggattacaggcgtgagccaccgctctcggcccaagattccttaatctagttggttttccgaaagcgtggctatgaaggaagaactcaggagttctagccattcccattgtattttgtgtttttttcagtaggtatcccgacgcaaccctcagattaaaactttaagggaaaatgaagaccacacccctattccatagaaattaactctaatgacaacgtagtggcgtggcgggggtatagctcagtggtagagcatttgactgcagatcaagaggtccccggttcaaatccgggtgccccctctgtgctccggagttacctcgttttgttggtctccggaggtcctctaaagagttcccgcacagatggaatgggagggagtctcgagccctgccaccctttttgctttcgcaggcgagtgaggatggagtcctggcccctgccagtggctcagcctgtgtgtgtacccagggtagaatgcaatgcgagtgagggcgaggagctccgggctgacccttggaacacggtacgggtggctcaacctcgcaatggcagggcggaggcgagcgcacccccaggtcagcctggctctttcttggcgggaaggaggctgagtttctaagggctgggctggggaagacaggtcgggagaagccgcgtgagcatgtgggagggagaaagaagctccgagacgtggcaaggggtcttctgcagggcaggagagtgggacgcccccgaagtgaaatatttcgagagacttctccttccacaccccaggaatatattttcttatactgccagtggggatcttcagctcagagcttcagggaacaacccctgcttccaagtgagtaattcttctgggagttgtattttttccatctcttgtaaacgtcttaccccacttccacttcccttcgggaacgccacacagcgcctgcgcagcaataccactaaacgactacgtgcggtcggtttgc

SEQ ID NO: 2310 - DNA, 1223 bp, Homo sapiens
cttcactccgtgtaccctgcaggtatcacagcctgtacctgaaggtgaaggggaatgtgttcaaaaacaagcggattctcatggaacacatccacaagctgaaggcagacaaggcccgcaagaagctcctggcgtaagtttcttttcagagtcttaggggaacattcttagacctttgagagttgttcttagatacttaaaatgtgccaatgcctaagtcttgacttgcacgtagtctgtcttaggaatacagctgttcccttagaggcacccactcctctgtcctgtacacacccactcttcctgtctcgtagggactagaggttagttgaagcaggagcctttggtgggcccagcaactcattccagaagctgactaggctcaaagggagaggtctggggatgtgcttctgtctccctagcatctcatctcttcccaaactgacccgtcttttctcttccctgaccagtgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatctgccttcctctctgcttcttgcaaggtttacggttactgagtgaggttttttttttttttttgagacgagtcttgccctgtcgcccaggcttgagtccgatggcgcagccttggctcaccgcaaactccacctccaggttcaagcagttctcctgcctcagcctcctgagtagctgggattacaggtgcgtgccaccacgcccggctgatttttgtatttttagtagagactgggtttcactgttggccaggttgatctcgaactcctgaccacaagtgatccacctgcctcggcctcccaaaatgctgggattgcaggcgtgagccactacacttggcctgctcactgagtcttttaccttgttttagtgggatgtagggagaaaaggaatggcttttatgcaagcctccaaaatactgtgcctcagaactgcccttcgaagcacgagtgacacctaagaagtggtctcagaatgttggttgggaccagtagttgtgacatcagttaaggaatcagtctttacaaaagccataggaaatacttagggtgttt

SEQ ID NO: 2311 - DNA, 1164 bp, Homo sapiens
tcaggggtagatgaaagagaaaagaaatggatcttcctgtttttccccctgcctcaccccctagattccacaggttttggtgaagttgaagaagtactctcatggagacaaggtgagttggggattgagatggaggcatgggagcagaaataagggcaaaggggagggtccttcaggccccagctgggcagtgttctcatgcctggaagagagccggatgtgagtgtacacctcagcgtgcacgtgcttcacaatgtgcatgcttcagcatgtgcgtgtgcttcagcatgtgcgtgtgcttcagtgtgtgcgtgcttcagtgtgtgtgtttcagcgtgtgtgtgcttcagcgtgtacgtgtgcttcagccagtgtgtgtgcttcagcgtctgcgtgcacccacaacatacacccaggctccaggcagaaagcagccaggcaactcaggccgatgcctccagcagacaaggttgcctgagatgatcagggcctggtggccctggaaaccagatggacacttctgcctctttctaggacttcactgaggatgtcaactgtgcttttgagttcctgctgaagctcacccccttgttggacaaagctgaccagcgctgcaagtatgagctcccctggtcacccccgccctactggaaggcgttctgggctcttcccctgatctctgtgccagagaagcctcaggggactctgtctccttgttcactccccttggcaggggcaggaaataggagcccacagttgccaagtccccagagcccctctaccgtccctcaggcactccagattttcctcatcctgaaagagggaggatgctgctcagggacctgccactcccacccctcaccatcctatccaggtgcccagttccctcagcatctttctccctcacagctgtgactgtacaaacttcctgctccaagaatgtggcaagcaggggcttctgtctgaggccagcgtcaacaaccttatggctaagcggtaagtgtgaacgcacctgtgctaccccaagagccccttgacctctctcttgttacggtggggctgctgcgtgcctttcaacctcctgtcgaaagtttgggctgcaagtgactgggaccgtgcctgggggtacagggaacaggaaggaaaagaaagcacagatgtctt

SEQ ID NO: 2312 - DNA, 1152 bp, Homo sapiens
aaaagaaaaaagacccaatcagtgtctcttgactttgttctttgatccctcagtttcttcttgatttcagcatgtgtcgggttcctaattttgggtatgagttagcaaatttaaccattgtgtttgtgccctacccaggggactccccagtttctgacttgaagtagactgagaagaatccacgaggtgctatctggccagatttaagtagattctatttccttggttctccctctccctgaggacctcttattttattgtcccctcttctaggttaattctcctttgatttgactttgttgagaaggaggttggacagtagattagcaaagttccaagtgcaaaattacagtgtgttagagtgtggggggaaaattagtcttatttttccctacatgggatacaacactgtgaattcaatcttcaactgaaggccctgcagttctcctaaaacatagttgtttgtttttctttaacaaagtttaagctagtgttaataaattaaaaaaaattgcttgtctgtctacttcagctttgttttatgcccatttcatattgttgtctgtgttgtaattcataacttttgataccatttctgatgtgtaaaattggttgtcttgtaaatatcttataaagagttcaattgtaaataaactattgtggctgttaatttttgaacttctgcttcaatttattatatttattggcaaacaaacaattctgcttgtatatttgaaacattggaaaaagaaatccattttctcaataaaaaagaataacacattattttcccctttataataaggtactcacttccatttgtgtataagtataatgtatgtttcatccctctttgtccagtgtacttccttaagtataatcagcaacttggctgggcgcagtggctcacacctgtgatcccagcactttggtggctgaggtgggcagatcacttgtggtcagaggttcaagaccagcctggccaacacagtaaaacatggtaaaaccccatctactaaaaatacaaaaattatccagatgtggtggcatgcacctgttatcccagttacttgggaggctgaggcaggaaaatctcttgaacctgggaagtggaagttgtggtaagccaagatcaagctgctgcacttcagc

SEQ ID NO: 2313 - DNA, 1507 bp, Homo sapiens
tgcttcttattacttggtagaaaatagaaaactccttgaatatagtgtcttgatacatttttttacattacaattatgttgtcagatttacaatgtgcaagttacctgggcttttctcttttagaaatccaagggggagagtgatgacttccatatggactttgactcagctgtggctcctcgggcaaaatctgtacgggcaaagaaacctataaagtacctggaagagtcagatgaagatgatctgttttaaaatgtgaggcgattattttaagtaattatcttaccaagcccaagactggttttaaagttacctgaagctcttaacttcctcccctctgaatttagtttggggaaggtgtttttagtacaagacatcaaagtgaagtaaagcccaagtgttctttagctttttataatactgtctaaatagtgaccatctcatgggcattgttttcttctctgctttgtctgtgttttgagtctgctttcttttgtctttaaaacctgatttttaagttcttctgaactgtagaaatagctatctgatcacttcagcgtaaagcagtgtgtttattaaccatccactaagctaaaactagagcagtttgatttaaaagtgtcactcttcctccttttctactttcagtagatatgagatagagcataattatctgttttatcttagttttatacataatttaccatcagatagaactttatggttctagtacagatactctactacactcagcctcttatgtgccaagtttttctttaagcaatgagaaattgctcatgttcttcatcttctcaaatcatcagaggccgaagaaaaacactttggctgtgtctataacttgacacagtcaatagaatgaagaaaattagagtagttatgtgattatttcagctcttgacctgtcccctctggctgcctctgagtctgaatctcccaaagagagaaaccaatttctaagaggactggattgcagaagactcggggacaacatttgatccaagatcttaaatgttatattgataaccatgctcagcaatgagctattagattcattttgggaaatctccataatttcaatttgtaaactttgttaagacctgtctacattgttatatgtgtgtgacttgagtaatgttatcaacgtttttgtaaatatttactatgtttttctattagctaaattccaacaattttgtactttaataaaatgttctaaacattgcaacccatagaatgcctcttttaaaacacacactacacccttttccttattctaaaatatagtcttcacttccctttcagaagcattccaatcatattgtgacagaccttacagcctctggctaaggtgataagtccaagagataggcattaagacctaattaaggccaaagactctttattgagattttatacatgaggactaagttcttcatctccaccacacttgatcagtaaatatgcatgtatcttttttttttaatg

SEQ ID NO: 2314 - DNA, 1124 bp, Homo sapiens
gatacaaaaaataaaaactgttcttgctgataaaaaattcagaaattagaacaaagttttaagagtatgttttaaatattccagaaaagtcacatatttggtgtttaaataggaattcataccagggacaaagcagaaaatggattttcatgtgttgcttaaatgtactattttcctttccatttgaaataatagaccttgaagctgatgatgttaagggcagtgtaccactgtcttcaagccctcctgctacacatttcccagatgaaactgaaattacaaacccagttcctaaaaagaatgtgacagtgaagaagacagcagcaaaaagtaagcctaaatctttgagatgggttaatgttgcaattacctaactggtttccacgtgtctatttcaatttttttattgccaaaacttactattgatattacagattaaatgttttccaattggaagcaatttcttttcgatctttataatcaaaattagtagtcaaggctgttccaaaacagtaagttatctctattgattgttcagttacagatcaaactccttgttctactcttttccctccttctcactactgcacttgactagtcaaaaaacaaaacaaaagccaggcagagtggctcatgcctgtaatcccagcactttgggaggctaaaacaagaggattgcttgaggccaggagttcaaggctgcagtgagctatatgatcaagccactgcactccagcctgagtgagagagcaagaccctgtctccaaaaataaggtagtccaaatgtttaaaatcagtgagtttctctcagtaccaggcttcatctagttcatttctgtgacaaggataggatttataagcaattgcaatgtttaacgtaaaacgtattcttgaaattgaattaagtttaaggctgggtgcagtggctcatgcctgtaatcccagcactttgggaggccaaggtgggtggatcacctgaggtcaggagttcgagactagcctggccaacatagtgaaacctcatctctactaaaaacacaaaattagccaggtgtggtggcacatgcctgtagtcagctactcgggaggctgaaacaggagaatcacttgaacccaggaggcag

SEQ ID NO: 2315 - DNA, 1144 bp, Homo sapiens
atctcagagcttcccgtcagaacatggacccaggtaaataattatggatttcttttttaggtttgtgatcaaaagaaataccttttgtactattgctgttgactattcagaagcctatattttagaaacttcaggattatttctttctttagacatacaaagaacaagttctagaacccatgttgaatggcaccgagaagacacctcctctcataacagactatagggaataccatacagataccactgtgaaatttgttgtgaagatgactgaagaaaaactggcagaggcagagagagttggactacacaaagtcttcaaactccaaactagtctcacatgcaactctatggtatgtatttgttttgtgagatgtacacgtttcaatttatattaaagattaatatcaattttaaaagtatatcttagtctacctttataaagtttagccaatttgtctattcttggctctaatcttgttttcctttttcaggtgctttttgaccacgtaggctgtttaaagaaatatgacacggtgttggatattctaagagacttttttgaactcagacttaaatattatggattaagaaaagaatggctcctaggaatgcttggtgctgaatctgctaaactgaataatcaggctcgctttatcttagagaaaatagatggcaaaataatcattggtatgttttgggaataataactgcttactaaaactctagttacgccaaactttctttaaacatttttggtgagagtaatggtggagaaagaggcaaaatccatttaattcacctggtcacttatacacgcatttctttaaaatatctgattaggtatttatagtttgaaagagatgatgtttccttgactgagcatcttgagaaatcaagatttagttgacaattagacatgaggagaatagagagctagaagaccttgcataaactgattgaccaagagaatagatacactaatcatgtctacaggaacagaaaataaaagagacagagaagagataataaatctgatggtaaaaaaaaaaaaaggcaggaagattacgaatggcttctactctctgggtgtggtggcgcatgcctgtaatctcagcacttgagctggggaggtcaaggctgc

SEQ ID NO: 2316 - DNA, 1258 bp, Homo sapiens
tgagggggctcatgatagaaattcatcattgggtggtgttgatgttcacacccagccccagaggaagctgctaattaatttgtaatttggtttccaataaaagaggccaaacttatcatttggctaaagcaggagtctgggttcctgtcattgatcaccatgagagagcttcaggacacatcttcaaagggtcagccgcatgcctgggccctcattactagggcaggccctccaggagactgccacaacccagcctgtgcctccactggctttgcccactgcacccccgcctgctctagccctgagaagcctgcaggtctgtgcagcagtggctgcctcttttaatgaaagcattccccatgggaagaggcctggctatttaacaaggaaatgtgtgggtggtagaaactgctccgatgctggcagcggcataaatccagcagaaaggaacaggaacctcagaggcttcctaacagacatcatcttcctgccaaggggaagaaaataatatcagtggggagagaatgaactcaagacataggcagcatcacttctcagccttttggctaagatcaagtgtggtatctgttcttatcgtcttaatatctgatacgtcctccatctgaggacaacatattaaatggattttgggagcagggagatggaataagagcttgctctgttcactctacatgttgacctggtattgcagtacctccaggaatgctgcaccccttcaaaaggcaaaaaaaaaaaaaaaaaaaagacccaaacagaagcctaagaatcaggtacatctttccagttggtctcttcctcttggaaaagtccatatcatgaacatctccaggtggcagctgctctgtcttgaccccctctggaccatccattcaattatcactgcaccatatacacaattgtcaagtgctcaataattgtttgttgaacagactgagaatagttggaacaggttctacttttactttctgttgtggcagatggggaaggctcacttcaggatctcagactatggaagcagtgtgaatccactcccttgggaaaggatgttctatagccctggaatgagctaagccaggagacagggagcatatttgcccaactatagaagccctgggcattcacttaagaaggcaacatgctagagcagtggttttcagtcctggctgcaaaagctgtgagcttcacatttagtatgtgtgtgctatatagccacttttttattcagtaatcttcttga

SEQ ID NO: 2317 - DNA, 1163 bp, Homo sapiens
agacccagacccacagaccaggaggaagcgctagagatgtcaacagccaacaaaaacagtgctttacacacttgtaaaattgtgacctacaggggctgggcactgtggctcacgcctgtaaccccagcactttgggtggccaaggtgggaggattgcttgagccccaggagttcgagatcagcctggcaaacatggtaaaatcctgtctctactaaaaatacaaaaattagctgggcgtggtggtgcatgcctgtaatcccagctacctgggaggctgaggcaggagaattgctggaacccaagaggcggaggctgcagtgagccgagattgcgccattgcacttcagtctcggccacagagcgagagtccgtctcaaaaaaaaaaaaaaaaaaaaaaaaaaaggaattagcttggcatggtggcgtgtgccttgcagcgagctgtacgtgatcagtgccactgcactccagcctggggcaacacagcgagaccctgtatcaaaaaaaaaaaaaaattgcgacaataagtacattttactacgcacccttacgcattctttttctcacctctgtgtgtgtgtgtgcgtgcacatgcacacacacaaatgggtgacacaattctcaccatactaagagaaatcccctctgatattttgtagcctattctgttgcattaaaaaactacacaatcggccgggcgcggtggctcatgcctgtaatcccagcactttgggaggcggaggcgggcggatcacgaggtcaggagatccagaccatcctggctaacacggtgaaaccccgtctctactaaaaatacaaaaaaaaattagctgggcgtggtggagggcgcctgtagtcccagctactcaggaggctgaggcaggagaatggcgtgaacccgggaggcggggcttgcagtgagccgagatcgcgacgctgcactccagcctgggtgacagagcgagactctgtctcaaaaaaaccccaaaaaacaaaaccaaaaaacccccccaaaacacaaaactatacaatcaccacctggtgccttgactaatgagtgatgacctgctctttgaaaaacagaacacaattaccttattcaatgataagctggctgttgtgaatgcgcctcttaggtcagtaagacctcaggttggggtga

SEQ ID NO: 2318 - DNA, 1137 bp, Homo sapiens
gcctccttccaacaaccattccccaggcctcccctagcaatatgctgtttatcaagtgctcaccctgtgctggccctctgcgtggcatttgtggacagtagctcattcaacctggggttagagtgtgggaccctgtgggttagatgaagacactgaggctcggggagctaatggccatggtcacaggtagtaaatggcagaactgggatttgaacccaggactgtccgtccccaaagctggggtttttctgttccaccacaaggcccacgtgtctccctgggagaagtgagatagacgtctgaggtagtgattttactggaaatggatttggctcagggccccagggtggtggggcagcagtgaaggcccagaaaggtgacaagcgagtagacatggctcagctgggccactgaatcatgcggccccctcaacaattgcctcctggtctcgaggcctcccttggccaccgtactttggcctgaggagggttctgcctgggtctgagggccccagggaaaggctgatgagttggagggaagagatgtggggcttagagccaagcctgggttcagatccagccactagctgtgtgtctgtgggcaagttccccaacctctctgagcctcattgcctcacttgcaccacaggatagtaacgccctctcacagggtgtggcgggtcatagggatgaaagttcccgggcacacacaggcagggctgacccctttaggtcatcccactccccttggacatattcgagaaggctccctggagttggctgctccctgactcccccgtcccttccttgccctccaggagggcctggagagtgtgctgaagattctggtgaatcagctgagtgtggatgacgtcaacgtcctcacctgtgccacgggcacactctccaacctgacatgcaacaacagcaagaacaagacgctggtgacacagaacagcggtgtggaggctctcatccatgccatcctgcgtgctggtgacaaggacgacatcacggagcctgccgtctgcgctctgcgccacctcactagccgccaccctgaggccgagatggcccagaactctgtgcgtctcaactatggcatcccagccatcgtgaagctgctcaaccagcccaa

SEQ ID NO: 2319 - DNA, 1154 bp, Homo sapiens
gcagtggagaagggcagccaagtttggggagggagggtggttatggaaaaacagaaccagcatacccccaggacccagctgtgctgggagcctcagtgtcctcacctgtcaagtgggcaagccatgctgatccgcagggtaagttactgggagtttgcaagacggtgagtggaaaagggctttcttactggaaagctgccttcccctgccccctgccccagtgaaagtttgttagaattgactctggacaaacatcccgtcccatcctcctttggatcctcagggtcgggaaggggtatcaggtctggggacctccatggagagacctcaagtagcctctcctagtgctctgagctgaccacactcccccattctggcctcaggagacaagatccctggctctgccgtgctaatcttcaacgtccatgtcattgacttccacaaccctgcggatgtggtggaaatcaggacactgtcccggccatctgagacctgcaatgagaccaccaagcttggggactttgttcgataccattacaactgttctttgctggacggcacccagctgttcacctcgtgggtccgggggggggccgggactgggcaggtgggtgggcacaggcatggggagtcctcctcagtgcacccccgacgcctgctcctccctcttggtcctcgagcgccaggggagcattcaacctcttgctgctttctgtaagtccccatctcggagcatgtcgaggagatgaaattctctgcttcgcaggggaagggaaggtgaagccaacagttgggggagaactgctctttctatttcacagaggggaaactgacgcagggagccatgagccctcgaggccacactttagggggcagaggcaagatgagaagggaaccccacgtctgcacagctgggcccctgcactctgctgcgtggcccaagtcaccagtgggagtaactccggaactgagggcttgttctgggcccacctcagagggagaggggtgtgcgctggcaggggacagggtggctgctgacctgggcatctgctctcccccaggcatgactacggggccccccaggaggcgactctcggggccaacaaggtgatcgaaggcctggacacgggcctgcagggcatgtgtgtgggaga

SEQ ID NO: 2320 - DNA, 1240 bp, Homo sapiens
ggcaccgaagaccaacatccacaggctaacaccccttcagtccacacaaagaagcttcatattttttttataagcatagaaataaaaaccaagccaatatttgtgactttgctctgctacctgctgtatttattatatggaagcatctaagtactgtcaggatggggtcttcctcattgtagggcgttaggatgttgctttctttttccattagttaaacatttttttctcctttggaggaagggaatgaaacatttatggcctcaagatactatacatttaaagcaccccaatgtctctctttttttttttttacttccctttcttcttccttatataacatgaagaacattgtattaatctgatttttaaagatctttttgtatgttacgtgttaagggcttgtttggtatcccactgaaatgttctgtgttgcagaccagagtctgtttatgtcagggggatggggccattgcatccttagccattgtcacaaaatatgtggagtagtaacttaatatgtaaagttgtaacatacatacatttaaaatggaaatgcagaaagctgtgaaatgtcttgtgtcttatgttctctgtatttatgcagctgatttgtctgtctgtaactgaagtgtgggtccaaggactcctaactactttgcatctgtaatccacaaagattctgggcagctgccacctcagtctcttctctgtattatcatagtctggtttaaataaactatatagtaacaatgaaggcatactgctggctcctggcatccatatcctttgatctgtattcctttgtaactgtacttttttccagacagggtatcactctgtcgccccagggctggagtacagtggcaccatcacagctcactgcagcctccatctcctgggctcaagcagtcctcccactccagcctcccaagtagctgggactacaggagcatgccaccactccaggctaacttttgtattttttgtggagataaggttctgctgtatttcccaggctcttctggaactcatggactcaagcaatccatcctccttggcctcccaaagtgctgttacaggcgtgagccactgtgcctggcctggcctgaactgtactaatagtttcagtatatatggttttaaaaatgctcatctacggtcaggcgtggtggctcatgcctgtaatcccagcactttgggaggctgaggcgggtggatcacgaggtcagcagatcga

SEQ ID NO: 2321 - DNA, 1225 bp, Homo sapiens
ttgtggtttctgcccccacaggttggaggcatcaagcctgggtgctttaagattggcaacacaggtgggatgctggacaacatcctggcctccaaactgtaccgcccaggcagcgtggcctatgtctcacgttccggaggcatgtccaacgagctcaacaatatcatctctcggaccacggatggcgtctatgagggcgtggccattggtggggacaggtaatcagctgggaagccaaggaggggcttcctgctttgagagcagtgggctaggagacgatgctgtgtcctgcaggctgcttgctgcccctgagttccaggcccgcaggaatgctgctgaagtctaaacaatggggcatcactgctcttgtctcaggactgacagagcatgaaatcggaaaacacagaacagggcaacaatgtgcaggaggggcgactgggctttggggataattctgtttgttgtgattggccatagggaggcagcagagtacagtggttaggagggccagttctgaaattggactaaagaggttcaaatcccattttccctctttagtagggggtgggtggcaggggccatcctggtccggttacttaacctccctagacctccatcatttttacacatcaaatgggtaaataatacccccacctcatggggctactggaggaataaatgaattgtaatacatataagtgtctgagccagggcctgcgttcagcaggtgctcagtgagtttttattgtagttaataatagtatcctcattatttttggtagtgggaacactgatcagtaggtcatgaatacagtattatatctcagagtaacgtctggcacttagtaggttcataataaatgttagccattattgtttattattcctactattactactgctgtcgggcttagaaaccaaaagctgttgagatagagtcaccttgttcgtctccctggctctaccacatgatttccgataggatgcctgggtgaggaagaactctcaccaaggtctttaggggtgtagcctgggaatccccagtccttgggtactgcctgaccaaaggctcagggaataagtctaggaaatgctgcttgtttagattgtcttcttagatttataatgatcatatcaaaagacatgaagaggccaagaacagtggcttatgcctataatcccagcactttggggggctgagggaggaggattgtttcagcccaga

SEQ ID NO: 2322 - DNA, 1099 bp, Homo sapiens
aactttgacattcacagccgtggaggcggggaagtctttgttgtccccttgctaaggggaggggaaggagtaattggcagggtcgataaccagctggaaaggcctggaatgcagcactgtggccacctggctttaatcctgatgtttttgcctctggaaaaagttaagagcagagtgagcccagtgtggaaagaacagggaccagccctggttctccaggagctctctgtgctctgaaggggaggagggttatgaggaggggggttatccttgttactttctggagtgagagaaataaaaggagggtgtgtcagggagaacagattatggctgagcgagccctcccctcagcgaggccagaggaggcctggtgtagggggcatagcccctggcacagaggttctctctggagcctctctgctgctggtgggctgaggatacacccttcagctttggtttctctgtgcttgaggaagggccactttacctccacccttcctgctggagatgctggtaggttggtagattccaggctttgtcttgatttctgtagctggcagggtagatagatcagaggcatgtgcacgtgcgtcacctggcgggggtgacatgatgcaggcttcccctgaggatggcgggtcatgaactcacacttatattctccctcctcactttcacagttgagctgcattttaagtgattgtgtaatcctggctctgatgctggatgacctcggacctcaatcatttggcatctctgggcttcagtttcctaggactgggaagtgggagaactggattaggtggctccccttgttctgtgatctcatgtctcagcagaacccggggggtctaggtgacagtaaatcccaggtatttgcaacatcaggaaccttctgtcatgagaagctgtaaggctgtgatggaagaggcaggcctgtacagggatttaatgagaccatgaacttggttagccaagcctgctctagtacagtaggttaattaatacgagatgccactgggctagatgcatcattcttcctaggggagctcagaacctccctgagggctgctttcctcctcttggacttgcagggacc

SEQ ID NO: 2323 - DNA, 1244 bp, Homo sapiens
gattggagggagggatgctgagcatgtccccagggagcacatcctgcttccttctgctggcctctgggaggggaaggtgggacatcagacatctgagctggcagcagcgttgggccagcaggagtggctcattacctcttatggattgctgtctggtccctgactcagcagtgacgcacaggccaggcgggggttttgggacttactaggatgagggctgtctcgccacagccgccgccagggaatcactcgaactgattagctctgcaggcctgtggtcctcagccaggagagtctgcgtggagaagtttccctgattaagccctggctccccacttctccacccattccctgcgcccggacccatgtcctgaggctgagtcactgtgccttcctcaaggctcatgaagcagaatggttacctcccttctacccggtttcccctccccgtcaagctctgccacagccgtgacttgttggagccctttcacttgcgcaggtcctgtgtcaccctccagaggaggccaagagtgggcaaggtcggtgcctgttcaggcacagcccgcaccagagcaaggggtgaaagggcatctcctgaggacttactgagcttagggatctgtgaccccattttttctggaaaaatctctctttgctgggtgtggtggtgggagtgcttgggcaccacccctgtgcagtccctccttctgccctaggggcaagacgtgctgtccctctgagtttcatctccctcaatttttctgtaggttggcaaggccacaggcttcctcaagaactttctgatcgagcccttcgtcccccacagtcaggtatgtgtgaggcggctccaggctgggtcttctccctcctggaaccttgggtttgtccaccgtaacctgaggaaagaagtcaagctgatgaggacagtcagagggaccagggtccctgaagctgcactgaggatctgagggtgctgcggactcgggagtccagaggggaaggaaagggcttggtctacagcagagaggagttaggactggtaacaaaggggacttccaagtgcagggatgagaacgacctgcaggcaggccccacccctcagctggggttggtcatactgattcagtctggaccaccagccagtggggtagaggcttcttcctcttgtcctcggggaaaagatggtggacaagtctctggatgaatggttttcactgggttttagaaaatgagaccgtggggat

SEQ ID NO: 2324 - DNA, 1183 bp, Homo sapiens
tctctacaaaatacaaaaatttgctgggtgtggtggtgcgtgcctgtaatcccagctactagggaggctgaggcaggagaatcgcttgaacccaggaggtggaggttgcagtgagctgagatcctgccgttgcactccagcctgggggacgaccaaagaactccatctcaaaaattaaattaaaaaaaattgagaaaagtagcttctctctgagaagtagccttttgcccaatgggttgataactgttactgtatgaactccttcaggcttaatgatctcatgaaggccaggcgtggtgactcatgcctgtaatcccagcattttgggaggccgaggcgggcggatcacctgaggtcaggagttcttctcccctaatttgcttaccccaactcaacatgcacatttcatttcagcctggcctgttaacatggtgaaaccctgtctctaaagatacaaaaattagccaggtgtggtgggcgcttgtaatcccagctactcgggaggctgaggcaggagaattgcttgaacctgggaggcagaggttgtagtgagccaagatcacgtcgctgcactccagcctgggcaacaagcgcgaatctccgtctcaaaaaaaaaaacaaactcatgaatgataacttttttctttttcttttctttttttttaactctttaaattttttaaaatagagacagggtcttaccatgttgccccggctggtctcaaactcctgggctcaagcgatcctcctaccttggcctcccaaagtgctagaattacagggatgtgccaccatccccagctgtgataacttcttctaactggggtgggtagtttttcttttgataaattaaaggcaattccagaaatactgaatgttatggcaaaacccacctaaatacatttcagtcattgtcaattcatttactaccttagaaaatggcctttgtacataaaagaagtcttagttatctccatgcttaatttgccagcatactttaatcccgtgtcagcattcttctcacctaatttgcttaccccagctcaacatgcacatttcattttaatgtctcattatacaaaacagttcattaagattaataagctgcctctctcctcaaaagataatcactacacttcaaagccgtaccttgttttgttttaaaactgattgtatccttgct

SEQ ID NO: 2325 - DNA, 1139 bp, Homo sapiens
caattttaagtcttaagtcacttttttaatatatatgatcttctgctcttcccacttcctcccctttctactgctctcccattttcccttgctgggagtagccacatgctcttgccccccaacccttgtatatggggacagtggggtcagtgcagctaccctttctttccctcctgcggaacagcggacccagcaagagcatccacatcctcactttgttcggagtggtctttggtttgggcggtggggcagaccttgggaaggggcttaggaagggagaggcagctcttccttcagctggctctcatcaggctgcagccccctccccgctcccacctccctgctgggaaaccacagcattatcacagcattattgtgacagccacgaacccattgcccacaacccctccaccctcggtcaccccaacctctggctctgagccctgttctgaccaaatcatgatgatgagtatttgggggtgggtgggtaagggggggagtgggaggggacggaaccaactttttctgtattttgtattgtatgttttcttcaacatgtaaccaatcagtatcttgtcaatatagtcagccgatcgatcgacctcacaattgtcttccttgtctttctctggcagtttatcagacagtgccctctgtagttgaagttgatttaaaatgaaccactgaatcttgttaaacaaaatcttcccctctaatgtgaggggatgctggtggtcatggtaaccaagagaaagaggctcttactgttagcagctccgatgaggtagctgacctgggctgaccaagtttgaagtttcagggcccgtgttcacttctccacctcccttcccctcccccacctaccagatcatactggggtgacatgcagtgtgtatttgatgatcattagtctctgaaacaccagaaacaacctctttgggttttttttggttggtctttaccagtgagagggtctggatcctctctcttcctgaagaggaaggaatcccaacagcccctggaacgctggactggtcttaaggccaagactgtagccactggctttcctcaccacctctgtccacgtcacccccccacaccacatccaagttgccccagtccagctctctactggttct

SEQ ID NO: 2326 - DNA, 1190 bp, Homo sapiens
gtgggcaaaggggcagtccagctgcttccaggggctgtgtgtgtatttgaggaagcccagggactgccccttcgaaggcaccacaattaccttcaaaatcatttctatggtggtttggccagctcagcccttgtggtcaggtctgtgtcatctgtgggcaactatgactacatttgggactttgtgttgtacccaaatggggcacttgaagggcgggtccatgccacgggttatatcaacacagctttcctgaaagggggagaggagggcctcctctttgggaaccgtgtgggggaaagagtgctgggaacggtgcacacacatgccttccacttcaagctggacctggatgtggcaggtgagtgctgaggggatgaggatggagacttgggggcggggtcaggtggggtggagggaagggaagggaatctcccaggtcaagctgaaataacaagtggcaagagcagggtgttccaacaccacagctctagtggcaacagggcagggactgtttgagcatattcagtgcagtgagtctggtactgggctactgggtatctggtaaaaggtgaaaagagttcccccgcccagcccctctgacttgctatgattgtgaaactagtttaaatgtaatggctgggcatgattgccttagcctcaagtgacactgggtgggtgaactggcccaatggggctggagttggagcactttgcttcttcctaattctgagggtcagtaggggtggggagggcagggtcctgagccgaggtcggaagaagtctgtccagagtcttcagggtgggggtcgacctggggcttaggaaggagagggtagcaaagctggggttgctccccaggatagggccactcctcatcgggagggccatcccattcctgtcatcacagttgactcatggcaggcacacagcttgctgcaagtatggaaagagatttctcaagcacaaagggctcaaagcacacagaggacttgctgttcctgacagactttgtcaaggacagaaaggaacttacagactcacacactgatccacaaagaaaattagaaactcaccagaccctctccattttaagggaaactaaggagggtggcgggagatgggacaggaaatgactgcccaagtataatgcaacataaactagtatttcttgtgaaatgttttcttatcct

SEQ ID NO: 2327 - DNA, 1086 bp, Homo sapiens
cccttcagcctgggctgaccagtgcccgcctctgggcttgaccagttcccaatctcgtcctctgtccccaacttcttaagcacaattgggcttcttccatctccaggttttctgccattcttaaccaaggctgcctcttccaacagggcgggaatcagacctactcccctaggtcacaactctgggaaggatacagagcccccacccttcactgagttctctggatttgttctcagtgccttagcaacgaaaacctgtgcttgtgtgtgtgtggcggcggggagggaggatcctgtttcccacctccttctcctcccctgtactccccagtgccttccttgttctggtggagctggggtttctctcctccccagtcccacaacactgccaaaaatctgtgtatgtgccattgggtggggcagccccaagcctcctggggaggcagggcaaaaacaggtgccctcatcgtggtctgtgccatgtcccgtctctatggtggttgaggagaaaggcggggaagcttcctcagccttgcagatatgtgtggcatttactagccagagctctgaaaggcagtgctgtctgtttcttgtactgggaccaaagtaaaaatccaagcacattccccttgcagttaggggaggccctactgccttctcaaagcagagaggcagcttatcaaactcagcccaaaactctgtttacatgggtggggagatggagcagggaagtacagagtgggatggtcaggacctgggccattgcaaccaaaatggggacttcctgggtagggaggtcactccctctactcactgagctaggattagggagggttattgccccaaccattgcaatgggaggtggagggacaggctcagcctcctcattgtctaaatgaggcctaaatgtgtgaagtgcgatttctgcttttgtgtaccccaccaccccattaccacagctgcctttgtgtgtttgtgtcaataaaaagccaaaccctgggtcctgcttgttgcctctgagagtggagggaaggtgagctcctggaaggctagtgctgccagcagaagatctgggctgcttcctgcc

SEQ ID NO: 2328 - DNA, 1204 bp, Homo sapiens
cagcctcccaagtagctgggactacaggcacgtgccaccacgcccggctaatttttgtatttttaatagagacggggtttctccgtgttatccagaatggtctcgatctcctgacctcgtgatccacctgcctcggcctcctaaagtgctgggattacaggcgtgagtcaccgcgcccggcacgcccggctaatttttttgtatttttagtagagatggggtttcaccgtgttccccaggctggtctcgagctcctgagtcgagacgggatttctccgtgtttgccagaatggtcttgatctcctgaccttgtgatccacccgcctcggcctcccaaagtgttaggattactggcgtgagccactgcgcccggcagatttttcttttaaaacgtggagaataagaaatcagcccgagtgtgtaatggcgtcaatattggtgtggacaagacaaagtgaatgaggcaaggagcgaggctggggctctcaccgcgtcttgaatgtagatgagagtgggacggtgatggcagggaggaaggcgacgacatctcttctcgtccttttggctaagatcaagtgtagtatctgttcttatcagtttaatatctgatacgtcctctatcagagaacaattatattagatagatttttggagcagggagatgaaataggagcttgctctgtccactccacgcgtcgacctggtattgcagtacctccaggaatggggctccctctcctgggatacaacctgtttgcaaggttagaaagaaaagactgcgccgggtagtttaggatagttggtaggttttcttactcctttaagtatcataaggttcatgatttatggagagtatcctaggacccaaaacaagaatattcatttccaagtagggaacatgttcgactttacttggagggctttaaatctcagcttggctgtggaggggtgatgacctttcaaagggatggattccagtggtgtgttgcccaggctggacttcaacttactctgtttgtttgtttgttttttgtttttgagatggagtttagctcttggtacccaggctggagtgcaacggcaccatctcggctcactgcaacctctgcctcccgagttcaggcaatgctcctgcctcagcctcccgagtatctgggattacaggcacccgccaccatgcccagctaatttttgtatttttagt

SEQ ID NO: 2329 - DNA, 1231 bp, Homo sapiens
tgcagcagggccttgagcgcctctatgagatgatcctcaagaggaagaaggcagctcggggtggcaagaagagacggtgacccaagccccccctccctttcctcccacctagtaggggtctgcacacttggacagcagggtgggaccagcctgtgacctctcagtcagactggggtgcaggacctgtccacctcaatgaaggagagaggagcatggggtgtcccgttttggtgccacactggggtggggatgggagatgggatgtctttgcatatctctctcatcctctctggagaagtgggcgctgcaggactgtggagacgtaaatgtaaactgtgactctacctcgaccctgtttcttatttttcttctctggctaaaaatttttaattggatgtgtttgggggcggggggatggaagtgacttggagaatgtgtttgggatgaaataactatctccccttcctctgtcccccaactggggagtctccccaggctgcttttctaggaataccagtcacatagtttttatttttgtgtctgtgaaagtgccaagaacccctccccacatttgtagatccatgaccctttttataagctgtgtgtgtcctctgtattattgttattaactattttttagcatttgcctgtaagttattaaagactgataactgtagctcttaccttggtctggggcattttcctctccttatcttgccccagagacaattcaagatttctatatggggttgtggcgcagggggagggagatttatcttgaagctgaatttgcaaagcaagcacttataaaaattagattgtgtgttacgggatggcttgtgaaaattataggggggagtggaaaacccctcaagctattgcctgatctctgtagttttttgggtggggtcacttcctttttctctgatttaacacccctcccctcatcctctgggtcttacttgtcccttatatcaactgctccttgcagatttaacttcaaattttgctagtctgagctactcctaggttcttgaccttggtgacacctaagtctatataggtaagtcctcaaagagccattctgttcccatcctccccacttccccagtcttaggttggtttgatttttttcctccttgtaagatgtggtgagagtggaaagtaattcctccctggccttaagtcacctctgtgtactcaatcctgctgactggctcactggcatgat

SEQ ID NO: 2330 - DNA, 1210 bp, Homo sapiens
ttcccaccgcaggatcctagagtaagctgctccctgggcccctgacaatggccacttttccagacttgctgtcaggttagaagggcagtggccttgaggctgctgtgccactgatgagctggctttctctggtgctaatgagacacatacaagaagactaattagagcaggtcttggggtttaataacgtaccacagctcagatcacaggttcgttggaggaaagggaaagaggccagatggcgggctcctcaggcactcgggccgtggctgccctcagccgcagggtccccgcttccctccactaatgctgttccatctgtcttttgtgcaaaccgcagatgatcagccttgtgacaaaggtaggcccagtatctatccgctgtccacaggcgtggccccttttccgtggaacgtctggggcctgaggggctcgtgttctttccctatctgggcagctgtgcccctcccactgtctgcgcacctcttcctgctctgccagctggactgggctgttccttgaggcaggcaaagctggtggggacagggttcaaggccttaggggcacctccctgccctcctgacacgtgcggcccagcctttccaggactcggctacgctgtgatggggctggataggagacaaggggtgggagggcagggcaggctggagtgaatccctccctattcacactgctcacactcagggactggggaggcctgctggcctagaatccccctcagggcctggaaaggctgttaggggcctaagcatggagaactgagcaaaacagaggaccttgctttcttggggtgtccaggacatgggatttcccctgagctccccacgagacaccatcccagggggctcttcctgcctggccatccaggggctgggtgccctgggccggatgtgtctggtgggactcactggcttccctccctctgtttgcttcccagagacctgtgactgtgagggctacctcaaagggcactatgtgggtaagtagctccccctgacacccacatgcacgacctgccccacccaaggccccagagttagggagaggtcaaagcagggtgatctgagccccaggagtccttctggagcagtggagcctatgggacccccatctctcctcagttctctcaacccaagcaggagctgagcctgcccaggcattgggcccccacccagcttttacccagctg

SEQ ID NO: 2331 - DNA, 1173 bp, Homo sapiens
gtgttcttaaacttggtgctttttattctttgagatgctaaccagttagtgcttctaactgattggtagtgaggccagcagctagcatgtttgcattgaaaatgggtgtagtatgggtgatagtcattgaatttttatggttactttttttttttttttttttgagatggagtctctctctgtcacccaggctagagtgcagtggtgcaagctcggctaactgaaacctccgcctcccgggttcaagcaattcctctgcctcagcctcccaagtagatgggactacaggtgcatgttactgtgcccggctaatttttgtaatttttgtagagatggggtttcgctatgttgaccaggctggtttcgaactcctgggctcaagtgatctgcctgccttggcctcccaaagtgctgggattacaagcatgagccactgctcttggcctggaaaaaatttttctatgttttgctgcataaagaaaatgaaaagacaagccatagactgggagaaataatttgcaaaacatacatcttacagagcacttgtgtccagaatgtataaagaactctttttatttgcgtgtgtgtgtgtgtgtgtgtgtgtgtgtgtgtgtgtgtgtgtgtgtttaatacggacactgtctatgttgtccacactggtcttgaacccctggctcaagtgatcggccttcctcagcctcccaaagtgctaggattacaggtgtgagtgaccacgcccagccaagaactcttaataaggcagcccgggcttggtggtttatgcttgtaattccagcactttgggaggctgaggtgggaggatgatttgagatcaggagtttgagactagcctagggaacacagggagaccccatcgctacataaaattaaaaaaaaaaaaacagaacaaacaaacctgccaggcatagtggtccttgcttgtggttccagatgcttgggaggctgaggtgggaggattgctttagccaaggaggtcaaggctgcagtgagccatgattatgccagtacactccagcctgggcaacagagcaagacctatctcaaaaaagaaaataataatgataataagacaatccaggctgggcatggtggctcatgcctgtaatcccagcactttgggaggccgaggcaggtgaatcacctgaggtcagg

SEQ ID NO: 2332 - DNA, 1173 bp, Homo sapiens
cctctttccccttttcattccacgtaggtcatttatccttaacttctaaaatggactctacaagcacttaaccgagcggacgcagctatacaaatacttttcagattcccctttatttcctcttctttcccactccacctaggatcccgccccaaccagcgccaggccacgccccggcgtgtgacgcaagcacgctccgtgcgcgccgtcgcgtcgcggcgctcactgggggcccggctttcgcccgctgctgccgccgccgccgccggccgcggctgcactcccaagatggcggctcctccgggcgagtacttcagcgttgggagccaggtgtcgtgccggacgtgccaggagcagcggctgcagggcgaggtggtagcctttgactaccaatccaaaatgctggctttaagtatccttccctgcgtgaagcccgagtccgggccggcgtgtaggtgcggtggtcggggggtgggggacgacggcggcggctggggctctctccgggcctaggggcgaccggctaccgcggcgcccggggcgcatgcgcacggccctgagctcccctccccctcccgcgggcccttcggtcagctttggggatcctgtctctctctctttgcgggagctggggctttaccgaggatcagtgggtggaggagggcttgacacggggatggctttttggggggaacgttatgagaggggacacagtaattaggagagggggtggtggtgggagggggctgatggattggagcccggatggaaaggaggggcgggtgaaatattatggggaggggtgtttagggtaaggaactgctggtagggcaaaggtatggaatttaggagggcatgtgcactgatgggatttcgtccaaggaagggcggtgggatggtgaccaaattggtccttgcctgttttgggggagagtaagttcagggcagagtttgtatctgagctagggatagtggcttgtttcgctgatgcgtgtgtatgtgtggtgggggggctgtgctgatttttaggcttctcggtcatttggaagttgctgtttaggggatgtttgcactggaaacctgttccagagagggcttgccaggggcttatgtggtttggggatgtgtgagttacaggtgaaagagtgaagttctcatgctgccttgatcagt

SEQ ID NO: 2333 - DNA, 1270 bp, Homo sapiens
ttgaaatgttttcttacctcattccctgccccaggaagggacccagcctcaccctcctggggtggccccgtgttcctcctgcccaccctgccccactgccctaccggggcagcccaggttcccaactgctgcttccacccccttcaccttgactggcttcagttcctctcagcgctcctgcctccaaagcgtgccctgtttcccttccttagcgcttttaagttatttattctgtacttgtggtttggggctctgaggaaaatcctaatcttgtgcctctccccctttgctaggagttgggtgggaagagagggtggcctctgtgccccaggttgtcagtggaggggaaggggtgtcactgcccctctgtgggactgtcatgccagtgtgcccacctgcctggtctacatcctaaagagatgtaccgtcccccctccatgcgggcaccaccactcccaggagccaagctggaggaccgcgacctgggctgggagcagagctgactgacatgggtggaggtgaccctgagccaagttctctggcacttgctggacatgtcccctaccctcttcccaagaggagccatcccacatttgggtagttagtacccaggactggttggactgatcgggttagggaccctagagggttaagggaacaacagagatggggctgcaatgccctgtctggaactccgctctcccgctggggtggttctgattgtggctcatgcctggttgcaaattggtttttaacccacaaattgtgattattttttaaaaagccaaacagattttggcaggagttagaataaatcccggggcctgggcttctctattcttggccctccgtagtctccctccgagaggaggccagagggagaggaggatctcagcaggcctctagccgcttccagatgcagtctggggagtgggctgaaggtgaagggaggaaggctgtgggccactctcccttctgagaggcagctgcagctcaggccctaatacactctttgccctgtggcctctcccttttccccccttctggttggaggagggagaagtgggaagtagcttgggaactggtttgtccacataaacttccccattgttccttggcccgccctcagggcagagccccctgcccaggctgggtaagagatgggcttggtccagcagggaccctgagggaacaaacccttttccttctggggagagagtgccccccctaccatgtagttgaacaggggctaggagctccccactcccct

SEQ ID NO: 2334 - DNA, 1184 bp, Homo sapiens
ggatgaggatgacgaggacgaggatgaagaagaggaagatgatgagaatggggactcctctgaagatggcggcgactcctctgagtccagcagcgaggacgagagcgaggatggggatgaggtggggcagacagggcacagtgggaggggaggggagtcctgccaggagggccacctggtgactccacatcctttctcaccccccagaatgaagaggatgacgaggacgaagacgacgacgaggatgacgatgaggatgaagataatgagtccgagggcagcagctccagctcctcctcctcaggggactcctcagactctgactccaactgaggctcagccccaccccagggcagccagggagagcccaggagctcccctccccaactgaccacctttgtttctcccccatgttctgtcccttgcccccctggcctcccccactttctttctttctttaaaaaaaaaaaaaaatacggtgggggtagggggctggaggagcccaggccaggactctgcagcctcagagacatcagcccttgggggtcctcctccagggacagcaactatcagactaagccagcaccggaccagcctggcccaccccacccacttctgcacttgcggttccggcatggacaatggaccggagagtgggggtggggggtcccaaagagtttgatgaggccctccacacctgcggcccaatccaaggtggggtggaagcttggggaagacccattccttcccagaggggcctgccacctggacccctgcattggaactggaggcagggaacatggggaggaggagggtcggtgccttcaagaaaacaggcactgccctggtggccctctcccctgccccctgcaggaaggagctgcctggacccgttcatgggggagggggcagaagtgttttttatatatgtgtatatatttttttttaagctctgagctgtcaacgagacgtttcctaccgatctcggctgccgtctctgttgtcatttctgggagagggagggtttaggggtagatttggaaccttttaaaaatggtcttgatgtatgtggaagagagtatgtgtatgtgtgttcctgtacatagcatgggtgcagctgtggatgtgtgcaaaagagtgtgagtgtgtgtgtgtgtgtgtaaaggggtctgtcctagagccca

SEQ ID NO: 2335 - DNA, 1099 bp, Homo sapiens
gacaaggagacagagccagggatagatggggaagggcagcaggaaagacaagaagcacatctgcttggagaggaaacaaagtcatacacagccagttctcaaaagggggcactggccgctgccatgctatgagtagccctttttcctggttggcataccctggctgcagactcacatgcccttggtgctgtacccaaaaaagccagctgtctgcaaccactgcccaagcagagaggggtatggattgctggaactgttgacccctttgatgaggatgttggacagttgactgcacacacccaaacactctcatgggatgggagggagaggccaagctctagagtcagagccagggaaggccagaagaaactggtagagtggacaaggtgctgtcctgggggacacaagacttgggcctgttctcctggctctgccactgaaccgctgtgtatggggcctttggtaagtcatttcacttctgtgggcctggtctttatgtgaggtgagccaggtctgtgtggtccccttcaggtctaaaactgttttgtctgaggaggactgagatgggggaagaggaggctgagctctgcttctggttttctgtgggaactgtgggaaaggagcactgcctttctatgcctggtgcttctataagaggcaggggttgggctcagttgccatgagctcctggcacctgccagtgccactcttgtgagcccgcgaggatgaaagaagagatggacattgtgtgggagccaagagagaaggtcgatgaggaagagaaagagacacattggaaaggaggaacaagaaggagactatggagaagtggggaaagatgcagggagggagtgaggtgagagtggggaggctaaaaagggggtgatgaagggaagggaagccaagtggtgggaaagaatgagtgggctgagggagggagggctggaggggccagacagccaggatcctggagaaagagaagaaggtgatggtgtgagaactgggcaggaagatgcagggtagctggctgagacttgtattggaagaactcgctctgggttcccctccacacaatctcccctcatgccttggaaacagg

SEQ ID NO: 2336 - DNA, 1232 bp, Homo sapiens
aggggacaggaacataatgccattctgtgctcccttccccgccaggctgtgtgctgcgaggatcgccagcactgctgcccggctggctacacctgcaacgtgaaggctcgatcctgcgagaaggaagtggtctctgcccagcctgccaccttcctggcccgtagccctcacgtgggtgtgaaggacgtggagtgtggggaaggacacttctgccatgataaccagacctgctgccgagacaaccgacagggctgggcctgctgtccctaccgccaggtcagtgccaacccccatcctggggctgggtatggccagggaccaggtcccacctcgtccaaccctctcgcccccctctgaccatccagggcgtctgttgtgctgatcggcgccactgctgtcctgctggcttccgctgcgcagccaggggtaccaagtgtttgcgcagggaggccccgcgctgggacgcccctttgagggacccagccttgagacagctgctgtgagggacagtactgaagactctgcagccctcgggaccccactcggagggtgccctctgctcaggcctccctagcacctccccctaaccaaattctccctggaccccattctgagctccccatcaccatgggaggtggggcctcaatctaaggccttccctgtcagaagggggttgtggcaaaagccacattacaagctgccatcccctccccgtttcagtggaccctgtggccaggtgcttttccctatccacaggggtgtttgtgtgtgtgcgcgtgtgcgtttcaataaagtttgtacactttcttaacagtgtctgatttgccgccctgcctgccctccccagggccccagaacaggggttcacgtccactgccaacactcccctcccctaccccacagaaagacatacacagccttaacctcaccagttttatatttgctgctgcccacatcggctgtatcacattaccccctagtccccagagctgtcccagccaccagccctgtgacatcgtagcccagagatgggctagtcagcaagcagcaccccctcccctcccaggggtccacaaagaacgccccctcccttcccagccctcacactagcagctgaggctgggtcacccctcctgctttcccacaatagagctttctatgtacagccacgtctacacaggcactgcttccccccagccctcctccccggcacctccccgtgggggtctgga

SEQ ID NO: 2337 - DNA, 3095 bp, Homo sapiens
atattccccagccccatctgacccccatttctttgtcccacctcactcactcaatcatccctggccaccctgccacctttctcgctagccatcccatccacatcattcccgcctcagccatccatcctgggcccttcacctttcaccctgtcccacatgctgccctctaccccaccctacttgctccacggcctgctgcagcagctgccactgcacttcaccttcacccactacttcaccccatcttctcaggtcaggacctgcaacatccccccagccatggcacgtgagttgggggatgggatcctaggtagggccaggggaggagacccataaatgttcccttgggggtgttgagccattaataccagcaagtagaagctgggatgggcagtgtctgacagccaaagaattgagttttggcttgcaggggtgggtttagatttgaagtttgctttcagtttactatcagggatttctttttcctgtcctcctctcaatttgtccctccctcttctgtgtttctaagctagggaacaccagtaagtgctacccacccctctgcagcaacatctccaaactgtcaagtttagataatcccctcctccctctgcttttttcctctgctcttcccttctgtaaattttaaaacattttcctcccctctggccagtgggttgtcaccagagcacttgctgtgggcccatctggtcttgccttctcagcgccacagggaaggccaagctgttctagtggtggaagtgccaccattttggggtagtatctttgaccatctttggtgacgttacgttatcccaggtgaggtggaaagcgtctcacctggaacctgatataactcaggctgcaattccatccagttcccacatcaacggagccacacatttggcactgttatcttggtatccctcatcccagaagaggcatctccatatcccagaaaagaagatcctatcatgaataaaagctgtatggcccagagaggagctcatgtgtctaaagtgaagggtatattttcttctgttgtgttgatgtttccttcttaatttataggatttttttaatgtaaaaaattgcactgaactctataaacgtaaatgctgctttttgtagctcatataaaaaaggttccatatttgtagtatactgcaataatattttttacatccagctctttaagtgatcctcgttctggtggctttgtgtaaatatgtttgccctagttgaattaagaaactctaaaggttataaaatgaaaacaaaaaataaaatatttgttttctgctagatgcaaaactgactaagcatgtatattttaccaaacttatgtattttttgaagttatgaactataaaatgttaaaacattttttgctgggacaaaatgttaagtaatttgcagtatgtagtgcccccagtattgggatttttgagctaatgggcagcagtcagctgggggcttctgagggatgctcatctttaacagtctccctcatgtacttttgctgttttacacagagaaacaggtagaccccacagaggagaaggaggggattcaacagctttattgtctggaagcagtgagatttggtgattgtctggggggattcctgggtttccctgggtaccttgttccaggcagtcagtccatttgccttcctagtacttagccccctctgacaattttttttttaatgtgccttttgggttggtagaaacggaagtagaagtaggctggaggatgagttgggacagtcttccttttgttgggaggtgagcacatttacagatattttgcttcatagtttccatgccctctgcccagctcagtttagacagtaaacgttccttgtttcttttctcccatgacactgacaagaggaattaccacctcagcctcttttgcccctcttcttgcctttcacccaggctctcagccctaattaacacactgacccaaaggtgcttgtgttgcaggtcccatctcctttgatgaggttaacaattcccactttggcattttcctaactattcgtgtggctagaattggttggttggtcacttgacaagaaaaaccatacttacctgggccaaggctctgttcctgccttcgcaaattctcaaaagagtaaagtttatgaaaagaaagtggcaggcaaacacaactcttgactgccctcccaccctcctacctgttcagtactcatctgattcagaagcatcacttcttggataactagcactggaaaaatgaaatcatctgtgtaagtgaagggactcatttttctttgctttcagcccatgtaaataaataatacagtattaacattttcgtgctgcttcccattagcttgtagattgagccatactctggctgcctctttgccttcctaggggcattttctttaacttccagaatagtgattttaaaagtaaaaataaaaataaaccttacttacaagcataacagattgtatttaactttatcacatatgatagagatatatatgctgtaaaatgagggaaaggaactttctaataaaccaatgatttgtggaaacttagcagagtctgtcgtaattgttgccccatccactcaaagttaggtagggttggaggtgtgggttataaataacatcttgtttgacatgaccaaggaatagattcctgtgaaccagttagagatgtttgcagttgtgcttctgaaagctcaggctacgcaaagagagaggaaagatgatggtgtgggaggtggtaatagtagttaatttctctcagttgtaggtagatgtattgggatgtacacctcctttccacttcctctttcccacaagaggaaagatttccttccattttagatatataatctgtgtgtagtagaatatatggtgtatatataggtgcttactaaatgggtgtggaatttctggctttgaattttaggattttggactactttaagggcactgagatgacaagaatcatctgccggacttttgtcctccaggtggagttctgtatgccagtcttcagttactctcctcagccctttaataccactacagtgtttgagcacct

SEQ ID NO: 2338 - DNA, 1167 bp, Homo sapiens
atggatgtttatagcattctttatttgtaattgccaaaacttggcagcagtccagatatccttcagtaggtgaatggataagtaaactgtggtataccaatggaatattattcagccctaaaaagaaatgagctatcaagccaggaaaagacatggaagaaccttggatacttattcaagaatatgtgaaagaagccaattggaaaaggctacataatgattgcaaatatatgacatcctggaaaaggcaaaaccgtagaaacagtaaaaagatcagtgattgccaggagtttgaggggaagaaaataaagggatgaacaggtggacactgtggattttttgagcagtgaaattattctctatgatactataatggtagataaatgtctgtatacatttgtcaaaactcatagaactacatcaagagtgaatcttaatgtactatggactttggctgataatgatgtgtcaatgttggttcatctattgtagcaaatgtattataataaatgtgcaggatgctgtgtctatactttcagctcaactttgcgataaacctaaaactgcttgaaaaaataaagtctgtctatctgaaagtaatcacaaaagttaataattacaataaactcatattcagtatttctaaagcacttcttccaaagagcatgtgtaatttaaaactttactaaaaaactgaaaggtaacaaattgaaaacaatgattacctctaagaaatgaaacggagaaaggagggctttctttcatgttttacttgttacagtgtggcctaaacttttaacaatacccattttacatttgtattatttgtgtttagtagtatattttaataaagggggccacaatatactaaaaaattaaagacattgcttgcacaacctttcctcacctgtgaccaggctatcagactagatgacatatttagaggtaagattaaagttattacaaaaattgttaaaaaaaattttttttaagttctccctatgagctcagtctaataaaatgtctcaagaaaagcattttacaaaaaaatgcccttaatgggcataattttaacaatgcaaatcacctttaaaagactgtgtgcctgtaatcccagctattctggaggctgaggcagcaggactgcttgggcccaagtttgaaaac

SEQ ID NO: 2339 - DNA, 1099 bp, Homo sapiens
agccacaagtgaatacagttcttgtcaccagggttgccctgccctcactcggcagggagttctgacaccccagggcccgtgagctacctgcttgagcccctgtttctggggcaccttcgaggaggcgttgtggagggcatcgccccctgtttattcacaacaccctcaggggcaaacaggcctgggacccgctgacaccattttgggtagctggatgcacccgacagcagtggggtccacacactgagctccagctggcactgcccactcaagggctgagtggaggggcccctccggccagctctgctccaccagccctgcaagctgatgcagggcgggggaagggctgggtgttgcactattgctgcgctgccttaaggcatctgtcctctggtggtgcacccgtgcacacaggtacagtgcatctgggcacagcttttggatccacacctctgcacaagtgtgaatacctctgcacatatgggcgtatctgtgtgtgctcgtgtatatggggtggggaacatgagacttcctgtgaccagtccaccctggctcccagctgtctgtatcctcctgccccgccctggcgagtgcctaccctggcagaacccagggaggagtggaggctgcctctgcctgggcctccacacagcatcctgtacatacgccacctgggctgggggtggggaggcagggccaggagcatcgattaaagatcacatcctggggcttccagggagctcacaccaaccttgcgtttctctcctgtctgtgaatggccatgctgtgacttgtcccctctggctcaggagggagcatgataactggggtgctggaggcgggaagggagcgcccaggaccagctccattcatggtgaggaaacagggtggaggcctggccctcccgcttccgcttcctcgcttcctcggctcttccaacaaagacagttgtgcccctcctctggctccagcaaagcaggaggccaggcgagtaggaaagcattttcccaaaagtctggagacccaacttcccttttatggctgaagccaaagaagcctctcctcacctcccaaaagattccagaacgctggacaaaac

SEQ ID NO: 2340 - DNA, 1099 bp, Homo sapiens
cttgcttagtctgcgaccacctcgggctttcttatatttgccccattccctgcagggcctcagtgaagatgtgagcatcagcaaattcttcgatgatcctatgttgctggaacttgccaaacaggatgttgtgctcaattaccccatgtgagtgcgtggactcctgggagctcctgctccctacagtgggctgcaactcctgtacttgaagctgagacctcatatgacgtggccttcgtgttgtcagagagtgtctggaagctgctgttgccatcttgaacaactcaccaacctccaacccagagccccagtgagagaggagcatttggcctcctgcttccttctgtggcctctgccgggctccattcccaaggaaaagagaggagcttgggctcacagaaagagaaggggatgaaaccccaaggggccctatctttgggatttacatggaattttattttctacaagtttgaccttagccatggtttgcaagtgaacagaacattctgacctctgtcttgctctgctcctttcatcctcgtctcccctgccccgtctggtgcttacattctgaatatatgtcatctcccaagaggcttcactgcctctgcttccagctgcagcctccttcctgcctgggtccccagggaagccgcctgccttttaattcagtgttcccatgagcgccaaggccccattattgcccccttgctcccactccatgctgcttctgggtggaacctaagatggcttgggagttgttgggttcctgcgatcagaagtctaccccaccacctcctcaggaaactgctgcctcccctaagaatcttccttgccctggagtagggggccagagcactttgatttccagccatttactccaagtcctctccccagctaccaccagtcccttactctgttctcccccagtgaaaaagagtctgttgattttcctcaaaactgctttattaggaatgtaccagggattgagttaggggagttggacagccccggctcctataggagtcctacttctctccagcatcctgtgccatcctcttgacgtaatcgctgtacattgtgtacacagcacctgtgt

SEQ ID NO: 2341 - DNA, 1217 bp, Homo sapiens
cctacggggccaccggggctgggaagacacacaccatgctgggaagggagggggaccccggcatcatgtacctgaccaccgtggaactgtacaggcgcctggaggcccgccagcaggagaagcacttcgaggtgctcatcagctaccaggaggtcggctgcccctgccctgggccttgttctcacaaccacccggggggaagtgagcccatggggtggagtgagctggtgtgggacagggtggcaggaaatggagagctggcacccctcaaggagatagatactgctcagtgagatgctgcactagagacacccgcctgttcaccctgctgtggtcatgtaacacagtcctgggaagcgccacttctgtgggtgtctcagatacatcccggcctcagctcccctgtccagccgctagggagaggtttcctgatgggccgctctccctcaggcctcttcctttcttcctttctcaggtgtataatgaacagatccatgacctcctggagcccaaggggccccttgccatccgcgaggaccccgacaagggggtggtggtgcaaggactttctttccaccaggtgtgggattgggctcgggtaggatgatcggccccatgggtccttggggttccctcacaaaactgtttggggatgccctgggtcctgtgatggtggtagcagtggtggtggtagcaagggggtgatgtagattctgaagagcagcccttcctgttaggggaaaagtcctgatccgggaacccacagccccgttcctgggcttctcctctgtagccagcctcagccgagcagctgctggagatactgaccagggggaaccgtaaccgcacgcagcaccccactgatgccaacgcgacttcctcccgctcccatgccatcttccaggtgaggtcatgggtcagagcctgaaaccagtgcccctgatgcccatctccccctcacccctgccatctgccttcagatctttgtgaagcagcaggaccgggttccaggactgacccaggctgtccaggtggccaagatgagcctgattgacctggctggctcagagcgggcatccagcacccatgcgaagggggagcggctgcgggagggggccaacatcaaccgctctctgctggcgctcatcaacgtcctcaatgccttggccgatgcaaaggtaaagcagcacaggccagtattctccccaggatagcaa

SEQ ID NO: 2342 - DNA, 1211 bp, Homo sapiens
tgtcacccaggctggggtgcaggggcgcaatctccgctcactgcaacctccgcctcctgggttcaagcgattctcctgcctcagcctcccgagtagctgggactgcaggcgcccgccaccaggcctggctaattttttgtatttttagtagagacggggttttaccatgttagccaggatggtctcgatctcctcacctcatgatctgcctgcctcggcctcccaaagtgctgggattacaggcgtgagccactacgcccagccaaggcagtcttatgatcctaaacctcattttatggatgagaaaactgaggttcagggaggcaagcggcttgcccggggttgcagcacatgtgagtggaggagctgggtgtgaagaagccatgccccaacctttgtgccgtgctgccgctgcttggtctgaggacgccacaaaccacgacgccagctcaaagtcacaccaccagcatcgcccagcctcctggcctttccctcacattccttcttggcaagagtggtacttttctaaacctcggccttagtggctgccgagccactgcttgcggctcagttccccatctgggccaagaggattgtgcgtctccatctatatcagctacccaggcagtcctagtgctggcgttcaaggggaagtgatccatgggaccttctgtggggaggaggccttggggcaaaagagggcccaggcacctggactctatttgtggtctcttttgcatcttccgtggatggctgcaggcaggccatttctttcctttgagcctcagtctcctagactagaaagtaaaggccagggggaccagtgggcatctgaagagtgctgtgggtctaccacagagagacaggtgtctccttcctctaggaagttggcctccaaggggatcctgcctcgtccaggaagcatgctgcctaacagcacctgaccttgccctgcctgttcagcttttgattgctgaatttatagtgttcgtttgcttttttttttttttttttttttagaaggaatctggttctgtcacccacggctgcagtgcagtggtgggatctcagcttaccgcaacctccacctcccaggttcaagcgatcctcctgccacagccttctgagtaactggaattctaggtgcacgccaccacgcccagctaatttttgtatttttagtagagatggggttccaccatgttggccag

SEQ ID NO: 2343 - DNA, 2148 bp, Homo sapiens
tccgggtcgggggttgcgggggacctctgtgccgtgctccggggccgagctctccccgccggcctctcccgcgtccgtccggccgccctcccgcccaacctctcccgcccaacctctcccgcgtccgcccgcccgcccaacctctcccgcgtccgcccgcccgcccaacctctcccgcgtccgcccgcccgcccaacctctcccgcgtccgcccgcccgcccaacctctcccgcgtccgcccgcccgcccaacctctcccgcgtccgcccgcccgcccaacctctcccgcgtccgcccgcccgcccaacctctcccggccccgcccgcccgcccgcccaacctctcccggccccgcccgcccgcccgcccaacctctcccggccccgcccgcccgcccgcccaacctctcccggccccgcccgcccgcccgcccaacctctcccggccccgcccgcccacccaacctctcccggccccgcccgtccaacctctcccggccccgcctgctggccggacgtccggtctgcaggcgcgcgctcccgaggtcccgcctcgcccgctgagccggcctgtaagcgctgcggagattgggctagaggcggaggcctgggccacggcggaggcgctgggtacgtagcgcgccacgcgggccggtgagagccagccgggcgccggggagggggcgggccctggccgcggctgctacgcggggctgccaccgccccgggcgacccaatttcgcggcctagtggggcgtacgggcctcttttgaaagcctgagttacgatgtattgagcgcgtcgtatgcggccagcactaaggcaagtgcttttatatccacggcccattgtcttgacagcaaccctaccaagcaacgtgttatttcctctgttttacggctgaggacgcgcaggaaggtttacagctagaaagggctggagattgtggattcaaactcaggatcagaccaaagccactgccctttagaactttgcgggccgattgattcttgaatctagcttctgccacttcagttgtgtgaccttggggtatctttccgatcccaagtttgctcatctgaaaaatgggaataaagctacagtatctgtcccatagggtgggtataaagtgctttactgttgagctgagtgatcatctccgattttcagacccctctcctccgcttccctctcccctgggaggccagttaaggttttagtgaaggcccccgggactggggcggcgtggatctcacgcccaccaactagtgagggaggccatccggccacccgtctcttccttccccagctccgcaaaggaggcgttggcatttcaggtgtttgcttacagagttttcaaagatttttcactctcccttagttgtgggaaaatgattcaacctacccaagtgaactttgacattaagtctcaattctaacggtgaggaaatggaagcctttgaatatgttttatgtcttaaacgtgtttgtttttgcaggagggagagtgctcattttacctgaataaatcaagattgagttggtgtggcacagtgctggcataggcctggggaaaggggtgaaatgctagagatctggtagatggatagaaagtggacagacgggttcgggtggtttttgtctcagcagggccctaaattcccaccaaatcctcctctgtctgtcttcaccaaggtctgaatctgtccccttggtaaataacgtttaaatggtctccgagcccctcttggtgcctgtaccttaaggagagaagaagagggctgatagctgaaggcaggcaagccacgaacttagctttgttttgaaaattaccctctgggccgggcacggtggctcacgcctgtaatcccagcgctttggtaggttgaggagggtggatcacccgaggttaggagttcgagaccagcctggtcaacatggtgaaacccccgtgtcaactaaaaatgcaaaaaaattagccggacatggtggtgcatgcctgtagtcccagctactcgggaggctgaggcagaaaaatcgcttgaacccgggaggctgaggttgcagtgagccgagatcgtgccactgcactccagcctgggcaagagagtgagactccttctcaaaagaaagaaagaaagaaaaaat

SEQ ID NO: 2344 - DNA, 1198 bp, Homo sapiens
tcagagttcaaggaagtattgtggtatgaatgccttgttaacaattatcattcgtctttggtgccattaccctggcaatataaagaaaataagcaacataaaagcaagaacggaaaaggccctttcacacaaataggacatcccttgcccagcactccctccctgaaagccgagggggcgcgagtcaggaggagtgctggtgtcctccaaatgccctttctggacctgggttcttcagcctgcttctgaagccaacaggcttgattaaggaaggtctggctccacagaaagctctttgtcaggggtagcacaaaacagattttttttaaaccctgcattagtatttactttttgttacagtggtttgagtccagccaatgacactggagccaaaaagaagaaaaagaaacaaaaaaagaagaaagaaaaaggcagtgagacagattcagcccaggatcagcctgtgaaggtaacaaggaggttctgttttttgtgactcagtcactttttcacatgagagagttttgaggtgaatgtataggatcaacttggattgacgttctccactggtattacttcaagatggaagagttggatcccagtgctgtcctctgctgccctagacctaggtgatgaaactgctctcagtaccctaaaagacacagcaggtcagacactgactcccaagcatggtgcccatcagaatggacaggtgcgtactgcatgtgctgctgtgccagtgccctggggagctacgtgtgacagcccctggcgcctagagcagtggttctctgtcttaagtccccaccgctctgacaatgaaaggccccccctttctttttgagacagagtcttactctgttgcccaggctagagtgtagttcatgattatagctcactgcagcctccactcctgggctcaagtgatcctcccacctcagcctcccaagtagctgggactgcaggtgcatgccaccacacctgtccagtttttttttttttttaattttttgtaaagatggagtctcactatgttacccaagctgggtcttgaactcctgggctcaagcaatcctcctgccctagcctcccaaagtgctgggattacaagcgtgagccactgcattcagccaaagacttcttcttaagacctttatatatttgcaaacattctcttaatgccatagtcattataatg

SEQ ID NO: 2345 - DNA, 1177 bp, Homo sapiens
tgccaggagacttggggagcaggacacttgtgggccctcagttcccctctgtcctcccgtgggccatcccagcctccttcccccagaggagcgcagtcactccacttggccccgaccccgagcttagcccctaagccctcctttaccccaggccttcctggactcctccctccagctccggaacctgagctccccttcccttctcaaagcaagaagggagcgctgaggcatgaagccctggggaaactggcagtaggttttggtttttattttttgagacagggtctcgctccgtcgcccaggctggagtgcaatgttgcaatcatggctcactgcagctttgaactcccaggctcaagcgatcctcccatctcagcctcctgagtagctgggactacaggcacaggccaccaaacctggctaatgtttaaattttatgtagagatggcggggggggcgggggtctccctatgttgcccaggctggtctcgagctcctgacctcaagtgatcctcctgccccagcattccaaagtgctgggattacaggtgtgagccactgcctggcctggccgtaggtttgtaactgtttcatagaagagccctggagaagacagtagaatgagcctatctagtttaaaaaataaagaagcacgttgatttcaccaccgccactccctgagcacctctatgctgccacccccacaggcccatgaggagggacagggctggatgagtttcttgggcctctcccctcaacagggcatggacttggctaagacagccagggggtggcagcaggagatgccacagctctaaatagcccgatccctgctcctggcttaaagctgctgcgagtatcacaagactgtctgaggatgccaattcagcaggtcagcgcctccccacaacacacacacacacacacacacacacacactcacacatacacagaggggccttgaatgaggaggagacaggagtctgagggaccctcagactgccactctccaggcttggctgggctcaaggcccctgtctgctcagtagggcaaatcccaaggacacgggcttcccttcctccagccagccagccttttacacaaaggctggaaacgctgcttgggccgcctctatagaaatgccaggagagcgcactggacactaggcgacagaat

SEQ ID NO: 2346 - DNA, 1560 bp, Homo sapiens
cacaattccaatctcaaaatatatatatatatataatgtataaatatatataatttatatttatatatttattatatataaatataaatatatatatatatattgcctaggctggagtgcagtggtccaatctccgctcactgtgacctttgcttcccaggctcaagctatccttccacctcaacctcccgagtagctgggtagctgggactacacgtgcaagccaccacatctggctatgttgttgttgtagagacagagtttcgtcctgttgcccaggctggtcacgaattcctgagctcaagtgatccacctgccttggcctcccaaagtgctgggattacaggtgtgagccaccacatctggcctaaaacactattacccaatattttttcatgcctgtatctatttgcagtagttattcctggttcctgctaaccagtggataaaagcacatctctgtgatttggggtagtttcttgaaacacgtctgttctcccttcccagacacatcatctcagagttggagcacctgacgtttgtcaacacggatgtgggccgctgccgggcatggctgcggctggccctgaacgatggcctgatggagtgctacctgaagctgctgctgcaggagcaggcccgcttgcatgagtactaccagcccaccgccctgctccgggatgctgaggagggcgagttcctccttagcttcctgcagggcctcacgtccttgtccttcgaactctcctacaagtctgccatcttaaatgagtggacgctcaccccattggccctgtctgggctttgcccgctttctgagctggaccctctctctacctctggtgcagaactacagcggaaggaatctctggattccatttcccattcttcaggctctgaagacatcgaagtccatcactcgggccataagatacggaggaaccagaagctgactgcctcctccctcagcctggacacggccagttcatcccagctgtcctgcagcctaaactctgatagctgcttactccaagagaatggctccaagagtccagaccattgcgaggagcccatgtcctgtgactcagacctgggcacagcaaatgctgaggactcagaccggtctctgcaagagtgagtacgctgcccccactccttcccatcttctctcttccctcctttctttcctctcctcctccctttcttcccatagcatgtgattgtctgttactgaactctattagtaattaaagaaagccaagggagtcatcgacttctccagggactggagtagctgggaactgtagcaggcaatacaggcatagtggagaaagtggacttagaacagcttagagctggtttgggctccagctctgccccggtgacttttagcaagttacttggccgggtgcggtggctcatgcctgaaatcccagcacttgggaggctgatacaggaggattgcttgagcccagcagttcgaggccagcctgggcaatgtagcaagatcctgcctctaaattaaaaataaataaataaataaaacaaaaactgaaaaca

SEQ ID NO: 2347 - DNA, 1560 bp, Homo sapiens; identical to SEQ ID NO: 2346

SEQ ID NO: 2348 - DNA, 1560 bp, Homo sapiens; identical to SEQ ID NO: 2346

SEQ ID NO: 2349 - DNA, 1893 bp, Homo sapiens
acactagatagactggtcctaggctccaggccacaaggtttgtggcagggccttggagcaggaagcaggctggctgggactgggtcctcaaagagcaacttgtctgcctacagtctgtccagccctgggagcggcggaccttccccctggcgcacagtccccaggcggagtgtgaggaccagctggatgcacaggagcgagcagcccgctgcactcgacgcacctcaggcagcaagactggccgggagacagaggcagcgcccacctcgcctcccattgtccccctcaagagtcggcatctggtggcagcagccacagctcagcgcccgactcacagatgagcgggagacagccatctaaacagactcactaactattggcattaaagcttcagaaatctctgcgtttgatattcaaacatcatatgccggaaattttcacagtttttagtgaacttaaggaatttagatcctactttggtatttttttttcttgttttaatttttgttttgtttttgtttccatgttttcttgtcacacacctgagcacttcctcccgttggcaaacagaagttcaggatgagaccctgctggcctggtcctggcacatcctctgcactgttgaatcactggacttactgatcttagatgaccaccccctccctcacacctgtgggcagggcagaacagcctggcgggctacagtttagcatggccttcttgagctagggtggaatggggcagggtgctctggactcttaccccctcccctcccatctgtggcttggctctgctgtggccctcctggctgggtccccttggtttttcgtgctggaacatccccaccagagcctctctgccataactgccagctgctctccccgagtgctcagctggcagaacacctttcctttctcacccagaacttaagagactgattttttgtttcatctgcatttggtcttctctgttttgactctttcactgcagtaacctggctgtggctgctcaggttcccctcctcatgccccttggtacccttccctgtctgctctcccatgccatgtacacacccacaacccgtccttccacttggaatatttttaccacctatcctgatctttgaaggtagggttaggactacttaacctctattcccactcccctgcaaactgggggttgtgggaagtgagcagccatctccctgtgtgattttttttttttttccctctgattcactttgccatgtttccttcacatccagatccctgtcggtgttagttccactcttggtctttcacgctccccttgcctgtggaacattgtctggtcctagctgtggttcccattgttcccccttcacccttctctgttaaccttgtgcctgtctcctgtatgatcacatcaccaaaaagggggaggggggagaagactctttttttttggccattttgtaatcgtataaaaatagtagacaactgcttaatggttggggttttttcacaattttcaacattagtgatttttttttctgtttgcaagttaaagggtttgtcattgtttctttaaaaaaaaatacaataatgcaccatatccctatgcataaagtgcttcttctatttataaggttgaaaattctgaataacccttttagcattgaaaaaaaaaacaaaaacaaaaaatggaaaaaaaaaaccttgtattttgtaaatattttcttttcctgctttggagctgtgtaatggcagcgaaacatgtagctgtctttgttctatagaaatgcttttcttcagagaagctgatctttgttaatgtcttgattctgttcgcaaagcacagactagtgcttaaaaaaaaaaaagaaggaaaaattgaaaaaaataaaaaaaaaag

SEQ ID NO: 2350 - DNA, 1161 bp, Homo sapiens
gatagccaactccaaagggcaccattcacataatatcccgtgtaaataacacaccccctgaagtcttgggattccctgtacatcattgtatagcagtaaataacagtgaaggctagcagcttggcatacgactgtgtaggtcaaacatttgtgtggtagattttactactgggccacccttacaacctcttctctagaagatgttttaaagtggcaggatttccaacttttttttttttcataacaaggttaaaaatgattttgattcattgattccatatagttacatttataccagacataaaggcagaaaattgtttgaatgtgatacttagctgttttctggccccataggacagatatttttttaagtagttttagtgctgtttcctaaccagtttgtgtagtttgttagaataacaaccaactgctgcttttcatcctggagttgtgcctcgcaccttgactgtacctcagcccctctcattaagtgtgtgtgggtgatagaaattgagggactgtgttatagccaactctacgcctggctgtggaaggtggagagactagggtataataacctgttagtattccagcaggaagggggctttgttttatcacctcaagtaatcaaatccagttaatccttagttggaaatgtagaggatatataaccttggagaaaagcttgttaactttataaaaggggcttaataagagcaccacctgctggccatgaagatctgtggtattttgagagagcttgccaaaccctgcacatgaggctacagcaacttcccagcaggaggaagaagtgagcattacaaaacacccggaaaaagtgcgcctgagaaaatggtggaaagtaaggagccagacagccaggtgaatcgtggaatgtcagaccctagtcatcctgaagtcagggtcttctcattcatctttcattttgtttgaggaaacagtaacttaaggatgacattagtaattcgtcttattttcctgttatttacctgataaggatcagcaccctcttctctgaaaatagcagtttacctatgtgggtatggaatgtaggagacctctagctgaatggatctctggtgtgttctcttccatttcatatccctttttttgcttactttcaggtcccgtatccagtct

SEQ ID NO: 2351 - DNA, 1208 bp, Homo sapiens
caagggagaaaacaaaagattcagggagattctgtacaagtgaatgatgtgtacaacacccttaaaattcgggtttcatagaactgattctaaggaagcccattaacatttgcaaaattcatcattttctaaccaactgtagttctctagactttatttactcgtgtgtttgatgtagaggagaactcaatcactagaacttgagtttatttattgacttttatctttcagacatgatgtagttaatgtgcaccaagaaccttacacataagcacacacaggtagattaacagacatcaagaggagacctgcttctgctctagaatgcttctttgtgtctgaacattagcaaatagaggttgaactagtataagaggctttgtttctttgtgttttcttgttgtttatttattttgtttctttgtgtgttctgagaatactcttccttccccttgtatagtcttcagcctgtcttggcagaccacattccaggtgacagctctgatgctgaggaacaattacataagaagcaacgactgaatctcgtctcttcatcatctgatggcacctgtgtggcagcccggacacgtcctgtactgagctgtaagaagcggaggcttgttcgacccaacagcatcgttcctctttccaagaaggtcggtacagatgagagttggtcattgtcaagcagtgagccagatgctcagatagagttagtctcttgccaactttggtgttttctaaacttggctaaccaccaaggtcttctggggagctttataaaatactaggttcctgggccctgtttgctctggagttggatgttggaatcttgttttcagaaaacacaaagctcctcggtgactctgcagctagttttgaaaaccactgtcttgagctttttaatagaaatgggagagactgaaagtttaagtactgcccttaacactttgaaggagaatagtgtgccctctcaccttcactgttatcactgaaaatggcagtatagaatcctttgccctaaaaaagaatcttggccatgtgcagtggctcatgcctgtaatcccaacacttcgggaggccaaggcgggaggattgcttgagcctaggaattgaataccagcctggaaaatatagtgagaccttcatctctacaaagtatttaaaaattaagcatggtggtgcacacctgtagtcccagctattca

SEQ ID NO: 2352 - DNA, 1152 bp, Homo sapiens
tgctggtaaatctagttaccatagaacttgaaaggatattgaaagaatagttgaggactatcctgattggttttcatctacttagtctgtatttgtgtcatttcagtgtctgagtaggtggtttgtgattaacatttcacatgttatttttattgatttggcaagtaccagaaaacttgaaggatgaactagaggttatttttcttagcatttgtggtattagtactaaaaggggagtaagagagtagaaagaattctggacaactgttaagaattgttacattttgtctacctaggctcgagttcctcacttttaaaattaggactgtactttttggaagaatattgcttgttgttttgtggtgggaccaggctgtgatgggaaaggctgttgtcataggcataggcaggccttttgctttgctgaggtatagtgagcagcccggtgaccctccatgtagcctgcattgcatgcagtttccacagggtccatagagttagtgcaaagctccagcaggcctactcacctgcttttctcatgaggcaacctgggaccagtgtgtccctgtagtaactgtaattttttgttgtgttcacttattgcagtgaaaaaaaaatctgagcgtaaggttctgagtggacctggaaaggggtgggtgttgtagtgagagactgaagacaaaggcctgtaacagatgggtatctttttagcttaatcaagctattgctggagtgttatgcttcagaaataagtctcttggccgggtgtggtggcttatgcctgtaatcccagcactttgtgaggccaaggcaggcagatcgcttgaggtcaggagtttgagaccagccttgccaacatggtgaaacctcgtctctactaaaaatacaaaaatgaaccgggtgtggtggcgggcacctgtaatcccagctactcgggacgctgaggcaggagaatcacttgaacccaggtggtggaggttacagtgagctgagattgctccactgcactccagcctgggcgatagagcgagactcagtctcaaaaacaaacaaaacaaaaaatacaaaaattggctgggcatggtgacacatgcccgtaatcccagctacttggaaggctgaggtgcaagaatcacttgaacctgggaggca

SEQ ID NO: 2353 - DNA, 1302 bp, Homo sapiens
tagctttgtagtataatctatacttctagagaagtgagaagctgatgaaaactggattccctggccagaaaaatgcacagacctgtgatatttggcatactttttttagtgaacacgggaattccttactaatttttttctgtttaattattgcttagtttgatgtgtcttgctttaaatccatttatttcaacaagcttaaagagatttttttttaatggagatgatttaattttaacaatctgtgattttctctgaatcgaacttgtgttttggcacctttcaatctgtggtaacaaatgacaagaagggtgcaattcttccttcccttgtgcagggattttgcctccccctttctcccagatgaaagatatttgggtctctagaataactgtggtacagttagctccagagtgttttctttctggaggcagtttagacaacagcctcaagtagtgcttttgttaaaaatatacatgtttttaaaagtgcttgtatttctaatattcttttctcctttctcttctagtctgttctctggggaggcagtaaggggccgtggagctggcctcggcctcggcatcgggagaggctggacttcctgtctctctgtgctgaatggctgcgatggcgcccgctctcactgacgcagcagctgaagcacaccatatccggttcaaactggctcccccatcctctaccttgtcccctggcagtgccgaaaataacggcaacgccaacatccttattgctgccaacggaaccaaaagaaaagccattgctgcagaggatcccagcctagatttccgaaataatcctaccaaggaagacttgggaaagctgcaaccactggtggcatcttatctctgctctgatgtaacatctgttccctcaaaggagtctttgaagttgcaaggggtcttcagcaagcagacagtccttaaatctcatcctctcttatctcagtcctatgaactccgagctgagctgttggggagacagccagttttggagttttccttagaaaatcttagaaccatgaatacgagtggtcagacagctctgccacaagcacctgtaaatgggttggctaagaaattgactaaaagttcaacacattctgatcatgacaattccacttccctcaatgggggaaaacgggctctcacttcatctgctcttcatgggggtgaaatgggaggatctgaatctggggacttgaaggggggtatgaccaattgcactcttccacatagaagccttgatgtagaacacacaactttgtatagcaataatagcact

SEQ ID NO: 2354 - DNA, 1176 bp, Homo sapiens
agccagcccagccccagcgagctgtaattcctgcctgttacaagtgttaacacctggcctggggccttcctcccccgcagtctccaggtgcctccctgggcccagcccactgacccccacggggtttgactgaacatgttcacaagcctctgaaaggtgggtggaggtgggagtgggtgggagaggcagcaggacatctgacagatggggaaactgaggtaggtcttaggcaggtgctcgagtgggaggatgggtcctgggatggcgagaactcaggtgtgctatttcccagctcactgcccttgtcctctgcaaaacattttcacccaagctgtgaggcagggcaggctggggactcctgggtgaagtgtaaggaagcagacccagatgggtggccactggtcctcagtcacacagcggcagggtgagctcctgatctccagcaggccccctccatctgcacgtccatcgctggaatgtagcaggtgctgggctaggccctaataacataggttcatccccccaccccagcgcccccaagaagaagaagaaagacaagtttctccaccaggagctaactgggactgacaaggggaattcgagaaatcagtgctgttgtttcctgtcccggctctgtcactacctggagaacatctcttccttccaggggtgtcagtctgaggccccttagagctgtcccttctggtcaaccttctgtcaggactggggtctgagcagtgtggactcagggtgtcatgcttgagggtccgcgtggacagaaatcccagctacatgacttcccctgtaaatccttcctggggaatgcatgagctgggtgggccaaagagggcaggccaagatgggcttagatgctcaaagtactggaatctgactgccaggcggggggctgggttggggagtgggggcagaaatgggatcaggaatcagaggcccatctaccctacagccccagccctaaccctgagaaggtgactcaccctccaccccagctccaagaccaaagaaaaacaacctcagagagaagggccagtgactctagtgcctggacagacaggacaagctggtgtcaaggaagcctgtgcccctgcctctctagcttgccatccctggccagctgtgccccctgcagccaccttgtgagacttttgcttcctg

SEQ ID NO: 2355 - DNA, 1232 bp, Homo sapiens
tgatgtcctgattcactttattctctttctttgataagaaactaaaaactttcctatcattcagtaggcttatgcaaagttatactatcataggatttttcaaattcaaaaaaaatccagttccttaattcctaatttatagatcttaacagaaaaatcctgagattcattctaaatcagttctacattctcaaaactctctcagagactcttatagtcagcattcaggaatgaacttgagacttcctcagtccctagttttgaggcaccctagttcaggcaccatgctcagggctgcccttaggctctcaaatgttcttaaggcaccagtgaagcaggggcaccaaaaagactgagaaaaatgcaggtttaattgaagaactcagaattttgcaatcagaaattctggaaacaggttattttactttcagcatacatgtgatttttgtctgtaataatagttaagtagtttgaattacgttcagggagaggttatactagatgtcttccatttgcctttcagaacccctcttcatcccactctggaccccagcgggtgctgacccacatggactgcagcatgaatggctcccttgccctctgacttcagcttctgtttatccaattattaatatccaaagaagatgagaagatataaggaagagatggtcagagtactctggctttctcattgccaggtcacatgggttgtctgtgtccctttagcaaagaccacagctcttaccaagcagccccctctagcttctggctccttctctttgctccttcacatctaggaatagaaagaaaggagaactcgagagctgggtgcggtggctcacgcttgtaatcccagcactttgggaggccgagacgggtagatcacctgaggtcaagaattcaagaccagcctggccaacatggtgaaaccccgtctctactaaaaatacaaaaattagctgggcatggtggcgcatgcctgtaatcccagctactcgggaggctgaggcaggagaattgccagaacccaggaggcagaggttgcagtgagccaagaccgtgccactgcactccagcctgggcaacaagagtgaaactccgtctccaaaaaaaaaaaagaagactcaagctgggtgcggtcactcacacctgtaatcccagcactttgggaggctgaggtagacagatcacctgaggtcaggagtttcagaccagcctggtcaacatgatga

SEQ ID NO: 2356 - DNA, 2064 bp, Homo sapiens
ccaagatcacgccattgcactccaacctgggccagaaagcgagactctgtctcaaaaagaaaaaagaaacaacctgcattttgaaaatctgaggctgggcatggtggctcacgcctgtaatcccagcagtttgggaggctgagactgacagatcgcttgagtccaggagtttgagaccagcctaggcaatatggtgaaaccccgcctctacaaaaaatacaaaaataagctgggtgaggtggcatgcacttgtggtcccacctatggaggaggctggggtgggaggtttgtttgagcctgggaggtggaggttgcagtaagctgagattgtgctgctgtactccagcctgtgtgacagagtgagaccccatcaccaaaaaaaaaaaaaagaaaagaaaatctttcttttcctatcttttctttcaagcctagcttcctttttatagttacatttctgaaatttgcatgtctgtggttaaagccgggttggggcagggactcacttgaatcagtacttatttggggcctggggtgtttttcttcttaagatcacaatcgaagcaatgaaaagtgacattgatgaggtggctttacaagggatagaattctggtccaatgtctgtgatgaggaaatggatttggccattgaagcttcagaggtgagctggggagaactattactctgaatacgctttgggacatatctcatttgtggatgatgttccccttctaggagaactttattctgtctgggtttagagggtatctccattggcagagattttgatttttctgctagccagagcccttcatgaaggaggcacatcagtaatgagggctcacgttcttgccaagcagtcaggcatgattgatcgtaaatagtggtattatcactgtgaacacaagggggcagcaggctgtcgcagtttaccaaggtgatgcctgatgctgaattatttccttttggaagtcctaatgcaagcctaggatgtataattgatactttactaactctggtgaaagagtcagatatggaagagaatggggagttctgtacttgggatctttgaattcaagttttgtttccagcttggtctttacacacttttatttcaggacaaaaataaaaaggttttttttggcatctttaggcaaactgagtgtgtgttgatccaaggaacactgaaatatcaggttgtccatatgaattgaacttatgaaaaaaaagttatacttaatgttgccttggacctatattatatggcctaaaagattctcactgaagtagaccaaaaaattagcactttccaagatcacattgtatgttaccatttgtccttgtatgtttctgtttctgttaagagatccctgttcggctctcattgtatgcctttagtatacagagctcggttgcttttgtctagaatttgctttgtttctcctcaggcagcagaacaaggacggccccctgagcacaccagcaagttttatgcgaagggagcactacagtatctggttccaatcctcacacagacactaactaaacaggtgagttaccttccaaatataggtaggtaagctgtggaaccttactaagagtaaactgtggaaactttccatggaaggaacttcgcagcccatcaactatttgatgttctgttgttgatgacttagaaacagctaagctgcatctataagatcccctaggctctgacttctttgtgaaggagaactgagtcttaacatctcagatgcatcttgctcaggaatgagccacatgctgctctgatttcctgagtgctccattgtccaaactcataaaagaaaggtgctctgtcaaagcttcagtgaagcaaggttaggagcaaagatgtgctggttttaggccacttgcgtatctgttgtaatatccaggatactttcgtgagttcacagggtgtatgtttttaaaattctaaggaagttggatataagttattcagatgctaatgaaggaccccaacccaagaaagaaacccttctactgatcctttaagataattaacttcaattattaagattcag

SEQ ID NO: 2357 - DNA, 1593 bp, Homo sapiens
ctcagcctcctgagtagctaggattacaggcacaagccactacacctggctaatttttatatttttagtagaggtggggtttcaccatgttgaccaggctggtctcaaactgacctcaagtgatccgcctgcctcagcctcctaaattgctgggattataggcatgagccatcacgtctagccaggaaaattggggtattttcttcatagcacttcagacaacctgttaaattgttcacatgattttttaccatttcaaaccattttttcctctataattttagcccatttccaaaagggccattctaaattttaactgtctggagaccataatgaacatagccattggctcaaaggacttgaagatttcattcttggatattgtgttttcaaactcaaaccaggtctgcagacataccggttcctgagttcttatttttggcaagacattgtctatgttcttccctgtccttttcatttgaggctttaagattttcgctgtgttctttacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggaggtgagacctaagagtgcccctgactatgggtgggaattgggtagtacttttgacacctaggtctgttttccagactgttctgtctttttagtgtttaagtatatattttctcagaaagataataaagcttatacaaaaaacattgcaccttaacgttagcattgtttgtcatggtttactcatatatgtgttacactatatgtattatgggttttttgttgctgttgtttactttcctatgttagtattagggaagattattaaatggtcccagcaaaagtggaaggttttcatgtagagtatgttttcttattttctttgtagtcacatatccagagcacatccgatagaatccagttcaatgaccttcagtctttactctgtgcaactcttcaggtatggtggtgccttatgacttaataactccaggttggagaattattagtatctcagtataacaagttcgtgtacacacagaactcgaaaatggtatagatgatgcggatcagaagctgttctcagaaggctttggtctgtgattggttgattgggagaggaattccccacctgccttacctgtctgtctagaaagattcaaatcctacttatttacagatggtctagatgtaatcttgataaaatcaaaccaacttgacttctcctaattcaacatacactcctcagacctctcttcctcactcgtttgtttcaactaatgtcactgtgtagagaaggaaactacttaatgtgtgatggttccttccagatgtatagctcatttgtgttggcagcttgaatggttttggtttttttattttgaaaaccaaaaaactcttggtttttcattaggttattcaagcctagctcagtcagatttggttcccagctatagttcacttggctaaaaataaagccttgaatttgtaccgtca

SEQ ID NO: 2358 - DNA, 1193 bp, Homo sapiens
attggctctttgagtttccctcgcaccctctgatgtaggtgttaataagagcaggtcaatggcacataggacaagaagaaagagtgtcaatccttgaaatgttgacaaattccattcaggcctaggagcatgtaattgtaggagtcagcattattggctctgttgggtatatgtgatctcaaagattgacctttttttccatctgttttcagatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaagaaagaaagttatctcttcccaggagaggctagaagtagcttttctgtcttttggccagtgccgagtggaatgcctggtttgggggaggaggagggactgggttcagctgtggtgctttgttgtaaaaggcagcctggcctttgctactgaggagaaagatggagcctgggtctcaagcccaccttcgctgtacctttgccacatggtactgtatgcttgccagctagaaggagggtcagggattttttacagtctgagaatgagtgtgtgtgagtgaggcggtatccacattttcaacttcaagtcattgcagtttctttttcccagaaaacaaggggttagatgttgcatttcataaaactaaccgaagttttgtttactgatgcagcacaagagatgtaaaaaaaaaaaaaaaaaaaaaaaaaaaaacacacacacagaggaaagacgctctttaggttttgttttgttttttttttttggttttgttttttgttttttttactctagggaaaacactgacgaatggtcagagctcctatcctgatcttttcatcaaggcgcctttcctaataatatggttcaactgtgaatgtagaagtgggggggaggggggagaaaaagaaaactctggcgttagaggatatagaaaaatataagtacaattgttacaaataacgcagacttcaaaaac

SEQ ID NO: 2359 - DNA, 1111 bp, Homo sapiens
gtatttgcaacggcctcccagatcggcgctaggaccccgccagcagacgtctcaatctgcgtggagaagacccagtgcccgccaggggaagcggctgccaggctgggctctcgagcgccgcctgtcgcaatcccacggccgctgcagcgcaccccctcccgtcccctgccctgagcccgcctcgcgtctccaattggctgtctccattctcccgcccctcccgagctcagccattcggagcctggggtgggcggggcttgaggcctgagtggagcgtaaaccctgattggctgtacggaaggcggcgacgtggccgaaggatgcccgtttgtgtctaaacggaggctcggccacaacgccactggattggtggtagggcggggcgggccacagtctccagcctgaagcggaagtggaggaaagatggaggtgtggggacaggagctgggtgtgctggggactggccgcggacccctaacctgtgtctccggtctccctccggaagcggctcaacccagcccatcgctctggccccgttctggccctgcagggtggtggttgggacgttgaaatgagcgcgcgagtggtacgtcctctctccgcgctcacgcccccctcctcaccgtgtttcccgccaggaccatcagcacgtgcccatcgacatccagaccagcaagctgctcggtaggagggggcgccaccgcgcagctggctgtcggggggaggcctgtgcgttgccccctgtgtccaatagccgggagctctgacccctgaaagcctgagtcgagatgctgaccactggcctcgttctatgccccatctgtggccagacctgcttccctgatagcagcgggaacgaaccatatgtacagtctgtttgacctgcgttttctcctttaataacatatgttatcgtatcattcagggacaggataaatgactcgctttaaaaacagtcaaccactgccgggcgcggtggctcatgcctgtaatcccagcactttgggaggccgaggtgggcgaatcacctgaggtcaggagttcgagaccagcctgaccaacatggagaaaccttgtctccatgtctccatgactaaaaatacaaaaaaat

SEQ ID NO: 2360 - DNA, 1375 bp, Homo sapiens
ttatttgggggagggagggatggggaggggagaaagggagatgggtagcatcattttgattaacatttggggcctgataggggaaatggtgaagcaatggaaaagaacagacaactaatgatttgcttctatgtccagaatattttacctttaaaaaaatgtcattggcaccataaataaggactgtgagagactgtttaaaagctgtgaaagtctgaaacctataagccaaggtgttccctgcctaaacttattgctgttcccacaaaggactaagcctgttcataagttaccaaagttgccattttggagatggaaattgacgaggagggaaggtcttttattggagagtatacagtacaagcagatcattctgccttagaggtgctaattcccgaaattagaagaccctttcttttccagtaacgaagttataaatatcagcttgttcatccaagccactggctgaggtgttaggaagaggaagagggtggtagaggaggtaagacagtagggaaagacaagggcccatgctcttagtggggaaaactcttggagccgtttactttgagctttgaacactgaaaccattgttggcagggttcagtcactgacagcacaagtttcactgaattgatccaagagtttagtgatttcaaaagccttggtctcaggagaagattaaactttcatattgggcagtggttcactttaaaacacacacatacacacacaaaacaattttttaagaaatcctaataagtaacatacccaaaatgctctgtcttgagtcatgagaaccatcagttcttgatattgtctagacttgcatctagagctacgttgtaaaattcttttaggcatgtgttagatttctgtgtaaactttgtttaaatgtaaacttcatactacattgtcagtttttgtcttaataaaactatagatttataatccctgatttctgtcttaagtcttaccaggaacccttcttgccttataggttcagcctgttggaaatggcttcctcacttgaatggttttatttcttgaacactgtaggcttgaaaatctagtgcctggcctgaatctttaagtggtcacaccatgttaatttagtaaatacttactgggcatttatcagttgctgcagaggttgtaaagatggtcgcatcatgctgtcttcagtactgccaaaagtttattgagcactctgacctgatagcacttccaaactatggtatatttggaaacatgggtttttaagttaggtttagatcctgcctatggtatgtaatagattatatgaccttggctaaaatctacttctccaaaattttccaggaatttggccctgtgtttgcgcactgatttaaaa

SEQ ID NO: 2361 - DNA, 1156 bp, Homo sapiens
agcaaggttcgatgggcagccccctgtgtgggtatatttcctagcagtgtgctatgacagccacttcccagtagggctaatggagagaaatagtggcttggcagccctacaattgtttgtactcagacttgaaattcattgtgtaatatttttgaaatacatttgtctctgcaaggtgctaacctaaacctaaccaaagtgcaagctctagacctagcctgaacctgaacctgaacctgagccttagcctcactcctaaccctaaatctaaatcgtttccaaaccctaactctaatcctaatctaaacttgaacccaactcaaaatgtaaacataacctgatcccagatcctaatcctcactctaaaaacaatcttaacattaaccctaatccttattttaactcagtcaggggtgattacccctcttcttctcagggaatatttggcaatgactagagatattttggggtcctacaatgcagaggggaaatactagaatctaatccgtaggctggtccaagtgcagtggtgtttacaactaactgatcacaaccagttacagatttctttgttccttctccactcccactgcttcgcttgactagccttaagaaaaaaaaaaaaaaaaaagaggaatctaatgggtagaggccaggaatactgctaaacattctaaaatgtttaggatacacagaacagcaccctcaaaacagaattattcagccccaaatgtccatattgccaactttagaaatgctgtctcaactttcaccttaattctaaaataaactaatactattaaccttaactttaagaataaaccaggcccggcacagtggttcatgcctgtaatcccagcactttgggaggccgaggcaggcagatcacctgaggtcgggagtttgagaccagcctgaccaacatggagaaaccccgtctctaataaaaatacaaaattagccaggtgtggtggcctaaaaatacaaaattagccaggtgtggtggcgcatgcctgtaatcccagctacctggggggctgaggcaggagaattgctcgaacccgggaggcagaggttgcggtgagccaagattgtgccattgcactctagcctgggtaacaagagagaaactctgtctcaaaaataataataataa

SEQ ID NO: 2362 - DNA, 1150 bp, Homo sapiens
gagtgaaggtgctggaaagggagggaggacgcgaggggaaaggcctgtggggagccgagggcgtcagagagacccgggaaggaaggctctcgggtgggggagccaggagacctgctctccggcgcagacaggcggggcccagcgctctcctggacgcccccgcccgcacagctcccggcgggtgctctgaggcctcactactcgagcccacccagcatcccgcgcgcccttccttcccgaggaactcgcctcagcctgatcaggcttcctggtgagaactgaggagcggactcacttgatgtttcctggaagcagagcaaaatgctcttgtccctgtcgcgtctcattttgtccatgtcccccgtgcacggttcaatggtagattcgctgtcccctcagcgggggccttgaagactccctgatcccagacctgtcgtctctcccaccccctccccaaagccactggaaggagcacatactacctagaagtaagaagaggagcctcagaagaaaacaaagttctattttattaattttctatgtgttgtgtttgtagtcttgtcttagctctggacgtgaaatacttcgatgatgatgatgatgatgatgatgataataataataataataacaacaacaacaacaataataaagatgtgaaaactcgacgctcggtcacctccaatcctcccctgccattttttcctctctcctcaacccccagcctctccatctttcctgagccagaattcttcagcaaaggcgagagccctggcccgccgaagcgagccctgttcgactgggaagttacagctgagataaaggctggagcgatcagtcctgcccaggccccagcgctgcgtttccctggtgctgaggctcacagccgcttctccccgtgcagacttgggggatggagaggtgctgtgtccctctcattctctagcctttcctcgtgtatacacagcactaagggagccactgaggcccctaaagctctctggcggagacggagccatagtctgggggcctctgcagcgcttttctgtcctcaccttcgcagcgacccctggtctttggcccgtccacatggccaggttttttcgccagccttggccctccgctcctggcctgtggctctggagactga

SEQ ID NO: 2363 - DNA, 1190 bp, Homo sapiens
gtcgaagcaacgcaggggttaacttttctgaaaacacaattaactttttccaatcctgcgtggggtgggggagagacatatttatttaatcacccgggagtggggtggtctcaatctaaacgttccctcctccctcaaaggcactgagcctgtttcacagatcctacgtaggtggaacaggacgcgttgtgttgttggggggagagaggagaaaggcgaaggagaaggaggaaaaaaaaaaaggttgataggtttgtgcgcgggtccctcgtgcgggctgcgctcctcctgggtgctatttgacaattcctgcctctgccattggtcagtgttggatcagatggttgtatttccttctggccctcactggcacctcgccatcccccctcagctaaaacccaatctcggatatactactaataggcgcggcgctcggactataaaacacaacaaatcataaacccggcggagcagcagcggccgcgcgcgcctcccctcccaatgagttcctatttcgtgaactccaccttccccgtcactctggccagcgggcaggagtccttcctgggccagctaccgctctattcgtcgggctatgcggacccgctgagacattaccccgcgccctacgggccagggccgggccaggacaagggctttgccacttcctcctattacccgccggcgggcggtggctacggccgagcggcgccctgcgactacgggccggcgccggccttctaccgcgagaaagagtcggcctgcgcactctccggcgccgacgagcagcccccgttccaccccgagccgcggaagtcggactgcgcgcaggacaagagcgtgttcggcgagacagaagagcagaagtgctccactccggtctacccgtggatgcagcggatgaattcgtgcaacagtgagtgagacttcccgtcgccgtcgccccggctcccctgggcgcccaccccgggacacagaactagtgagcgccccctgccccaatctcccacagggtgctgggtgggcatctcagttaggagatagaagaagattgggcgccggccgggggtctctcgctgtgtcccctattaggcaggagttacaaagtttgcaaagtcccagccgcactgggagccatggggagcaagtgtgctctcctggggcgcctggccagagccggggttccagga

SEQ ID NO: 2364 - DNA, 1121 bp, Homo sapiens
cctgggactgacagagagacaggtcaaaatctggttccagaaccggaggatgaagtggaaaaaagagaacaacaaagacaagttccccagcagcaaatgcgagcaggaggagctggagaaacagaagctggagcgggccccagaggcggcggacgagggcgacgcgcagaagggcgacaagaagtaggcttcagctgggactgccagggccgcggccgcccgcacgtccgcgggtcccggccgcgccgccgccgcgcgcccctgcccgagagagctctggccccgctagcggggccaggagccgggcctcccaccgcagcgtcccccgccgcgccagtccccgctagtggtagtatctcgtaatagcttctgtgtgtgagctaccgtggatctccttcccttctcttgggggccggggggaaagaaaaggatttaagcaaaggctccctcgccctgtgagggcgagcggcaaaggcccggctgagccccccatgcccctcccctccccgtgtaaaaagcctccttgtgcaattgtcttttttttcctttgaacgtgcttctttgtaatgaccaaggtaccgatttctgctaagttctcccaacaacatgaaactgcctattcacgccgtaattctttctgtctcccttctctctctctctctcgctcgctcgctctcgctctcgctctctctcgctgcgtcctcatttcccctcccaatcctctctcccctctgcaaccccccagctcgctggctttctctctggcttctctcttttcctcctccacccaccccctttggtttgacaattttgtcttaagtgtttctcaaaagaggttactttagttagcatgcgcgctgtgggcaattgttacaagtgttcttaggtttactgtgaagagaatgtattctgtatccgtgaattgctttatgggggggagggagggctaattatatattttgttgttcctctatactttgttctgttgtctgcgcctgaaaagggcggaagagttacaataaagtttacaagcgagaacccgagactggcccggccagcgctcctcatttgctcccgggtgccttgcagagccggtggggagcctgtcaccgggctcctgc

SEQ ID NO: 2365 - DNA, 1215 bp, Homo sapiens
agggacactccaactctacacagctcagcagacatccacacacagtaatggggtgagctcacaaccaccattcagtcaagtgaggtgacactccagttgcagaccatcgcacaccaaatttggcaaaacagccctcagactgtcaggcaagcccgggttctacccctaatgcaaatacccaccagggagatgtctagaggcagactcctgagtgaggtgttgcagcccaaaggctgcagcattgccataccattcccatggagttgccaactattctcaggccaagggccatggggaagatggagcaaacctagcccccaagccggtgggctagaaagtacaagaaaaggcagcacgtggttttatgaagctatcttaggtggagctactccccacctcccaccaacatatacattttgttgcaggaaatgtttaattccgcatgatgtttccctctccttccaacaaaagaaggtcaaactgtgggtcgtagagccttgacaatgttgtcctcctgttcatctgtgcaccacttgacagactgtagcttctcttgctctcgaccggccctgcattcttccgcaccctccctagctctgaaatcaactctcttcggtcgtatccaccttgcacccgcaagtcaagccgccccttgtagaaaaatccctccaccttccgttccccgctaggtcaaccccactgtagacaggaaagccaggccaggagagtccgaatgagaatttattgtgaatcgattcccaagctcccttccgggacaagtggtctgggacagggaggagcaacggccccagcgcgcaacgctctgcgcgttcctccgaatcccgtcggcttctcgacccacgcagagaagccccgggcttggcggctctagccccagcgccaaaggagacccgccccagggccgggcttggcctcctgcttcatgggcctggatgcagatctgcgtggctggtgcgtgcgcgcgcttctgggaaacagtcccgcgtgcaaaggaaaggggcaaaatggcacctaagcatcagatggaagcttactctctgcttccgttcctccccctgctcccctacttctcagtccccttcaatttgtagactcttgctcctgcttctcctgatcctgcaaggggacattccagtagaagttttttgctttgtcggtggctgtcgtgaaattgtgcttgtgtttcgtgatttc

SEQ ID NO: 2366 - DNA, 1196 bp, Homo sapiens
ggaggcagagattgtagtgagctgagattgtgctactgcactccagcctgggcaacaaagggaaactccatctaaaaaaaaaaaaaaaaaaaaaaaagccagacgcggtggcttatacctgtaatcccagcactttgggaggccaaggtaggcggatcaccagagatcgggagttcgagactagcctgaccaacatggagaagccccatctctactaaaaatacagaattagctgggtgtgatggcgcattcctggaatcccagctacttgggcggctgaggcaggagaactgcttgaatccgggaggcagaggttgcggtgagctgagatcgcgccattgcactccagcctgggcaacaagagcaaaacaccatctcaaaaggaaaaaaaaaaaaagaagagatagatttggcttcaaataacaggaaaacacaaaataatagtggcttcagtaagacaggacattatttctctttctcataaacactcaatacttacctggcaggggagataccatgatcctgaaggtggttttcctagggcgaggctcatccattgcactccggatgtgccgactcgcgatttccccaaatgtgggaaactcgactgcgtaatttgtggtagcggtggactgcgtttgcgctctagtaaaattaaaaataaaaaaaaaaaaaataggctgggctcacgcctataatcctaccactttgggaggccaaggcgggcggactgcctgagctcaggagttcaagaccagcctgggcaacatggtgaaaccccgtctctactaaaatacaaaaaaaaaaaaaaaaaaaaaatagctgggtatggtggtgtgctcctgtagtcctagctactcgggaggctgaggcagaattgcgtgaacccaagaggcagaggttgcagtgagccaagatcgtgccactgcactctagcctggcgacagagcaagactctgtctcaaaataaataaataaataaacactcagagattggtggcctagggctagtatgacagtctgctctgtaaaatccttagggatcgaagctcattggactcatggttccaccattcctctaggtccaaaatggcagctacatgtcttgccatcaacctttgctctcatcctctttttatcattttacttgaaaccttcctagtaaaattcacattcatgatttcactgtgttgatt

SEQ ID NO: 2367 - DNA, 1099 bp, Homo sapiens
aaattgtgaacaccttcaaccaggcattttgtctcctttgtttatttgtgtgtctccagcatctggaacaaagtagtatgtgaagtaggtatcaattaaatggttgttagattaattaataataatgtcttgggccgggtgttgtggctcatgcctgtaatccctgcattttgggaggccgaggtgggcagatcatctgaggtcaggagttcaagaccagcctgaccaatatggtgaaaccctgtctctactgaaaatacagaaattagccggatgtggtagtgcacacctgtaatcccagctactagggaggctgaggcaggagaatcgcttgaacccagggggcagaggttacagtgagccgagatcgcaccattgcactccagcctgggtggcagagcgagagactctgtctcaaaaacaaataaaacataaaaaataatgtcttatttagctttgtattcctagtgcctggaacatagtcatggtaacctgcttactgaataaaggaatgagaaagtggtgggacaaacaaagtgtgtgtgtgtgtgtgtgtgtgtgtgtgtgtgtgtgtgtgtgttgggaatgttaacagagtgcttagaacacctgattctgcattcctaggtatggtagcatccatgataattttggtctctaaagcgggtacccctactccaagtctccattcctaaaagtgtattcttagattttaagactatggtgttggtgagcagaaggtggggaaatagaaactggggcaaggattagaaactgcgagttcacagacccctaatgtattcagagctttctttaactctgctccccctttactttcaggagccggaaaattcaaatccgaaatattccaccccagctccgatgggaagtaagtgtttgggggaaactctaaatggagtgggatagtggagcctggaaagtacgtctggactagctggagttgccagaaatgattggggaggtctggggccaggctagggaggcctgggtctcatcctttctttctttttttctttttgagtctcatcctttcttctttttctttctttcttttctttctttttttttttttttgaga

SEQ ID NO: 2368 - DNA, 1112 bp, Homo sapiens
ctcagcctcccaagtagctgggattacaggcgtgtacccccatgctcagctaattttgtgtttttattggagacagggtttcaccatgttgatcaggctggtctcaaacgcctgacctcaagtgagccaccgtgcctggcctcatgtaacccacagccccatctttaggttgtccctatggtgagagacattagggaggtggatgagtgtttcctaagccctaaacttggtaatatggcagaagataatttagggacccaggcagcccaggtctgcttcccaaaaggcccttaaggcagaacttaagtacactcctgcaaagataccccatcagcattagcaccctagaaaggtcacactggacaggtaataatgctcaaacactcctatggctctgtcaatgcccgattgctttgggatgcagggtgtccagtggctgctttgcaagggtcttgggactcagagttaagtgtacttcccttctccattctcctaggtactggacagcctgctggctcagtatggtacagtagagaactgtgagcaaggtaagagtgggccgggtgtggggtggcactcgtggtgggggttggaggagtttggtgcatttgttctgcttcactttgtttctttctttttctcccttccttccttccttccttcctgccttccttcctgcctgccttcctgccttcctgccttccttcctgccttcctgccttcctgccttcctgccttcctgccttcctgcctgccttcctgccttcctgcctgccttcctgccttcctgccttcctgtctatcttgctctgtcaccaggctggagtgaagtggcgcaatctcggctcactgcaacctctgcctcctgggttcaagcgattctcctaccttagcctcctaagtagctgggattataggcacgtgccaccatacccagctgatttttgtatttttagtagagacgcgtttcaccacgttggccaggatggtcttgatctcctgaccttgtgacccacccgcctcagcctcccaaaatgctgggattacaggcgtgagccattgcgcccggcctctgcttcactttctgtgatcaaatctacattgaaaaccaa

SEQ ID NO: 2369 - DNA, 2744 bp, Homo sapiens
tcaagtgtgctgggaagggaggaaggcctctctacatatggaaaagcccatgcgtggagttcccctcctttcaacattgcaacaacagtaacaacaagacaaccgcaacatgtgggcgtagtcaggcaatgctgtgtgcgaagtaaactacctcaaggtatgaagttacctcagcaattattttcctttttgttccccccaaccccattaaaaaaatttttttttgatttttgtttttttgcagcttgctgatattttatataaaaaagaaaagcaaagcaaaagagaagctgatagtcttgaatattttatttttttaatgaaaagaaaaaacaagaaagttatgtttcataatttcttacaacatgagccagtaaccctttaggaactctctatggagaacaggcctggtgggaaaggctttgggggctgcccccttaggaggaggctagtgctaagagggaaggcccaggtttgagagagcccagaggggcagagcccagagccttgtttggccctgatctctgacttctagagccccagctgctggcggctgctggaatatcctacctgataggattaaaaggcctagtggagctgggggctctcagtggttaaacaatgcccaacaaccaaccagctggcccttggtctcctctctttcctcctttggttaaagagcatctcagccagcttttcccaccagtggtgctgttgagatattttaaaatattgcctccgttttatcgaggagagaaataataactaaaaaatataccctttaaaaaaacctatatttctctgtctaaaaatatgggagctgagattccgttcgtggaaaaaagacaaggccaccctctcgccctcagagaggtccacctggtttgtcattgcaatgcttttcattttttttttttgttattgtttcatttcagttccgtcttgctattcttcctaatctatatccatagatctaaggggcaaacagatactagttaactgcccccacctctgtctccctgtcttctttagatcggtctgattgattttaaaagtggacccaaacttagggaattcttgatttagggtggctggtggcaaggaggggcaggggatatggggacgtgactgggacaggttcctgccttatcattttctccctaggacattcccttgtagcccccagaattgtctggcccaaattgaatagaagcagaaaaacatttagggataacatcaggccagtagaattaagcctctccacctgtcccaaccataaaaagggtctcccagctttccatctctggctctatatgctttatcccaaaacaaagcagataacgttcagacgtcggccatttagtaatttaaagcgaatttccagcagcaagcatgctttgatatctggttcagactatcatcaggaagaaaaaaaaatcccacagtacctgaaatgtgattgttgcagtgttcagtttccttgggggcctgctcccttcacaccttgagcccaagtccttttccgttggctgattcagctcccagaagagacgaggaagtgtgtggcaagggactggaaaacttcacttgcttggattaggcaaggctccactcattgttgatatttgcccagcaggaaaatcatgtaagttataccaccagaaagcaaaaggagcatggtttggtggttaaggtttagtgggatgaaggacctgtcttggtgggccgggccctcttgtgccccgtaggctaggtcttagggcaactccttgccctcctgctcagcacctccatttccccatccttggtgagataacaagctatcgcgaaaagcacttgggagatttggatgatttgagaagagtgacttaaaaaaaatgcttctgtgctctaagatatatatgtgtgtgtgtgtgctacatatatatttttaagaaaggaccatctctttaggatatatttttaaattctttgaaacacataaccaaaatggtttgattcactgactgactttgaagctgcatctgccagttacaccccaaatggctttaatcccctctcgggtctggttgccttttgcagtttgggttgtggactcagctcctgtgaggggtctggttaggagagagccatttttaaggacagggagttttatagcccttttctactttcctcccctcctcccagtccttatcaatcttttttcctttttcctgaccccctccttctggaggcagttgggagctatccttgtttatgcctcactattggcagaaaagaccccatttaaaacccagagaacactggagggggatgctctagttggttctgtgtccattttcctctgtgccaaagacagacagacagaggctgagagaggctgttcctgaatcaaagcaatagccagctttcgacacatacctggctgtctgaggaggaaggcctcctggaaactgggagctaagggcgaggcccttcccttcagaggctcctgggggattagggtgtggtgtttgccaagccaaggggtagggagccgagaaattggtctgtcggctcctggttgcactttggggaaggagaggaagtttggggctccaggtagctccctgttgtgggactgctctgtcccctgcccctactgcagagatagcactgccgagttcccttcaggcctggcagacgggcagtgaggaggggcctcagttagctctcaagggtgccttcccctcctcccaacccag

SEQ ID NO: 2370 - DNA, 1230 bp, Homo sapiens
aggcacacacgcatgtggaggcgaaactttagaacggttttctcgtgagctccagccacgtgaaacagtaggactcgcaccgacgcagtcaggctgggggcgcaatttcaaagtctccgttacgcgcgtccctggggcgcctggggtttgaaccgttgttccccacatgctagtccgcttcccttcccgcttggccaaaataccttttctaaggcactccccacgtaaataaataaataaacaacccaggctccgtgcgccgcgcctcctgccctggagctggggttggagcaggctttccctggacccagtccggccccacatcgccaaccccgccagcctgctgcctttccgacctcccagcccccggaggagcgcaggaagacatgatatccccgggaccagaaacgccgggaacacgaaggacgcagaagccctcgccacgccgcccgtggggccccggtccagggcccagtccctcaaacacggacaccgctgccgctctggaaaggccgcccagagccctcctagcttgaggagactcgcggccgccttaagaagccagcaggtcccatggtgtaatggttagcactctggactttgaatccagcgatccgagttcaaatctcggtgggacctcacgagactttttggtcctacaattcctgttttggagaccgcttccggcagcagccacctcgggctgtgtgggtagcctcactgacctggcctacagcggcttggggtccctccccctctctcaagatgttttcatttcagggccgttctgggggtgtcagtgcgcacgcgcgagagtcgggcagaaaaataaatgtgttgatgggagagcgaacgcgacttcaccctggagggcagcttccgaaagaacccgaaggatcaggaggatgctgcttcgggcggggcatagctaggtcggccggtctaggaggtcccaggttgccgagggtgccgtcatgcttcttattggctactgagcaagcgcgatacgttactgctgcctgagccgccaatgaagtggcgcgacagaaccaaggggcggggaaacggcgcctgcgggactccaattggtcacgaacaataacgaggctgcgctccccagaggggtgtgtttttggggtctggaacgcaccctagtgtgtttgtcttggttgtccggtgctcagtgaggttgtctgtgtctgtcagtcagaaaacaggcccttaggctgt

SEQ ID NO: 2371 - DNA, 1133 bp, Homo sapiens
tttatgattgttgaatagatatgtatgtttagttccattattatttcactggaagttttaaattttgagaagatgaagcagagatagaaatccattgcagatatatgtatatttaccccatcttgcaggtttcagttagtaaaacacagaatgataggtcggttttaatgttttaaaaaaaaactaaaaaactaaagttagagaaacctttctgtttgagctactgtatagaaaagacaacttttattgcattgctggtccacatgataaatatttcaatgctgttctagactgtatgagaagtacttaatgaaaaaagggatacattacatttaagaattgtatcagctaattactgttttaaaaaaatcaactcatttggaattcttcggactataaaattgagcaagtaaagtttgggttttaattttcctttgcctgaaccaagataggaaattacttaagagttttttttttttttttttttttttttttttaggaatgaaaggtcataagccattagaaatagtggcattattatgcaataacaacaccctagctaacctgcttttgtcatctgtagcacttacaataaagaatgatgaccttccaaccctggacactacctcgataaagcaaaccagagatcctctctacactttctatggaagccataaaagttgccatcaatatatccactttcatagttctatacttttatactttctagacttttttatagactttatgatcagatctttttgtctcagaggataggttttgcaagattcaaaggaaaatcaaactccttggttgttccagctttgaagcttttgcttcagtaaatttgtttaaagaaccagatcacataccatttatcaaattctttacttaagtcagaatactttgcagacatacatatttggaaaacaaactgtttcttgttcactagatagaatctgtattgtagtaagaaactacttacaaggtggctttctttctgctttgttactctatgtattactcaataatatatgtatggtcacaggttcctggagttgttttatttctttatgacagacacatgagtatgcacctctctctaatcctctgatgtcactgcagcttcagtc

SEQ ID NO: 2372 - DNA, 1161 bp, Homo sapiens
gcagcgcctgctacaaccccctgcactcttcactttggcttcctttcggcaaccacgccccccgactcacggagagcgccgcgcatgcgcagctctcgtctttacctgggctcccggcagtgggcggagtgggagaaggcgggggcggcgcggggagccggcggttatctgggcggcggagcgctcacaatgtggcaggagacagaaaaggtgcgcccgggccggcccgagggctgcgcatgcgcgccgccgctcccagcggccgggatgctgagggggcgggcggagggaggtgtcgggatccccgttgggcgggggggccagcgagggaaggggccgcgggcgcgcgcgggcgcgcgcgtcctcgccgccgctcgcctccctccctgccccctccggcacacacatccacacacgcacaccccctcccctgccgcccgccccgcgctgcccgccccgccggccccgctcgccctcgcgcgctgggaagggagtcgcgagacgtcggagcggcggccacgtagcgctgcggcggcagcggcagcggccgaggccgggtctgaggagcggccctgaggacagacgttgggcagggggggaggggctggcccagccggcggttgtgactcgagcgccgcggctgcaggcccccgccgcagggatggaccgccgaggcggcggccggggcggcggaggcggaggcggccggcccgggtgagtaagggccccttcccccacgcactcgccaccgccgcggcggcgcccccggcagcccttcctctccgccgcccgcggggccggcccgggctccgggggccggcgtaacccttcgccgaggcagctgcgtgcgctaggccggagcagcccccatccggctgggaggccccgggcgctgagctcctcaggcacccagcttgggctgggggcgccccgctcctgctctttcgcccccttcctcctggacccgggcttggctgcagttttgcagcgggtccgctcgccctgaggcctgaggggaggctggggcggcacgggttagcgggccgagaggaggtttgcaccggtcctcctgcgagcgttctcctgccctgcagctggtggcttgcacccactacctcccccgccttgcggttgcacccaaacctccaacccccgggagta

SEQ ID NO: 2373 - DNA, 1176 bp, Homo sapiens
atctttgaaactagatctgcttacattgcccttgatgaaagtgtgttctgagtttcctctgttggggaaacaagtttgagatgtgcaaccccaggcagtgacatcaacattttaataacagagacccattttaagtacggttttatcatatgctttcccagccctgtccatggtggtggtgggttttttgtttctgtttttcctgtatgtttctctcactttccatccagtgttctcagcagctgaaaaaagttataaaagctattggtcagtgtgagatttcttaaaatgtggatgaggaacataaggtgagaaaaacctgaaaactgctatcttcctatcaggatcatgcagagggagggaggggaaatgataatctgcccttcatcctgttttttcaggttgtccacttcctatttaattgcttcctgtttttctatcaacagatcaaggtagtgaaattctcctacatgtggaccatcaataactttagcttttgccgggaggaaatgggtgaagtcattaaaagttctacattttcatcaggagcaaatgataaactgaaatggtgaggaagaatacgtctaactgtaaaaatttttctgaagttgtctgttttgtttggttttatgggacactgacaagaatgtaatttccatgaaggccaggacttttgttttgttcttactgtatttcccagtgcctagcacagtgcctggcacataataggtactcactaaatgtttgttgaactaattcaatgagtatatcagaaatcagcaaactcaagctatagggtaatgtaaataaataaagaaagccagtgttataaatgatatccataaatggaatgactggtgactgcttggcaaactagtgagtgttcttctaaaagaggtgctggctactcagctccagctaactatagctatgcatgagtaagggctgacccttgccagattttctgatttttcaagaaaagcaagaaatctagattttaacataaaaatctctttacttttaaattgcctgcttttaaacaagaaaggggatttatttgcttatgtaactgtattgacagggtataggatgggtttgaaggtagcttgatccagcaagccagtagttagagtaagaacaccatctctgccctggccctgttctccacgctcttgg

SEQ ID NO: 2374 - DNA, 1185 bp, Homo sapiens
ctcaccggggggcggaaggggctgggatcatgcctggtgtccagacctgaccccctaccctcctttgttttccagatctcagaactggaaggaaacttgcaaacactgaggaattccaattctacttaacaggaatcattccatgactggacaataattaacccccctcccattgttcctccctcccctgtcctcaacaccccacccctcccccttccagcctggggacaggtgccccgactccccccacccctccaccccacctcccccagcttcagggaccagagggctcatatcacaggcccccttaagatggcctgggcagacagaggtggctagaagggcagcctctttcttgccccatggggctgaggcacagaggccgagggctgccgagggctggcctggtggtcgacggacacaagcacctgcagatcaaactgccagactttacacactccagcttttgtctctggactggaacggggctggggctctcccagcatctgccaactgggggctgctccctgcccatggggcacctgggtggcccctgggcctcttgacttgagattctaccttctcggcccttccctctccccccatcattgtgccgtctctgttgcattctgaccctcccgcctggggggtgggggcgttgcctcaacacctcccccatccctgttccctgtcctgggagggatagagtccaccccagagcccggaggctgggcctggccctggccctgcactgatttctcatgtgtccttcgggaaaagggggagtgagagtgggaaaaagggagagttcaggacacctggtccccagctccccattgcctggggcagcagccctcaatttctccttgtgcctcccctcttccaggtgccaaatagccataacctcgtcttggaactgttatgtggcctctctggggtccaggtttcctggtcaagcctgggaatgccagggaggaaagggggtctggctacagcgaccctggtcttaggcaaggggaacatttctccctggagagtcaggtcctatcctgtgctgccctgtctgcccagcccagggcgatgcctggaagcctactgacattgcagggagtcagcctcgcccccaccccctactggttttccaatgttttgactggagggcaaaattttactactactcatctt

SEQ ID NO: 2375 - DNA, 1541 bp, Homo sapiens
aactgggggggactagaacaccacgctcagtaaatccagtctaaactgggaggtaggggtattcctgttttctttaggacctcagagatgtaagcattttagcagccacacaaaatctctggctatgaaagggacttcatgaccatccagtccaatataacacttgcagacagagaaactgaggtcttccatgacttgcctagtctcccagctagtttgaggcaaaactggattcccactctggtattctttcttccctttacatcattttccctcctttataatgtcctgagagaccagaactcacaccagaatcgattattcctcaggtgaagcatagactctttcatggtagacagatttcacgactcagagatagaaatctcttgctatcatcaggtcacgggcagctcctgtggagtcctgcccaacttatgtggcttccataaaatggcaacagtccaggctccttgcctaattttagagcattaactccctaattgccagtaagcaaggaggtggatctctgcaaacctacactgtctatgacagctctagttgtacttggtgtgactaaatacctcaaaggcaacctgcttctgcaggttttgaagtgtcagcttcataagacactgaggtttagaattgtttgattctagaccataactgaagggcataaatggaaacaggatatgaagggaaacaagtagcatcatggagctgaaaagtggtgcatcacccaatggctagcacaaacaaggatcacactgtccattctcttgtctgctaaattaagcattttcttgcctcctttgcttcatcttttcacaacagctggatagagggatcagaaatgactgtgtcatggtgctcattcactgcaaactcccagttgcaagctccttggctcccccggagggagcaagaatctcatagttcagagacacagagggccttttagccctaatgaccttttggatgggactgcaactcatgactatcctgatattggaagaaaggactttgttaatcttctcccccatagctctgctgcgtaggtctacatcttactcagaatcactacacattcctttagtcttcctccaagctccagagccattggtacaaatgctttattgaaactaaatacataatacacacaatgagatgaagacaatatagaagtccgcatagtcatcataatcccgttccttggccggttgaggcagctcagtggctgagcccagtcaagccaacccgcagcttcactcacgacttcaagatttgatgctaattcttttggatttctacagttattaaataagtgtctgagtggactgtctttgttcctttgtgttttgagggctggctgggtaggagtgggggtggtttgtctgtggcagtgaatttttgccaggagaggaacattaaatgccaaaggtaggtggcagtatttcagtctctgccccagccgacaggcagagagaccttcacaaataataagacccaagaaagactgggcctcacctaggcttgtgttc

SEQ ID NO: 2376 - DNA, 1208 bp, Homo sapiens
tcatgctcggggagaccaaccctgcagactccaagcctgggaccatccgtggagacttctgcatacaagttggcaggtgagattttggtatttttcccccttttccaaaatctgatttagttgccacaaggatttgggtttccgaggctggaggtagacatgataccatatgcaggttgattttatcggagtttattgttttcctccctcttaagttggcgtttggctttggttgttaacatcacttagtcgtacctctgttacacgaagtgtagaacctggtacaacacactttgctggccagtctttcctgaaggctctcactgtttgcaccagcgtggccgggagggctggatgtggggagggcatttttcagccttaagtgaatggccattgtaggctttttcttttaacatggtctaatgtccatggagcttcagcttttatgctgctgtggctgtagatttctggcaatgggcgcattttaatccttctggtcttggtcatgtgactatctctttctccacccaggaacattatacatggcagtgattctgtggagagtgcagagaaggagatcggcttgtggtttcaccctgaggaactggtagattacacgagctgtgctcagaactggatctatgaatgacaggagggcagaccacattgcttttcacatccatttcccctccttcccatgggcagaggaccaggctgtaggaaatctagttatttacaggaacttcatcataatttggagggaagctcttggagctgtgagttctccctgtacagtgttaccatccccgaccatctgattaaaatgcttcctcccagcataggattcattgagttggttacttcatattgttgcattgcttttttttccttcttttcatgtacactgaataacctgacctaatagagagtgtaaatactataaaaatgatttattttgaggtctcacatacacacaggcattctttgcctgcccttcttaacccccgcatcccttccactcttggcactgagctattcaacaggcatctatggagcatgtgctacgtggccaagactggactaggtgcagaggattcatcagaaatgaaagaaaacatgagggctgggtgtgctggcttgtgcttgtgataccagctacttgggaggctgagatgggagaccagcctgggtaacatagcaagaccctg

SEQ ID NO: 2377 - DNA, 1208 bp, Homo sapiens; identical to SEQ ID NO: 2376

SEQ ID NO: 2378 - DNA, 1202 bp, Homo sapiens
aagcagaggggagggaaggctggatttcagaggtagggaggataaggaccgtgggtgcacgacggggagggagagccaagtcaaggttaatgccggtgctcgggcggatggtgaaagcagcagatggccttgaccggggtagagaactcgagcacaggagcaggttctgtgtgtgtgtgtgtgtgtgtgtgtgtgtaggagcttttggggtcacgggaagtactgagaggtgaggagtgggatttgggacgtgcgtagttgaactcataggacgtccaggtggagaaggaatcacttcctgtctctggatccgtctcgatctctgcctggcgagggcgcgccccggctgggcgtggacactgttctccggccgcgtcgggccgggcgggtggggcgttcctgcgggttgggcggctgggccctccggggtgtggccaccccgcgctccgccctgcgcccctcctccgccgccggctcccgggtgtggtggtcgcaccagctctctgctctcccagcgcagcgccgccgcccggcccctccagcttcccggtaaggcggtgggggcgcatcccctggcgactcctcccgttccctcttccgcttgcgctgccgcaggtgggcccggtctgtgggcgccccccgatttcccgcaggtcccgcgcggcgtcggagcgggagattcccttgcagcttgcgccccgcgggccttcgggctccgcagagggacgccggccctgcgcggggcggaagcggccgggaagccacgtgtccccgcggccgcgcgtggtgggggaggagggaccggcggcgcccacgtggcctccgcgggccccgccagagcctgcgcccgggccctgaccgcacctctcgccccgcaggaccatggccaacctggagcgcaccttcatcgccatcaagccggacggcgtgcagcgcggcctggtgggcgagatcatcaagcgcttcgagcagaagggattccgcctcgtggccatgaagttcctccgggtaactcgcccccgtctccccttccccgctgcagccggctcgcgggtgtttttccctcccggcggcggtttgtccgcgtctgctttccgagttcatttcgctgccgcgaaatccctttgccctctgcccccgcccacggcggcttgggcccgccgaccctttcccggggtggtggggacagacgcccttgggaa

SEQ ID NO: 2379 - DNA, 1202 bp, Homo sapiens; identical to SEQ ID NO: 2378

SEQ ID NO: 2380 - DNA, 1196 bp, Homo sapiens
gtgcttagcgcagaaattgaaaggtggtataaaaggagagtaatatttggtgtcagaaaactttagcttgagtctagatgtccttttattacctgtgaaatcttggtttcaatttgttgaacctttgccccctcacctctaaaaaccaggctagtcctatttacttcccaggtattgtgaatatctcttgggataatgcatgtggggaaagcaccatgagctagaaagcatgggtactaaggttcacctggctgccaatataggggtacataggctgacataaagaaagcagcaggcctgagtgtccactacagcttgattatctcattgctctccatctgttgctttttctctgacccacatttcctttctggaacttagtgggtgttctcactaatgaacacacaccttctactgtcaggaagaaggagtctcaacaagaagcctgtgagagtgtcttaaaaggcttggctggataatgaccaaggaacttgaaccactggtctatcttgttttccccatctttagagaaaaagttcctggacactctggtacatccgattacagaagaaagagataagaattggctctgaggacagagcgaacaatcttttatcccccatcctatcaacggctatgacaattggtatccttcagtttttaagaattactacatatcagattccaagaagctcaggcaataacataatagacaccaatgtctcaaatatccttctggaagagccattgatattttgctaaatgtactaagatttatttcttgaaaaaaataattacagatagggttgaagttctactctgtatgctttctctttctctcccctcccttgaggcatctcatttctgaggttggtcaaagccatttgcaaatatgcttttggttttctatccaaagtcttcacataatatgctatgaggtatcattaaagttatagaaaatgcatctagccctatctatcctttgtaacttgcttttttcatttatcataatgcagatacaattcattcattttaactgcaatgatacaattcattcattttaactgcaatgtataaatgatcatggatttgtccatttgcttacaaataaatagctggatccaccccacttctgccatttttagctattttaaattatgctgcaatgaatatccttgtgtagatctcattgttta

SEQ ID NO: 2381 - DNA, 1181 bp, Homo sapiens
tggatgcagctttgagcagttaaaaactatgtgtttaggccgggcgctgtggctcacgcctgtaaccccaacactttgggaggccgaggcaggtgcatcacggggtcaggaattcaagatcagcctggtcaagatggtgaaaccccgtctctactaaaaatacaaaaaattagctgggcatcgtggtgagtgcctgtagtcccagctacttgggaggcttgaggcagagaattgcttaacccaggaggcggaggttgcagtgagctgagatcgcaccaatgtattccagccggggcgacagagcgaaactccgtctcaaaaaaaaagaaagaaaaagaaactgtgtgtttaagcgttttgatatagggggaaggatggacccgatcctttttgctgaagtctgcagatttcataggccaaggtggaggcctagttgaaaagggggctcagggaagcctggctagagcttggtcaaggaggggatcttcatcagtcgtacgtatgtacatggcacgtggacctgcatagacacgtgtttggtggaggctgtcttatacggattctgcacaactcaagtcccctaatgggaacagacttggggaggtcactcttgaggctttttgtggtattgtggctactgggagacctgaggagggttctggtcactagcagactcatttcattcaccccttggaatctgcccaggacttggacttctgtgtaatagtaacttcacgccccaatgatcctccacgttccttgctgatgctgtgattgctcctccaagttctccacctatgtccatctgagcacttggtatttctactctagtgtcaaaaggtcctgttcccaagtctcctcccaaacatttattccaatttatcatccagatgcccgtcctttgccatccctctctgttccagcaaaggacaccacccctcagggagatgctcacagtggactccttgtcctcatcctgactccccttttctctggcacccgcaggcctcagtgagtctctcggtctctggcagcagcacaggtcctggactcgagcccatctctccatccccccctccactactcccctggtccagctgtcaccattctcacccttgaatgactgtcacagcctcccacctggtcttcctgctttactatgttccctgcaggctgcctct

SEQ ID NO: 2382 - DNA, 1296 bp, Homo sapiens
ggtgctttggagttgtaaattgaggagtgcatccttgctgtcttgaaccattctgtttgcaatggtgagaccttacataacctagccttgcagggccgccacacaaccctggagtcctagagttggaggaacctttgtatccatctgacttctcattttgcagaatatgatgagaaagtagaggatcgctctgttcaccactcttgctattccattagtggggagatgcctgctagcatgtgtgaggggaacactctgatacactgggaagtatcggaaattcccagaaacacaaacataaaataactctcctagacccaggtactggggactgtctcagtccgtgtggcatgataaataaaaggttaggatcaagtctttgtatttttcaagatgtggtagctgattattcctgttttaagtactctgaaattgatctgtgatcaataatactaatatgttatcttttaccgtattctgcctctcactattgattttaattagttaggagtatttgagctgttatttcttgagcttaatatttttttagagttaactctttaaggagataatcatggctgtagacaaggccagggctggctgacgtgccttagaaggtttgaatgcaataaagcggtgtttggcgttctcctgcattgtagtgcgggtacaaaatgctatttgttcgtcatactgttgtcagcagatgagccgcccactacagacggctactgcccagggacctgcccaggccccacccaagggctcccaagggttgagatttctgcagacctatagccagcacacttagtcctgccctatatagagttcctcttcgggaagcttttgataaggaattctcagaccgataggatgtctgtctgggctttgctgcgggacagtctaactgtgggggctaggggaaagcaggagagtatcgatcaaagagtaagccacacacggataatcagttactagggatggaggtgtgagggttcattatattattcattttactgttgtatatgtttgaaaatgtctataataaaaagctttaaaaaaaaaaaagaaacaaaaatagttcaggccagcaatgggccctccatgttcagtggattttatccttgtttcaattggggtaggagttccaggaggtgtggattggaggttgtctaaagaattgaactggcctttgtccctgcttcctgggagggagactttcagtccttgacatttccagggtaataggagtgtctttgttatttgtgaggccatgggatcacacctgagcttatg

SEQ ID NO: 2383 - DNA, 1196 bp, Homo sapiens
tgaacttttgacctctggctccaggtccataaatgtcccgaggttcccaggaaaaggaagacttgttagatgggaaccctgatgtttgattagagcagcttttagtcactactgtcatgtgtttgtttattcaggcaccagttgcatctgagtagtggtaggtcctggagacaggaggcacagcctttactcatggcctcatggtaaggtagagtcatgcagaacatttaacgaaagtatggcttggccgggtgtggtggtgactcacgcctctaatcctagcactttaggaggctgaggcaggaggattgtttgagcccaggaattcaagaccagcctgggcaacatagcaagacttcatctctacaaaaaattaaaaaattagccgggcacggtggctcacacctgtaatctcagcactttggaaggctgaggcgggcagatcacctgaggtcaggagttcgagaccagcctggccgacattgtgaaaccccgtctctactaaaaatgtaaaaattagctgggcgtgatgacaggcacctgtaatctcagctactcgggaggctgagacaggagaattgcctgaacccggggggtggaggttgcagtgagccaagatcatgccactgcactccagcctgggcaacagaacggaactctgtctcaaataaataaataaataaataaataaataaataaataaataaataatcagttgggcgtggtgacacatgcctgtagtcccagctacttgggaagctgaggcaggaggatcacttgagcttgggaggatgaggctgcagtgagctgtggttgcaccattgcactccagcccgggtgacagagccaaaccctgtcttgggaaggaaagaaggcaggaagttagggagggaaagagaaaaaggaaaggaaaggaaaaagagagaaagagaagaaaagaaaaagatttgatgggcaaaatcctgtctttggaaggaaagaggggaggaaggtagggagggaaagtggaaaagaaaaggaaaaagaaagagaagaaaagaaaaagatttgatgtacgccaccatgaaagcaggtagaaggcagaggaatcatgaggagctggatgggttcacctggggagagtactaatgggacatgaggcaccccgcctgtgtgtttggagaactacagcagtttgcaatgccagaaggaacaaa

SEQ ID NO: 2384 - DNA, 1216 bp, Homo sapiens
ctcagtaagcttctagccaggtgattctcgtgcgtattcaatagtccagtgaagtccatctttgaaactctagttaaaacagtggaggaaatcgcatacttgtctgacacttctttctcctcccctctcccctccattttatgttttcttctggacatcctggccttccctgccctgcagagcatacctggatgtccaggcaagactgggcgaagtttctgagtggccctttgtttaggtgatgtcctcagacctggacccccaccagcctcactccccatcccaaccagagatggctcacttcggatcgagggttgactacatctcatcatctcacgaatctgctgtaatataagacaacagcttttaaatgtgtatataacccatgatttcggttttgttttgttttgtttttcttgatggtttccctctccctccctctcttcccattctccttttaaatctctttgaatcacatttggtagtgattttgacttagtccagtagtcacatagctttaatatctagttcaaagctaaccatagtataattgttatattaaggagttattttttcttaaaacatttttttttgcttgttttggttctgttctcacttttaaaggatgctgagatggtaatatgactctccatattttggtaccaattctgagactgtatgaattttcaggtggaactttagcacacactgaagcaaagttgtgaagtgcagggcgggaggtgggcgtgagctttctattttgcgttgtagaagaagtgagatgtagtaagctaattaacagactttctagcagttctttttgtgatgtctctttgttaatctgagtctatctattttcggcaataaggtaaggacgacagtgttttgagtgtcctccttttctataagtgctttttttctgttgaaagaggtgatattataaggttttttgaaattgtgaattctaaaaaagaaatgttgtaaatacaattccattaactacatagaaactattaagaaagagagaatcaaaaatatttttgtgagggagtcggtcccaggcagtttgatgctctgtggaaggaggcgggaagggaacgttggccaagtcagttactgagatgaagatcgcccagctgccaggaccaccccaggacaagttagagcactgtttagctcctttgtctgtgtgatagacctaagaactgtattagtg

SEQ ID NO: 2385 - DNA, 1180 bp, Homo sapiens
ctctttattggttgcaagtggcacgcaggaacagagggagagtggggggctggtgggggaggggagatttttttttttttttcttgaatgtgcttcgcaagccaggctatcttccaaggaaggcagacagtgggagagcagagggactgactgcaggcaagcacattgaagaaagacactggcgggtttccccaccctcaccccaaagcagaaaactagcagacgtcagctcagccccgtcctgggcacagacactacacaaggagacgctggaagttaagcaatactttaatactgtaatatgtttgttttctttttctttcttttttttctaccaaaaaaaagtaagtaaactaaaacacaaaaacatataaataaaatccatccctcttgtcggggacctgcaggggggcaaccttaatccaaacacctggctatcaaataatcagaatgtattgtctcagacaggatttcagttccgggaggcaggggcatgatgggggagggggccggaggctgagagacaaaagttccagagcctccctcgaaggttctctactactgtattctgtacataatgtaccatcccatgtggaatctgtgagtgtcctcttaagtagcgtgggctagccaatctgccgttcatggtgtattgtaaactccgaattccatatgtaataggatgcaagtctaagcgtttcatgtggacataaatgtatctaaataaaactttccctagcactgtggctgacctcacccttacttttatactttagtatgaaactgatgagaactttggtagtgagtattttttttatatatatacatatatatgtactatctatatatatatctcaagcatctttcaggtctttgtgtgtggctttcttaaagccctgttgtaaaaaattactatgtggatggcagtctctcacatcacagatgtggaaagtataattttatatttgtattttcaaataaataagtttgtgaaaggtttccatcctctactgtggtccagaaatcaatgtgtttgtctgacaaaaaaaaaaataaaataaaataaactgttttgaacagagttgtttggtgttctttcacttgcagaggaggtctggggtctgggagagctgttgttttgcttgggcgggagaggatatcatcaaatcgcacctgccac

SEQ ID NO: 2386 - DNA, 1153 bp, Homo sapiens
tgcccatttataggggaagagtgaaaaaaatcaggaggagctccttgagaaaccagctggcaacatgtctcttacgaagagtacatgaaaacatggagacattttataacaaggctggaaacagcagttacactaacatttgtatatgctagaatttcaaccattggctgaagatgatggagacagtgcatttcaaaagaaaatgaacagaatgaaatagacgaaaatggatttatgctcgtgtttcggtgatagaactatgactagattttttttttattttccccttcttttgtatttttcaagagttctttgatgaggtgttttacttttaaaatggaaaataagtatgggtcttcaaattagaaaatccatcaagagtttttgatctaacctcaaaatgaaaagtttttcatggaagtcatttttccagaatttatttcattccactgaaaagtctattggcttggaagttctggatgtgagggcgatctggctgcaacgtctgtcaccccattgatcgtcagggttgattcggctgatctggctggctaggtgggtgtccacttcctccctcagcactccatgtgcgtccctccggaggctgaagaggatgaccatccccgacagaggaggaccgatcttcggtcaagggcatatgagtagctgtgctcccttgctagaacctccaaacaagctctcaggttatgccactggaagtatattaacacatctttgctccctgaaaatgcccatgcttcctgagctttcatctccaaacaggagggatattgagtgggggcagaagcaattatggtatatacagccaactacagactgctgtttacacaggaacaccccaagaaagtcaggataaagccttgcaccagatgacctgatttacctaaaatactgcctctctttatgggcagtcccaggcagatctttcaggagtacccgtcttttgtgttgcagacacagatatgagaggacccagaaacggaggaggaataagagtttgagtatgagaacccatttccttcaagcctgccaaaacagtccagaacctgtgtgctgtgaactgtggaatgagccagggccactcagaagtcctccccacccaccagcaagccctgcaaaaaggagaaacaac

SEQ ID NO: 2387 - DNA, 1207 bp, Homo sapiens
gctgaatttgaagattagagaggatctaatgtttacttaggtaaaggggcataggttttgtagttaagatgaccagacagctaaaagctgtgatgggaagtatggactgctcctatttatagtctcagaaaatggacctttaggtctctatccgtattggcaattattagaagaaagttacacccttttgaaactacaaaagctgtcttggaatttccccctcttctccctatttatgtccccttagaatattttagggagcctataattattttctaaccaaggaaaaacttaagtctctttaagaagcaattacttttcataacatcagattgaataacccaccttgctgttcagcccacatcctactggaaacaaaaggtaagaaacccattttctggttcttgattgtttgggtctgaattttgtttttaaaactaagctaagtttaatgttttttaaaatgctgtttggaatatgaatagattccccgtaaaatgatttttcctaagttttatgctttagtaaatattcagtgctcacgtctgtgcatcatagtgcttgcgtttaatatgatttattgtagaatctcaacttttcttggtgtttgttgtctttgaaacattgtcttggtcattagggctggtgttttcacatttctgtggtcaaggtggatttcttatgtgtgcctttttgcttactttgtatatgaattttgtaatttaaattgcaagtaagttatatatatgtatttaccataaatagtattaaaagatgagaaactgttagactgaagttctgttgtaacataaccattatttccatcacagtatgaagactgcaaacgcagaaaacagattacagtctcttatccattttttgaaatccaaaaactacgaaaacaaaagattttctgttgttgagctaattaaatgtgaaccctgaccagaattgctgccttcattttgcacttagtgtgactaaactgtttcctgttgaacttcattattcattgcacagttgccacagactttgctgagggttttatgtaatacagggtatatatgtacctcataaagtgcatacagctctgaatcccagatatgtctgtctccaaagagttcatataagggattgtaggaactgtactagcatacacaggcctaatgcttttgtctgtaactggggtgtcttgactgaaaaacct

SEQ ID NO: 2388 - DNA, 1515 bp, Homo sapiens
cctccaagtggaagttggcaggatttaaaggatcacatgcgtgaagcaggtgatgtatgttatgctgatgtttaccgagatggcactggtgtcgtggagtttgtacggaaagaagatatgacctatgcagttcgaaaactggataacactaagtttagatctcatgaggtaggttatacacgtattcttttctttgaccagaattggatacagtggtcttaacagtggaatttcaaggtaaggattcaggcaaggttgtccaagtaaattgccagatttctggttttagttacattgtattcattcagcatgtctgaagatagatgaaagcttagatctttcaatggaaagttctgtctatccaatagggagaaactgcctacatccgggttaaagttgatgggcccagaagtccaagttatggaagatctcgatctcgaagccgtagtcgtagcagaagccgtagcagaagcaacagcaggagtcgcagttactccccaaggagaagcagaggatcaccacgctattctccccgtcatagcagatctcgctctcgtacataagatgattggtgacactttttgtagaacccatgttgtatacagttttcctttattcagtacaatcttttcattttttaattcaaactgttttgttcagaatgggctaaagtgttgaattgcattcttgtaatatccccttgctcctaacatctacattcccttcgtgtctttgataaattgtattttaagtgatgtcatagacaggattgtttaaatttagttaactccatactcttcagactgtgatattgtgtaaatgtctatctgccctggtttgtgtgaactgggatgttgggggtgtttgtggttatcttacctggggaagttcttatgtttatcttgcttttcatgtgtctttctgtagacatatctgaagagatggattaagaatgctttggattaaggattgtggagcacatttcaatcattttaggattgtcaaaaggaggattgaggaggatcagatcaataatggaggcaatggtatgactccaagtgctattgtcacagatgaaattggcagtattgaccttatactaaaaggcaggggttaaaaatgattatatacattttccttaaaacacttgcaaacattttattcagttgtctttagctacaattgctttgctttttaaaccttggcaattgtggcaaaattatattgcccattttgtagcaacttattttgctcccttccccccatttttgttttaatagggactaatgtgggaagaactggctaatttgtcacagtgcttagttacaactgttaatgtgtgacctgctgttggtgtacatgtgggtacagggtgtttttaaatccaacaagatagagtataatatcaatactgctaaatctgcatgtcctctgtgtgactgatagagcgttgctatttcatttttttaagacaaaatgaaagcaaaatatagagttccaatgtattggtgtaga

SEQ ID NO: 2389 - DNA, 1093 bp, Homo sapiens
ccgagttgctttcaaagatcctcattcctggagaaatcgaccatccttcaagacccgacctggatgactagctcctttaacgaaagttcgttatttaacttttaccaaacggctggtcactctgttcgcaaaccaccccaagctgggaacgcgggggacttttttacccccttcgtggggagggtgacgtcgcgcgtgcgtgcgcgtgcgctgaacgtagccctcgcagcacccgttgcgctcccgcgcgtgcgtgttgggatcgaatcgctgtttccttccgcttctcttcctctgtctcccccccatatccgtgcgccgagctgataaaggcgccattttggaggggccgcgggagacgtggtgccgctgcgggctcgctctgccgtgcgctaggcttggtgggaaggcctgttctcgagtccgcgcttttcgtcaccgccatgtcgggaggtggtgtgattcgtggccccgcagggaacaacgattgccgcatctacgtgggtaacttacctccagacatccgaaccaaggacattgaggacgtgttctacaaatacggcgctatccgcgacatcgacctcaagaatcgccgcgggggaccgcccttcgccttcgttgagttcgaggacccgcggtgaggcggcatggggcttgcagccttgaggaaataggtccgagtagttggggaaggctccaaggccttaacatagagaacggggaagcgggggctcttagagaggttggggcgagactgtatcgcccatgcaggagtcgagtaaggagctgagttgatgtggcttctctggcgcctcgccttggacgtccccggagcccattcgcaggctggagcgggaaactgaggcgctgagggctggtgtagtggttgggagcctggcgtgtttctgggtgggggaggggccattcctattatgcggcgcatgtgggctcttccacgttgggtgcgcatgtgcggggggtttgctggttcccaactgagcgagcttctcctcctggtgtttctcatcccttttactttctgcgatcccgcagagacgcggaagacgcggtgtatggtcgcgacggctatgat

SEQ ID NO: 2390 - DNA, 1102 bp, Homo sapiens
ttgttgacatataaatggtaaattatatttaggcttatcctgttttgaaatgatggtagtcatctttcttactgctactttcatgttgctttctagaaaacagcatttcattccaaaataactaggatctgcatttagaacaagaatcattatttgtcctgaccttttcagtcctacagagacgcatctgtggttcttttgtacttgccatagatgtaacctaaaaagttttggcatatttaggtcagcctagcggaactttttttttcatttaaatggagctgaataatggagattttgtgtctgcaaaattcctgagatcattgaaaaagtaacaagctgttccttgtttctgatacataaaattattttaagcattttatcaatcattaaaatttactgccagttgtgagtggctttttaattaacttgtctttcattgcacttcactctgcctgttttcaaggggagtaagattggtaacatttggggagactgtatctgtctacttagcgtggctgttttgagggactgtcccatcagtgaacaaactgcatggccttggagagagactctgggctcttggctcagatgtgttcatcaaatactcctttcagagctgttgtgggtgtaagtgacatgatgtggccaaaaatccaaactgtgcagttgcgttgtgacaaacatgcaatgtgctgtaaaaattcaatacagtttaaataaaatctctatattagtgctgctttgttgggtcgttttattttcatttctaaaaaaacttaatattcacttattctttgaccatgagaagagtagaacattgtacccctttctcccagcaatttccaatttatttattttgagatggagtctccctctgttccccaggctggagtgcagtggtgcgatctcggctcactgcaacctccgccttctgggttcaagcgattctcctgcctcagcctcctgaacagttgggactacaggtatgctaccacgctggctaatttttgtatttttagtagagacagggtttgaccatgttggccaggctggtctcgaactcctgggttcaagcagtccacccagctcggcctcccga

SEQ ID NO: 2391 - DNA, 1099 bp, Homo sapiens
atgtaaccaaataccacctgtacctcaataacttacagaaaactaaaataaaaaaaagaaaggcttgaactattgattctcacacacacactcacacacacacacacacacacacacacacacacacacacaaaaataaatagaatgaaatatctggctgagtgtagtggctcatgcctgtaatcccagcactttggaaggctgagacaggaggatcttttgagcccaggagtttgagaccagcctcggcaatattagtgagactgtctctacaaaaaattaaaaacaaacaaaaacttctgaataaaatatctaagcgtttttcaattcagaaaaaacttaacagtttagaaagctttgtgttaacattggtgttttttttttcaggaaacaaatgaaaacgtattttttttattctctgttgttttttgttgttgttgttgttgtttggaaacagagtctcactttgttgccctggctgtggtgcaatcttggctcactgcaaccttcacctcctgggttcaagcccagcctcagtctgattctctagcctcagcctcccaagtagctgggattacaggcacccaccaccatgctcggttaatttttgtattttaagtagagacttggtttcaccatgttggccaggctggtctcaaactcctgacctcaagtgatccacccaccatggcctcccaaattgatgggattacaggcatgagccaccgcacgcagccccattctctaccttattctatatagttttactacattttaatatttttagatataaatgtagaaattatagttttagttttaatggttcctgacatttttttttaagtttattcagagcaaatgaaaactgcttttaggccaggcatggtggcttatgcctgtaatcccagcactttgggaggctgagtgaggcggatcacctgaggtccgaagttcgagaccagcccagccaacatggtgaaaccccgtctctactaaaaatacaaaaattagctggatgtggtggtgggcagcgggcacctgtaatcccagctacttgggaggctgaggcagggagaattgcttgaacctaggaggcaga

SEQ ID NO: 2392 - DNA, 1320 bp, Homo sapiens
gttaacccttgatgtctagagattgggggctggtgaagggggtttggcttcaatgactggataatgatatctttcatgagagagattataagaagaagggcagataatatatgaataaagttcagccaaaaggatcaaatgagaataaaacgatttaaatatatgtacacacgcatgcacacacacacttagtcttgtaatttcaggccagaaattctcaacactattttgcatctgttttctttttctaagtcatgataatatagatgttctggtctatcataaaagaatgtttatgtacatttcagtcattcggtatgtggctttgtaaattaaagtataggcaaaacatttgtgttatacatgatatataatttcattttgtaaatgttgattgcacatgtggtcacattattgttgagactgcttttatgtgacctgtagtctcccacagaacctaaagtaataagctggcttttctgtgatagccacgtttgcgtatttctttccctatttcccttgcctgctaatgttgaacagcatgaacttgctttctgatgctgttttagactgtccctgttgtatctcaataatatctttgttttccttcagcctttattactataattgttcattctacatgaaagctaggaaactgaaattagaagagcacttatctgctacttgccagttttgcgtgagtgtgttatatgtatgtgtcaatttccctttaaaataactatttattttaaaataactattggcaataaggaaactgttcaaagtagaggcagatcttgatagaaagatgttaatcacagggttgtttataatagcaatatacatacacatttggctagtactaggtgaataggaaaataaatcatgctgtatgtatacaataagaggtcaagttgccaataaattattactgttaatgttctgggaaatgctgaaactatgctaagtgggggagagggaaagcaggtattgcagttttgtagtgaagattgggctttggagtcatatctgagatgtaagtagcagcttttaaattctagctatgaccctgtgcagatcacttaacttttgagtgtcaggatgtttggaaggacaagacaggaaagtgttttaatacagggttcagtatttagtaagccttcaataagtgatattacatacatgtaataaaaactaagcattgaaaggactaggaaaaatgcatcaaatgttagttctgcaggttatagaattatacttttatgtaattttaaaatttcagttatgaacatgtttgtccattaacaaacttataatagc

SEQ ID NO: 2393 - DNA, 1295 bp, Homo sapiens
acccacctcggcctcccaaaatgctgagattataggccggagcaactgcacctttaattttacactttggctgggtgcagtgcctcatgcctgtaatcccagcactttgggaggccgaggcgggcagatcaggagggcaggagttcgagaccagcctgtccaatgtggtgaaaccctgtctctactaaaaaatacaaaaattagttggcgtggtgatgcgcgcttgtagttccagctactcagaaggctgaggcaggagtatcgcttgaacctggagagcggaagttgcagtgagccgagatcatgccactgcactccagcctgggtgacagagtgagactctgtctcaaaaaaaaaaataagaagtttaaaaatgttaaatagaaaaaaacttacataataaggatataaagaaagaaaatatatttgtacagctgtaaaatgtttgtgttttaaggtattattacgaaagagtcaagttttttaaaatttaaaagtttataaagaagttacagtaagctaaataggtattttttaaattttattatatttttaagagacagggtctcactttgtctcttaggctggagtacagtggcatgatcatagatgaactcctgggctcaagcgatcctcctgcctcagcatcccaagtcactagaactacagggatgtgccactatacctccctaatttttaaatttttttcgtaaagatgagatctctccatgttgcccaggcttgtctccaactcctgacctcaagcaatcctcctggctcggcctcccaaagtgttgggattacaggcatgagccaccgtgccaggtctatttttaaaataaatttcatgttgcctaagtatacagtgtttataaggtctacagtactgtatagtaatgtcctatgccttccattcactcaccactcactcagtgacaccaaaagcaacttccagtcctgcaagctccattcatgataagtgccctaatgcaggtgtcccatttttatcttttatatcatattttaattgtaccctttctgtgtttagacagattcacaagtacttaacactgtgttacatttgcctgtagtatttagtacagtaatgtgctgtacagatttgtaaccacggaacaataggctatactctataacatagatgtttaaataccatctagatttgtgtaagtgcactctgtgatgtccgcacaatgacaaaattgaccatacatttctcagaacatacgcccattgttaagtggtgcatgactttataatatttttatattatgtgt

SEQ ID NO: 2394 - DNA, 1567 bp, Homo sapiens
acctgtaatcccagcaggcatgagggaggccaaggtgagtggatcacctgagctccggagttagagaccagcctgtccaacatggtgaaaccccatctttactaaaaatacaaaaattagccaggtgtggtggtgggtgcctgtaatcccagctacttgggaggctgaggcaggagaatcgctcgaacctgggaggcggagattgcagtgagtggagattgcgtcattgcactccagcctgggtgacagagtgagactgcctcaaaaaagaaaaaaaaaatcattttcttgtctttggtcgttcagtatctcttctctgcttctgtatttcctaggaacatgcttttgaaagcagccagaaatataaagaaggcaaatacatcattgaactagcacacatgatcaaggacaatggctgggactgattggacagcatctacccaacccagtgtccacgtgaacgccattcaaccgaacattcttcccaagcgtgagagagtgactgacacttggttccatccatttaggggccttgccatccggggcatcctcccaccctgacgccatctttctggtgaccggcctctaaatcgctgtctctctgtctctttgctttgtatctgtttgtgagttgatcctggcttctctctctgttctagttttggctgaaaacaaaacaacaaaaggaacagatccttgaccgcatggcggcagcccaccttggtaagggccccagggcccatgcgagagctgcctgatggcctcttgtcaggagagcagtggcacgggggcgtgaggaagagggaaaggggaaactctaagggtcctggcgcggggaaggggtggaagggtggaggtaggaacaaaattgcgccgctcctggagacctgataacttaggcttgaaataattgacttgtctaaaaggacaaagagaaaaaaaaaatacctcatgactgcattctctctgactagaagcttctgttcctgacaccaaatgtgccaggttagcaaatgagcacaagatgtggccctgattctagttggtggggcaagggcctggttctcctgggctgagtgggggagtgtcctggcagcagcgagtgacctgggcagtggccaggtgggtgcgatgactctgatgcctcactcagtctctgggcaatcatcatctttgcctctagccaccgtagataaggtgtgaagggactgctgtttgcaatgggcttaccatccaaatatcccaaaggctttgaccagcaaccaagtaaaatcagtaattgaggagagcagggcacaaaggggctgcagtttgggagctcctgaagaaatggctcagatattgagtcagagaaataaaaagtaggatcagttagcaattctaactgcccttccttctgacccctcataagaggagtgtggtgagggaggggactgggtaggggtcatcccaggaggaggggtttacattggaaccagttcaggttcggtgcatctttcctcttcggttttacagtggcttccgtgggatcgtcaatttcttgttcttagagtttcgggtgtttttc

SEQ ID NO: 2395 - DNA, 1199 bp, Homo sapiens
tgtgaccatttatttcagaaggctgaacataagaggtttctactcagcaatacttagatgtctaactgtttaattgctacagagctttatagatatttagagaaaagacttaatcaattagtaaataaaattgcctatggcaggattctttcttgaattaatattaatccttaaattgatttttctgggattatacaaattcctttttatataaaagtatattgtttaaaacagtagctatagccattaaccaaaggacagatgatatatatatatatgatatatatatatatataagttcttttttagctgtacctacgtacttatatcagcaccatgtatgtaggtgtgatagtactttcaaacagcgcctccacctggcctactctgttatttccacctgtttgggtagggccatttaacttccattatgccaaacttgggatgggattttcgaagcagacaacactatttcatcgtgtttcaaattggaaccttgaggctagttagtatcacactcaggccacactcagcacttgcccactcttgtttactgccttgtattctagttatttgtgtatttgtctccctcactagattatacgctccttgtgggcagggactgtgtcttttttcatctttgtatctttcatgcacctagcatagtgctttgcacatagtagtcactcagtgtttgttaaataaagctattagtgtcattaaaattcaaaagacagtataatgtgtgtttttagatattttgtgtaaaaattaagaatctaaattttttatcggtaactcttctagttatttcctttggaatctagttttatgttcaataatagaaacttgaaatctttatcaaaaatcacaaggacccaaattcatgtatttgtccctaaagtaaggtgagtgatgatggtttctctaaacctttccagtgttttaatttgttaatttttttttttttttttttgagacggagtctcactttgtcgcccaggctggagtacggtggcatgatcttggctcactgcaagctccgcctcccaggttcacgccattctcctgcctcagcctcccgagtagctgggactacaggcatccaccactatgcctggctaattttttgtattttttagtagagacggggtttcaccgtgttagccaggatggtcttgatctcctgacctcatgat

SEQ ID NO: 2396 - DNA, 1371 bp, Homo sapiens
cttctttttgtttctaactataaacttggatcacctatgttaaaaccttatttcacattccacatcattttagaatttattttcgaaggggaatagtttcaatgttttattcacttgggctttttttcttccccctctttctttaaagaactgctcaatattcaatctgttgtgaagaacctgatttgcactctgtagtgtttaaagaaacaaagaaactctaatattgaatctcttaaatttagtgtatgtaaacagcttacaaatacgtattgtctaaatgcatttaaatctgttttattcaaagaaaagctaaagcaaaaacactggcatatgaccatgcaagactgtcagtgccaacaaagacaacactaatcagcacatcgtacactggattgcagtgcttcccagattattgaaaaatgttacagacaacttgcctgatttttaaatgagcgtaaaaggccctctaacctatgcaggtttccccattatgcatatagaaaatgctagtatgttttgctcacttcatatgtaacaggtgcccttatgttgtgctgtatcctgtgctttttctgtgggaccattccattcaggagcaaagagcaccatgattccaatcttgtgtgtgtttactaacccttccctgaggtttgtgtatgttggatattgtggtgttttagatcactgagtgtacagaagagagaaattcaaacaaaatattgctgttcttcagttttgtttgtggaatttgaaattactcaaatttaaaataaattactggactgtggaaataacatagaattgaagttttaattaaataccactcaaacgaaaagaacagtagtttttgtagttttatattggatactgaggcattagggaggcatgaaaggaagaggaatgaggattgagacatgtgaagacattgtgcattatatcaatgtgcattcctgtagttcattaacaaggtacatgcaatagtctaaagaaccagagtcactactatagtggcttaacatttaatctgtctccaatattttaaccaagtgacaccgaggtttttatcgaagcatttcacttaaatgaacaaatcatggctgttatattaacttgaaataaaatatatttaaacatgtagttaacatgctctttctcatcatgaattataaaggtgcccaaattatgggtatcttgatttttttcaaaaattggttgtgtgaatccagctcttgcttatggctgagaatgttcctaaagttcatttcactatcccttaatcctcaatagctacacatacccccttgcctagttagtcttgcactgctttacaactctcttaggcaaattacctaacataagctccacaga

SEQ ID NO: 2397 - DNA, 1190 bp, Homo sapiens
cttagatttatgtatcaacagttgcagcatcttttgtagtatattctatttttatataataatgttaaagggaatatgaaagaaaactgtaaaaaggtaaaatgataagattaattttgagtacacagtagtatgatatttaattgtaaattagaaggagttagactttatagtgtgttaacatttggagttactagtgcttgatatcctccttctgtggacagattacctccaaatttcaatctggaagatccctgaaataactactaggaaaaggtttacaactatatggcttttatatttttactatttgtattagaatatctatataaattgttcaatagaataactaaattgttcaaattttggttataaaagaaaaaaagtgtaaacacatcatacatatcatgtggcttattactgtgatgttattcctgtattcagttttattcagtcacagctacacagcagaagtttgtaatgtattgctggattttattttgctgtattagctcctcaagagttactgatctatgaaatggcagagaatggaaaaaattgtgaccagagacgtgtagcaatgaacaaggaacatcataatggaaatttcacaggtaaattttgatggtttgcagggaggagtgctatgggtttaaatgatatacttttcattggaataaaatagagatatattacttcttttatttttaatcttatattatcttcttagtaaattaaattatgggtcagtcagggcctgtaaggtgatatttcacagtgatggcagaaggagcctggccacaatcacataaacagtgttccaagtacaagattattacttgttaatcttatagtatggtcagtgtttatttggctttgctcagtgctcaattttattgtgctattttgtaattctagaagtagattataaacttactacactgttcttaaatatacagttatcaaaaaagttagaatgtgaatattatttaaaaatttattttaaaattatcgtttgagatgaataaactcatattttaaccaaattggaatttgtggtaaatttcagtgtatttgactcctgtttatacagttaccctgaaaatgatgacttttattaatatggatgatttaagtagaaactttccttcatgcatttaaaggaaaatgaaaaaaaagttttacttttg

SEQ ID NO: 2398 - DNA, 1229 bp, Homo sapiens
ataaatgtttgaggtgatagatatcccatttaccctgatttgatcattacacatgtatacacatatccaaatatcacatgtacccccaaaataagtacagctatgaaaaccccaaatattaaagtatctgattaaaacctcaaaaataaagagaactttctatactctgtaaattccctctgctagcagtcctgttcgcctgttaacccatttatgccagaggttgcaattttttaaatttttgcatgagtgaaaaatccgaccttagcaataaccttgagcaataggatataaataactcccacatgcttagcgttccaataatggaacactaggcataagtgggttaaatatattcaacttatgtatttaaaattttgtcagtcagggtacctgtacctttcatgagagttccttcacttccgtagttttgaaaaaacctctctatcctgtatctttctctctgaattacatatctgtggttaaattgaaaagtgtttgtgtttgtttcttttgccattgcatagttactctgttcatggacccaggcatgaagaatctataatgaacataatccggaaggaagtggagaaatgtgactctttcagtggttttttcatcataatgagtatggctgggggcacaggatcaggattaggagctttcgttacacagaatttagaagatcagtactcaaactcattgaaaatgaatcagattatttggccttatggaactggtgaggtatggacatgttaattgaaaagtttatgttttatgttctttgcaatagaaataaatatgggtaaaagattgctctcaccacccaggtgcggtggcttatgcctgtaatcccagcactttgggaggccaaggcgggcggatcgtgaggtcaggatatcgagaccatcccggctaacatggtgaaaccccgtctctactaacaatacaaaaaattagccaggcgtggtggcgggcgcctctagtcccagctactcgggaggctgaggcaggagtatagcgtgaacccatgaggcggagcttgcagtgagccaagatcgcgctaccgtactccagcctgggcaatagagcaagactccgtctcaaaaaaaaataaataaataaaaataaagattgtgctcaccctttcattggaaatgttaagttatggcttccagaatggttatttaatatgagtaccatattatatatggtatatatatatcttc

SEQ ID NO: 2399 - DNA, 1162 bp, Homo sapiens
acgcctgactaatttttggtattttttgtagaaatggggtttcatcatgttgcccagggtggtctcaaactcctgagctcaattgatctgcctgccttggcctcccaaattgctgggattacaggcataacccaccttccccccagccagaatcagtttattcttgctgtttgtttgtaacaacaaacataaacatcagagagactgataatctatacaactatagatatagcacagtgagccttgactacaactgcatgctgctaaagacagctcaatttatgctaatctgggctgtaggtagacttggcaattcactcgtaccccaaaggagcaaccagctgacccagggtatctagaaggtggtagcagctgctaatccttagatgtctacagaataatccatgaggtagttaattgtttcaaactcttagaaaatgatgtatgaacaactgaggctcatataaacattccagattatactcctccacccaccttttttttttttttaaggagaaatgatatacttaactgaatatatcatgggaatcagtgtctcttccttcctctcatcaacacctcctcactccccaaaacgtggattctgatctgaattataagtcacaggatagaataggggagcgatagaatagttaacttctttgatttataaggttgagtgtatcagatggttctgtgaaaataaaggccatacttcttctgtatcagagtgtagtatatatttacatttgaatcaataggtcattgtgccttttctgtgaaatgaacctcaaatactagagtccctgagattgttgaaccacttgttatgacagtccagtaaagaaagctaaacttgaactgaaatgatctttgtgtaaggtggtaagttttttactttctggatcagtgatgattgattcatactatctagcaattttctttctttcccctaattggtagcattgggcagaatgagctaccttgttataatgagtttctgagaccattttaaggactcttcacagttcactgtgataaaagctatatatttgaagtactgtctcacacctttgttcaaaaggtacagagtatgtttattggggtctgtgtacgtaaactagacttcataaaacagttttcccaggatttttctttttca

SEQ ID NO: 2400 - DNA, 1236 bp, Homo sapiens
catctcaaaaaaaaaaaaaaaaaaaaaagaaaaagaaaattagtgttgacatgtcagataatttgatcttagagcttcatctgcctacctaagagagtacttagctttaattttttctcttcataaaatgacatatttacttacgaatattactaattgtgagggtagtatgtttcaaatactggcaagactaaatggaaagatcagagaccaagggatcaggaaaaatgagccatcctttcttagaagtggctaaccccagatttgctgattcactggagcatgaataatttgattgtgtctctgctcatggaatcttaccagtctttccccgctttaatgtgtcaagctttattcttctatgtgtaatctcctaaaaaaatgtaaatggggaagaatggtgaaatcttttctatcattattacattacataatgtgtatcttcctttttgagaactatgaaggagcagctattactattcacatgcagattttcctatttagttatcacgtaactttagagctagaagatactttaaatcacctttcgtgcctctctcccatgggctttggggggtccctgttctccttagccaaggctggaggccaagagcagccctcgaggatcgtcgtcaggactgccacgagtggggcagccttgttttcctgcctcagacatgtgtagttgagtgggaaataaaaggaatgaaacacctctcttctctgaatttacaaatgaagcctctgaggtccttaggttttataattgcccaaagctgtatcagacaattattttattactttatctagcactctagagctcagtgtcctgagtcctgccttagtacctaatctgttgctccatgctgccctctatttttccaaagctagcatttcagtcactagtgaaatatgaaattgacataactgttaattgattcttgtaacatacctatgtacagggcataaaaagtagtagtatcatcaatagagaaaaaggtgaatcttgacccatattttagaacacataaactatttatacaactcacagggaatcctaaaatctcaaaataaaattctcttatattaaaataagtacctagtccttttgtgaattgttgactcagaaaatgaggacatttctctctacaggtgaaactttacctatttagaaatctatcttctgaaaaccagggttctaggataattttgaatagttccagacccctgaagtca

SEQ ID NO: 2401 - DNA, 1130 bp, Homo sapiens
ttgtgtaagcacgctgatgtctgcacaatgatgaaatcacctaacgatgcattcctgtcatttgtgatgcataactgtagtttaaagtgttaatagcttgaccaggatttgttaaatgacaaccagctccttaattttccttggcattttccttctcttagaggagaccactttgtattcttttagttgatctttggtatttggtattgatttttcagtttcagcattatctgttgacttcccacttctgagcatgagaatttagttgtctctcccttccttccaccttagccacttccccttcccctctccctgttacttaatcctaccgcaatagttatatggtaattttagataactgttaaatgtttaccttatgagcatatgcgtaggattcacagctgaaattaggtagtaagttttgattacttttctagcacaatgtttgttttccttggagctgatgactgattttatttgtgtttgcttagtattctaagtatttatcactaattcaaccctgaacactgtcacttgcctaagtctcctttcaagactatgagttgttggcagtttattcttctaatgtctcatgtggcctttttacttacatgaaaggagcttgcaggactggtgcttcatattgtcagtctttcagtttagccatcctgattgttggaaagtagtatctcaatgtggattaatctgcatttccttgactaagtgatgttgaacaccctttatatgtgcatgttggccatttatacatgtgtttcatttaattttttttttttttgagacagaatcttgctctgttgcccaggctggagtgcagtagtgcagtcttggcttattgcaacctccacctcccaagttcaagcgattctcctgcctcagcttcctgagtagctgggattatataggcgtgtgccaccgcacctggctgatttttgtatttttagtagagacggggtttcaccacattggccaggctggtcttgaaatcctgacctcaggtgatccacccgccttggcctcccaaagtgctgggattatacgtgtgagccactgcgcccggccatttaatttttttttttttttttttttttttaatttttagagacagagtc

SEQ ID NO: 2402 - DNA, 1139 bp, Homo sapiens
cctttttaattgcttatatcacaatttaatgcctatttatttatttatttattgagacaagagtctcgctctgtcatccaggctggagtacagtggtgtgattctcggctcactgcagcctctgcctcccgagttcaagcagttctctctccacttagataaggccttctgtcaacccccaattgtttactaattaggtagtgttgctttttttttgacatggtatttatacttacttttcttcacattacattcatttggttatactgcctattccagtaatctcaaaattttccactttgaatctaccctaattcctctctgaacaggaattttggcttatgcatctttgtatttgaaacacataagacattattttgtaataatgtagtcttattttattagtgatttaatatactgagctatcttagttgttgtattttaatcatttagattatttatgtgaactctttatttttagtgtaatgaacaagtctggggtgaatcgtgtagtttggaaacgacctcgactcactcacaatggacctgttagaaggagcacagttattgaccagattccttttctggcagtagcaagagcacttggtaagtaggacttaatttggtgaaattatattgaattttctacaatatatggtggcaaaataaaagaggagacagaactaaacccttacttggcatatagtgagggtagagatatcatgatattctattaactgctttagaacctaatcgaagccatgcatggtggctcacgcttataatcccagcactttgggaggctgaggtgggcggatctcttgaggtcaggagtttgagaccagcctagccaacatggtgaaactgcatcttcactaaaaaatacaaaaattagctgggcatagtgatgtgtagctgtagtcctagctactcaagaggctgagtcaggagaattgcttgaaagcaggaggcagaggttgcagtgatcgcatcactgcactccagcctgggcgacagagcaagactctaaaaaaaagcctaattgaggggaaggtttaggtatataattcactgacagttgccctttgttcatgagtcacgttcaatgttttgctaatttctatctctgtttagggaag

SEQ ID NO: 2403 - DNA, 1148 bp, Homo sapiens
ttgttattgctattcctgcggtctttgattctgacccatttttagcttctgtgcatttacttttagttaatctgtttgatttgaatacactgttcagttagtctcaaacactttcttagcatttatcttcaaaccttaagtgtaaaaatgagacagaggcttagaggtgtcctcggaattttagaactaacggtttaatttcctgactcttagagtccaaatgttttcttagattgatgtggattggtttaacgtaattggaagtttgaaaggtacatgtttctaaagcttttaagataatgatacttagaaatcactgattgttccttgatgatgaatgcctttaatatatgtttacaagctccaaaacttttaatatatcttaccatactctgattactagaaatatataaatgaaaccaacatttctctatcctggaaaaaaagtgtccagtagagtctgtccttcctgagcttagttaaagcaattcttgtatctttgttttatattttttaaccttttccaatccttaatacatttgtggtcttactgggatatgccaggaagaaatttcttccttctatttcttctccctctttttagctgtctactgtataccatgtagaaccacaaaatgcatgtttttatctgttctgttgtgtagaatgtatatgctgccagccagccttactctttcctctctacactgccacagctacaactgcttccctgtcaaacattagaaaaacacaggtgggcacctagtgcatggtgttacagtaaagacaactcgacatcatactgactacaaattacctcccctagtttaaaggcaaatagtagctatcacaaccaaatttagaatgtgacaccattgtttaggtgtatgtgattcatttttattatctaatcacatatttttttcccttctaatttgtgccctgactgcaccttgtgaaaggttagaactgggataataactgtgatgaacaagttattcaagaaatacttgcaaggtggacaatgttaactttgaacagtgaacacaaagggtaatgaattactaataccatagttcccttctcaaacagcagtgacagcttaattttgataggatccctatgatctttgtaagcgtattcatgcc

SEQ ID NO: 2404 - DNA, 1241 bp, Homo sapiens
ttgtttttaattcaatttgcaaagcctctagcagatagttctgaaacctttgtgaacgctttctgtaacttatgaagcttttggaaatttggtctagtgatgagtaattctttctttctgacgttaatcatttgcattttatcagtggctccaagattaatataaaaagagaacttcatttactctgagtgatcatgtttcaatgtgttaatgttttaggagtagcagaggataacatgcaactgttaagatctagatcatgctaaaagtattaaagttggctttcagagattagttttttcctacttaaaattaagaacttaaagattttaatcaagataatcctaaaatgtcttaaggtgcaacttattctggagttgataccagttggaatagtaaagaccaaaggagaaattgtgagttaatgtttacttttttattactattttaatcaaatggctttacaacttgaccttttaaatgtgaatatatttttttaaaagaacactcaggtatgtgaagccataattgttgtgttggaagttctcagccctaaaagttctgcacttgaatgttaaatatatgtgtgataaaaatattttgattggggttttctgtgtgggcatttacattctcctggtgacaggtgttttggtgaagagaaaagcatcttgtagatgtttgagatctgtaaccatgctgtctcaacagcagcagcagcagcagcaggaggaggagctaccatttattgaatgcctgctctatcataggcactcctctaggcactctacagacataatttcttctacttacaaccatcctggcgggtagaatagtatttttatttcacagattcaaaaacagcctaagagaagataagtggtagggacaggctttgaactcaggtttctctgattccaaggtccatattcttttcactataccatgatattaaaaaggaacaagtggggccaagcacagtgggtcacacctgtaaccccagcactttgggaggctaaggcgggtggatcacttgaggccaggagtttgagaccagcctggccaacatggtgaaaccccatctctactaaaaatacaaaaaaaaatagccaggcgtggtggcgcacgcctgtaatcccagctactctggaggctgaggcaggagaatcgcttgaactcaggaagcagaggttgcagtgagctgagattgtgccactgcactccagcctaggcaacagaga

SEQ ID NO: 2405 - DNA, 1179 bp, Homo sapiens
cactgcaagacaaactatcctcggaaacctagcaattccttcaatggaaaaacaaggaactgaatctctcaagacagcaagcatacaaactgggttttctaggacagtcctcattccaaataattagtctgtggtcaggtatcaggaaaggtaagataactaacatttgtcgggtgtccactttgcatcaggcatagctactttatacacactattgcactgaaatcatcccaataacttatgaggtggatgttattgttccaatttgtacagttcaaggaactgtggcagagagaagtaagattgttgcttaagatgacaaggtcaagggtacagtcaggattaggatcctaggttcatttggctccaaagcctgtcatttctccactaaaactaccatgctgaatttttttttttgaaaatatggctggagtgccagcgagggggttttcagctcagtctttccattccagaatttttaagtgttcttgcagttgggtggtagggggtggagggagcaacccagctaaatcctgtgatttctgtgctccacaaataagtcaaacacgaggctctcaactgagaactttgaagtctgaaacctggggccaagaagtcttctgtttttattagtcaaagaagatgtttcaaaaaccagatttatcatgactggatttcagatgtgaaacccaatatacacacagacacgagtggcttgtcctcttggattatttctgaccttttactctcctctgaggatctgcgtttcctcagagtgcgaactctctgcctccccagctggcggaggtgtctggaggcccagctttgcaggcctgggccccctgctggccttgggaatttcaaagagcagggagggatgggtgggcacactggctctgatctggagccaggggctatttgttcctctaaggccctgggacagtagctgcggggaaaggaaaggaggagtccacctgccctgaaggggagggtcccggatgtgcctgccggtactggagttgacccgtttgatacctgacccatttttagctttgttattttggtagtctcctaactatgtgggctttaaaaatggtgttcccagcttgggcaataaacatgtgtatttggagtgtgtggtcaaccttccacctctctcaaccacctaaacccaagagc

SEQ ID NO: 2406 - DNA, 1164 bp, Homo sapiens
ctatcttttttcaatgcaggttattaatgatgatcaaatattcaaataatgagcttatctgcctatacacttagtaaaatgatcttaaatcatcttcatttgaagactatttaagaatattaagaaacttcaccttaggtttaaagagagaacttaaagtttgttaactttgacagaggttttttgttttttgcttttgcttttgaaattgccaagatagtagtagtagtagtagtagtggtggtggtggtagaaattgccaagataatagtagaagtagtagtagtaatagtagtagtagcagtagtagtggtagaaattgccaagataatagtagtagtagcagcagcagcagctaactgtgccagcaccattcagatctctctaaatctgttaataaatttaaccccataacagctctatgagatatattgttttcctcattttataaatgagaaaagacacagagagattaatatacttgccgtagtcacattggcttaaacaaatgaagttaagtttgtttagctagacacacaaaaaatcatttttttctttcccctctttagttattagaaaaattaaaagaacgttggctctctactggtttatggcataatctggagttggtgaagacagtcattgtagaaccacagggaggagaaaaaacaaattttgatgaattactgcaggtgtactatgacgcaatcaaatacaaaggagagaaaggtaactggaaattatttcatggtcggtgaaaaaatattttttattacaaagtaagaaggtacaattataattttatatttttagatgaattacacttaagagaaaaattataatcctgagtgaaaagaaaataaattgggtaaagaaattcttttaattgtacttgttctcctatgaatattttcacttgagtatgctgattcaactttaagaaaaacgatgccatcatctcacagtcttcagtgcactacctgaaatagtttgtgcaaaaaggcagttaggatatatataaatatattccttactagccaaatgagacctatattctgatgcatttagtacacttggtgcttgtattctattacataaggtaaacttgaattttcaaaacataactgaaaactcaattccaagttagagcatatccatgaagag

SEQ ID NO: 2407 - DNA, 1099 bp, Homo sapiens
tatatttttctcatttttggcaagaatttacagttgtgtaccagtggatctctagataaacactgctattctaacttgagtaatctacttttgagaataatttttatggaaattgcttctttcccctcaaggactctctgttacactcttttttaaggtgactttgagtcttaaatgccataattgaaaactgcttccaaaatctaggttggaaataaataaatgacttatgcagtttatttgcttttcaggtttgttttggaacagtacaatgcactctcctggctaacctgtgaccctgcaacccaggacagacgctcatgtctcccaattcattttgtggtgctgaatcagttatataactttattatgaatatgctgtgatcttcatttgatggaactgtgcaagaaaagaacaaggaaaaatggatgtttcgctgcaggattaagttacaattatcttctcagtgaaggtcatttgtgatggggtctaattcttattacttcaacaaatattgttttgacttggggggaggggctataaccctgctatttttcattgactctattgaactctttaggatgatgactgatcatacaaaacgtattataacattttcgtagcaaaattaaccttttttttttccagtcacagtatttgtgaaaagtaatgagccatagtacccagtcatgttaaatgaatattaaaagcatggagaggaaacatgaggaacaatgaatttcaacatatggcttcagaacatgaagatgttcttgtatggattatagtatctagtattcaaaaatgcctgcatctcttctcttatttattgtaagtttttaaatgtataaattgtcttatatttcttaacctcttttataaaaattttcctagaaggtttatactgccttcttgctttaaagcaattggtctaaaatatatgtaatcgtcttaattaaaaagttgcagtagggttgcttttagagtattatttttttgtaagggggtgggtgggacagtaaatttgtattgtctcgatgtacagtttaacggggatagagggggaataatgtccataccattgtgtgtggaggattt

SEQ ID NO: 2408 - DNA, 1099 bp, Homo sapiens
gttacagagtatgtattttttttaatagtcaccattataatttaagggtggaagtgatgcaagttcttaatactaggactcagtattggattcaaggtaggatttacaagaataaattcattgagtattaactttgcattattcctttactgtgttttttcctcagggaacttcttcattatgaaataactttagccacaaaaagtggagaaaataatgtgtaaacacttgtacatcagccaacttaaggattttacatacagttagaattcccatgtactgtttttcttcttccagtcttccttccactgtcctgaatttggtaccttttttttttttttgagacagagtctctgtcacccaggctagagtgtagaggcacgatctaggcccactgaaatttccgcctctgggttcaagcgaccctcctgcctcagcctcccgagtagctgggattacaggtgtgagccaccacacccagctaatttttgtatttttagtagagatggggtttcaccatgctggctaggctggtctcgaactcctgacctcaagtgatccacccacctcggcctcctgaagtgttgggattacaggcatgagccaccgcacctggcctcaatttggtacttattatttcagtacatgtttttatacgtgtagctctagttattcattttaattgctttatggtatttccttatgaatatatagtaaatacctaaactcttaaagatggatatgttggttattttcagtttttcaccctaacattttccattttgtttggtacacatttccttgtttacttgtataagaatttttttaggaaatacatctaaaagccattttcaacatggctatgtccattttcaacattaagggttgttgcccagttgcagttcagcaactggtatatagtttaaaccctcatgaaccagcagtgtatgagaatggctgttgcactatattttcctctatagttggtcttacaagatttaatttcagtaatttacagcatgcaaaatgtcatctcattgtctaaatatgtgtcttccagatttctagtgagattgagcatcatttaaaatgttttggg

SEQ ID NO: 2409 - DNA, 1152 bp, Homo sapiens
tttctttcccactagtggaatttttatcaaatagttctgttttagttcctaaactagacttttttattctttttgaaaaggtggattttaagtattttgtctaaaatggttttagaggaaggcattaaaatatgcatgttggcaacacaggtttaaattcttggtctttaagctgaacttttatttttaaaaagttgttttctcttgtccaggcgcagtggcttatgcctgtaatcccagcactttgggttgctgaggcaggtggatcacgtgaggtcaggagttcaagaccagcctggccaacatggtgaaataccatctctattaaaaatacaaaaattagccaggcatggtggcacacgcctgtaatcccagctactcaggaggctgaggcaggagaatcgcttgaacccggaaggcagaggttgcagtgagccaagatggcgttactgcactttggtgttggtggcagagcgagactccgtctcaaaaaaaaaaaagtcatttttaaaagtattttcagaaatttctcagaggcatatagagatttaatatgctaaaattttacataatcgatacgtgtgacttgctttggttagtttgctcctttagtaaatacagcatttctaataatttacttaaaaaaattagtattacattttgtactttaggtcttctgcccaccacaaatctagcttatttcttaagtgaaggtaagacagatagacagtgagctactacatgtgtatcctctttgccatagaatatataggaggttggggggcatacattgataactgactctgttaaatcggcctctagctcgctctcaaatccatttctgctttttctctgttctgttctgtattgcagggaattaaatttcctagactcgtttgctttctggagttggctaataggaggcactaacagaagattggagggtgagaggagggaagaagccagggtctttccccagtccctttttgagccaactccagcagcagctcccttgtgtcctattaacacagccccttcctcatggtcccagttactactgagcagatcctgctatggttctagcaccatcctgagcttctgggatatggtgagactacatcatcttattgtcctttcagtgctagaagtcat

SEQ ID NO: 2410 - DNA, 1215 bp, Homo sapiens
tgttccccttcctgtgtccgtgtgttctcattgttcaattcccacctatgagtgagaacacgcggtgttcggttttttgtccttgcgatagtttgctgagaatgatggtttccagcttcatccatgtgcctacaaaggacatgaactcatcattttttatggctgcatagtattccatggtgtatatgtgccacattttcttaatccagtctatcattgttggacatttggcttggttcaaataacaagagagggggaagccctaccaacccagcttctggtccataagccctgtttctcaaactatgccaagtggaaaggcgacggtaattcacaagttccttccggggtctagggtagcagaactgcattgtatcccacccccattcctactgttaaccaagaccacctgggcttttcctccctgactccaccaagatcgcacgcatggaggccttgccaccgcctccgtagacgcccgcccccagtgcgctcggtcacctccctcctgctggctgccctcgggggcagcacctccctcagagccaaagacatcaagaggatcctggacagcgtaggcatcgaggcggacgacgaccggctcaacgaggttatcagtgagctgaatggaaaaagcattgaagatgtcattgcccagggtattggcaaggttgccagtgtacctgccggtggggctgtggctgtctctgctgccccaggctgtgcagctcctgctgctggttccacccccgctgcagcagaggagaagatgaggaggaggaggaggtgtccaaagagtcagacgatgacatgggatttggtctcttttattaaattcctgctcccctgcaaataaagccttttacacatccaaaaacaaaaacaaacaaacaaacaacagttggtcccaagaagtgacagggcagggatgagtctccccaaaagaaaccctgggaaaatctacttactactaggcaggtatctaagatgtaaacaagtaggcaaatacattttattctttgtcaattatgacttgaaatgctctactgatttcataataaaatagcatctttaaataactttttccatatatttccagaatgctcattatctgtgtcacatggcaccatttttattatttaaggtgtacaacttgataatttgatatatgtatacattgttaaacaatcaccacaatcaatctaattaacatat

SEQ ID NO: 2411 - DNA, 1130 bp, Homo sapiens
agctgtaactacaggcctgcaccaccattcctggctgtggtaattttttatgacagccctaggaaactgactcacaaagggggaaactgttttaggcaaataccaggaggtgagagagcatggagtatttgaggacccgagttaaatgtaatctagggtgtgagaggggaagttacaagagatgagggctgggcacagctgctctcgcctataatcccagcactttgggaggctgatgggggtggatcacttgaggtcaggagttcaagaccagcttgagcaatgtggtgaaaccctgtctttacaaaaaaatacaaagattagccaggcatggtagtgcaggcttgtagtcccagctactccaggaagctgaaatgagaggattgcttgagtttgggaggtagaggctgcaatgagccttgatcgcaccactgcactccagcactctagcctgggagataagagagcaagactctgtggagagacagagagagatatatgagactggaggttaagcaaaggatatattatgaaggacctttgaaatgtcacgttaagttagaactttttcataggaaacctgagaggtcactgtaggctttttagaaggtaagtgatgtgatgatatgattagatttgtgcttggcattgtaggccacttaaatattttctaatatattcagttatgatctggctgcagtgtggaaagtggatggagatggcaaatatggaaacagagtgacaaggcaggatactacagttaagtccaagaagatagtgactttcttacactagggtgtttctgtggggatagagagaaatgcattgctttcatgttgaggaggtaagatagacagggcttagtgattggttggatgtagggaatgagagagcagtgacaactggggattatgctgcgcctttggctcagacagttgggtaaatacactgagatggcaaaaccatgcactgagatctgaaactcaagtggaagaactatagaagtatgtgtggacacagatatacaaactaccatcagagaatactataaacacctctacgcaaataaactagaaaatctagaagaaatggataaattcctggacacatataccctcccaagactaaac

SEQ ID NO: 2412 - DNA, 1109 bp, Homo sapiens
cggacaaaggccaagggaggcgcaggagggcccaggccgggccaggaggtgggggcccgctcggctgggggccactcgggtgcggcgcggagggcgggggggtcggaaccgctggtgcccaggacccgcctccggccccttaatccggatcggttcggtccggattagtagtgatcggtgtaaacacactagtgaaaccgcgtgtttcctcgcgagatttgcacggctgggaggcggggggggtcctgggggggtgggggaagcgccgacagtgggggagcagggggaggggacgaggaaggtgggggggggtccccgctgccccggcgccccgccttctccaatcagcggccgcgctgccgggcaggggttaaccaggggaccccgcgccggcggaggaagccgcgcctcgccggacggctgagggcgggcgacgggcggcgccggctgacgggccgcaacgcgaggggaggtccggcggcccggggcgccctgcgactgcccgaggccggaggcccggaggacccgccgccgcctttgtgtcgccggcccccgccccgctggactggcccgggccggggcggttgggccggcgctgaaggggcttggccgcccgggtccacccgttcccggatccgcctcgccggcccccgcgcccgcccaacccctgcccagcccctcggctccgcgagtttgggtgagaagtgcggcggcttttcccagggatggagtttagaggacgctaatcctatgtgtgagcggcggaccccgcccggacttcccggaggcgcccggttagtgaggcgacggcgcccacccgcgttcgcgggctcccggccgccactccccggagccgccggcccgccccagccccgcgcgtcgcccgggagggcgggctgcactccctccacgtacctggctggcagagcgtctccagggacaaaaggtgccctgggatcaaagccgagcccccgcccccgcggggatgctgccctccggaaggaggggcgctgcccccaaggtactctccccgggcacccagggggaggttccatttcaacctccgatgaaaaacacggccctcccgggtacttaggagggtctgaggg

SEQ ID NO: 2413 - DNA, 1227 bp, Homo sapiens
ttcccaggtcagaatatgatcatttaaaaatgtcatcacataaattgctagaaggttattagcagtttgagagtaccaattttttcacaccctgctaataatactgaattttatcattgtaacctttggcataaagaaaaataccttgttttaacttgcatttgttcattagttatgtatattaaacatcatatgtttaatggccttttggatttctcttttaatgcttgttcaggtcctttgcatatgtctcttttgaaatacttgtgtgttttggtttttgttttactgataggtaaagcattatttattaagatttaataaattatttatattattaatttgttatattgtaaatatttttgcttgtttgtaatcttgtcttttaactttatgttgacttttaccattcagatgcaaaaaaattgaagtagttaaatttatcagtgtttttcctttatgacttatgggatttgtcttattcttagatgttcccatatggtgtattcctatacggggtgtgtgtgtgtgtgtgtgtgtgtctgtgtgtgtgtgtgtaattttttttttttttgagacagggtcttgctgtgtagcccagtgtgtgtgtgtctgtgtgtgtgtgtgtaatttttttttttttttgagacagggtcttgctgtgtagcccaggctggagtgcagtggtgtgatcttggttcactgcagcctctgcctcccgcgttcaagtgattctcatgcctcagcttcccgagtagctgggactacaggcatgtgccaccatgcccagctaatttttgtatttttagtagaggcagggttttgccacgttggccaggctggtctcaaactcctgacctcaagtgatttgcccatcgcggcctcccaaagtgctgggattacaggcatgagccactgtgccccgcccatggtttatatttttaatgtcatgtttaaaaagtcctttaccactagaaaattctaaaagcatttgtttattttttcttcttgtaattttttatatatgataaaaggtaggaatcttcttttccctttttttctaatatctgcacaaacgtcctaccatctttttaataagttcccgctaatatgaaatgcacattaatcacaacttatatatctatattatatagatctgtttctgaattctgtattctgtgccactggtcaatctgtctgcttctgtatctgtatgatactgtttta

SEQ ID NO: 2414 - DNA, 1204 bp, Homo sapiens
gaatcgcttgaacccgggaggtggaggttgcagtgagccgagatcccaccactgcactccagcttgggcaacagagtgagacttcgtctcaaaaaaaaaaaaaaaaaaaaaaattatccggacgtggtggcatgcacctgtagtcccagctactcaggagactgaggcaggagaatcgcttgaacccgggaagaagaggctgcagtgagccgagatcatgactctgcactccagtctgggtgatagagcaagactctgtcttaaaaaaaaaaacaaacaaaaaaccaaccaaacaaacaaaaaaccccacacacacataggcagattgggaaagctttacctgtgaagaacttgtggttgtttcattattctatcttgtctactttgtttgaataggaatagttagtcatccgaggagtcattactgactgttctgagaagtgtatggttttcaataatatgtttcctgataatgttaaatgttttagtttctaagaagtgtctttatccatgctaattggtattgaattcctttttttgtctgtttcccctaagtcaaaacaagagaagatggcgtgtagagataagagcatgcaagaccgcttgagactgggccactttactactgtccgacacggagcctcatttactgaacagtggacagatggttatgcttttcagaatcttatcaagtaagtgaattgttatgattaaatggagaattgaaaagttcgtttgcattttttaggttttctgtaattgtagtcattaataatcctactattggtagtcatcttttcagttagttttttagtcaccacatgtggaaagaaatgtatcgaatgaggtgaagtcctgaaaaaaaacgacacaagtaaaatcaggagtacaaaatgagttccagaaaataaataaagtatgagttcaggccaggcgcggtggctcacgcctgtaatcccagcactttgggaggccgaggcgggtggatcatgaggtcaggagttcaagaccagcctggccaacatggtgagaccctgtctctactagaaatacaaaaattagccaggcgtggtggcaggcgcctgtaatcccagctacttgggaggctgaggcagagaactgattgaacctgggaggtggaggttgcagtgagccgagatcgtaccactgcactccagcctgggcgacagagcaagactccatc

SEQ ID NO: 2415 - DNA, 1205 bp, Homo sapiens
gccgttccccacccccaaactgtggaaggggcgggggcgcgcgcgctccaccacgcacgcgcccccacgcacgcgcgctccctccgcgctcgcgcccctccccaccccagcccggagggggcggggctgcgggcggcctcagagggtgcgacgcccccagcgcggcggcggcgctagcgagcggccggcggggcgcgggttgctgggcgcgctgctccggcggggcccgctggcacagccgcctcgcgcgagccgcccgcccggcgggggaagctgcgagcgctccgagcgcccggcctagggccgctggcgctgccctcccgccgccaccgccctccgcgcctccttcgggcggccccgcccccattcccatccccctcgcgctcacctcccggctgtgccgcgcgctaggcggagcgaggcgcccgccgccgccgagccgagccgaggggcgagagctggcccccgagccgccgctgacaggagcaccgccgcgggctgcgctcgccggctgcgaggccccgccgcgccgttccggggtgcagactcgccgcggggcgttggaggactgcgaggtgctccgggaatcgcgggcggcgccggcgggcggcgcggtcctcacaggagaccccggggactggggcttgacccggaggtgcagagagcccctcagagcggcaggtaaggggcccggggagcagggcgaggaaaggtcgcttcagtgacagggtcgttcgcctccacagcctcggctccggggagaggggcgggggcgagcggggagacggcgaaatgggcagcgaagtgcctcggtgtccaaggcgtggggaaggctggctccgaatatgacaccaaggcgggcttcagaggcgtgtggggtcgccacttggctgtcaccgaagatgtcatggaatttggtacctagagcgtctctggatgacggggaccaaggataagatgcgaggcggattgctaaacgtggcagggaatgtggtgcagaacgagttgcaaaatgtgcccccagaatgcagcataaaagtagttgcgaaatgtgccaggtaaggcacaggatgggctggcctctgtggcgttgaaattcatggtcgaagtgttattagcgatattaataattcctctgggaaaggaggtgtagcataataaaagattaataaggctcattgctagatattttgccataggaaatc

SEQ ID NO: 2416 - DNA, 1229 bp, Homo sapiens
cggcttgtggggcgggcaggctggcgcccccgacccgaaccccaccccgaccccggaccctcgccccgacagtcagccgcggggcccgagcgccgggctgcgcgcacggcctgcgctcccagcatgcacgagttggatggatgagggtggctgctcccaggccgcgcccgccttcgccgaaggtgctgggcttggctctggggcccccgcgctctcgggcagctgccttctcacctccggacgctgtcgctgtcaccgtcaccgcactgcactgtccatccaccctccactcgcccggcctcttttctggtcccaatttctgctccaccattcccatgaggcagattccctccagaaggaggaagcgcggcttccgcaaactaaggtctcccgcagggatctccccagggcccgggctctggaagcccttggccttcctcccctcccccagcaccgtggcttctcctttatggcctgcatctaagcagggtcctacaccctccctgccctcctggtgcccaataggaggaagcagccctgctcagccaggagtttgcggaggcctggggccagaaggccaaggagctgtatgaaccgatctggcagaacttcacggacccgcagctgcgcaggatcatcggagctgtgcgcaccctgggctctgccaacctgcccctggctaagcggcagcaggtgggctgagggctgaggcagagctcgggggcggcctcctagtgccccatcgtgggggtcgggggagagcagcccatcagggagggaggaaccctgggatccacatgggccctgacagaagggaaagcccaggtaagcacagaatggctttctgagcattgatttttcttggagatggggtggggagttactttctgttaaaggaagcattctggagtaggaagccaaattcaaatacacttctccctaggctggtttatgagcttctttggaagagttgagaagggctgggcgtggtggctcaagcctgtaatcccagcactttgggaggctgaggtgggcgcatcgcttgagcccaggagttcaagaccagcctggccaacatggcaaaacctcgtctctacaaaaaaaaaatagctgggcttggtggtgcgtgcacctacagtcccagctactcttgaaactgagggggaaggatcacctgagcccaggaggtcaaggctacagtgagctgtgattgcactactgcaccccag

SEQ ID NO: 2417 - DNA, 1087 bp, Homo sapiens
cttgcgctctgctcctacccgaaggtttttaagtccctctgaattgctcatctgagattagtagagtagcaggcctgaaggatgatggttttgtcctctttggttctcacctgcttgagaagtaaaacagtaactttgttcttctgggcccttaagcttttttggttaagtcttccttttcagaagtagatgtcattatatgccaaaagtctagctctttgctttaccatacagggacctgtcccaaagaaaaaggctctttttttagccagcatatttccccttctacccttttactttgttgttctgattttaggactctggctggccatgtgcttgtggttgcctctcctgcatttgccactggatttgcactgcatcgtttggagatacaaagcgagcagttcttggtcagaaccctcctctgcttttcattgtgtttgataatggttactgggtccttctctcaagggtagcaaggccaagctgatggctgcttgtttaggaggccatcagttccttcctgtggagaagggtctgaaatggaagtcagtggtagaaggggctggtctgctgggcagggcttacatccactgagttctaagattcctttcctgatctgcacctacgcctggtctgtatggtggaatttgtcagctggaactcagaaacaacaacttgaaaaaaaaataataattagaacatatttgcataagatagctatttactctggaaaccaacaacttttgagatttcccttgccctgtggacgcccagctcctgtcatccttccttaggtcctgcagtacagtcttcccctgaatgccaccggggacccagggggactccacccccctaagcaagcacacacatactcacagttgatgagttgctggtctttgagtcccagctctcttaccctccctttactccaccagcccgacgacccatgactgaggaggggatttctacagtctcaggatttagaaagtctgtaagccatccatgctccagaaagcaccgatctgttgtagttgcaaaaacaactctgtaatttgttgaggttctcaaactgacagccagcgag

SEQ ID NO: 2418 - DNA, 1213 bp, Homo sapiens
taggtaccataagaaataattcgtaggttttctgttgcttttaactcccacagcagctttgtgaaatgatgctttatctccattttacagatgaggaaattgaggtttggagagaataaatgatttgctcagggcctccttaccaaatttttctgactctgaagttcatattcctaactgcttcagtctaagaaagttgttatttgttgtttttttttttgagatggagtctcgccctgtcgccatgctggagttcagtagcgctatctcagctcacaccaacctccgcctcctgtgttcaggcaattctcctgcctcagcctcccaagtagctgggattacaggcgcacaccaccacgcgcagttaatttttttgtatttttagtagagacggggtttcaccatgttggccaggctggtttcgaactcctgacctcaagtgatccacgcatcttggcctcccaaagtgctagaattacaggcgtgagcctctgcgcccagcctgttatttgtttttaaaagttttgtttgtttttaaagaatgccacattggaggagtgctgataattcagttagtctcagtccataccacagagataactggcttgtggcagccaagtgtgcatagtgatgttgctttttagaaggaaaaaaaacaaaaacaaaacctcaatccaggaagaaatgcctaaaagagccacttgatttacttcctgtctttatacatgtcctctgaagtatcagttgaagaacctgtctacctctaggaatgtattttactttgacacaaaattagattctataaccctgattcacttgtgtcagttgtcccagatttcagatgacagtgccaaacttttccactagtgtgttctcagctctggaactactaaacaagtttgttcattaagtaatgccaggaattggttagcttcctggaaacagaatttgtcaacctgataaaccagctcttataatagcgtcatcttatacagaattagaaatgatttcttcagtcatacttgtggatctgacttgaaaagtggtgtgtgtatgtgtgtgcctgtatgtgtattcacatccatctttgttcaatatctgagttgaaagaactgaaaattctcaatacttagggtggttaatgttgttactgataactccttgcattccgcttttaggagtattgttggatgctcctcagaaaacacttaaa

SEQ ID NO: 2419 - DNA, 1110 bp, Homo sapiens
accttaaaaaacaaaagcaaaattaaaaagtataaaacagaacatttacttttttcattggtgaaagctgcaagattcttaccctgtttccttctcttctagtttattttacttaaataaatagcaccagatgtgcacagtgtaccaagctattttggaatatatgaatcagtgtcttataaggagagaggataagaacctttcctacctagacttctgactctgttcagattgcagacatttgcagcttctgcagcagccctaaggttgagtgaaggacagtgatgttgactgggaatttctgagtaaagctttggctgtgcttatgtcatctgctaatcaggagcacctctctatcagatccaaatgctttccaatctgaagaccaaaaacgttccctataggctcagttagctatttttctagaatacgatgccaattacataggatttttatatttttacagctgctgatgttatatcaaaagttatcctgtgtgaaacctgtgggaagttgaatgtgtttatttggtagcattttgtgaatattgtctttgtgtgctttactgtattttgttttaaactctttaaacacagttattttatggtcatttctggatatcagctgcttatttatttttcagatgcttcaaaatgaataaaatgcatttcatggtgggggaaactaagaaaacactttgacagaattagttcctttctatgagcaattggagattattacattgcactaattaaactatgccatgctgcatttaaagagaatgggctaaatagttcattctttttatctgagtttagacctgttctaaaactgaaacagtgtgatgaactaacctgcgtttcttgtggcaatgtcagatgatctagacttcttcctttcaaaatattgcctgtttccttgtttgtttgtttgttttcctaaatgaagtttggtctctctttgagttcggacctatacaatatccacaaagtagaaggcctccattttagaatcattcctagtaagctggggacagagcagttgctatcactggactagttcattttatgcaattccagattgcctgtgagctcatattgccagtttcat

SEQ ID NO: 2420 - DNA, 1234 bp, Homo sapiens
cttaatttgaattctctcgtccccactccctttctctatttattaccccttctttctctaggaggctgcattgaggcgtgagcaaaagaagttggaaaagaagcaaatgaaaatgaaacaaatcaaagtgaaagccatgtaaagccatcccagagatttgagttctgatgccacctgtaagctctgaattcacaggaaacatgaaaaacgccagtccatttctcaaccttaaatttcagacagtcttgggcaactgagaaatccttatttcatcatctactctgtttggggtttggggttttacagagattgaagatacctggaaagggctctgtttcaagaatttttttttccagataatcaaattattttgattattttataaaaggaatgatctatgaaatctgtgtaggttttaaatattttaaaaattataatacaaatcatcagtgcttttagtacttcagtgtttaaagaaataccgtgaaatttataggtagataaccagattgttgctttttgtttaaaccaagcagttgaaatggctataaagactgactctaaaccaagattctgcaaataatgattggaattgcacaataaacattgcttgatgttttcttgtatgtctacattaaacttgagaaaaagtaaaaattagaacactgtatgtagtaatgaaatttcagggacccagaacataatgtagtatatgtttttaggtgggagatgctgataacaaaattaataggaagtctgtaggcattaggatactgacatgtacatggaaaattctagggacaggagcatcattttttccttacctgataccacgaaccagtgacaacgtgaatgctgtattttaagtggttgtatgtttattttcttgagtaacaaatgcatgaaaaattaatgcttcacctaggtaagatcattggtctgtgtgaaatcacaaatgttttttccttcttggttgctgcagcctggtggatgttcatggagaagctctgttctctatattatggctgtgtgccgttgcttctccctctgcttttatcttttccacagttgaggctgggtatgttctttcaaagaaatggccatgaatatgtgtaagtatacttttgaaaatgagctttcctaaactattgagagttctttccacctcttgcggaaccaactcttggaggagaggcccatgtatctgcacgagcacttagcttgttcagatctc

SEQ ID NO: 2421 - DNA, 1205 bp, Homo sapiens
tcccgaggggactcctatgtaaagctctgggtgatttttacccacagcagttcccagggtggattagcccaggggtggggattatgctatggctttcctcctggctctttgcagatcatcactgatgtgattggaaatcctgaggaggagagacgagctgctttctaccaccagccctgggcccaggaagcagtaggcaggcacatctttgccaaggtgaggctctgccctgttttccctcctttggccgtgagtagcaaaggcctgagccacttggtttctcccttctccaggtgcagcagcgaaggcaggaactggaacaggtgctgggaattcgcctgacctaactgctcagggatctttcttcccagccctggagcctggagggagaccaccctctgggtccttgctggggccgcagacacgtaggctggggtgaggagtgtctgctgtcaccctctactctccagctttagtcttataaatgtagtgataggattccttgttgcttggtccccaaagccttatactttttgcattggctttaattgggttcagcagatgcctcctctgcccccctgcaggcaggcccaagtaggactgctggaggctgtgctttgacattgtaagacatttccgaaccaaaggctgctgggtttgcatgtttacagactccccctggggcgagggtcagagctggctctggggagctgggctaggaagaggaggtgcagcccagactcttcctagcctttctaaaccaaagttctttgccattcctacaagcccagccttgctgctggttttttcctttcctttgggtatttgcactattttgggagcaagttttctatgtgggagccactttttttgtacaggggtaagttgggggttttcagggagcctgttaggtgcctccttcttttctttcctcaatctatgcaagcggctctggccgccatcatctcctgggatgccagagggctgcctctccagcggcttgggccggggaggggacactccagttctctagcatggcctgaggtatggggtatgtgcatgtggaggccagggtaaggtgaatggggaggctgggaggactggtgttgccctttggagcttggtgaggagggtgggcctagggcttggcgagtgccacatctggcaggtttggaaatttccaaataaatccttttgtctattgg

SEQ ID NO: 2422 - DNA, 1135 bp, Homo sapiens
gttttcctggatactgaacctaccatcaaaggaggaagtgtttgcctttttgaggatttttgaaaaaaatatgtagggtctgaagacacctgccaaaagtattgctccaaaaactatttttgaataatgataacctcactgcaaagatgcatggcctctcaaagcaattgctttgaaagaggcaacagttatctggctacatgatctttggtgagcttaaaacaaataaaaccccctgcagtacagtcatatccttgtaaacagtgattgcttctcttgattgctggcctcatctgtatctggctagaaattttgcagtgatgtcgcaactctctcccatgcaaggttatcaacctggttgaccagacttcagaaaacgcacctaccaccgtgtctcgggatgtggaggagaagcccgcccatgcccctgcccggcccgaggcccccgtggactccatgcttaaggacatggctaccatcatcctgagcaccttcctgctgattggctgggtggccttcatcatcacctatcccctggtaaagctcaacaattcccctttgccatccacctatttctggggcttctctgcctgtcgcctcatgtcagtgagatccagacaaaaacaaccagcacatttctttccccatttaaaagtcagtgtttgttggccgggcgggcacagtggctcacgcctgtaatcccagcactttgggaggccgaggcgggtggatcacaaggtcaggagatcaagaccatcctggctaacacagtgaaaccctgtctctactaaaaatacaaaaaattagccgggcatggtggcaggggcctgtagtcccagccactctggaggctgaggcaggagaatggcgtgaacccgtgaggcggagcttatagtgagctgagatcacaccactgcactccagcctgggcgacagagcaaggcgacagagcaagactccatctcaaaaaaaaagaaaaaaaaagtcagtgtttgtttatcttcaaaaacataattaaagagacactagcctcccagaaaaggacaattttgttcctaaatcttagtgtttttcagctaagagctgatttataagccttgctcaaagatgattttgaatagttatctgtattttt

SEQ ID NO: 2423 - DNA, 1454 bp, Homo sapiens
agcgaacgcatcacaaagtcaggatgtggtgcagatcggtccattttcaatacaagctctttctaccacgacaggttattttgcacttggggacagtttttaactttccattctcaactcctatcctagctcctggcacagaacatgtcatccaagttaggcatcatcgtcgcctgctcttggtgaagttttcttttgcgtactgcggagagatgcgctcattaccagctggcggtggagtcgctgaaacgcaaatggatttgagactgagcgactcccatctctatggttggtatgtgacccatctatcctctggaggactcagcaaggactaccagtcaccagacaactttacgcgcacgtggtcgcaaggtgaacttgctattggttaatggcagtaaagcccgcccatcagcgctggtctgctcctttaaaagaacgccatcgacgctcccctgtctttcagcgcctgcaggttccgggaggtcaggttgtattcctggcgggtcgtctggctgggtgggccccggaggtcgtggctcgggagcagggaggcgtaggggggccggcctgctgtgatgacattccaattaaagcacgtgttagactgctgacgcgggtgatgcgaactggagtctgagcctgcccgagcggagctgggagggggctggcgggcgggcgcgcgcacacccgctgatctatcactctcgttcttgtagctcccagccgaggacgtcggatgtcatcgtccttgctgctttgccaccccattcccgtcaataaagtggtttgaacccaaccctggtgtcggtgtgtgtcgttggcgacgcgctgtctttgagcccccgccgagcttcctcgtggcgccgggggtcaatctgcagcgctagagcatgtgcttgcgcataactggggccgcctggcctcccgcgggcggcctttttaaccgcgagcgacaagaagtaacctgactgtccggctgctaggctgggcaattttccagctgttttgccacgacaggcctcaatccgtaataccaaggctggaatggcgtgttaggggggcggtggctgacggggatacgcggactcttgatgcgtaaggagtgcccctctgctcccatacgttccccagcccagccttccctgagtgtatcgcgcgcgctgtgccttcgccgtgagttcgacataagtcccaggctgtcgcgtctgccatcagacgcgcagatttagttgaaggcagcgtggaatggcgtctgcagggctgttgtgtacttgacataaacagattcggtgtggaactgcattgagttaactcctgactaaagggtaatcgacctgtttacaaataaccatgcaggagtactgacaagcatgggactaaagctttgggcaggttaatctgtcactcctaaacagttcaaaattatagggcggttgtgaaggtgaattaga

SEQ ID NO: 2424 - DNA, 1454 bp, Homo sapiens; identical to SEQ ID NO: 2423

SEQ ID NO: 2425 - DNA, 1159 bp, Homo sapiens
aaagtgttgggattacagacatgagccaccgcacctgaccttgttgtagcagtttcttactacccactgagagtctgagagaggtctgttttcccatacttcagcaaatgtggggtactgttaaccagcatggctggctccttctccataggtggcctctgctcaaatgccactcctcagggaagccatccctgacctcctcagccaaaacagccacccccgtgttccctctgcccattacctgcttgatgttctttgcagcactaatcactctctggaagtatattgtctatgtatttacctgtttctgcctttctattataaaccccgtgagagccaggccctggcctgacctcttcatggctctgtctggagtacgaagcctagtacatgatgtgtgcacattacgttttcgttacataaatgatatgtccccaaaaccttggccaccatcctctccggaagcatgttgacttgcaacagcatgttttgtaggttgctcatgggtctcactcattgtttgcttgtttcctctagctcccctactttatgaatgagctcactctgacggaacttgacatgggcgtggctgtgccaaaaatcctccaggccttcaagccttacgttgatcaccaaggtaactcctaactgaccattctatgagtgttaaaatatatcctttgctgcagattcagtaccatgatggctttgtgtttggagggtgttgaggactttttaaatcatctgtttcatgttgagtgtctttctgttcttaccagtcatggccttaaaactgatttggggccgggcatggtggcttacgcctgtaatcccagcattttgggaggccaaggcaggcggatcacctgaggtcaggaattcgaggccagcctggccaacatggcaaaacaccgtctctactaaaaaagtacaaaaattagtcgggcgtggtggcgggtgcctgtaatcccagctactcaggaggctgaggcaggagaatcgcttgaacccaggagacggaggttgcagtgagccaagatcgtgccactggactccagcctggatgacaagagcgagactctgtctcacaaaaaaaaaaaaaaaaaaaaaaaaagatttggaatagatccaagctcccatcctaagtcttttagtctct

SEQ ID NO: 2426 - DNA, 1879 bp, Homo sapiens
cagtggatttttttcatatctgatagtgaatttaactttttcatttctggcgaaattaaagagatctgtgaccaaaagtggtcaagcactggagtctgaggttttcaatgtgagtttaataacacaacttgtcttttaacttaggtggcctgccatgggtatccatggtgacaagagtcaacaagagcgtgactgggttctaaatggtaaatatttcaaatgaagtatttttcccccttacttaacctagctagaattctgctcagataattgatcatgtatatgccttcctttgtagaattcaaacatggaaaagctcctattctgattgctacagatgtggcctccagagggctaggttagtacaaactcgcattcatggcttggtttcccagaagatctccatttaacttttttaaagaaagtttattgctttctttaacctgcattttttctaagttttttttcacataaaggtgctgtctttgtggcaaggcctaggcatgacaatcggaggactcgagggggatggaggactagtgatcggctggctgcttccagtcgattagagaggtgaaaaagctgaacgtgtgccagtaatcttcaaaaggcagaacatatcacctctgccccgtaaactgttctctccgagggaaaaaatggaagttatcctcacagttcactgccgtggtatttcttctgtcccatgctttgcatgactgccatggtacagccttgtttcaaactgttcactgtgatctgtgggtctttgagtttcagtgagtttgctgaaatgtcgaagaagtagttccaaacttcaatgttcaatgaaatttttgttcaagtttgaaatggagagagcagctttaaaaggtactaagccttttacaaattggtgagtactggcacatgagatctagagcaggagcaacttctcacacatagtaagtgggaaaagaaagtgctttgaaagttcctccctcacctacacagtagtcgtcatgtcgagacctgccagagagagacacattctcaagtgaatcctggcttcttggaagcgcttgcctagacgagacacagtgcataaaaacaacttttgggggacaggtatgttttcttgcagctgcggttgtaaggtcttggcaagacaagcagtgtggccagaattttgaacttctgatgaatgtgtaatgcaaaggaccttgtacatttttttgtttcaaggtcctcaaaatgagcacatgaagaggttgctgtgaaactttaagtggccctactgcgcagaagcattcagatgtcacttgatgatctgtaagggaacttgctgatttgggaatgtgcttagggaacacacattccttttgacagggtctgtcactgggtgggtgatgaattatacagatgacatgtgcttttttttcttttttcaacctcaatggtattcctacaggaaatggataaccattttaactgtattttttgcagcccgtaccttcttgggaatacaattgtctaactttttatttttggtctggctgttgtggtgtgcaaaactccgtacattgctattttgccacactgcaacaccttacagatgtggaagatgtgaaatttgtcatcaattatgactaccctaactcctcagaggattatattcatcgaattggaagaactgctcgcagtaccaaaacaggcacagcatacactttctttacacctaataacataaagcaagtgagcgaccttatctctgtgcttcgtgaagctaatcaagcaattaatcccaagttgcttcagttggtcgaagacagaggttcaggtaaggatgactgataggaaatgttggtagttacgagtcacatcgttgtctacaaatcca

SEQ ID NO: 2427 - DNA, 1879 bp, Homo sapiens; identical to SEQ ID NO: 2426

SEQ ID NO: 2428 - DNA, 1879 bp, Homo sapiens; identical to SEQ ID NO: 2426

SEQ ID NO: 2429 - DNA, 1185 bp, Homo sapiens
ggtgctggcaccaactcgggaactggcccaacaggtgcagcaagtagctgctgaatattgtagagcatgtcgcttgaagtctacttgtatctacggtggtgctcctaagggaccacaaatacgtgatttggagagaggtatgtaatgaaaagggttttatttgtcattggtgctaaatatcctaggtattgtagttacacttacgtatttaattaaaggtgtggaaatctgtattgcaacacctggaagactgattgactttttagagtgtggaaaaaccaatctgagaagaacaacctaccttgtccttgatgaagcagatagaatgcttgatatgggctttgaaccccaaataaggaagattgtggatcaaataagagtaagtgtcctttgaaatatgtgatcaaactgaattgtgttttcactcttaagagtctgatactaatttttccccccaaaatccattagcctgataggcaaactctaatgtggagtgcgacttggccaaaagaagtaagacagcttgctgaagatttcctgaaagactatattcatataaacattggtgcacttgaactgagtgcaaaccacaacattcttcagattgtggatgtgtgtcatgacgtagaaaaggatgaaaagtaagttttattaactctgttatatttgcttcctaacaactttgctgtaaaattgagggatcattgtttggtgagttgttttaggttatttcagttggtgtgatttcatttagttagcctactaatcctgaaaatttcttgaatccttcaaataatggctgtcaccatttatagctttcctatagaaggaattcatgtgtcccctggttgacttaaggaccaagggtcgaactgctcgataagtggattagcaggcgtttcctctttgacttccagccatgtaaattgaacttaatgttttgctgaccataaatgtgtggccctagcaatggtcttttaaaactcaggatttttcctttctctctcctattattagacttattcgtctaatggaagagatcatgagtgagaaggagaataaaaccattgtttttgtggaaaccaaaagaagatgtgatgagcttaccagaaaaatgaggagagatgggtatgtgtgagctcctccattgaagcagattgattaaaacagcttaggaaagggcaa

SEQ ID NO: 2430 - DNA, 1180 bp, Homo sapiens
tccgaatattctagccctggcagacctcttagctgctttgttgatgagaacactccaattagtggaacaaatggtgcaacatgtggacagtcttcagatcccaggctggcagagaggagagtcaggtcacaacgacatagaaattacatgagcagaacacatttacatactcctccagacctaccagaaggctatggtatgacaactacaaaggaaaaataaaatgtggtttactgatttcagtttgctgaggaagtcagaaaatatattttgaaaaagttattaatctgagcttagggattctgcatgaaaataaatataaaacctcccaactttgaaaagtctttgaagtggtagatgactacctaaccaacagtttgaccttgtgctcatcattcagcctcagcgtttgtgctcttctataatgaagtgagatgactagtttataacaaaggtagtgtgagaagcatacgaaatgaagtgagactgttttgtaaataggcactgtatagaaaggtaagatggtattgttactgataacggtaatctgaagttcaacctatgacataattttttagacatatatatttagaaataattttaaaggcatatttctgatcatatatttgtattgtctgtaattttggattatctgattggattgttgtaaatgactgagtcacttctatgtttgtataaaatgattacaatcttatataaaatcctagattataaagtttcatgtggaagataacatgagtcttctcctaatagaatacggaagtttctaatttaataccatcttgtgaatccttgtatatagtctgaacttgacttcctcttcttgccaaaagctcaccaaggttacttacatctttgccctcttaacagactatagataaaccactttggattgatgttgacatctaatgaccaacactgggaattgccacatctaagttttattttactcaagaatatattttaaaactcttctgcaaatgcatgattcttattttagttttaaatgtattttagctctttaatttgaaaaaacttgtccattaactgtgctatgactcaaaggttaacttttagcacaatcattaaattataggcttgagtgacagacagacttaggacctaggttcgtatcctggctttgccatgtaacaccgag

SEQ ID NO: 2431 - DNA, 1169 bp, Homo sapiens
cctcctgggttcaagcaattctcctacctcagcctcccgagtagctgggactacaggcacgcgccaccacgcccagctaatttttttttcttgtctttttagtagagacggggtttcgtcatgttggccaggatggtcttggtctcctgacctcatgatctgcccgcctcagcctcccaaagtgctgggattacaggtgtgagccactgtgcccggccacctttttatttttttttcatgtattttgataagcaaaagttttcaatgttaataaaatcaatttatcgttttaaaacacattttgtaggtgttgtgccttctttaggaaacatttgcattttccaaagtcacaagtaatttcttcaatgtgttcttctagaatacatacagttatttagccctctgttaaggtttattatccactcagttaatttttgcatttcatggaaggttggtttattttttttaatatatggaaatacagttcagcaccatgtggcaactctttcttttacccatagatttgcttggcatcttatcaaaaataaattaaacacatatgtgtgtatgtctagttctgtaatctctattctatgctattggtctgtttttctttccttggccaataccagtgtctcttgatagtgtatatttatattaaaacttgaggttctatgaaacaaatcctccagtttcttagtctttatcaaaattgttctgactattctagatcctttgcatatacatataaatcttagaattcacctgtcaatttattttaaaaattctaccagaattttaattcagcctcttttgatatttgccaaatatttgccaaggagttatttgccaaaatatctctatcccttccttctacagttacacatatggtagactcagaattctcctactggtcactgaggctctgttcattttagttcaaccatttgtggtcctctcactattcttcagattagataatttctttggataagtttttgagtttactcatgcattctatttctgcctggttttgttcgttcttaaaggactttgtgcagatttctgtgtgtttttatacagaacttttgtagttttcagtgagagagttcatctgaaaaaaagctacaccaccgacacagaacagcaaatgtcaatgtggctttctc

SEQ ID NO: 2432 - DNA, 1238 bp, Homo sapiens
agttcgagaccagcctggccaacatgacgaaagcttgtctctactaaaaaatacaaaaattagccaggagtggtggcacatgcctgtagtcccagctactcgggaggctgaggcagaagaatcacttgagcccaggaggcagaggttgcagtgagccaggatagtgccactgcactccagcctgggcgacagagcaagactctatctcaaaacaaaaacaaaaacaaaaaacatgtaacatagctccactgtacagcgtttgcttacagaggttgcttctgcaatgaagagaattaggcatctgacttgaggtatgattacagactgcagtgaaagctggaagttgaaaagtggaagagttatgtgctgagtataaattctggtgcaccaaaggttctattactttctatctcaaaatcaaatttcaattgctctgggctcctacccaatgactagcagaaagttcaatcctcatagattcctgagtctgtcactcactcctcctccacttggtcagaaagtccctgggctcctgtggccttagaaaagtggcccagctgtctatggccatgtcaccctgaacattctccgtctgtctgatcttggaagctaggcagggtcgggcctggttagtacttggatgggagaaaagtggggcaggggctgagctaaggccttcgtccatgatcccagcatctctcaagttgatccttgggttccaggatgctacggataagctctggtccctgccaagacatggtctctgtatgtcaggctttgctgctctgggggtgacaatgatagccccatagaggttctcttcattgactgaaaggacctcatgcacagggtgtgctcatacatgcttgaggggcagtcaattcccctctggtcagtttctgcctcccacactccttctaactgctcccatttggttatttccacagaactgccccacctgcccctgcaatgagtcttcacacataccatactggcctctccttctcagggatgggagcgagtggagaatggcgagtataacttaggttggcaactctttttttttttctccttttaataaatctccctgatcctgctgtgaagccccagggttggtttaggtgggagggtcggaggctgagatggctcctttcctttttattaccatcagcatatttgggtaaaagacagagctgccaaccaatgatggctatggtagccttgcagtcagagagaat

SEQ ID NO: 2433 - DNA, 1179 bp, Homo sapiens
gccgggaaccccagcactttgggaggctgagatgggaggattgcttgagcccaggagtttgagaccagccctggcaacaccgtaagaccccatctcaatgaaaagtaaattagtcagggccgggtatggtggctcatgcctgtaatcccagcattttgggaggctgaggcgggtggattgcctgagcttaggagtttgagatcagcctggcaacatggtgaaccctgtctctactaaaaatacaaaaaattagccgggcgtggtagcaggcacctgtaatcccagctactcaagaggctgaggcatgagaattccttggacccgggagacggatgttgcattgagcccagatcgcggcactgcactccagcctgggagacaaagcgaaactctgtctccaaaaaaaaaaaaaaaaaaaaaaaaaagtaaattagctaggcatgatggtacgtgcctgtggtgccaagctcctcaggaggctgaggcagaaggatggcctgaggccaggagttcgagattgcagtgagctgtgatcacacctctgcattccagcttggacgacagaacaacgccctgtttccaaaaaaaaaaaaagattggggtgctcttaagctcacagttctggccatctcctctttcctaagtggagggagatcgtggatccctgagggggaacctacttcccctttcacttcaaagtctgcttctgtttctaaaaatgaactgaaaccccatctgtttgctcatgtatttgaaaacccttgaaaatgtttatttttgtacatcttcatacgactctcgtctcagagctgcttctcctcttcaggtggtttctgggcacactggggacgtctgtgcacctcctctgagtggaagtcaatgcctgtgatcccctttctaaaggaggcacggatagctgctgtgcggttttttcaacctgtagccagttttcatgtttttgttctcaaaataatactttttttttcaggtgaagacaaggaacatttaatttacactgaaatgatttttcctcttagaccttctgaaagctatgacgtatgtatatttataccataatagatgctaatggtgtcctctctgggtgatggtcccagagatgtttataccacggcatttcactccactaataaatgtgggtggatggatggacgggcggac

SEQ ID NO: 2434 - DNA, 1179 bp, Homo sapiens
tgaaggtcgattcttatccctaattgacttcctcttgggttttgtagtctgagtatttgaaatcacatgttgattgggctgggtgtggtagcacaagcttgtaatcccagcactttgggaggccgaggtgggcggatcacgaggtcaagagatcaagaccatcctggctaacatggtgaaaccccatctctactaaaaatacaaaaaattagccgggcgtggtggcgggcgcctgtagtcccagctactcgggaggctgaggcaggagaatggcgtgaacccgggaggcggagcttgcagtgagccgagatcacgccactgcactccagcctgggtgacagagcaagactctgtctcaaaaaagaaaagaaaaagaaatcacaagttgatctttctgaatgttggggcccaatgtatttgagtaataaacttgtaacatgagggaaatggacaagtgaaccttcttaaggactcatggtaatttgactctctcctgtatgattctttactgacagtgacatgaaggggaattgcctggggtagacttaggctgtctagtgtcatatgctgcttttattaatccggagatttctgattggaatatatttccatttcaatgggattagagtataaagaatgctttgttacaattatttacttacaccgccaccaccgtaagtaataatagtagttagcatttaccctgtgtgtgttacctataaggtgctgttctcagcacttcatgtgaattattcctcaaattatccccaaactctctgagactgcgctgttaccattttgctttgtagctaaagaaacagcttagagaggttgagtaactcctccaaggcatactcagcagtaggcaggacttgaacctgcgttgtgatttgtgaattcccacttttaaccacccttcactgcccatctacactgcctcttgcacatctcatattttgccagatgggaaaactcaccaaggatgaagcttccttaagatctttttgagtataaataggccatctgttgatctgtgtgtccatcaggttaggggctcttacctcaagccaacatatggcagaaaagatatgtattgatgtcttgtgggatagttaataaaacacaaatgtgcagtgcagcttctttaacctgctccatcttggacccaaattcccccac

SEQ ID NO: 2435 - DNA, 1169 bp, Homo sapiens
ctgttggtgacaggtctagtgtggggtgcacatttcatcattagatgggtgctgcttctattggtgacacctcagttctgtcgctctgctttagtaaactcagggattgttttattactttgttagatttttattgttcatatagtcagaaatcacatgaaatgaaaaccctatataggtttgaaattttttgaaagttgcactcaagagatggaattgttactaaggttgatagagccatatttctcattagcatggaagtatctttttcagtctattgagtgttcagttggctgtaattctgtcattccctaaaaggttagggaattatgtaaactttaaggatgattttaaaatgtagcatgcaacaatggaaagatggtttttcttcttattaagaaatatctttcttaattgtaggatatattttctagtttaggtatttctgagttactaaatttcaaaaagtacatattttaatatttaagattactaacataattttagttttagcctgttaatcttttatacaaattaattattagtatagctataacctttactagaaagtctataatgtctgcatcttgaacatgtgatgaattttctgtgggaaaagctgcatttcttaggacttttattttattttatttcttagcacttctggtgcctctacctcaagaattttgttgcaagacacaaccaatgtcacaagaggattctcttgttgctctaaactgtgagattaacttttcatgcctgctaaattgtgatcaagtgttttgggatggtgattctcaaatagacatgagtgaaactttaatatatggcctaaggcctgggcgcagtggctcacacctataatcttagcacttcgggaggcccaggtgggcaggtcttttgagcccaggagtttgagaccagcctcggcaacatggcgagaccccatctctacaaaaaatacaaaaattagctgggcgtgatggtgtgcacctgtggtccctgctactcaggaggctgaggggaggatcgcttgagctcaggaggtcaaggctgcagtgagctaagattgtgctactgcactccagcctgggtgacagtgagaccctgtctcaaaaaacaaaacaaaacaaaaaactattaaaaaatatatgtggcccaagatagtt

SEQ ID NO: 2436 - DNA, 1177 bp, Homo sapiens
ctcaaagggtagcaagaaacagctgcagcctcctttctgtggtcaccagtggtccagttgacccgtatgttgttagccgttcaggaccctggggcaggcccagaagcttcagccccaggaagggacgcaggcctgcagaagagggagggggcgagccctagggaattttcctttgtgaccccggaggatagggcaatgtttctctggcctttttttcattacatgtatgatttttattcttttgcccagggagtgagggtcactaaagagcttattgatagtgagaaacaaaaatcatctgtgtctcccctctgcgtctcatgggcttggagggtgtcagagccctcaggagcgactcaccttgtcccatctcctccttttacaaatgagatagacataggctccaggaggtataggggcttgtccaaggctcacggataaaccactacaaagccactggaggtggtcacggcgatgtctcaggagggatctgagacatgaaggactgaatttgcggtgagttcattggaatgggtggccgggtgcggtggctcacgcctacaatcccagcactttggaaggctgaggcgggcggatcatgaggtcaggagtttgagaccagcctggccaatatggtgaaaccccgtctctactaaaaatacaaaaaaaattagccagacgtgatggcaggtgcatgtaatccgttacttgggaggctgaggcagacgaattgcttgaacctgggaggcggaggctgtagtgagctgagattgcaccatttcactccagcctgggcggcagggtgagactccatctcaaaatatatatatatatatatataaaatatataaaaatatgtaattttatataacatatagatgtatataaatatatatttggtttggagacagggtctcactctgtcacctaggctgcagcagcatcgaacacttaggctcaagtgatcctggagcccctttagtagctgtgattgcaggcatgtcccaccatggtggctggttttaaaatgtttattttatagagacgaggttttgctatgttgcccagctacaaaacacttttctagggccaggcactgggttacaatggtaatctcagcactttgggaggctgaggtgggtggattccttgagcacaggagtttgaagccagcgtg

SEQ ID NO: 2437 - DNA, 1205 bp, Homo sapiens
gatggggtttcaccatgttgctcaggctggtcttgaactcctgacctcaagtgattcacccaattcagcctcccaaagtgctgggattacaggtgtgagccaccacacccagctgagtgttactaactcttaagaatgaattcccctgcatattcttggatgaagagttcagaaaatgcttttctgaagttttgtttattgtctgtaatttatcctgtcttaatccaatttatctttctctcttgcaggagtccgaagcctttctctcaaatctagtagttaacaagaccatctttgctaaagtagacagattagcaggaattatcaacttccagagacccaaggatccaaataatttattaaatgactggtctcagaaactgaactcattaatgtctctggttaacaaaactacgcatctcatagccaaagaggagatgatacataatctacaataagggtcttagtgctttagaaaaaagttaaaattggaagtcattaaaaaaagactgttataatggtgtatatgttggggttttttttctaagcttctttgtcttaaattttaaaatagtgaatatgtttgagactccctttgacctttcagttccccaagttcattgttaactttgcatttgcaattggtgcaaaaatacagatttctgtcgtctgaatacacaaaaagttgtgtcataacttacccagatatgtttttctatcatttgaaacctttttagctactgtttgttttcattcaactaacaaacatattccaataataaaagcagtatatacatatttcctttctacagttacctctgattctcaacattttgtggggtagtgatttggcaagtgttttttaaataaaacaaatctcattgtaaagctatcagtcatttagtagaatagaaaagcaacatagagcatacaagaacatttgggatagagttgtgatttgtgaagaatttgtactttgatattgtggcggaaagtctagactgagtgtgtatgctggtaaactgtagacttttttttttttttttttgagtccggctggttccaatcacagtagcttgattgctttcagccctcatcctctcacttgatcagttgttcaacagaatcagctgacataattgacacagtttattgggtgttaagtccgctctatagggatagtgactactttttttttttttttt

SEQ ID NO: 2438 - DNA, 1219 bp, Homo sapiens
ctcgctatgctcagcctgtgtgtcatcattactgtcatgctggccattgttctctgctgctgtgcccgggccctgaggcctccttcacctctatccccaccaccactatccagtcagtttgctgctgcttccgtggttcacatgaggcagatgaggagtttgatgcatgctgggtgacatgcttcaacaagccagagatagatgcctgggaattgcataaagaattgaacacacttgctggctatgacctggttccagaaccccaaatcattgatgttgcttcgcaggcatgcagacagttcgatgcttttcctagggcagtttgcatcctagaggttgttaaggacaaggcaggacctcataagaaaatgtcatccaagaactcagaccaactttaaatgaattgggaatccccactccagaggacctaggcttagacaaagtgtgaaccccagggacaagcgttccagggatttattggtattgctacttgattgtaaacactcccctggaaatgctgatgataacatgttaccttatttgaacacctttttctttattgaataccaaaccatgttatggtaacttggactttaataaaagggaaatgagtttgaactgaaaaaaaaaaaaatagagagaatggtgtgttggactcccatgtaccctcaacccagccttatcagttttcaaaccatggccaagtaagaggcacttttgaaagagaacataggaggagttaccaaacagtaaaggcagaaattaaaagcaactgtgcctgctttgtttagaatacccaaaacctggaaacaatccagatgcccaccaataggtgaatgcatcaaccaattgtggtatatcttttcactggaatactattcagcagtgaaaaggaaatgaactatttatacatacaacatgcaagaagttaaaaataattatgccgaatgaaaaaagccccacccccccatatatactgtatgcatctatgcatataaaattctggaaaactatacatatgtaaaattctaaaggtctgcaacctgcattccaagggccaattccagcccatcacctcttcttgtaaataaggttttattggaacacgggcacactcaaggtattgcctatggatgcttttgtgttacaatggcagagttgagtagtggccatatggtgtgcaaagccaaaaatatttgtcaacccgcaggggttgaaa

SEQ ID NO: 2439 - DNA, 1223 bp, Homo sapiens
gggaggctgaggcaggagaactgtttgaacccaggaggcggacgttgcagtgagctgagatcgcgccactgcactccagtctgggcaacaagcaaaactctgtcccaaaaaaaaaaagcggggggaataagagaatacagattagtgaaaaaatattcccagagaatcccatggtagtccctctttaaaaataatacttatgctgggtgcggtggctcatgcctgtaatcccaacactttgagaggctgaggcgggtggatcacctgaggtcgggagttcaagaccagcctgaccaacatggagaaaccccgtctctactaaaaatacaaaattagccaggtgtggtggcatatgcctgtaatctcagctacctgggaggctgaggcaggagaatcacttgaacccgggagttggaggttgcggtgagccaagatggcaccattgcactccagcctgggcgacaagagtgatactccgtctcaaaaaaaaaaaaaaacttatttaaaaaacagtaagaaacatttaaaaataatgtatttaccctcctacaaaggcatgtctatagttccttgtctttggacatgtaagaattggaggcaaagaaatgtggacttggagaaatctggggccagcttgctctccgcaggctcaagatcaaccatcccacatagaagcagtaaaaacaataaattgttttggtttggtaatatgttattctaacgaaggattttaaacacttaagttggctattcttcatataaaaaataacttctttttttttttccttttcaagaaggcaaggtctcgctcaaccacactggagtgcagtgggaatcatagtttggggcagacatgaatcctgccctgaagcagtcctccccacttaccctcccaagtagctgggactgctggtacatgccaccacaccacatgaaaatacaatttttttttccttttttgagacggagtctcgctctgtctcccaggctagaatgcagtggcacgatctcggctcactgcaacctccgcctccagggttcaagtgattctcctgcctcagcctcctgagtagctgggactacaggcacaagccaccacacctggctaatttttgtgtttttagtagagatggggttttaccgtattgaccaggctcatctcaaactcctgacctcaggtgatctacccatctcagcctcccaaagtgctaggattacaggtg

SEQ ID NO: 2440 - DNA, 1199 bp, Homo sapiens
gccttctccctccacccgcttccgtcggccgggcccctcccgcccggccccgcgggcctccccacccggccccggcgctccccaccgccccccctgcgcccgcccctcccccttcgctttccttctccccccgcctcggctccgacatgaggggccggcggggcaggccgcccaagcagcccgcggctcccgctgcggagcgctgcgccccggccccgccgccaccgccgccgccgcccacgtccggacccatcggggggctccgctcgcggcaccgcggcagcagccggggcaggtgggccgccgcccaggctgaggtggcgcccaagacgcggctgagctcgcccagggggggcagcagtagccggaggaagccgccgccgccgccgccggccccccccagcaccagcgccccgggccggggggggcgaggaggcgggggcggcaggacggggggcgggggcggcggcggccacctggcccggaccaccgcggcccggagggccgtcaacaaagtggtgtacgatgaccacgagagcgaggaggaggaggaagaggaggacatggtctccgaggaggaggaggaggaggacggcgacgccgaggagacccaggattctgaggacgacgaggaggatgagatggaagaggacgacgatgactccgattatccggaggagatggaagacgacgacgacgacgccagttactgcacggaaagcagcttcaggagccatagtacctacagcagcactccaggtacccacccagcccagttgctgcagactccttccccacctcctctgccctccccccttgctcactcgtgtgctgtgcatcctgctccgatctccccccaaccccgcctcccccccaaacagaggggaaatgcgacggcacatcaagtggcaaaaaactagatttacaagaggaaagaggcgcattgttcaaaatggagattgcattgttgcagtttgcaggccacactcgctcgctctctctcccccccccaaccccctttttttcctcttcaaaatttgtgccagtgcagtgtctccaccgggcaggattgaaactttggcaaacacatatccattgcattcatttttctccccttgttttggtgtggttttctggaatgaaagaagcctcttgttttgcaaacctctttgcatttctaatgtggtttctttcggatt

SEQ ID NO: 2441 - DNA, 1196 bp, Homo sapiens
agaactgattataatttataatttttttacttctggtttataatctaatgggaaaactttgcatttagattttctatagatttaaaaattagagctgaatcattgcttcttcgtattattttaacttgacaattattaaagaaatgtacttatgtattttaggggggtatatgttcaaataggaaatttgtagaaatgatgtaatgtattgatttgtaatgatgtcacgtctttatctacaggtaggcgaaaaccaagagtacatcggcctcgttctcctatattggaagaaaaagacatcccgccccttgaatttcccaagtcctctgaggatttaatggtgcctaatgagcatataatgaatgtcattgccatttacgaggtactgcggaactttggcactgttttgagattatctccttttcgctttgaggacttttgtgcagctctggtgagccaagagcagtgcacactcatggcagagatgcatgttgtgcttttgaaagcagttctgcgtgaagaagacacttccaatactacctttggacctgctgatctgaaagatagcgttaattccacactgtatttcatagatgggatgacgtggccagaggtgctgcgggtgtactgtgagagtgataaggagtaccatcacgttcttccttaccaagaggcagaggactacccatatggaccagtagagaacaagatcaaagttctacagtttctagtcgatcagtttcttacaacaaatattgctcgagaggaattgatgtctgaaggggtgatacagtatgatgaccattgtagggtttgtcacaaacttggggatttgctttgctgtgagacatgttcagcagtataccatttggaatgtgtgaagccacctcttgaggaggtgccagaggacgagtggcagtgtgaagtctgtgtagcacacaaggtgcctggtgtgactgactgtgttgctgaaatccaaaaaaataaaccatatattcgacatgaacctattggatatgatagaagtcggaggaaatactggttcttgaaccgaagactcataatgtaagtaaatctggtcttaattttttgtatgcatttaaaattagactagtttccttcgtgattgatgtagcagagctatgctgttgatgtggtataaacctttgtaacttaatagttatacagttaaataa

SEQ ID NO: 2442 - DNA, 1218 bp, Homo sapiens
tttttctctttttccctttttacctacccttcaaaatttatcttgcttcatagtgaatgtttgagacacattggggaaaatgtggtttaatggtagatttgattcttcaatatgtaacatagaaattaatgagattaaaatagcctgacttgtttggactttatcagtgtttgaaatggtgctttattgtaggttagaaaaacactaatttgggtacaagctctgagactctgttattagcttataggattttgaacacccatatggtacagtactagttgaaagatttttggctttgttttcagctttaaaatcaattgaatgtttcatatttatctttaaattggttctccagtattacacagtgttcttataaatttttttactgcttgttcttaacatcaaaaatactaaattaatgaactggaatgtcaatcttgaaagtattaaaaccataatactaaaactattttatatcccagggtttagcaaattttcaggtgcatgctttattataagtaacatcatcccatgtgttttgaactcacatttccatttcggatcttgcagattttatattggctgtgatcggtgtcagaattggtaccatgggcgctgcgttggcatcttgcaaagtgaggcagagctcattgatgagtatgtctgtccacagtgccagtcaacagaggatgccatgacagtgctcacgccactaacagagaaggattatgaggggttgaagagggtgctccgttccttacaggtgagacccctctgtgtgcagcatttcaaaatgaaatcagccagcataattttggaagcatttctaggatttcaagtttccaatcttagaatgattatttactgactcccagctagtctagtgaagtgcctaacaaactgcagtccttcacgtaccagtgccatgagctttaccatatccccacaccacgtcagcttatctcacactcacaagagtgttaacatgactcacttctttatacattttatttttaaggagacttcctctcacccccatggattgagaagcagtatgattagattatagttgttcttggccgggcatggtggctcatgcctgtaatcccagcactttgggaggccaaggtgggcggatcacaaggtcaggagatcagaccatcctggctaacacggtgaaaccccgtctctactaaaaatacaaaaaattagctgggc

SEQ ID NO: 2443 - DNA, 1177 bp, Homo sapiens
acaagaaggttggcgggagagggaagctgcgggaggatttcgcgatctgcagtggctcccaacgccgcctgccctgcagagggtcccggggagctttgtaaaatgaagacgcccaggtccgccccagtcaactgaactagaatgggatggggcaggcactggaaccttgtttaaaattccccaggtgagcccaatggacaactggagttaagaacgcttgaagaacccgacaggaaggatagcacccaaacccggcggggtggatgccatgcagttaccgggcaggagagctcggagggtcacgcgcaggccctccggggcccttgcggccgctccgggcccatggcgcagcgcgcgggaagtccaggcggccgacagggacgcagaaaagcgcaggcgcgcgccgccgccgctgggggcggctgccaaatcacttgcctctcggcgcgagaccgcgatgcgcgggggcgggagcgtgatgatggcatcgcgtaaggagagggtgtgagaagccggatcctgtggtgacccagtggcctaatggataaggcatcagcctccggagctggggattgtgggttcgagtcccatctgggtcgcgtgagattagttttggtggaagagagggcgatcattggacagttgattaagagatggttcttggcagctatcgttatcacaaataaagaggtgcttttgagagttttaaaaacactgtcagcgaatgggtactaaaatacggtcagacctagtgttcggtagcacagtagggtaattatagctaacggtaatttactgtatatttcaaagtagctagaagaaaatatttgaaatgctcctaacacaaagaaatgatcagtgtttgaggtgacagctatcccagttaccctgatttgatcattacacattatacgaatgtaacacaatatcacttgttattcggggtggggtggctcacgcctgtaattccagctctttaggaggccaaggcgagagaatcacttgagtccgggagtttgagaccagcctgggcgacataaggagacgacaccacccccaaccccaacctccccagaaaaaaattttaaaattagcagtaagttataatatgattgggccactgcactccagcctgggtaacggagcgagaccctgtctcaaaaaacaaaaacaaaaa

SEQ ID NO: 2444 - DNA, 1205 bp, Homo sapiens
tagtttggcttgatggtaataaaatctttttaaactgagattttaaaagccaccagattagtttcaaatgaacaaccttgagaatcttagaatatcttgagggtaagttaacgggtgtcattgtaggaggtgatagagaagtaggccaaactcatcaccatgctctgggcctaatacagtcttttcctattgaaaagtgacggttggggaagaaaaaaatctcggcctgtttgtgttactgtagtagctagcatttatgaattggcaaagtttcagagaccctccctcctctatgtcaaatactataatatcatacaggattaaaggtgtaatatgcagatcaagacctagagattaaatacagacttcaggtaggctgctgcttggaatacttatatcatttttatacttattttttaatatatttccaggaagaggaagatcaaaacgttgtaccagaaactacctctgaaggctacactttccaagttcaggatggggctcctgggacctttaacttttagatcatgtagctgagacataaatttgttgtgtactacgtttggtattttgtcttattgtttctctactaagaactctttcttaaatgtggtttgttactgtagcactttttacactgaaactatacttgaacagttccaactgtacatacatactgtatgaagcttgtcctctgactaggtttctaatttctatgtggaatttcctatcttgcagcatcctgtaaataaacattcaagtccacccttttcttgacttcaccatgcctatgtgttgctttctaatttggggcctttaatgttgctagtgaaaggtaacctgtccaaactgatgggattaaccagaggtagtcctggctgcagtttttgcagaagaatgaataacattttctggaaaccctcagccagtgtctccttaagtctccttggccagggagatgggctaaacaccgtaaatttaatcataaatctctgctggagctacaaatggaattctttcctcccaaacttcaaggccgaatggggttccaaggtaaatcacggctgcacatgggcctcatctgggaaagtacccagttctgtttcgttgatgaggggcatgagggtccaccatgtgtcttttttaaaaatgtaattcccaagggctcctgtacagtgtaggttgatagccactactctttgaga

SEQ ID NO: 2445 - DNA, 1148 bp, Homo sapiens
gagtgaaagctaacttttcaaaaccccagtattctagttgagtagcttacaggttcttttttttttttttttgagacagggtctcactctgtcacccaggctggagtacagtggtgtgatcacagttcactgcagactcgacctccctgggctcaggtgatcctcccacctcagcctctagagtagctggaattataggcacaagtcaccacacccaactaatttttgtattttttgtgaagatagggtttcactatattggtcaagctggtctcaaactcctctgacttcaagtgatctacccacctcggcctcccaaagtgctgggtttacaggcgtgagctaccatgcccagcctacagttcatcctgtgcactaatctgtttcactctctaaatgaacaaagtgggagatcactgtcatggccaaagttacatggccaagacaaactatggcctgggagtcccaggttctcctgtgtgggcactttcctggcatatgctaaatgatgggaaagtctgggtctcatgtttctgtgtggtcctcacctcactcgacttctgctctttctgttcactctgggcttctgtgctttcattaatatagttcttagttttccactggtctgtatcccattctgccttggacgcctttacttcctgctgctcactgagaagcctcatcaggaggcctgtcctggagatgagcttggcacaggtcacttgcacataggtctcggagcagtccgtcttcaaggtccagataacatgagaaatgaagcttctcacatcgttgttggggatgacggactgtagttgatgggttagcggaatttcaaactgatcacctggggatgagagcaatgggtaactgaagcttttgggctcgggggacaggtcagtgcccacgttgttgtattcccattttgtctcagtttgtttaacagttggctctaagttgaatgcagtcctagtgggaatctgcctcaggaagatgattgtagtttgtgttttcagagatggtgccttctggcatagtagtgttttccataaaaacgttttcttcagaggcatttcttgcagttgtgttttttacagtagtgttttctataaaacattctgaaggagcaaatacttctggaaaagggt

SEQ ID NO: 2446 - DNA, 1424 bp, Homo sapiens
tctgcctggttttatttatatcttgttattaatgtttcttctccaattctgaaatacttttgagtatggctatctatacctgccttttaagtttgaaactaactcatagattgcaaatattggttagtatttaactacatctgcctcggctcacaaattccgattagacctttatccagctagtgccaaataattgatcagatgctgaattgagaataagaatttgaggtctacattcttggttgttaatttagagcgtttggttaaagtatgtccttcagctgactccagtataatctcctctgctcattaaactgattccaggagattggatttgctgtgactagatacagatggagcaaatgtcctaacagagaaatagaggtgatgctgctaaagggagaaatgccaggcggacaaagttcagtgtcgggaattttccccgtgacattcactggggcatgagattttggaagaagttttttactttggtttagtctttttttccttcctttttattcagctagaatttctggtgggttgatggtagggtataatgtgtctgtgttgcttcaaattggtctgaaaggctatcctgctgaaagtcctgctttcctatctagcatttatttctctggcaaacttttctttcttttcttttttaaagtaaacttgtgtattgagtcttaactgtatttcagtattttccagccttatgtgttacattattccaatgatacccaacagtttatttttattatttttttaaacaaaatttcacagttctgtaatgtaggcacttttattttcattgtgatttatatataaggtaatgtagggttatatttgggagtgactgcaagcatttttccatctgtgtgcaactaactgactctgttattgatcccttctcctgccctttcccaggtaatttaaattggtcatggtagatttttttcatagatttgaaaaacttttaggttgttaccaagtatgaagtataaatctggggaagaggttttatttacattttagggtgggtaagaaagccaccttgttacaaattttttaatttccaaaataatctatattaaatgagggtttctgatctgtactttgtgtttagctacctttttatatttaaaaaattaaaaatgaaaattacgttcttacaagcttaaagcttgatttgatctttgtttaaatgccaaaatgtacttaaatgagttacttagaatgccataaaattgcagtttcatgtatgtatataatcatgctcatgtatatttagttacgtataatgctttctgagtgagttttactcttaaatcatttggttaaatcatttggcttgctgtttactcccttctgtagtttttaattaaaaactttaaagataagtctacattaaacaatgatcacat

SEQ ID NO: 2447 - DNA, 1192 bp, Homo sapiens
gggaattggaagcagcaagcaggaacgctccctcttatggaaagaagagcccagggccctggtcatgacaggttcaggtgccaaaaaggagacgggaagaaaacgtgaggcgccagaacaacaggttctacaaggtgcacacgagggtccctgccattgaatgaagaattttctgtgtggatgcccctgcgcaggtccaatgaaagccgtggagaataagcgttagctcttcaaactgaatctgagctaaaacctagcaaagccaggctggggtctgaggggttgcgggggaagacaggaaggggtggacggggaagaggcgggggtcctaggaggaagggatggggaggagcgagaggagggaggcggagggagggcggcagccaggatggtccattccattcttggagctgcactgttgacttcgaccacaagggggcagggctgctgaaattggaagtgcgaacgcctacatgagtcttgatcctcggcaggcaccgtacccagtttcctccgttgggagggtttaactgcccggaaacggaagtctcgttctttttcgtccttttccccggttgctgcttgctgtgagtgtctctagggtgatacgtgggtgagaaaggtaatctggggcaatccactgccaggtgaaatctggggaccccaggtccgcgtggagggtgtcggggaggagaaggggagtgcgatggggccgatatttcgggggagagcgggaaaacggggttcgctgccagcccccgcgccgtgttaacgccgaggactgtttcccgcaggtcctggtccgcgccagagcccagcgcgcctcgtcgccatggtgagtacagtccctgcctggcgccttcccggggtgggctcgtggggccccggggcgagggcgagagagcctcccaaggatctcctgaggccgggagaagctggtggactgggccatcgccgggagacgtgtctctttcctctctgttcacccgcttcctttgtgttgcagcctcggaaaattgaggaaatcaaggacttcctgctcacagcccgacgaaaggatgccaaatgtaagtggttgctccgaaggttcaagaagagcggtgcctagcctggcaccgctccgggagcgtcttccccggaatgtcaggcaggagacggttaggccgtctgggtgtgtgcctggccctctggg

SEQ ID NO: 2448 - DNA, 1198 bp, Homo sapiens
gtaggtgccacctcagagagggcctggctggccccatgacaagaacaagaagtgctaactggtaccagagtccccagatagagctgcgagggccctcgctgtgggcgcgagctccggagtagcaggctggatggagcatcccttctacagggacacagccgcctgccagctgggcctaaagtctggagcttgtctctgaaagggaccgtctgctgccctcgctgccccactggagccctcagggcctcctacagtgcaggtggtcctactagagggaagccatccccacctggcacctcagcggcttggcagtgacatggcagtgggagggctctgaggttcccaccctgacaatggtcaggctgcccgtgctcccactccaacactaaaagcggctcccttaggggctgagcgtgggtgctcagtgttcacgctatatcccttgggcaatgtggggttggatggggcccccacttccattcccatggaaggaggccaggtccccagccacctcccactcagccatgcacgcacttgctgggctggcctcctgggaaacacaggtgactcgaatgaactctgcattttcaacgtgccttctactgcttcaggacctgggggtccccctgaccctcactggcttgcccccagccctgggcctggccccacctgtcctggagcccagagcccctggcctggagctacctctctggggtgggtctcaggccccacccctccctcttttgagttcagtgccttgctcagcccctcccctgtatctcagcgtcttcagacctctgacagagcgacgatgtagggtctcccggggcccaaggtggtctcagggtcaggggtgggatttgcagggaactcggggagcccacgggctgcgccacctctgccctggcagctgaagcctgggagagtccctgcgtggtgtaattggcctcagcccgctttctctgtgccgtcgcacctcagtgtttctcatagcttgtccccacgtgtcactttccatccacgggaaaaacaaatgccccttctccatctatcattgcgacttcctcccaggaggcctctcaggttgggtagagcaggggcctgcagtggtcaggccaagagcaaggaagacctggctgccccactgtggctgaaaactcaaaacatctggaactacccttctccaattacgttccct

SEQ ID NO: 2449 - DNA, 1191 bp, Homo sapiens
ctgttgagcgaagcgctcacccttcctctggccccagccgcccgcctagtcacccccgagcggagcggcacctggactagtctctgagcctccctgggaattgcgaccgcgtggcctaagggatgaggcgtctgacgtcagatcataagattgagggttcctttgtggtcgggctcttttggagcgagcagcccttgcccgaatcccagcatagtttgagggtttgttcttccctccgccctcgtccatccctattcctcccagctatgctccaccggcctctgcgctcgccgagcacttcttctcggggttacagggcaccgcgggctcctggtccccgcgcgtcgtcaccgcatggagctcttgtgtagcccggtggggacgccgcgcccagccagcggttcatcctgtcgtccccatggcttctcaggcttggagcgcggtgacccacagcagggccgtgtttgggcactatggttgaacacctatcaaggagcacgtgggtttagcgtcttaccgcgccccagtggcctaatggataaggcactggcctcctaagccagggattgtgggttcgagtcccacctggggtgtcgagaggggctgtgctcgcaaggtttcttttggtgccggcagccagagacctcagaatccaccaccacctgcccgctacctgcttgcctctgccctgtttgcgcccctcgccttctcttgcaggaccctctgtttgcagtcgcggtggtcatttacctctggttctccggggctgccccgccaggtggagctggggtgtcctgggaaccctttgggcaactttattcttacgagtttccccagcttcgaaattgtggggccctacccggacgaaagctgttcattcaagggcttggcaagacccgagcttaccggctttaggcgcttggaggaggtggctcctcctcaacacgttgcacgggagtcgaactagagaccaaggtcgattccagcatccctgagaagggaagagaaaagaaataaaaaattccgtaaaaggaactttcacctctaccccaggtgggactcgaacccacaatccctggcttaggaggccagtgccttatccattaggccactggggcttggggcacgtggccgtgccatcccttcccctcataagcgagtgtccccttttcctagagaaggcctgacaga

SEQ ID NO: 2450 - DNA, 1089 bp, Homo sapiens
cgccactgcactccaacctgagtgacagagtgagactccaactcaaaaaaaaaaaaaaaagaagagcagagaggtggattgcctgagcccagagtttgagaccagcctgagcaatatgacaaaaacctgtctctaccaaaaaaaaaaaaaaaacaaaacgaaaatttatcaggtgtggtggtggcatgcacctgtagtcccagctactcaggaggctaagacagaaggatggcttgagcttgggaggcagaggctgcagtaagctgagattgcgccactgcactccaccctgggtgacagagcaaaactccgtctcaaaagaaaaaggacaggaaaagagtagaaaaaaagtcagtttgttccaaagggagacaggaaggaagctaaaaggaacccaggaggtgggcaaacatttaacttgaaagccccctggggcgtggtggcgcatgcctggctgaggcacgtggattgcttgagcccaagagttctgggctgtagcgcgttatgccgatcgggtgtcttcaccaagttcagcatcaatatggtgacctcccaggagcgggggaccaccaggttgcctaagaaggggtgaaccggcccaggtcagaaacagagcaggtcaaaactcctgtgctgatcagaaagccctctggctcccagattaaggctacactctactgctgaatgaacagagcctaaattcctgcacctatttacagttcaatcgaccacaaggcctttggccatacgcatccttcctaagcttccttagggatctggctgtcatgctgtgtatgtaattatccctgttcctgctccctacccacaggcatgttacaagctcagtgctttagaggtgtgaagtctcaccttcttctcaaagtcatccaccaagccagccttggccacattggccttgtagtaagcccagtcgatagctggtggattctcaggtaaagcagccaacctgcccacaaggaaaggcaaaagttaggattgttcataagcagtagaaaattcacatggtaattttcctatcccttcttcctatggcctggagggtcaccacactttcctctcctaagatca

SEQ ID NO: 2451 - DNA, 1137 bp, Homo sapiens
gaattgcttgaacctgggaagtggaggttgcagtgagccaagactgcaccattgcactccagcctgggcaacagcgagactccgtcaaaaaacaaaacaaaacaaaaaaaaacttcatgtccttatatatttgtgtaatttagaaaagaacataaacaacaaatatgggaaaagatgaacaatggttaattctgtggagtgggagcatggtgggtgattattttgtttatgcttttaggtatgtttccaaccatcaaaccaaaaaaaaaagaaaaagagaaacagatccttgatcttaacaggaaatggctgtcattatgagtattatttctattccctgttttcatagaaaatgtggacacagacttgccaggcagcctggggcagagtgaagagaagcccgtgcctgctgcgcctgtgcccagcccggtggccccggccccagtgccatccagaagaaatccccctggcggcaagtccagcctcgtcttgggttagctctgactgtcctgaacgctgtcgttctgtctgtttcctccatgcttgtgaactgcacaacttgagcctgactgtacatctcttggatttgtttcattaaaaagaagcactttatgtactgctgtcttttttttttttcttttgaagaacaggtttctctctgtccttgactcttgggtctgtgggccatggcatgagtgttttctagtagtagattggagggaaagctttgtgacacttagtactgtgtttttaagaagaaataatttggttccagatgtgttagaggatcttttgtactgaggtttttaacactttacttgggtttaccaagcctcaactggacagaccataaacagtccacaggcaccgttcctgccaggccccaacccacagggagtctctccgcagagccttcttggtgttgccctaacttgccagtggcctttgctcagagcctcctcctgtgacatgtgaacaatgaagaggcctgcgcctcctgccttgccgcctgcaaagcaaagaaactgccttttattttttaaccttaaaaagtagccagatagtaacaagactggctggctgatgagcaaagcctttgctctcacgcagaggaaggcttggatgtacaatgaaact

SEQ ID NO: 2452 - DNA, 1179 bp, Homo sapiens
gcgactgagcgagactccgtctcaaaaaaaagaagaagaagaagaagaagaagacactgcattttaggcaagagtccggtgggaagcaggttgagattgactgagaggaagtaaccatgggagggctgctggtccactgaatgagagagatttttccagaacctcatgctggggctttgatttaggaatccccttcctcctctagtaagtctgccttccctggcctatggcttacgtctaaagcctcgagcctcatcgttcccaccgaggaccagctggaagccattttgattatgctccaccacgaaggaggacaatacagccccgcccagagccaggcgcgcccccgcggcgggccgggtgcgcgtgtccgcgcctcttcccgccggccgggcgggcgcctggcccaggacgcggtggcgtgggacggggggtgggggtggttatgtaagcgttgcgcgctcccgcgaggcgccagccaatgggaggcttcggctactcgtgctcgcgcacgcagggtggggggagggagcgcacgacgtgcgcgcaccctctcccctcgtccaccgctgccgcctccttcttctgccgctcctggtgctgcttgtgtgctcgtttggtgcggacctggtacctcttttgtgaagcggcagctgaggagactccggcgctcgccatggccgacgaaaagcccaaggtgagctcgccgccggccccttcgcctcgccgcgcggtgggggtcatggcgcgggccggggtccggccagagcccgccgctggctcccagcgctttcccgggccccccacggggccggccgcggctcaggcccgggcgctccgcgccattttcctccctccctctcttcctccctcccgcgccgaaggaggccccgccgctctctcccgcccccggcggcctccgagtgcgcgccgggcgcgagttgggcgggcagaaagcggacgcccgcggacccaccagccccgaacggggattcttggcccagccggccggcgcgcgtgaggaggggcgttagggcgcgcggggtctccaccttctgtcgaccccgcgtcgggtgttgcagtctccgaggcggcgaggagtcctctgggctcgggcttcacctctcgggtaggaaccgcgggcatctggggacccctgcctggggccgcggcggcggg

SEQ ID NO: 2453 - DNA, 1196 bp, Homo sapiens
tggatatacaaagctggaattcagacaaggaagtttgggctagagaggaaaagttgggagttatcagtatgtatatgtttatatatttgtgatttttttttttttttttttttttttttttgagatagagttttgctcttgttgcccaggctggagtgcagtgccttgaatactgaattagtgaatattgaaccattgctcctaggggaaatacagggttaggttcctgcaagcctctggtcatattttgttcaaccaatcaatatataaccgatcacttgttttatgtgtgtatctgtttggagacaacttacttgacataatattgttgaatcattaacagtgaagtcagccaggcgcagtggctcacgcctgtaatcccagcactttgggaggccgaggcgggcggatcatgaagtcaggagatcaagaccatcctggctaacacagtgaaaccccgtctctactaaaaatacaaaaaattagccaggcatggtggcaggcgcctgtagtcccagctactcgggaggctgaggcaggagaatggcgtgaacctgggaagtggagcttgcagtgagccgagatcgcgccactgcactccagcctgggcgacagcaagactctgtctcaaaaaaaaaaaaaaaaaaaaaactcagggccaacagcactataattcgtgtctgaatgaagcttatctaacacctcccatagttcttgcacttagcaacactagaaagcacttcagtactacacgtggggacccaagaaaatgtacaaaaatgaaaaaaatgtggcactaactgcatcacgagaaagccttgtttagtgtgtgtcaagcaactcaatattcttgccactcttaattttgatttgaaagtaccacaaatactgatttgggggttacagataaattttagtgagtaggcagattcacagataaagactgaacagtgaagactatttgcattgagtgtatattttatgttatgttatgttatttttgagatggagtctcactctgtcacccaggctggggtgcagtggcgtgatcttggctcactgcaacctctgcctcccgggttcaaatgattcttgttcctcagcctcccgagtagctgggactacaggcatgcaccatcacgcccggctaatttttgtatttttagtagaaacagggtttcaccatgttgaccagg

SEQ ID NO: 2454 - DNA, 1197 bp, Homo sapiens
tgtgccctgattttccttcttgccttggtgtctgaatctgcagcatcgccctgagcaactggtggtttgtggcccacctgacagacctgctggaccactgcaagctcctccagtcacacaacctctagtaagtggccgggaggcaccgatcctcctcttcttaccaccaggcccccgagggtggtgtgaactgaatgcctgaaagggaggttgggctaagggggccctgaacagggcaggccaggagtcttggtcttttgttatgttttattccagtttcggttccaacatgagagagttcctcctgctggagtacgcctcgggactgtttgctcatcccaggtaggaaggaccccatgggtgtgggctatgcgggtgctcttcagcatgcgggtgccattggagcttggactgttctctcccagttggctccttgaaggcttcggaagggtcagtgaaagggagctgtaggtgccagtcctcggagccatgaggcagcacctcatgtctgtcctcctcgaacctttgcagcctgtggcagctgggggtcgattactttgattactgccccgagctgggccgagtctccctggagctgcacattgagcggatacctctgaacaccgagcagaaagccctgaaggtgctgcggatctgtgagcagcggcagatgactgaacaaggtgagctggccctgctcccagcctactgtctgtgggacgcaggagtcaggggatcctgaggtcacactttatgcctaccccagccatcctcctcctcacgagccacactggagacgtggggctgtggacgccaagaggtaaactaagagatgggataattacttgggagggacaggaaagctagggatccactggaacccagacaaaatctacacgccatctggaaaggcctgagccgccccttttctcacacacttgattccacgaggtcagggctggggttggcgctgtttccctgtccaggtgggttgctattgctagctcagcctggctcaatggggaagcagtgctggaggtggctccagaaaagcagagagagtggaatgaggatgaccaagtctgccccttcatttctcccctcactgttgagtaatgtaaacatgagttattaccctgcagagaggcagttgcatgttcacgaccatttctgaaagcatatggtattcacgatcca

SEQ ID NO: 2455 - DNA, 1075 bp, Homo sapiens
tcttgctcttagattgggccatggctttcatcctgtgtcccctgacctgtccaggtgagtgtgagggcagcactgggaagctggagtgctgcttgtgcctcccttcccagtgggctgtgttgactgctgctccccacccctaccgatggtcccaggaagcagggagagttggggaaggcaagattggaaagacaggaagaccaaggcctcggcagaactctctgtcttctctccacttctggtcccctgtggtgatgtgcctgtaatctttttctccacccaaaccccttcccacgacaaaaacaagactgcctccctctcttccgggagctggtgacagccttgggcctttcagtcccaaagcggccgatgggagtctccctccgactccagatatgaacagggcccaggcctggagcgtttgctgtgccaggaggcggcagctcttctgggcagagcctgtccccgccttccctcactcttcctcatcctgcttctcttttcctcgcagatgataaaaggaatctggcattctacacctggaccatttgattgttttattttggaattggtgtatatcatgaagccttgctgaactaagttttgtgtgtatatatttaaaaaaaaaatcagtgtttaaataaagacctatgtacttaatcctttaactctgcggatagcatttggtaggtagtgattaactgtgaataataaatacacaatgaattcttcacttggtatctttttttccccttgcctgccttaaaaatttaaaaaccgcatcggggagtcaggaatcttgggtccttatttcagacgtgatcacccagcttacatccccctaggggagcatgtggggctcacaggccttcctgggagcgatgcctgcagttggctgtcaggaactcctggggagcctgttaacaatacagaatcgcaaaccccgccccacatcctcggacattgcctttgaggacacagacacgcccgctgtttctgatgtagagaaaccactgaccacgctttgggaactctggtctagaccaagggctttgggaagataaagagcttggct

SEQ ID NO: 2456 - DNA, 1197 bp, Homo sapiens
tatgtatttagcttaatctgatgaatcaggttgaactcgtaccttagcagtctaagcctgaacgccataaagcctttaagtccattcctggtgttcaagtgagaaggttctgggtcaggcgtggcactggttggtaaatatgtgtcaatatttcttatcttactattgtgttagtgttgtttttacgatggtgtctttctttacccaaatgataggatttaaaaatattgtttaaagcccgtttccaagcaggcctgggtttgtttatagcagcacaggtgaactagagggtaggccatggctgaaacaggaatgcttttcttccgagcagacccgccagccagaatgtgtggtttggtgatcaggggtttgtgtaataataagctttgcctgtggccactgagacggtagtaaacagtatgggtcacatggcatgacaagtaggttaagggccagatttagacactgatggcctgcgtaaggaggagcaaaccacacactgcttgctttgggtttctctagctcccaaggccagaagtgatgggagaggggtgaggggtgtcagagagaagaaccttgaaaggcttagagtggtatttgaggaaccataaattttagtgtactataattaaatgaacccaattttcataacttcaagggcttcttgaaaaaggggttcatggtaccagtcttgcttggtagggaggtgaatagaaaaatactgggaaacacttaaaaaagatgtatgctggacaaagactcaggtgtactgaaagagcgtaaaccttcattatgttgacgtgaaagccaagtagggaatgttgcttagctataaggcagagcctattgcaaaatcagaatcaggagctgctgatttttttttttttttttgagacagaacttgctctgtagcccatgttggagtgcagtggtgtgattacggcttacggcagccttgatcttctgggctcaggtgatccttccaccttaccccctgagtagctgggaccacaggcacatgccaccacacctggctaatttttgtattttttacagagacggttcttgccctgttgcccaggctggtctcaaactcctgtgctcaagggatctgcctgcctcggcctcccaaagtgctggaattacaggtggccagaagttgccgatttttaaaattaaggaaaaaaatacatagta

SEQ ID NO: 2457 - DNA, 1087 bp, Homo sapiens
gcccgggaccgtggcgcttcgagagattcgtcgttatcagaagtcgaccgagctgctcatccggaagctgcccttccagaggttggtgagggagatcgcgcaggatttcaaaaccgacctgaggtttcagagcgcagccatcggtgcgctgcaggtaagacaaaggcctggagccgggggagggctgggcggtttccgctccccgagtgggattaatagtgcggctctcgtcctcaacaggaggctagcgaagcgtacctggtgggtctgttcgaagataccaacctgtgtgccatccacgctaagagagtcaccatcatgcccaaagacatccagttggctcgccggatacggggagagagagcttaagtgaaggcagtttttatggcgttttgtagtaaattctgtaaaatactttggtttaatttgtgactttttttgtaagaaattgtttataatatgttgcatttgtacttaagtcattccatctttcactcaggatgaatgcgaaaagtgactgttcacagacctcagtgatgtgagcactgttgctcaggagtgacaagttgctaatatgcagaagggatgggtgatacttcttgcttctcatgatgcatgtttctgtatgttaatgacttgttgggtagctattaaggtactagagttgataaatgtgtacagggtccttttgcaataaaactggttatgacttgatccaagtgtttaacaattggggctgttaagtctgaccatacatcactgtgatagaatgtgggctttttcaagggtgaagatacaagtcttaaccacagtgtaacttacagtttcctttaaaaaaaaaaaaagtaaacctggcagctatagaatacactatgtgcatttataatagctattttatatattgtagtatcaacatttttaaattaaatgttttacattcacaagtggtggggagtcttgtcattaaggtgtgtgtaatttagagtccagttggttttcttctgactgcacttgttctcatagtagtaaaatgctatgcgcatttataccttgcataagtcctcattctaccacatgttaaccctct

SEQ ID NO: 2458 - DNA, 1200 bp, Homo sapiens
tcatcattgccttcttcctagtgcaccttccaggccatagtgaaagctgttcaatggttggggaaaggccaggcgcagtggctcatgcttgtaatcctagcactttgggaggttgaggtgggcagatcatgaggtcaggagatcgagaccatcctggccaacatggtgaaaccccgtctctactaaaaatacaaaaattagctgggcatagtggtgtgtgcctgtagtcccagctactcgggaggctgaggcaggagaatcacttgaaccagggagtcagagttgcagtgagccaagatcgcgccgctgcactccagcctggcgacagagcaagactccgtctcaaaaacaaaacaaaacaaacaaacaacaacaacaacaacaaaaacagttggggtaagggcagggggtaggcagggaagcctaggctgcaggcagcaaagttgagtgacccccactaccgtgttccaggtgcccattcctgcacagaaccacaggggacactgagcgcaggtaccaccttcgttactacaaaactggaatctgcatccacgagacagactcgaaaggcaactgcaccaaaaacggcctgcactgcgcttttgcccacgggccccatgacctccgctcccctgtctacgacatcaggtgggctgggtgctgggctgggctgatggcagtaggctggggtccagggcaggggcctggcggctaatgatggtgagtacctcagactgcagtggagggctggcactctggttcttgccccctcatgccccctctccaccctctctgttctttcctctcctcccagggagcttcaggccatggaggccttgcagaatggccagaccacggtagaggggagcatagagggccagtcggctggggctgcgagccatgccatgatagaaaagatcctcagcgaggagcctcggtggcaaggtacaggcatccacacctcggccgcgccctccctataatcctgctcatagctgccctggggatttggctcaccaccacctactgcctgctctagccgaggccccgacctggcccgcatcccaccctacacccaccattcaaaaggcgcctctaggggcgttttccctgacacatcatgttcccaagatccctccaggctttcacatgtgcacaggcacgtacataagcgcacatgcaaatgttttccgccctgca

SEQ ID NO: 2459 - DNA, 1153 bp, Homo sapiens
gactgggaggctggtttccgtcatttttattcaactgttaccagcctatgcggcaggaccctctggggatttgtgcctgaggcgttggccgcccctgtgccaggctgggcacacactccctgacgaggtcctggagacttcaggacgcagagggaaaagcagccaaaagtggcctggctttctagcctcagtgactgtggcggacccaccggctcccggggcctggaagcggctgcatggccttgctgtcaagctgatgctctctggagccctgtcccccactcggagctcctccagcccgcttcccgtatttgcagcatgtcccggcgttcacagagcttggctgcctcctctgtcccaggagagagatgcttagagctgtcctcccagggagtcatgtcagcctctagggtgtgcatggagctgaggggacactcctgctgcctccctggagtggtaattaaccgggactttcctcctcccagaaccaacatcccgggtaaccgggtggctgaaggacaggtgacgtgtccctacctcccccccttccctgcccgaggctccggcatccaccgtcttgccttcctgctcttcaagcaggaccagccgattgacttctctgaggacgcacgcccctcaccctggtaatctacaccacccacacataacccggcctcaggccagctcccctggaacggtcactcttgctcagttctctcttgacctcagccttgagactggcagaagagcaggatagggtgctagcagactcccaggggcctctcagggttacctgttggggtggcggggtgaggggctctggtgccccactccacactctcatacgctctctatcttctcatagctatcagctggcccagcggaccttccgcacttttgatttctacaagaaacaccaagaaaccatgactccagccggcttgtccttcttccagtgccgctgggatgactccgtcacctacatcttccaccagcttctgggtaagggccatggggctggggcactgggtgggcctgagctcccaggcctcgcctgccctgccagggagaagctttgttaggggaaggctgcggcaggtccctggtgggcaggcctcagcctgagggggcgcaggccagcagaccaccccgt

SEQ ID NO: 2460 - DNA, 1160 bp, Homo sapiens
caagtcacactgtaattgactaaaacgactttttattttaaaatattgatggtggggttttgcttttttttttttttttttttttgagacgttgtcttgctctttcacccagggtagagtgcagtggcgaaatcttggctcactgcaacctctgcctcccgggttcaagcaattctctgcctcagcctcctgagaagctgggattacagcgcctgccaccatgcctgtctagtttttttgtatttttagtagagacaggggtttcaccaagttggccaggctggtcttgaactcctgacctcgtgatccacccacctcggcctcccaaagtgctgggattacaggcgtgagccaccgtgccgggccagtgtttttaactgtccacacttactaaattttccagtacttcttcctatggttcatgatagtaaacacagaaacatataaggaacattattagagttaccagatgttagctgttgcatatgtgcacattcctagattcaagggtgtttttgccttaaatttaagtgggtcattggttgtcttgggaagatcatggaaaattcgggattttttagaattctgaaccaaaatatgttttgagtgtttcttagtaaatgtgtgatcttccaccttccacattcagactgcggactacacttcataaatgcctttttatttccagttatggattcaactaaatgactgccttgggagcacataattactttgctacctttttccccctttgctgttgtggctcgagtttggttctcacctgagaagatgcattgagcatatgttgttacccagccctggcttaatggtgtcctgtggggtaggggtgggaggacgaggggcacggggccagagcatgtgaatggatcatggttggacagctgtgacctgccagcactgcgggtaagcaaaactacaaaccgttctttcctctgtgacattgaataaaccttaataaaattcataattagcacatactagaaaaaatgtgacttaatctttttgtggggcgacagtattgggtttcattctggctatacagctttgattggatcattaaacaggtcagtcacttccctcaagctttggggtgtggaataaacaccggtgaatttgtggattcacccgtcaacctccca

SEQ ID NO: 2461 - DNA, 1365 bp, Homo sapiens
acaccctcttaggctgtgcaaggcatgggttatcaggggattgaggtcacctgggacttcagggaggctcagcttgctccctgccccagacctgtttcttctaagggaggaggacatggtggagaccagggacaggagagccagcagggtggatgcaaggggcctctacccacacctggacctccgtgccctcaccccagccctaggtgtgcacctaggcctcattccttaccccccagcccctgcccaccttcagcaggatgaggccctgggttgccgtgctctcgctgttcccctctcggggctgggctggggccgctcttggccccaaggttgccccgggccagcagcccagccagcagcacagtctctatggtgctgaggaagagcagcagcagcaggatggtgaagtagtaaactgggggaggcagggcacagggagatgctcaggggccagtccctgtgtctctggtgcccagcgagctgagcaccagtgggtgaccggggagaaacagggcagactgggtaagggagcagggcttactgagcagtgggttgcaggaggaggagctgggcagggcctgcaccagggaggagtggaggacgaggtaactcagcagcaatgtcaccttgtagcctatgcgctcaatggcccggaggggcagcaaccccccgcacacgtcagccaacagcagtgcctctgcaggcaccaagagagcgatgatggacttgagcgccgtgttcttcagcctcagctggaaggggaaaagtcagggccttcccggcgggggggaaggaggtgggcatcgggggcatggggcctggcctctggccgtgcatcctcactcccacccgcctccagcagccctctgtcggcctcctcccgacttgactcaccgtcacctggaagcagggcaccagctgctggggtgggacttgggtcttcagatcataaactacgtattccctcttgacactcacaatctcgttcaccacgtgggcctggaactctaactccatcgctgaggggtgggaatgagaactatgaaccaggaaggagagatcccagctgccaagtctgggggtagcagactggagcccaggggtgatggagacttttgatggcttttggcagggacagacttggacacaaaaccgatccatagaagggcttcccaaaccttgttttgcaacatcccaaattgtctccagttgaaggaaggcctttatcagattcatagatgagctttcattgtaaaaataaatgtactttgcaccacttcatgatggagggagaagtggtcacaggctcgtcagtctatcatctcacagctgaagcaggatccccagggctaccgctgtggt

SEQ ID NO: 2462 - DNA, 1099 bp, Homo sapiens
catcccttggcacataggaccaggcagttctgccgccggttttgcctgcaggcgcccccgccgtggcctccagtaatagggtctggcctcctcctggggcagctggcaacccctcctctctgggacttaccagcctcttagattttgaccccatgccagccagcctcagaagctgcagccaaccaccctcttagatgttccagaagccctgactgggctggtcacttccttcacaggccccgcatttgcccacatggatgaccccagtgccagcctccttgaggtggcacagccacctgcccaccctgggctgccctctttcaggtacaactcagaatgctcagtcctggggtcaaaccaccttatccaggacgctgattcaggaatcttccctccttatctttccatccgtcactctcctgcctctggtgtctgatcccactgtctgcgcagagccgagaatgaagccagaacaaaggctgggctcagctccttttattcccctcgaacctggcggggcctgctggctcccttgcagctttctgccagaacagtcagcctcttccccatcctctgccagtgtggggtacaggccaggagctgggggacccacgccgcccccagccaggagtgtggctggccccagaccagcagctcaagagttgtgccatcccccagggagagatgacatgctggacgtggagaccgatgcctacatccactgcgtcagtgccttcgtcaagctggcgcagagcgagtaccagctgctggccgacatcatccccgagcaccaccagaagaagaccttcgactccctgatacaggtcccgccccgccccgggggctctgcagccagccccagcaagagctgtcacaacagactcttgcagccctcaactccacccaccaccaccacctcgtgccctggggaccggtcctgggtggacgctcaccacctccccgtcacccctcttcctgcacactggcccccctacatactgcaaggatcccccactagcccagaactagctcccaccgccccacccttccctgaactgtctccctgccccctcaggatgccctggatgggctgatgctt

SEQ ID NO: 2463 - DNA, 1099 bp, Homo sapiens
aacaaggagggtcggtagtagaatcaaggctccatttggagaaggaaatgactcctttccttcatccttgtccccagcgtctctggtggtctcagggaaaggcctgctcactgttggggagctgggtgcggggcctggggggcaggtggagggccgctgctgttttctctcactcatttcctaggtcttcttatctcctctctgtgtggctctggtgacagggacgatccgtaaggctcagaaccttctgaaacagtattcccagcatggtctagatgggaaaaaggggggctctaacctcattcctctggaaggtaatcaccctgtgttcccctcctgtcccttcctcctccactgtgtgtccacgcacttggcagggcagagcctcccccaggagggcctcgggagaaaccctgaggggagcagggtgggaacggcaggtccccgatgccactcgggcttcagcgggcacagggacagtttcgcagccctcggcctggtcctctctggctgatggcagctctgccctccctgaggcttccctcctcccttccctgtctctgtccttgtctcctgtgtgaactcagaaaaagttatttgtcttggggcagccctttcacgctcagaccagcagtggcaggccccagctggccgaggcctcccggccttcccatctttagaaaggggagtgtgtgcagcagaggacaggcaaactggggctttccccaaatacagcgaggtggggaacccccctggggccaagcatcagctcttcagcccctccttggtccttctccgctttccctgggcctccaggctcggggaaatgagcagctaaggacggtcctgggtgctcactgaagtcaggcttgaaacggctgttcccaaggtggcttgaggtagaggaggggctcagggccctctccgatgcccccttccccatccccatctgacgtccccctcctggagatgaagggcttcttccctgtaccccaaggggcggcctgcctggcccctggataaacgctgcttgtgtttgtgcggccgacatctcgccaggtcacgagcatgatttccgagttaagcacctgtccgaggc

SEQ ID NO: 2464 - DNA, 1176 bp, Homo sapiens
gtttctgtgtggctgcagaggccaggagtgcagtgactgtctcactgcctagtggttgtggctcacatcctgccctgatggagaggggggcctgtcgtccaaccctctctgaaaaactgcagtagactttaccatttcaggccccacctaatgttctttccttccttccccctacattcttcccgcccctttcatagttaagatgcataagctgagcaataaccccacttcctgatttccctgaaatatgagcccagaagcagcaggtgacagggagcttcccttaccctggggtggtggcacacagaccacctcctgtcctgtcccctgcaggtagtattcacagtgtggtgttacctgggaggagggaggaaggagctgagatgaaggagattcaggtaaacagtagccacagtggccaggacccccttcctgaggatccctgtccttcctcgcagcaggtgcttagtcctctcctagggagaagcacggaaagattcctcaaggcctcagtcccatgtccaaggcatacctaggttagaaatgtcctttacttgtttctcagttactatttctcctcttcctccctccccctgccttctcttggctgtcatttagctctctggcccacagaaatactccatccaaggagctggtcctcagtcagcctgatgaggacaggtcagtggccaacccttttgccccagtccttcatctggagacagtcacatagtcacgtcaacagttcacccaaagagaagaggtggggcctggcttctcccacagggcacagcctaactatggagacccagggctccttcctgctgcactaggcctgtgctctccctattgccttcaggtggtgtgatcccggcttcctcacagagcccttttttccttctgcccagctccatcccaccagagtttctacccccgctgaggcatctcctgggcacagaccaccacactctaagccggctggcctgggagttagggtcctgcccacctcacctgggagttggggtcctgcccacctggagtttagcacgctggtcgctcactttgctttggtctgcacacctggtgtgtgcatgtgtatactgcttgtgccatctgtgtacccctctccctggagtacacttgtggtcacactacagtggggacatcaagaatgca

SEQ ID NO: 2465 - DNA, 1477 bp, Homo sapiens
ctcctgggctgccctgctggagacaccatctggatttggccaaaggtctggctcctgtaatgttcattttctcttccccaggtgcctggcaggctgatgacaatgccgtcagtcggaatgcccagcgccggcgcttgtcatccagcagcctggaggactctgagacgaggccctgtgtgtggggccctttggctgtctgagccccagcctctgcacttgggctcccctcctgccctgcattccatccatcctcactcagctgctgcctactgggcatcctcagcaagatgctggagactttttaccctcctgtgacagctgttacaacctgtaaccacaatccctcacctctcagagggaactggaaccctcctttctccgtgtgacctaaagccactcaatgaactgcagctcacgagaccttttgcagggactctggaatgtcctcacggtatattgatgttcaggtggagctggggtccatgggctaatttcttacacatcttttttctccttagggggtagaacaagaaggcttagagtttggcagctttgttacaaacatccctctggcatttcctggtctctggcacatcataaccaattggaaacctgcagtttggggtagggctggaggatcgctcctgtggaaagggagagccatactgcacggacgtagcgtttccctctacaagcactaggagcacctttctcaaggacaagaaatggtagcaaccaaaaggttggttgaaggaaacaatccttccttctggtggcagagccagtcttctgggcctcacatgcctgtgcggttaagaaggagctcttggccgggcgcggtggctcacgcctgtaatcccagcactttgggaggccgaggcgggtggatcatgagatcaggagatcgagaccatcctggctaacacggcgaaaccccgtctctactaaaaatacaaaaaattagctgggcatggttgcaggcgcctgtagtcccagctacttgggaggctgaggcaggagaatggcctgaacccgggaggcggagcttgcagtgagccgagatcgcgccaatgcactccagcctgggcgacagagaaaaaaaaaaaaaaagaaggagcccttgaatctgagaatcccccagttaagatgatttcccttaaggagcatttctcctgatcaggtgcattcagggaggcctgcaactccatcctaaggtgacatttcaagaaacacatgtgttgaccacctctgtgtgccaagcactgggtgaggagtggtcgtatattaccataattcatcctcactcaattgggaggtggcattcttgtccctgttgcccccatctctacccccttttgttaatggttgagagaaatgtggaccagtgattctcagtttggtgcccaggtccccaaaggaagtgatggagagccttgagctaagttcaggcagcagcatgtggccagcagcagtgtgc

SEQ ID NO: 2466 - DNA, 1140 bp, Homo sapiens
cagcaaggttttgtgcagcccagtttggaagcaactggcttcatacaacctggcacagagcagcatgatttgatccagtctggcagatttcagcgtgctttggtgcagcgtggtgcatatcagcctggcttggtccaacctggtgcagatcagcgtggtttggtccggcctggaatggatcagtctggtttggcccaacctggtgcagatcagcgtggtttggtctggcctggaatggatcagtctggtttggcccaacctggtagagatcagcatggtttgatccagcctggcacaggtcagcatgatttggtccaatctggcacaggtcagggtgtcttggtacagcctggtgtagatcagcctggcatggtccaacctggcagatttcagcgtgctttggtgcagcctggtgcatatcagcctggcttggtccaacctggtgcagatcagattgatgtggtgcaacctggtgcagatcagcatggtttggtacaatctggtgcagatcagagtgatttggctcaacctggtgcagttcagcatggtttggtccaacctggagtagatcagcgtggtttggcacaacctcgtgcagatcatcagcgtggtttggtcccacctggtgcagatcagcgtggtttggtccaacctggtgcagatcagcatggtttggtccaacctggagtggatcagcatggtttggcacaacctggtgaagttcagcgtagtttggtgcaacctggtatagttcagcgtggtttggtgcaacctggtgcagttcagcgtggtttggtgcaacctggtgcagttcagcgtggtttggtccaacctggagtggatcagcgtggtttggttcaacctggtgcagttcagcgtggtttggtccaacctggtgcagttcagcatggtttggtccaacctggtgcagatcagcgtggtttggtccaacctggagtggatcagcgtggtttggtgcaacctggagtggatcagcgtggtttggtccaacctggaatggaccagcgtggtttgatccaacctggtgcagatcagcctggtttggtccagcctggtgcaggtcagctgggtatggtgcagcctggaataggtcagcaaggtatggtgcaacctcaggca

SEQ ID NO: 2467 - DNA, 1120 bp, Homo sapiens
atccacacgtggaacccatagatccagatggtcaactgtatgtgaatttcatcctctccaaaaaactatagtgtttctggaaagaacaagtaatactggttctacaccctggaagttttgctgtgacctttgaccatttgcaatgtgtttatatatatgtaccttttcctcttcagtactcttgattataagagtatctcttcattgtttttctataagaatacttgaaacattctttgttacatacagaaattattctaagcttcaatatctttgtgttatatgagtttcttttcttctaatatgtatattactttgcgtttgtgttcttgctactttttgccttcgctacagttctttatcctttcttttaagattctgtaatcaaggccttactgttttttccatctcttcggtattaattccatattcatatttttgcttctgccacattattcttttctcaattttctggaccaagccaaaagtcaataattcccactttcttagctttagttctttgtccatgtggaaggttgtagccttctctacattaaggctttattaaggttaacaatcaagcctgtgactgcagtgcttaatcacagtaccccgtcttcagtctgctggtaggaagcaggagttgagcatctagtttaggtccactgtagccatttacctgtaggggtgaactttgtaattttttgttttaaaatttcaggtttaactcacattatcactatggatcttcatcaaaaggaaatacaaggctttttcagctttcctgtggacaaccttagagcctcacctttcctgcttcagtatatccaggaagaagtgaggaaccaccagcaaacaccccattgtcctcaaaagagatcttatttagtttttctctggtatcagatttcgttactggaaggcacatcaaatgagctctcccttaagtcacaatgcctgaggcagcagacagggtcagctttagtcgtggacgatcatagctttaaaagacactaaaaacagattttttttctacgtatctttagcaatttgcttatgttttctaaaatgaatgttttaagaattatttttaaaaaattcttgacgtaggagtgctttt

SEQ ID NO: 2468 - DNA, 1138 bp, Homo sapiens
agtctgagattgaggagtcagactacgattcggtagaaggcagcaccagcggggcatcctcggatgaatgggaagatgatagtgacagctgggagacggacaatgggctggtggaggacgagcaccccaagatagaggagccccccatcccacccctggagcagccggtggcccctgaggacaagggagtggtgatcagtgaagaggcagccacagctgccgtccagggggctgtggccatggctgcccccatggccgggctgatggagaaggctggcaaggacgggccacccaagagcttccgggagttgaaagaggccatcaagatcctggagagcctcaagaacatgactgtggagcagctgctgacgggctcgcccacctctccgactgtggagcctgagaagccaactcgggagaagaagtttctggatgacatcaagaagctacaggaaaacctcaagaagaccctggacaatgtggccattgtagaggaggagaagatggaagcagtgcccgacgtagagcgcaaggaggacaagcccgaggggcagtcacctgtgaaggctgagtggcccagcgaaaccccggtgctgtgccagcagtgtggcggcaagcctggcgtcaccttcaccagcgccaagggcgaggtcttctccgtactggagtttgcaccctgtgagtcagcccttgcctggtcttcgccttcccccgccttctcggggctcctgtttgtgtcaccagatctgggtgcagggtggttagtcccctcgccagaccccagctactgccccagggcaaaccatttccctgtgtggtcacagtgctgaggccagcagcggcgagtgggaagtctgtgggtgtgctcacctgtccagccaggttggcagatggagctccagggcctctccatgagggactgactattctcttcccccctctagcaaatcattcttttaagaaaattgagttccagcctccagaagccaagaagttcttcagcacagtgcggaaggagatggcgctgctggctacctcactgcctgagggcatcatggtcaagacttttgaagatagaatggcaagtaggcttggcatgggcaggtgcagatgtgctgtgtgggcacccagtgcccaa

SEQ ID NO: 2469 - DNA, 1189 bp, Homo sapiens
ggagtgtcttgaggacggccccaatcggtagttcatatttagctttacagataggagtcaataggattgtaaacttctggaaagccgtagttttaacaacgagccttttttcctcccccagaggcctttctttgtttggcatctgcagagacggtgaaaagcagagctccaggttgaaggatcagagtaatagatggagcccttaacatgagtaagagtgggtgcaggcagggcctgagtggtcactagaaatgagaaagcacagttggtgccatcacatacattcacctcctgctttattctgaagttcaagtatgagaatacgtgttgacatacaagccagctatggtaagaaattactcaaaattcagaatgctaattattttaatgataaaaatgagtagcgtctttgcccgtgtgatttggggccactaggtgtcattgtaaccagcgtggatcctcgttagggcatgcagggatgaaagagacatggcaaatgaattttggatcgctaggatttaggaatctttgttattggctgagctgaggatgatttaaagttatccctgtctgaaatggtatcttttgtgaggaggtctgacttgctgaggctcagctgtttaatacaaatctggagaataaaccttaaggtggtttctgttagaatgaagcctgttatccttctcttttagattaaaggtggtggctgtggccttgaaaacagtcatgtgaaaactcatcaccttaaggtgttaagtgtaaggatcttcatgatgaaatttctgtaaatggtgagatttttagtactttcatagacttgaatatgcttatggtcctctttaagtattggtttgttagttttggggatgtgttggtcttccagggttacgattgcccagataatggaagtagtatggaattccttttgatagggtccttgccaagcactctcataaagagcattttttgtttgtttgttttgagacagagttttgctcttgttgcccaggctggagtgcgatggtgcgatcttggctcagcgcaacctctgcctcctgggttcaagctagtctcctgcctcagcctcccaagtagctgggattacaggcatgcaccaccacgcctagctaattttgtgtttttagtagagacggggtttctccatgttggtcaggctggtcttgaactc

SEQ ID NO: 2470 - DNA, 1189 bp, Homo sapiens; identical to SEQ ID NO: 2469

SEQ ID NO: 2471 - DNA, 1996 bp, Homo sapiens
ataaaagttctcctggtgtctccgcagagtgccttccaggaacagatctttgcatagaatatcagtggtttccttttttgtttcaaatagtggtcagaaaatacccagtgttgactcaccaaggcaatcagcttcctttttccctttttttgttttttttttaacattttatatttttgctttattttattttattttattttattttattttattttattttattttttgagacggagttccactctgtcgccaggctggagtgaagtggtacaatcttggctcactgcaacctccacctcccgggttcaagcaattctcctggctcagcctcctgagtgctgggactacaggcgcgtaccttctttagtagagactgggtttcaccatgttggccaggatggtctctatctcctgaccttgtgatctgcctgcctcagcttcccaaagtgctgagatgacaggtgtgagccatcagacccagcatttttttttttaatttaaatttaaattttttttcatttttttgagaggttttttttgttttgttttgttgttgttgttgttgttgtttttgagacagtcttgctctgtcacccaggctgggagtgcagtggcatgatctctgcaacctctacctcccaggttcaagcaattcttgtgcctcagcctcccaagtaactgggactacaggtgcacgctaccacacctggctgattttttttgttttagtagagacagggtttcaaccatgttgcccaggttggtctcaaactcctgagctcaggcaatccacccgccttggcctcccaaagtgctaggattacaggtgtgagccaccacacccagctattttttctttcgttttttaattttaaagttgggggggggtctcaatttgttaccctggctggtctcgaactcccggacttaagcgatcctctggctccaagcccactaccagtctcaggtttctttactaaaagatcactacctttttttctcttatctgctgccatgtgagatgtggctttcaccttccgccatgattgtgaggccttcccagccatgtagaactgtaagtccaataaacctcttttgtaaattaaaaaaaaaaaatcactatttaagatactaggatggattgtgactgttgaggagtacttacatatcctacatttgactacattatttccaaaccaagtattccatccaaaggaacatactgctatcatagagaccaaggagggactgtttaaggttgccaaggtgaagcgagctgagaggctttgtcctcgtgccagtaactctgaaatctctcttaattcctgctgtccaggcagcagaatgccatggtttccccaagtaggtagctgctttagcagttaaagcccaaatgtctgttctgttgatcagaggtctctgaatttctgaagtggtgtttcgtttctggtgactgagttaatcctttacaatccctcttgtaaagtgtgctaatagaaagaatccacctttcaaagctgcagaaccagaccgtgccctaaattgaccaacgtaactgatgtgcctcaggaagtctcttgccagctgtccctgtgaagacccccctcctcccccccagctgctgccttgcacactgaagcatctcagactgtgcaaagccgtgtagtcatcaagacagtaaatcccagggcttggttaagtgctgtgtgataacttgtttggatgagacttaacttaaaaccacttacaataaacttgggaaactaccgtcagctgagttcaaatttactgacgccatgatatgaggatgaaggtttattacctggtgacatcatcctgttggtgacaaggtggtgatacatctctaatgggacttccctcagtggcaggcaggctgccaagcaactaacccccatcaagtgccagaccctcccagtgttctgagagtcatctccatgctaaacagcctgcgttttatatgatttctctaccc

SEQ ID NO: 2472 - DNA, 1075 bp, Homo sapiens
tcaaaatcctgatggcattgggaaaagtaaactgaaggaatttttgtacacttgtaccagctaagatgttctgactgcaacgacagaaaactccagctcaactggcttaaacaagaacagggctctctcacgtgagaagccaagagttagaacaactccaggcccagaatggtcggagctcaagctgcagttctcttagctcagtcttcctcgtactgtgggcttttattggagactagctctcctcatggtggcaagatggctgcaggagttcaggtatctcatccagaagcaagaaaagggcatgtcttgcttgcgtctctaggcgtaagggaactggtccagatgtccccgccccacatcccttcagatcccaattggccagaatatggcacgtgcccatgtttcaaccaatcatgggcaaggacatgggaccagcatgattggcctagacccctggagcctggggctgggcccagcatcccctgaatacatggccatctggaggagaaggtaactgaatttcactggggatctgtgataaaagggagcatgggtgttggggagacacctgttccagttgggtttcctatgaggtccaggacagggcttggtgggcactcggaagccagtgtctgaagtgctcagcatcctcctcttcctcggtggtgggtgtccaccgcccaggccccacccctggccttggacacttcatggaaacactgctgatttgctgtggtgttgggtggctcctatctattccccgtaagtgctggcctctgttgacaccatttctgctacctcatctgagattgttctcatcagctcacagagattcatttcagtgaatgaaccaaatctaagctaaaaagcataaaggagggcagaaagaaacagcagtgtgggagaaagagcgcaaacaccgagagaaagatgtctacctggcagccatgtcagagaatcaccagtatgtatgtcactgccaccaagaacctaagagccacagaggcctacagaagccaatcccaatggaactctctctgggtgtgggggttgagagaacctaaagcattca

SEQ ID NO: 2473 - DNA, 1098 bp, Homo sapiens
cctgagtaactgggactacaggtgtgtaccactacatccagctaaaggagagcgtttttttctttttctttttgagacagagtctcactctggcgcctggtcactgtgcccttcaccttctgggttcaagtgattctcctgcctcagcctccctagtagctgggattacaggcatgcaccaccatacccagctaatttctgtatttttagtagagatggagtttcaccatgttggccaggctggtctcgaactcctgacctcaggtgatccacctgcctcggcctcccaaagtgctaggattacaggcgtgagccaccatgcccagctgggagcgttctttcagcaaaaagtctaattcagagactcaccttccatcctggcactaaacaatagtactagaggtaagatctgccaagaatttctctcacttaagcaggatacttactttaaatataattaggcaagacttatttgagtacttgcctaattgtatttaattagaactatgctggatgctgtagacagaagaaataaaatactcaacttggtccctatcttccagcaggttagaggcctttagggaagaaaagcctgtgtgcagggaaagagaacctcaccagaaagtattcaataaaatgccaaagtgatcttacagaacagtgcctgtgacaccggaggggattgttctgtctttgtgagtgaacatacaatgatggggataactggtcctcataccatgcaggtcccatttctgatcaccccactggcaggacaattcacagttcttgagcaaactgagttagggagggtatgctaacgacagaacctatgcaagttcttagaaatattttttgtttgctgaaataaagctcaatcaacacactaccttaaaaaaaaagtggagcagtggcatttccatgcctcatgctcaccatcatgaggttaacttcccgccgtcgcctcttgcctgccaggggtttttcgggagcccctctctgttccactctgattccttttgtttcttgctgaccattcactctctgtgtctgttgttggatccaaatacgagtgtttttctttctttttgtggtcagtgc

SEQ ID NO: 2474 - DNA, 1108 bp, Homo sapiens
gcggggccggccccgctgcctggaattaaccccgctgtgcttgctcgtcccgcccgcagccctaggcggcgtcgccgcagccgatcccggagtcggagtcgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatggtaatgtctgggaatccgagacacataaccctaattcataaatgggatttggggtaggtctttttgagtcgtgttaatgtaagaatgactcctatcattaggagtgctgctcggaggttactcacctttgggagtaatactgaagagaggggtctgcagaaaggatgtgtatgaagcttagataataatggctgtttcgtaaactgtttgagacctattaatgaaaatgactatttcttgctgtttttatccaacgtctgcattttccccctttaaagctgcggtctcctgtttgataaaagaatattggccagtattgcagattttaactgatttggctgatcctccagggaccagtttctgtgggcgtgtattggagcaggtttgtctttaaatgttaaagatgcactatcctcttagagaaacaatcagttcaactattgttgtactgactgggacttcatattctaatggatgtggcaaaagaattgcaataagaagcagtgaacatttggaaccccaaaagaaagttacaggtattgcactgggtggggaaaggatagtgtgtctttaactcttaaattgtttggtcctattttttaaaaaggaaagggccctaagtagctcagatattaaagtagtattctcaattaccaaatgtttcatttgaaacaatttatcttaatgaaatatagaccaattctctgatctcgagttgtttttgtttggatacagccc

SEQ ID NO: 2475 - DNA, 1108 bp, Homo sapiens; identical to SEQ ID NO: 2474

SEQ ID NO: 2476 - DNA, 1307 bp, Homo sapiens
tggtggtcgccgactcgcagtccgcaggatgactcagggcagccctgaccacagttccgccgccatcggccctagcctgcggaattgggctcgccccgggacgataacagagctctgccgggggctggaggcactgaccgggtgaccagagacccagagaccagaccccctccacggcgcccgggatttcggggacggcttctcccatcgcaagtagggcttggacgggaggcgacaaaagagaacttggtccgcacacagccaccgaaattggaatgaggagctgtagggaggccccgtagccagcagaaaagcattggggtccctggctgggttagcccaggtttctaggagtgtggtaagcgtcgaatgacttttgtccttttaaagcacattatgttactttttcccccaaggtttcaacagaaaatgagaaatatcccccgacgattggctgaaaacatgcagcaaccactattttcttcctgcccctcgttgatgagagcattcgaagtgacctcagcagggcatccaggtatgtcaagcatggtgacaaagtgttcaggtcagacggtctggggaaaggctcctgtgttgttgagcctgccaagttgtgggtgcagcatggtaccaggcagcccaaccctgacctaaagtaaattcccggaagaagtctttcctgggttttgaatttgcagtaacaggtgtgagcattctagcagcagtttgatgatcatgtatgatactgcaaacaggacctacgtttaaagaaaatggttgtagttagtatcagagagcccttgcttttcaaaacttcataaacaatgttactgtcatgtctttcattcaataaacatttgttgatacattggcctgacatcatgttaaatgttacggatacagagatgaagaaaacagtcatggcccttgttctctgggaactacaacccagttagggagacaaggttaaatgatcacacttaagagggcataattcagccaggtgcagtggctcatgcctgtaatcccagcactttgggaggccgaggcgggtggatcacctgatgtcaggagttcgagaccagtctggccaacatgatgaaaccccatttctactaaaaatacaaaaaattagctgggcatggtggcatgtgcctgtaatcccagctactcaggaggctgaggcaggagaatcgcttgaacccaggaggtggagaggttgcagggagccgagatcacacacaccactgcactccagcctgggcaacaagagcaaaactccgagaaaaaaaaaaaaaagtcataat

SEQ ID NO: 2477 - DNA, 1307 bp, Homo sapiens; identical to SEQ ID NO: 2476

SEQ ID NO: 2478 - DNA, 1307 bp, Homo sapiens; identical to SEQ ID NO: 2476

SEQ ID NO: 2479 - DNA, 1379 bp, Homo sapiens
acacattttttttttttgagacagagtttcgctcttgttgccctggctggagtgcaatggtaccatctcggctcaccgacacctccacctccccggttcaagcgattctcctgcctcaacctcccgagtagctgcgattacaggcacgtaccaccacgccagttcattttgtatttttagtagagacgggtttctccatgttggtcatgctgctctcgaactcccgacctcaggtgatccacctgcctcggcctcccaaagtgctgggattacaggtgtgagccaccgcacctggtccacaacacatttttttaacctttccaccatgtggtaataatgcagtcaaaatatacatcatgttactttgcacagatctaaattacacccagaagaaattgaagacactgtcattcctattttccattctcatctcagccttaccagtcaatatcaacttcaattaaaatggctgtcaaatcagtactaatttgattccttgcactgaagggttgcccatatttaaaaatacttgagccacaataaggagccaatggggcgaagctaccatctgtgggattatgactgaacgcctttaagtcagaatcccacccaggcagacggatacagcagtgcccgtggggcctcggttggcctccaatggcctcagagagccggtccctcccccgccgagcgccaggactggggtccggtgcagaaagcccctcgtcctgggaaaggcagtcgcccccttgcccgttgggccacccatgttcgtggggaacctggctctaaaccattcatagacgacctgcagaattctgggtcggggatttgtatgtagcagagcacctccctcactgcgatctattgaaagtcagccctcaacacaagggtttgtttaaaaaaaaaaaaagaagaagaagaaagaagaaaagaagagaaagaaagagagaaagagaggaaggaaggaagggaggggaggggaggggagggaagggaaacaaacaaaaattaaaatatagtacttgagccaaccaggcactcatgttaaacacaaacaggaaaatacaaggatgtttattcccctcccttccttaacctctggttgtttaaaaaaaaaaaaaaaaaaaaaaaagaaccaatttaaggacccagctgatttggattcatgaaagtaaagcaaaatctctatggcaaagaaatccttcatgaagcctgagtcatgtacaaaccctccttttaaaagagaaacgtgtccttgaacctttaatgttgaccagttactttttcccccttgcagaactcagtctattgaccagttatttttattttttaattaactttttttttgagatagagtatcattttattgcccaggc

SEQ ID NO: 2480 - DNA, 1181 bp, Homo sapiens
gcaacagcctgtcaagcacccatacagcaggtggtttcattgccctccatttacagacaagtaaactgagcttcagggtggctaccgcttgtctcccaagccacccagccatttagccacggaagaggtcatgactttttacaccccagtgaagctgaagatttttctttccgtttttaaaaatgtttactccccagggcagtgaacacctggtgcctctgtctagcgcaagaggtgaacgtttgccacttccgtttctttcctcctaccagacctgaccctccttttgtgacgggaacatcctgcaggcagtctgtcctgctttcatagactttgagaaacggggtccaaattgccggctgtgggtgggacaggcgacactgcagtgaagaggtggagtatttttgtagcggggaagaaatacatttcctctaccctcttaggttcagtgtttgggggtctgtgaattaaactcactcaagataaattaatgagagaaaagacagatttaatcacatacgtatgggatttcactgaaaaacgtgactcaaaagagcaggtagaaggtggggcccgtgactggtccgaaggtagtgagttatctcagttgattgttcacagtcagttacagattagactccttgttccactgtctcccctcttcccacttgttttgttttttttgagtcagagtcttgcactgttgcctgggctggagtgcaatggcacgatctcggctcactctaacctccgcctcccgggttcaagcgattcccctgcctcagcctcccgagtagctaggattacaggcacccaccaccacgcctggctaattttttgtatttttagtagagacagggtttcactatgttggccaggctggtctcaaactcctgacctcgtgatctgcctacctcggcctcccaaagtggtgggattacaggcatgagccactgcacccagccaactagtcttaaaaaaaaaaaaaaaaaaaaaagaacttagggcccgtatactatcttaataggaaaaaaggaaggggtgaaagcacatattatgggccgggtgcgatggctcacgcctgtaatcccggcacttcgggaggccgaggcaggtggatcacctgaggtcgggaattcaagaccagcctggccaacatggtgaaaccccgtctctactaa

SEQ ID NO: 2481 - DNA, 1692 bp, Homo sapiens
cagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgcttggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccttcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggtgagacagtttactttgccaacttgccatgtttttgccaaaaccaagattttgaaggaaatgagtggccagcgccagggcccaggccatgtggcctgcccagcctcaatgtcacttggtggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaacccagaaggctcctgagtgagaatgttttttctgcccctgaagtgcagttctttgggcctcgggacaggttggggtcagctgcaggtgggcaagaagcatgggcaagaaaaggtaggccgggcgcggtggctcacgcctgtaatcccagc

SEQ ID NO: 2482 - DNA, 1102 bp, Homo sapiens
gtgtggtgtgccttggcgatgaaatgtgaatacagcaatgctggccacatcctctagggagcattgaatgcttgcgtgacactcaccaaggtcgtggaggcccagtcatgccccagaggtcacccagagcctggtgccccttacaggagccagaaataaacctgtgctgttttccatcctttgactttcagcatttctgtgatatcataaggagcatatagtttgattaaaaaaaatcgagtctgaaaatcttcatctttgaattggagtattcagtccaattttcgccatattagtccaacctttaacacttgttatatattgtttaataaatgttggcatgttggttgaacatttaatccaataactgatttgtttgggtttaaacataccatcttactgtgggttttatatttatcccatctattctatgttcatttttttctttccttccttgccttttttttgggatgaaatgagtaaatcctattatttcatttcctctgtcattagcttgttagtgagactgtcttttactattcttgcagtggtgattctacttgaggttatagcatgcatctttgatttactgaagactaatatagagcaaaacttttaccacttcccagacaaggccagaactttggaaagcttttacactatttacccctcctgcctttttatgctattgtttccttgtcatttaatcctttttatgttttaacctgaatttttattgcctattcattttgttttatgtagtaaaaattcatttatatttgcccaaatgtttaccttttccagggattttctttattgccttatttttttagtttccatctgggattacactcctttgctcaaaaatctcctctttacctatcttttagtgtgagttgttggcaataaattctttcctttttttttttgaggggaagtctggaaatgtctttatcttaccctcacttttatttctttacttcattataacaaagaaaagtgtttattgcatgctgctaaatgaataaggtaaaaacacacacttacacaacattagtgtacaagtgtgcaaaaagatgatcagaaataaaaacactttaca

SEQ ID NO: 2483 - DNA, 1210 bp, Homo sapiens
aaagtctggaggttggcaccaggtgtctgggctctgataagccctctaggtgattgtgatgcaaaccaagggtgagaactgctgctccagtcttaatgtatcaccttgattttacagatgaggaatccaaggcccaggaatagctggctcagactctcaagattagtttgtgtgtagcaaaactaggtctcaaacttggaactctagactttagtccagttctgtttccaaagcactacattgtcattttttctcagtttttggttatggtttccttggtttgggttgggttttaaaggggtctagctaaagttttgggttcttttgcctttcattcattttagtgccagaacctactaagacctgttcaagccagccccaacctgccggtaccagtaccagtacttccaccagcactatctcaagcagcaacaatggcaaacgtgcatctgccagtggccagcagccagctgcatcccgttacctgcctcgtgaggtgcctccacgcttccgccagcaagaacagaagcagctattaaagagaggccagccattgcctacggggactctaaccagtgtgagcccaacccagggtgctgggcctgcaggggtaagcccacctcccctacctggagccggaacacagcatcatcccagtaagctccaaccaggtaaaaaccacataggatgagacattgttttgatctgaaaactttgctattttcaactttgctgctgagcaatagaaatagacatattttggtccatactcacaacatacacagagacagacaaattcatttcattttaagtgggttttaaaatttaattgtgttttccctctatttatttacattattggtcatgagtttgcagatggcatgagctacttcagctgagcttatttttcatcagaaactaaaggtctgtacattggtccatacgaacccatcaaggcagttactttagaacccagaagtgaaaacttttcagtaaaacccttttctctcaatttcctagtctgtcttatgagtgcacacaagcattttttgcagggaggtacagatccttccactaggcgtttctaactgtaacttagtcatacacattgagccaagcctatctgatacctcctcatcctaagccctgcttcttgttgcttccttgcctgtaactagttgttagctttcttttggctcctaagaaaaat

SEQ ID NO: 2484 - DNA, 1149 bp, Homo sapiens
agctgggaccacaggcatgcatgcgccaccccacccagctcatttcattttttatttttgtagagatagggtctcaccatgttgcccaggctgatctcgaactgctgggaatacaggcatgagccaggtgcccagcctttgttgttgttgttgttgctgctattttggcaacatcacggcagaacggtaaaggcagaaagcacagtgcccagcagctagcagtgtggcgtgccaagaaggctgttccaatgggggagaagccagcagacacagaggcatcatggcgagccccgactgagtgttcagtgaagagggaaaacagagacagtggggcatcccgagaagatcctctgcaggagtgcggtgtctacggatggaccaagaaaacctacgcaggatccacgtggaaacaaagctgcttagctctgcatatcagtgcttctcggcggagctgtggctgatgggctcctggtgcaggactggcccctgaacagcacaagtgtagtatgcctgggccccaggtcatcatgaaaaccagaagcagacactcaggaggctgaggcgggaggatcacctgagcccaggaggtcgaggctgcagtgagctgtgatcgtgccactgtgctccgggatgggcaacagaaagaccccatctcaaaaaagcagaagcacatttccgaagccccccaagcccacgggcgtgagtgcatgcatgcgtttgtgacagcctggtgctcggatgggcccagagcaggggttctcaaccttggcccattagaattacctgaaaatttttaagataattcacatccggccaggcatggtggctcatgcctgtaatcccagcactttgggagtccgaggcgggcggatcacctgaggtcaggagttcaagaccagcctgagcaacatggagaaaccctgtctctactaaaaatacaaaattagctgggcatggtagcacatgcctgtaatcccagctacttgggaagctgaggcaggagaatggcttgaacccagtaggcggaggttgcggtgagccaagatcgtcccgttgcactccagcctggggaacaagagtgaaactccattccaagaaaaaaaaaaaaaattcacatccaaaattttaaagataattcaaatccaaatc

SEQ ID NO: 2485 - DNA, 1835 bp, Homo sapiens
aatggaggaagcaggtagagtggtgctgggtgcataccaagcactccgtcagtgtttcctgttattcgatgattaggaggcagcttaaactagagggagttgagctgaatcaggatgtttgtcccaggtagctgggaatctgcctagcccagtgcccagtttatttaggtgctctctcagtgttccctgattgttttttcctttgtcatcttatctacaggatgtgactgggaagctctggtttcagtgtcatgtgtctattctttatttccaggcaaaggaaaccaacaataagaagaaagaatttgaggaaactgcggagaaagtgcgccgtgccatcgagcagctggctgccatggattgaggcctctggccggagctgcctggtcccagagtggctgcaccacttccagggtttattccctggtgccaccagccttcctgtgggccccttagcaatgtcttaggaaaggagatcaacattttcaaattagatgtttcaactgtgctcttgttttgtcttgaaagtggcaccagaggtgcttctgcctgtgcagcgggtgctgctggtaacagtggctgcttctctctctctctctcttttttgggggctcatttttgctgttttgattcccgggcttaccaggtgagaagtgagggaggaagaaggcagtgtcccttttgctagagctgacagctttgttcgcgtgggcagagccttccacagtgaatgtgtctggacctcatgttgttgaggctgtcacagtcctgagtgtggacttggcaggtgcctgttgaatctgagctgcaggttccttatctgtcacacctgtgcctcctcagaggacagtttttttgttgttgtgtttttttgtttttttttttttggtagatgcatgacttgtgtgtgatgagagaatggagacagagtccctggctcctctactgtttaacaacatggctttcttattttgtttgaattgttaattcacagaatagcacaaactacaattaaaactaagcacaaagccattctaagtcattggggaaacggggtgaacttcaggtggatgaggagacagaatagagtgataggaagcgtctggcagatactccttttgccactgctgtgtgattagacaggcccagtgagccgcggggcacatgctggccgctcctccctcagaaaaaggcagtggcctaaatcctttttaaatgacttggctcgatgctgtgggggactggctgggctgctgcaggccgtgtgtctgtcagcccaaccttcacatctgtcacgttctccacacgggggagagacgcagtccgcccaggtccccgctttctttggaggcagcagctcccgcagggctgaagtctggcgtaagatgatggatttgattcgccctcctccctgtcatagagctgcagggtggattgttacagcttcgctggaaacctctggaggtcatctcggctgttcctgagaaataaaaagcctgtcatttcaaacactgctgtggaccctactgggtttttaaaatattgtcagtttttcatcgtcgtccctagcctgccaacagccatctgcccagacagccgcagtgaggatgagcgtcctggcagagacgcagttgtctctgggcgcttgccagagccacgaaccccagacctgtttgtatcatccgggctccttccgggcagaaacaactgaaaatgcacttcagacccacttatttctgccacatctgagtcggcctgagatagacttttccctctaaactgggagaatatcacagtggtttttgttagcagaaaatgcactccagcctctgtac

SEQ ID NO: 2486 - DNA, 1198 bp, Homo sapiens
agggatcacctgacgttagaagttcaagaccagcctggacaacatggtgaagccccgtctctactaaaaatacaaaaattagctgggtgtggtggcacacacctgtaatcccagctactcgggaggctgaggcaggaggatcacttgaacctgggaggcggaggctgcagggagccaagatcatgccactgcactccagcctgggcgacagaatgagattgtctcaaaaaaaaaaaaagccctgtgtggttagttgactttctgtgtctgcatctcctcttctcagctacactgtcggctccttgagaggaggaggctgtgggtcactttgctgtgtcaccttggatcaactctggctttgtcttttgcacgtgttcattgctgagtagctatttgttaactgcatcttgacctgagtttgtcacccccctgctagttcacctgagacctgggtcaccaggacacgctgctgcatacccttgcctgagtcctcctcacctgcatcttccctccctgtagtgcaaacctgagtgactcctacttcaccaaccgccaggaccgctacgtgttcctgcaggactgtgcggagattgccgacttcttcacggagctggtggacgcggtgggggatgtgtccctgcagctgcagggggacgacacggtgcaggtggtggatgggatggtgcatccttacaaaggtaggggctgccgctgacacccttctatggctgtgggtggggtggagtgagggcccgggagagcacaactctaggtggttctgccacaggcataggggacttgggtggcaaggcttcattctgcttttgtccttgaagccagacagatgtgactcactgaccatcagtcatgctctgtgggtgagagagccagcccagaaaggtgggagcttgggcttgggactcctactccttgaggcggagtcactcaggtttgcactacagggagggaagacgcaggtgaggaggactcaggcaagggtatgcagcagcgtgtcctagtgacccaggtctcaggtgaactagcaggggggtgacaaactcaggtcaggacgcagttaacaaatagctactcagcaatgaacacgtgtgcctgggcgagtgacccagaagcctgccctgcatcacaggaagcaaccaggccagcagctgttcgcctagggcccatttccccaagccta

SEQ ID NO: 2487 - DNA, 1175 bp, Homo sapiens
cttttccatcccaagtgcctgcggagcgccgaggagaggagagagctgactggacgcttacgttattttcctccttcagaatccaagttcttgttgggctttaaagtagaaagtcagcattttccttgagctaaatacctaataaccaaaactgtgaggaaggttatcgggacagaggttccggataacctgtttcattttgggttttcttcctcttccccagactccagtcctcgttctagaggaaggagtaggacttccccgatccccgtagggcttcagctttttctgcctcaaaaccagccctaactggactactctggatgcattttgtggtgggccccctagaggggaagatgggcctttatctgctccgtggggtgcactggagtgaggggggtggccgggctgcctctcgcatctctgtcttcccctgcaggcgctgtgtgagctggccctgcccctcctcattacagtatgaagggagccgtgacacgcagcattttcctgccgttctctcagggactctcagggcagctcctgccactccgccagggccagcatgccagtccaggcagagcaggtggctggctgtctggccgtctcgccccgcccctccacaggaccctggaccagggcggtgcagggcgcagccctgaggaggcaggtggaggagctgcgggttttcacagggccgcgtcgccacggctcctctgatcctttagggttggcgagcatctctggaaatagcttttgcagaggagtggtgggaggaatagagggggacagtctgtcacctccctccccgccactttgtgtagatcctacctggagggaatggctttaggcacttttgtgccagagcttgtgagggtgacagaagagggtccaggctggaaacctgaactttctgggtgggagaaccaggtggtgcctgccgaggtctgggcgtgtttgggccggtgctggagcctgtccagctggcccgggccctggcctggttctcaagtgtttcctagacagagaggcacctgggtcagtattagtctatttatcagaggtgtaaataatctatgtatagtttttctccttttagattattttgtatttgtttaaaagaagttttgtcaaaatacaaaaatataaagaaatgactgaaagttgttgacagggtt

SEQ ID NO: 2488 - DNA, 1155 bp, Homo sapiens
ggaaagtaactgctctgtgaatgtagtagattaagttttaatgccatgggcagaaggaaagtatgtgtatcctaactgtgctctcaagcagagatgttaattccaactctatgctgtctagaaatataatatgagccatagatgcacttttatttcatactagttcctttgagatcaattaaaataatacatttcattaagttatatcaatgtgcaatcaatataaaatattattaaaaagtcattttcctttgtttttatagaaagtctggtgtgtgtgtgtgtgtgtgtgtgtatatatatatattatttatttatttatttatttatttatttatttatttatttgagatggagtcttgtactgtctcccaggctggagggcaatggcgggatctcggctcactgcaacctccacctcccgggtttacgccattctcctgcctcagcctcccgagtagctgggactacaggcacctgccaccacgcccagctaattttttgtatttttagtagtgacggggtttcaccatgttagccaggatggtctcggtctcctgacctcgtgatctgcccgccccggcctctcaaagtgctgggattacaggcatgagccactgtgcccggcctcggtgtatattttttacctacagcacatctcaaactgggtggtgacatttcaagtggttaatgtcacgtggggctcctggccgccatattgtacagtgcagctcaggctcacataggcacccactgaaggatagaaggaccctcaaaccacccctacccttgagagtgtgggtgccctttgctgtgccatggagggaacaagagccaacacttctgagcttctgctcagcaccaggcagggtttgaggcactttaattactctacatcatcttcacagcagccttatcaagtgggtgatggtgggaccacttcattgatgatgaaatgtgacccaagtgggttacataacttgtctgaagtgacctaatttgatatttggtagattggagctaggatttgaacctggtttgtttgattctaatgcttgttcttctcatttgcccacatggcttcccatagcatgcttgaagggtcattttagagggtgtctgtccaaatctcctgttggtataggtgggggagat

SEQ ID NO: 2489 - DNA, 1132 bp, Homo sapiens
cacctggccagcatcttggtttttaatcattgcctgggggagctcctgcacagcgttgctgcacacccattcgccccaaattgtctttttcttgtttgtggcggggcagttttgagacagtctcgctctgtcgcccaggctgagtgcagtggctcgatctcggctcactgcaacctctgcctcgcgggttcaagtgattcttgttcctcagcctcctgagtagctgggattacaggcagtgcaccaccatgcccagctaattttttgtatttttattagaagtggggtttcgctatattggtcaggctgatctcgaactcctcgaggtgatccccctgcctcagcctcccaaagtgctgggattacaggcgtgagccactgtgcccggcccccaaattgttaaagaccagacaagctgggcattttgtgtggttgtggatggaaagggcaaattgatctttactctcaaagtgaattttatttgtcttttccttgatttttcaaacaggatgtaggctatccggaattcctcaacatacgtccgtatatgtcccagaataatggtgatcctgtcatgtatggactctatgctgtcctggtgcactcgggctacagctgccatgccgggcactattactgctacgtgaaggtgagaggcttgtgtcagtgcagctgcctcctgggacaggtttcagcacccatgcacatccagatgcggcctctgtagagcacttactttgtgaaaagtgtgatgttttgtggttgtattcaagtcctcgttgttgcctctctgcgtggagtgaaaagatgccctttacagaagtgttgcaccagaatctagtgttctcagacttgcagggagacacggaagaggcagccgcttctggtgccatccttagaaccctggcaaaatcggccatggtgatgacactgcctgaatgtcctttagaagggacagttcctatctgttggggcactaggaaggaactgggacgcagagcacactttggggtcacattccgagttatgaaaatattacacgttttaatagaagttgttacctgttgattattaatagtgtttggaaatgtagcaactaacagattttttattccctttttaaaaagtgagg

SEQ ID NO: 2490 - DNA, 1194 bp, Homo sapiens
cattcctgtgctgtgttttttattacccttggtaggtattagacttgcacttttttaaaaaaaggtttctgcatcgtggaagcatttgacccagagtggaacgcgtggcctatgcaggtggattccttcaggtctttcctttggttctttgagcatctttgctttcattcgtctcccgtctttggttctccagttcaaattattgcaaagtaaaggatctttgagtaggttcggtctgaaaggtgtggcctttatatttgatccacacacgttggtcttttaaccgtgctgagcagaaaacaaaacaggttaagaagagccgggtggcagctgacagaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagagaacgtgggctctctccgtgtggctgtatccgatgttcagaacggccacttcctagctcaagaatgggaatcagcctctgcaaggagcctctcctgtccggcgggagggggcgccctgtgtcctccagagaaacaaggccagtgagctctgagtcaaatatgggatgcagaccaggtgtggtggctcacgcctgtcatcccagcactttgggaggccaaggcgggtggattgtttgtgcccaggagttcgagactagcctggccaacttcgcaaaaccctgtctctgcaaaaaataggcgtggtggcatgtacctgtggtcccagctattcaaaaggctgagataggaggattacttgaacctcggaggcagaggttgcagtgagctataattgcaccactgcattccagcctgggcaaga

SEQ ID NO: 2491 - DNA, 1168 bp, Homo sapiens
cccaggagccttccagagtgaatgaggcagccacaaatccctcactttcagatgaagacactgaccccagagagtggcagtgccccggctcctaacgcagcccacttccctcccgccccttcttagaaaccaggagcacccacaccctggacctctccagggagctctcggaggcccttggccagatctttgacagccagcggggctgcgacctgtccatcagcgtgaatgtgcagggcgaggacgccctgggcttctgtggccacacggtcatcctgactgccaacctggaggcccaggccctgtggaaggagccgggcagcaatgtcaccatgagtgtggatgctgagtgtgtgcccatggtcagggaccttctcaggtgagccgtctcgtcctcaggctctggggccgccaggggctttgtcctcctcccctcttcaaaagcacagccccccacacacacacctgcacatactcatgcatgcacatgtacacacgcagtcacacatgcactcacgcagttgcacacacacgcatgctcactcccacactgtgtgcactcaggtggctgtgttggacagttgggcccagggctcccctgctgtcctgtggggccggcatctgctctccttctttctccccaggtacttctactcccgaaggattgacatcaccctgtcgtcagtcaagtgcttccacaagctggcctctgcctatggggccaggcagctgcagggctactgcgcaagcctctttgccatcctcctcccccaggacccctcgttccagatgcccctggacctgtatgcctatgcagtggccacaggggacgccctgctggagaagctctgcctacagttcctggcctggaacttcgaggccttgacgcaggccgaggcctggcccagtgtccccacagacctgctccaactgctgctgcccaggagcgacctggcggtgcccagcgagctggccctactgaaggccgtggacacctggagctggggggagcgtgcctcccatgaggaggtggagggcttggtggagaagatccgcttccccatgatgctccctgaggagctctttgagctgcagttcaacctgtccctgtactggagccacgaggccctgttccagaagaagactctgcaggccctggaattccaca

SEQ ID NO: 2492 - DNA, 1127 bp, Homo sapiens
caagacttctgtgaatgacttgaattttttattccctgcctagggtctgtgaacgaggcctgtctcttccctggggtttctttccatggcctttatttctcctcttccagtgggagttttgcaggctcttctctgtggaaacttcacgagcgttggctgggcctcggcttcgctggagtgtactccagggtgaaggcagagtgggatttgagacccaggttaggcacgacccaggctgagaagggacgtttccatcattcacagtgccctccccacagcactacctcaccccgacccccaccctcactcctaccccaccccgcgatcgtcaggggtgccacggtgggccggagggtgccggctctggctgtccctgtgccggtccctcacaaacctctccccctttgaaactcaagcacagctgcgaggagggcagcgaggagggacccctctctcatggttgtctctttcccccgctatgtcataggtagtggaggaagcgaaggaagtgaacgctgaatgtgacgcatttctgaagagctcagctgtcaccgggcatagcctggaagccccaagtctgttctgactttgcctggctgtctccttgacccgcctcctagatcattgtccttgatgtccaggctgggtcatttaaaatagagatgcaatcaggaaggttgggggacttgggactgtggctgaattgagaccttgctgatgtattcatgtcagcacctgagtcacagcccaggtgcccggaagcagcctcttcgcataggcagtgatttgcgattactttaaagctcaccttttttcttcccctctctgttcgctgctgtcagcataatgattgtgttccttccctatgggatccatctgttttgtaaacaataaagcgtctgagggagtgtagttttctgtctcccggtctgtgctgactgtttgcagaggcctggccacgagagcgcctgcgcaggatgctgggcatgcgcacgggagtcgcccgccagggcatcccatctggaaactgcgtcctccagtccgccttgtcccactatctcaaggcgctccaagagcacgagcgctgtggtcagaaaggtggggtctgaagccactgcaagcccgat

SEQ ID NO: 2493 - DNA, 1216 bp, Homo sapiens
ccgtagctgctacgaggtgagcctgcgtgggtgcctgctgctagacctcctcgtttgcttctcacggccgccgggtagtcgggaggaggagagcttcacctgtcggcttggagagatccaggtgatgcttcccagaggggctcgggctgggctggctgtttgtccagctggagtgggggtggaggccgccccaggccgcccccttcttgggttcagcggggaactggggtggaggagtcagggaggggaaatgtgtgcgtgggggcaccctctccccgcccccgggcgtccagccgtgctgagccttctctcctgccaggtggtggacgctgccagcctgctggcccctctgccccaggtgcaggccgtcaccatctctcacatccgctggcagccatccgcctctgagcgggaggggccccctgctctgctccagctcagctgcaccctgcactggtccttcctcctctcacaagtccgttgcttccgaatccactgctggggagggatgagtgatgactctccgggcagggagctgccgaggccagagatgcccatgttcctggggttggcttttgccacccagtaccggatagtggacctgctggtggaagccgccgggcccggccaggatcgtcgcatggaatttctggtggagcctgtccccaaggaagggttccgggtacctcaggccgagtggggcagggcagttctgctttattcagcccctgcatgagcggatgctaaggccgggtggtctcctggcctcgggctgaggcctcttcccggctgtctgcccctggcctgcgctggacctgctaagtgcccacagtggcagcgaggtcccggtcccggggctggggtgggagaccccgggctgagtgctgtggctttctggtggggggcgatggaaacaggaaaccaagcagtgggatcgcagcgttggtcactgcgaggcgagtggcgggctttctgtttctgccttgtccctccccacggtacctggttcccaggtgaaaatgaaaggaggggagaagttgagaacagaacattccataaaggatatttcctaataggctgcaagatgctgatgccgagaatgatgattttctttcctgcagatgaaactattagaaagggtcttagattgtggcaggtaggctttggagcaggcgccgagacatttctgagcatgaggacgagctacagcagctcc

SEQ ID NO: 2494 - DNA, 1112 bp, Homo sapiens
cccgctgccgaggaaaagccagttcaagaagccgggggaagggtggggccccgcgtgccccggagcagcgcccctcgaaggcgggggcaggaagcagccgccgcgccccgtcccgcttccctcccttcgggccagaacaatggctttttgcccggaaaacggagttgggagcaagggcgggcgcgccccgggaatcacgcgggactcggtgggcgccccaggcccgaagtccctaggcacctcctcccccagccaggggcccgcccgcgcccccacccccgcccccgcccccgcccggggccccgcgcgggaccccccgccggagcgcgaggcccagcccgccgcggacaatgcgcgccccgccccgccccgcacccgccccccctcgctgattggcccgcacgggatttgggcagcgcgcgggggcgggcggcgggccggggcgcgggcgcggagcggcggtgcgcgtgcgcggggcgggccggcgccgggcgggggcggtgctttgtgtgctgccggcggggcgcgcggcggtccgggcgggtgactggcggcgggcgccgcggtcgggctggctgccgggcagcatggaggagctgagcagcgtgggcgagcaggtcttcgccgccgagtgcatcctgagcaagcggctccgcaaggtgcgtgcggcccgccgggccccccgcccgccgcccgctgtccgtctggctcacggcccctcttctctccccgcagggcaagctggagtacctggtcaagtggcgcggctggtcctccaagtgagtcccccgcgacgccgcgcccccctcccgccccctcgcccgggggtggggacgtggagcccctcggccgcgccgtccggtggcctgggggcgcccgcgggcagagcgggaagttcgcggggtccccgcgggctcctccggctctgaggggggcgggggccgcccggcccgaggttgccctttgtttacacgcccgcgggtgcagagctgggcggccccccgcgccagaacctcctcggctgccgcgccgcgctccccccaacccccgtcccggccgggagggaggcgcgggatgcaagcccccctcctcttggccagattctccccgct

SEQ ID NO: 2495 - DNA, 1681 bp, Homo sapiens
tcttggagtccccagggaatgagcctcaggatccacttcgtcccttgtttctaagccaggctgcacggccgttcctgggtgtgaaagcattctgtcctgtctccagtcagagggaaccgcccccaaactagaaagctaatttcccccgaaggttcatgaagccagaggcatgcccttgggggttggtcgggagaagggtgagaggcagtgctgtggaaggggcctggcccctgctgcctgcgattctccccgggtatgtggccttctgcctccttcagcctcagtttcctcacctgtaacatgagaataatgatgcctgcctgcccaggccacctcctgggagtgcattggggactctaagtgtaaaactgtcatgaggatggtttatgaagtcccagggaccacacctgccactcagggaagagaccgctgacctcagccatcagccgtgtgcatcgtgaggggcagcgagctcaggacggagagctctcccttggttcggagtcagcacacctgcactcccacacgcccacccagctgtgtgtcctccgccgagggcgagcctctctgtgactcttctgtaaaatgcaccccattctgcccactcctgccacgagacccatcctctgcgatcccgccaggcatgtgtgtgtgaatgcatgtgcaaagctctccatcagaagggtggtgtgggccctgcaggtcctacccctcggccttgaagctccctcgggctgcggactctgcctcctgggtctgagcattagaaccaggagaggggtgtccctgggcagagccaggggtgcaaacagcctgcagccatctggccttttaagtatagtgtgtcgcatttccgggtaggaaggtagcatttcaagttcaaagagaggtcaagtcatgcaaccatctttcctccagcacttttggggtaaggaggacagtttttgttatggtttaggggaaattttcatgaaatttccaccattaccaatagattactgatgtccatggcaagtgatctgttcttggtattttgttttgttttgttttggtttttaaatgtaatcacccattggtcaggcccaggactggtcaccatgagctctgctagccacggccccaacgatgcttccggctctcatggattccacagcaaataaaactgtactgacaacagatgcacgctgtacagtgcctctggaaggtgcggtgggacttgctgggtcaaagcacggcaggctctgtgctgggcaaacagggccccgtggcagcccaagggcagcctgcagacgccagtgtgcccggcttctcccatgttctgagatgggggaggggaaggtgtaaaagagagctggatgggggctgtggggactgagggtcctgggaggctggccaggggctcagcaagcgcccactttgggaggccttgccctctgggctgtggttggacagcactaggcctgcaggctgggctgccaggaggaagagcagctccggacctcaggcccccccagcaggcggcgatggagggtgatgggagaattgacgagtgctcgcggggtctcactcgggaaagggccggttaactctgagcaactgggagcctcgctcccaccccagtgcctggaaacacaaacagtattttattgagccttggctgccggggctctggtttcaggaa

SEQ ID NO: 2496 - DNA, 1166 bp, Homo sapiens
ccccaagacctgacccggaccaatcagctgcatctctgcaccaagtgccacccccaccgtgcactgctcgcacctcacgctccccatgggctggcccggaccccagtgaggtctgcacctctcggaccagccaggacctcggaagccatgagctgggtgttcagggcttggcggaggagacgctgctccgcgggggatggagaagccccgcccctccacaactcccttaatctggatgcaattagaggaaaccagccaaaaaccccgcggcagctgttgccccgggattattcccagccagcgagaggcattagggcgataattcagtcattagacttctagccttcccaccgccagaacgtgcaaataggggataatcagccctgcacggccatcctcagcaatgctgcttatttaacccattttttaaaatgacacttaatgttattggctggcgtacgtgtgtgcgcatacttaaaagttgatgcgtggtgcagctctgctgctaatgtctgctgacagcgtcgcccgatgttgctcagggcctctgggaagaggggacacctttgatgtgggcgtgctggcacccaagaggcaacgtggtcaggctcgatgcttgccagccctggaaggtcccgccagggttggggggtcgggtgagcactcagagatctggggaggaagcgaggagcctggtgtcctcaccaggtgcagaggggaaatgcgtactgctccagaaggttctgactcaagtctcggccctgaggactcagaactcacaagtcatggatcaagtacagagggagggagggccccagcccacccctgcgggggaggaggagggtctgaaggtgggagggcagctccatgagcagccactgttcctgaccagccgaagtgccaggcagggggaggtttccatgtccaggagggagaggacctccaccctctgacctttcagttttccatagcagcccagtgtgaagctcggcgggggtgggcagggcatcaggacaagatgaagatgctggctctggaatgaggactccccttgggctaaggggtagtggctggcagaggttgcccagctcttttggaggccacagggaatagaggtggggtggtgcttccgttcctgtgaggcccgcccccctgagccccctcgt

SEQ ID NO: 2497 - DNA, 1099 bp, Homo sapiens
tcattcatctttatgaaaaggtgggtcaggtagagtagggctgccagaggttgcgaatgaaaacaggatgcccagtaaacccgaattgcagataccccaggcatgactttgtttttttgtgtaaggatgcaaaatttgggatgtatttatactagaaaagctgcttgttgtttatctgaaattcagagttatcaggtgttctgtattttacctccatcctgggggaggcgtcctcctcctggctctgcagatgagggagccgaggctcagagaggctgaatgtgctgcccatggtcccacatccatgtgtggctgcaccaggacctgacctgtccttggcgtgcgggttgttctctggagagtaaggtggctgtggggaacatcaataaacccccatctcttctagatcaaagatccagctaacaggcgctacgaggtgcccttggagaccccgcatgtccacagccgggcaccgtccccactctacagcgtggagttctccgaggagcccttcggggtgatcgtgcgccggcagctggacggccgcgtgctgtgagttctgggctctgtgccagcatgatggggagggcgacgcgcatttctcacacggcagggagggccacacgcgtttgtttctcacacgatgggcagggcgacacatgtttgtttctcacacggcggggagggcgacgggcatttctcacagggcgctccctgggtcttttactcacataggtctaaatcccatgtaaacacgtgttcaggactcaccaagcccctgcttgtcatttaactcaggaaaactctcaggaacgacagcacttggatttgccttaatcttaagagaagttgccttcggaaatgcgtttttctttttttgctcattcatttactcagtgtccacgcactgaccctccgtgccgggtggtttggatcctgctcccggggacagacacacagtgaggggaagccataagcaagtccatgcagacacagcgtcagggagtggtcatgcagagagcacgctagaagccagctgtgcagacacggggcagggaggtcccctctagaagccagctgtgcagacgcaggggacagg

SEQ ID NO: 2498 - DNA, 3097 bp, Homo sapiens
ctcccttttccccaggaatgaaccgaggccgtcgcccctgcacacgcacacgcacacagcctggttttgtcctcatgcacacgaagcagcccctgctcccatctgtccctgaggaagccccacttctctgtaggagcccggactctctcaggcatgccccattcacagctgaagtgggtgctgcaacgtcttgaacaaggcagaagttggtgagaggatctgtgtgtgcgtgtctacatgtgtgtgtctacgtgtgtgcgtgcgtggctgggggaggccttttctttgaggacgtacctcatttccttctttcttctggctttggaaaaatctcatgatgaaaattcatatttgccaactttgttagctgcgtgcgtgctttggggttggtgcaacctcagtacacgcatttgtctttgtttgcaaacctttctcagagcgacatatctttatattgatgtaataaatgtcttttagtggtttgtcaaaggccgggggcgggggctctctacagagaatttttattttgtaatagaagtgaactgtctctgaagggtgaaggcaggccgtcctgggatggtaccctgtgctctcccgtggaggagaggggatggctgaggacactggcccttaccccagggccagacagcatccatccctgctgtttgcatctgagagcagcatggggcctgggaggtcggcctgtgtgcccagctcagctagctctgccccaggacggccctgccctcgaccttcccacctcctcagatcctgcaaggctggggtctgcccctcccttctcacctctggagctgtgctgcactgcttcagcccagagggccctgagagaggagcgtgccacccacagcccgggaagccgggccccagcacccctctcctttggcctccggcagtgcagaccagaggggaccttttaaggaaagaagccgtgtttcgatgaagacctggccacatggggccactgggacttcaacccagcccatcggtgggaaggtcctttttgggggactttgacagccatatccctcccagcacaccaggcgccaggtgagctggttcagacccctccaggggtactccagagacctcacgtgtggagccaggcctggccagggcaggggcctgaaacccactcctccatctcatggggctcacggcctacagcagcccacaagctgccactggccggcgacactgacacctgagcagtgtccagaacctttttgcctttttttgttccccgtgaaaagcaacatggacatttccttctagtccttccaaggaggggagagaagtgtatgtgcatttgtgtgtgtgtgtgtgtgttgtgtgtgtgtgtgcgctaagtgagaaagagagcaggctcgggaggccctgcccagggtaggaggagcttcctgctttgcaccatctggtggtcgcacgccctgagggcaccccgactctgtctccaggagtctcatcagcaaaccgctgacaagtctttctagaaattctactgcactgcctggctcagctgcagctgcagacatttctgcaggaggagcaggtgtttctgtcttctgttccttctagggccacctgtccccttaaacacaggtccacgttgtgtcaagaacctagtgcatctgtgtgtgtctgtcagtgtctctgtgtcagtgttctcgtgggtgtctgcacggtacccggccgccgttctgcaatgcatcactcccgcagaggggggtgcagatcaggcgccgtgctgcgcgttgttgttcaacagtggctttttcttagataatcgtgcttcctcagcgcccgtcgggttgtggcatccttggatctgcagggatcttctccgtttgcatgttcctcggggtggcgtgttccttgctccctgggtccgacatgtgttcccgcacctgcatggactgccccggttctgtgttgtgtgccgagtgccgcccagtgttctgtgaccacccgtgtagctactgaaaatggctgggtaagcaagtcaagggtgttggaggaggtcaagagagagctcagtttccctctccccctccccaaacacaccaagaagcatttttaacgtgtaggttgagaacaagcctaaaggattcccacagctgggagccagcaagagagcttggagtcgcctctctagaccagatctagccccaccctcactccagccatctcggagcccttgtgtaggcaacgcccggtgcgggctgtgtggggtgctcccctgccagcacctccggccagccccgcccctgccgatctactggaccgcagaccaccttctgcccccgtgggccaggtgggagctgtccgttcaggaccatgagccatcctctgccctgactagcgaggggcagagcacaccccagtgcttacgcctccacccctgcagcctcctggcccgctcaccttcctcacccctcctctgacccacccatggtgccagggccgaagctgacctttagctccctcctgccccttgctagggtctgagccaagcccctcgactccctcactgtgttgacacttggcactttgctggccccgagaaaggtcgatgacacagccgcaaatctaatccacgtagttcccatttactccttaatctgattgatgttccctcttgcactgaataatacatgcctctctcaggtaagccattttataaaacaagaagataaaaagcactgttgaggcagtgtttgcttttgccgagctggtgtccgacagctccctgggtgtccggggtgggagagctgttgacagaagctctccgggccctcaggggcttagatcccacttgagtcgtaagccttcttgcttttgataacacagtattatttctcttactgtagaagaaaaagtttattaccaaacaagagtatttttatgaaagaaaaggacaaacctataaattaactcaacctatatctcccttgaaaatactttcaggctccaccaaaacgtagaactgaaagcatgtattttggaagaaagagatacattttgtatgctttcttttccttttgtagattcccagtttattttctaagactgcaaagat

SEQ ID NO: 2499 - DNA, 1205 bp, Homo sapiens
caaaatctggaagaaacaaggcggttgattcctttaatttcaggagcatgtaacttcatttataatgacaatgtttttgaaaaaataaattaaaccgacagtttcatttgtaggattgactttaataacacgcctctactgaacaaatggcgattaactggggaaaacggaattatggtaaccgaggtaacggggtcggggactctttctccttcgctgcatgctgggtggcggggagagaccgctctgaggaggtttggtctgtcggccacgccgtaggccgcggtgcattctgggtcctggcaatatggcgtcctccttgatgggctgatgagatgagtttcactgtagctccaaaccagagggcaaagctcccatgacccaataagcccacattgtccctttcctccgtggttccgtgtcgcccgtttctcaggactcgttctcaggcaggagagagcctcggggctgaaggccaggaccagccaggccgcgcggacctgaggttgaggaaccgggtgcaggcgagcacgatgggccggtcgtggctctggttgcagcagctcagacgagtgcgggacccgcagggctgagagtggctggaggagacccagggccctttgaacccgatcccttggccggagacctcagcccagtcggcccagtgggcgaaccggcaccaagagcggcctgcctgtcttcggaactgctgaggcggtggaggccgagagcagggtcatcgtgaggcctgaagtctcttacgcttttggcagctcccctcgcagcccctctggaaacgtacagcctcaggagcagccagtggcttgggacctggggtggtgtgtgtctgcggagcttcttgggctgccccatttcctagcggcccccacctccccacttcccgctcagagttagagataaggatctcagacttttgcctgagtaagggtctccgcactctttatccatttggttttcgatttcccgtttttgtttcttatttcaccaattctggtacacgctagtttttaaggctggaggttctcgagcgcttgctgccaaggactcccccaccccctcccccactgatggagtccgaaatgctgcaatcgcctcttctgggcctgggggaggaagatgaggctgatcttacagactggaacctacctttggcttttatgaaaaagaggcactgtgagaaaatt

SEQ ID NO: 2500 - DNA, 1195 bp, Homo sapiens
tgattaatgggtatacgtttgaccttttaattaaaacattaatttgtgaatgatcaacattccctaataagcttttcacaggttgttaagagaaacaaaagttctgtgactcttagtgactactgagattgctgcttagaaaggagctggggagaaagtttgctgtatctgtttttcggtggagaaaatcagcagctaacatcttcagttgagtgtgtgggagtttggaatcttgtcatctcttccctcttccaaaggtcaggtcctttggaatcttgtcatctcttccctcaaggaccgtatcacacatgctataggacagaagttgcaaactcaaatgatattgagtggggatggtagcataagagaatgaaacaggccacatttaagaagaataatggcataggttcaaagataaagacaaatggcagctgacatttggcacagtgtgtgtgacagtttctggagggtgggaacaggggctccctgatgccataactgaaggggcaactgggctatggccaggcctctctctttgtctttgagaagtcagcaaactttttttttcttttattgtaaatattcatactaattcagatttattaccaaacacactgtagtccaacactgcaggctgaacaaccccatttgtggagtgtttttctgtttctttttttttttttttttttttgagacagggtcttgctctgtcatccaggctggagtacagtggtgagatcacacggctcactgcagcctcgacctcctgggcctgagtgatcctctcacctcagcctccccagtagctgagactataagtgtgcgccagtgtgtctggggttggggagtctcactgtgttgcccaggctggtcttgaactcctgggatcaagcaatcctcctgccttgtcctccaaaaatgctaggattacaggcatcagccaacacgctcagcctggggtggtttttttttttttttttttttttttttgagatggagtttcattcttgttgcccaggctggagtgcagtggtgtggtcttgactcactgcaacctccgcctcccaggatcaagctattctcctgcctcagcctcccaagtagctgggattacaggcgcctggctagttttttttgtatttttagtggagatggggtttcaccatgttggccaggctggtcctgaactcctgac

SEQ ID NO: 2501 - DNA, 1204 bp, Homo sapiens
agacagagggaagtgccccttcccatcactaggaggcttctggttaggaaaggaaagcatacacaaatcctggaattggatgcaggaagcaggagccacccaaactctgagtgagccagagctgggaggtggctggacactgtgccaggggtgccaggccgtcctctagaactgcggcccagtctgttgaaaagtcaatggaatttagtctaatgttaacaagcttggtgtccttgatgcggtctcgtgcttaaggcagacaaggtcaggcgactaagaaacccacatggtctggtcttcgctcttgctgggatggcagtggctgtacatgttggtaatttcttggtgtgataacgagaggcttttcttgaagtccttgaaaaatgcctattctcagtcatctatcctatgatgaaagaggaatggcatagataatccaaaactcattgctcttaaacttaaaaatgaatttgacttttccccaaaggatttgctttcctttcctaagcatttttaagtacacagcagctgattgcaggaggaagttccccagaggcatgtggaaggccgtgtgtgtgtctgtctgtctgtctgtctgtctgtctctatgtgtgtgtgtgtatccctgtgtctgtctgtgtgatgtgtgtgtgtatctctgtatgtgtgtatgtgtatctcgtgtgtgtgtctgtgtgtttctgtgtgtctgtgtgtgtgtgtctatttgttccggtgtgtgcaagccccaagccagcgtctcctctccctttcttcagattagcagcccctcctccgcctgccctcatctcctccatttgcacatctgagaattcccgcccgcacggaggagctggagggtgtcagccttgtggtctggccctgccagcaggtcctgctgtgtggacactgcagaggagattagtccaaggggatccatgtaggagctgccatcacacaggaggttgatcaggaaacggttgctgaatgagtaaatgattgtcttcctctgcccctgccaagtatttgaaaacaaatgctcacttggttgtcgttgaaacaacaggctctgggtgtcatgatggaaaagagcgccgtgttgtggtcggcgtcgtctgtaactcctgatagcaactgcagtcttaggagtgtctttaacattagagaccttttccaaacttcagaagaggaagcaggacgtgtt

SEQ ID NO: 2502 - DNA, 1183 bp, Homo sapiens
gtgagaggatctcttgagcccaggagctcgagaccagcctgggcaacatagccgaaaccctatctctactaacataaaaaaaaaaaaaagaaaagaaaaaacaaataaggcccttgtccccagaaactgtgatcggtgtgactgatgaagcttctgatggaagctcaccctgaacgcccagctccactgaggaaccctggccaggcacagtggtcagatgggggctttgggcctagaaacagagttgctgctagtgcctcagcccctctgtcctcgcgggacctgcctggtctgtgtgcctagcgtcggcttcccggctggtgactctttccttgtgtgccgccctctctcggatgcaggccaacggagcccacagacttcctgatgctcttcgagggcagccccagtgggaaaaagaggcctgccagcctgagcacagcccccagcgagaagggagccacctggaacgtcctggtaaggtggtgcatgcggccccacgtcctggtctctgtgatgggattgtggcctggttcctaatttgttctcactgcctttgcaaaagggcactgcagggagggtgtcaagcttagatctgacatggcagaccccaggacatccacctgtctgtatgggaagttggtggctcctcccgtttgtgggagaggcagggaagggatggggtgtctgggtgtgtgcgggcggtgtcatgggctgagctgtctgacaggatgaccagccccggggcttcaccttgccatccaatgcccggagttccagtgcccttgactcaccagcgggcccgcggaggaaagaatgcaccgtggccctggcccccaacttcactgctaacaacaggtacgacctgtgcaggtgcccacgacgggcaccagtgggaagctcctggagtggagactgtgtgtgtctttgtcttgtttatggctcgttcagggtgctttggaatgaatgaatgagtgagtgagtgaaagaatggctttcattcccaagggcataggcaggaggctgccaggtggcgtcttgcacataaggggctctcggcccaggctttgctcttaaagagtttcaggccttggggaggctcacatggggctgagagggtggggcctggggaggggccttggctgaggaggcttgtagggggtcctggggaagctccaaaagaaat

SEQ ID NO: 2503 - DNA, 1199 bp, Homo sapiens
cgggttacggctggcacacacttggtgcaggagcacccggtctgactcgcttcaacactggccagttatttgccgcaagcggctgtgacttatgtcatttttacaagatgttttcaaattattataggaagctttgaaaaatgatgggttagggctgtgaggcataaaagttcaatccaggagcgagaaggatgttttgtgagtggtgagagcaaatatctcagggacggccctgcatgccaggcatagactgacgtgccggcccagcctccccagtggtgacaccatgaccagccagagaagtgcagggtcagcattctcccaggaacgcagccctgggcctcgcccagacccctggatgtgggggacagggctggctccaaggagatcagggccatggggccggccctcaagcagcagcccctgctccctgctagcaccccgggccagacgcctgcctgcagggaaaggccatgacgggcagagcaggtctcccgcacacctcctttcacaggaggaagtgcaggtggcagaccagccacctcggccgtgggccacgtgctcgccctgggtgctgcggggctcaaccacggaatgtcaatggtacaaggacgagatcccatgtgctggtgacacctccccatactccagggcagggttccgaaagagcaggcaccatggcctcacttgctcctcaaaggactagccctgggcctggtgctgggaagaggaggaaagaggagacagaagggaggagggggagggggaggagggagggagaaagaggaggagggagaaggaaggtgggggaagaggaggagggaggaggaggaaggagggaagaggaggaaggagggaagaggaggaaggagggaagaggaggaaggagggaagaggaggaaggagggaagaggaggaggagggagggaagaggagcaggagggagggaagaggaggatgaaggagggagggaagaggagggagaaggagggagggagaaggagggagggaagaggagggaggagggaagaggagggaggagagaagaggagggagaaggagggaggagggaagaggagggaggaaggaagaggaagaggaggaaaaaagagggggaggggggaaggagccatgccacgtccagccagaagccacgtgggacacatgtgaagcaccgtggaggagacaggctgttccta

SEQ ID NO: 2504 - DNA, 1205 bp, Homo sapiens
aagccggctccagggcctgggctgccgcccgagcctcgcgagcagagggacgtggagcgagcgggtggaaaccaggcggccagccagctggagggtaaggcctccgccctacagccgcctgcctcaggcccagggagcggcagccccctcccccagccctggggtgatgcccaggtcatcctcgggagccctgccaggccccccttctctttccagccgcctgctgagcagacccctcggagagctttctgctcccttcccatcagcagcttgctttctgggaaccttttatctgccttactcccctttaaacacctgcggcatcgtcacatggcttgtgattaccgttttatctcccttgctcccctttaaaacacctgcggcattgtcacttggcttgtgattaccatttcgtctttaaagcaggtttgttaacagttttaacactcggagtatttaaagccagccaggtgtgggcgtgcctgcacccagatgtggaggtttattttaaggctgtgccccaaggggacccagtttgggggtggctgtgcccgccctggtcctagcatagccctggcccagagcactgctcccacaccctcgggcctcggagctcggctgtgttcatctacagggatctgtcacctgtccctccaggaaagctccttacgcctttgctctcctgagaataaaacttgctctgaatcctcctccaaacttctcgccccttgggtctcagctgttggctttttgcgacccctccttgtggcctcatgcagttgggtagcagcagccccgtctgtgagcctgctggggacaggcttctgtgccatgtcctctcccaggctaggggtccacccgccctctgagggtgtgtggctgggcccccgctcaccaaaagtcacgtgcatttggtggcagtgtccaagccttctctcaagatggtcaaccctgccccatgcggggtccacgtgtgcctcagcattgagagggtctgttccagggatctgtgtgggggtcgcagggcacagccgctccagcctcctgtgccaagcccctgggagcaggtgtgggagctccgggccagccctggcacgggcacctcccaggatgttcgtaagacacacgcttcctgcccgcgcatcttgccctgtggcctcaggacagccggtccgagggagggcaggtgcagcagccacgtccca

SEQ ID NO: 2505 - DNA, 1156 bp, Homo sapiens
tggaggtgctggccagtgacttccgcctccaggaggggcctccacttctgtaacagacaggaggagaggtccgttgaagggagcccctggcgtcggctgagtgcgtggggacgccatctcagccgtgaccctggggcttgttgtcatctctgttctgagctccgcactcctgtgcctggaaagctccttcccagcgttgtcacctcatacaaactgccccgagggacactctccgagggtcttcctggatccgctgtgctcatatttgccaaggatgactgttcccggatggcgaaggtgggcaggggagccctgccttctgggttccgtgcagctggcggggctgtgcttggggacagtaggggtcaccagagaaggaaactgggagtgttccgaagcagccggtggagctgccttgcgttggatttggtaattcggactggaaaaacgtccacctggagagggaggtgggtgttttgctcccacctcagctggtgccccaggctcggtcctgcctgagcagggccacttactgctgtccaggcctctgggctagactgggcgctgacatgggagctgtcggtgggattgtggtagcctgggagctagagtccagtgtgctgagaccctagccctgggcagtgaggggtgtcgccctcgtccagcaggctgccggggagtggacttctcggtgccagccagcaggaggctccccgtccccttagcactgcgccgcctctgcctgcggccggtgcaagcagctgtatcccgtcatgaggcttgtgcgggccgtgggcctccggctcacctggtgccctccgaggccacatctggtttctgtttcttccacgaggctgtaacaaaacacatggcccctctcagaaccacatgctgcttgtttttagcgtgtctctgattttccagcccccggctcccccgtgatagatgggctgccgggctgaggctgagctggggtcgagggtcctgcaccgatgtgcgctccctgtcagactgctgagcggagttttattggtctctttgatgctgcagaggccaaagatggtacctgctgactgggtgagagtcctgcgtggccctgggctgtggccgtgaatcccatcctcatgcagatgtcatgtgtcgtggttagacgcgc

SEQ ID NO: 2506 - DNA, 1214 bp, Homo sapiens
gtaatcccagcactttgggagaccgaggtgggcagatcatgaggtcaggagttcaagaccagcctggccaacatggtgaaaccctgtctctactaaaaatacaaaaattagctgggcatggtggcacgtgcatgtaaacccggctactcgggaggctgaggcaggagaattgcttgaaccaggaccggggaggcagaggtacgccgaggccaagatcgcaccactgcactccagcctggtctacagagggagaccccgtctcaaaaaaaaaaaaaaagaaagaaaaagaaagaaatgggcatgttcttacagaaactagagatttttagaaggaggaggcgaaatggtgccttgcccctggaaggccatctcttgcagaagcttcattatgaagtggattgaaggccattctggggggcagggcacaggtcccccccatgccctgcccactgtgacaggtgccactcggctaggatgtctgtctgccacgttgccatttcttattctccaacaggtggggtttttcggctacgtcagcttcaccgaggccacggccggcaacgtgctcatgcactttccctccaacctggtgacggagatgctccgtgtgggcttcatgatgtcagtggctgtgggcttccccatgatgatcctgccatgcaggcaggccctgagcacgctgctgtgtgagcagcaggtaagaccctcggggcactctccggatcgtaatagcacaggtcaggctcgcttcccataagcccccagctgtcccgaaccagagatatagcaggaaagtggggatttgcgtcagaggagtcccgggagggcggaagttgggggagcctagaggaaccagattgatgggcaggagctgataatggccagagtctggagatgggcacatggcgttcactgcacagttctctttttttttgagacggagtttcgctctgtcgcccaggctggagtgcagtggcgcgatctcgactcactgcaagctccgcctcccgggttcacgccattctcctgcctcagcctcccgtgtagctgggactacaggcgcgcgccaccatgcccggctaatttttgtatttttagtagagatggggtttcaccgtgttagccaggatggtctcgatctcctgacctcgtgatccgcccgtctcggcctcccaaagtgctgggattacaggcgtgagccaccgcgcccggcc

SEQ ID NO: 2507 - DNA, 1179 bp, Homo sapiens
gtaagtgttttaaagaaactagagcagcagagaagagagactcagaagcccgtggcacggctttctcggcgtcccctccagcgagggggtctccattgctgcagttgccggttttgtccaaccaggtcaggaggctgcccggccccctccccactctcaaagttgcttgttaaacacagagtcgtaatttgtggctaaatataactagtgtgttctcacggaaagtataattcagggtgctcattgtatgaggttatcaacaagacccatctgggttaaattaaagtgattttcataaagggcagaagcgcccctttgcctggtttcccctgcctttttattagtgacagtgttattgttgcaattattagaggggatcaaggaaggtgggagttgccagggacccccaggctgaggagggagcctcccagcccccctccactcaccattgtcctgctgcccctccagccccctggtcactgtcacctctgcggctggagggctggagaaaggcccaggagcccagggaacctccaccatgccaggctgccttccctaaaggccggctccttccccccaggcagccagtctgggggtggacctggaggggcagggttctctgggaatctctgggccaagggatgcgctttggggatctgctggaataaagagtaatcggttttccttacaggaggttgacccgaaacagccctccgtcttcctgcccatgaggatgaggacaggaagccagacccgggagagaaagcccagatcagacagatgggggttgggagggcctagtggctgaaactgccctgcttggggacaatgctcaggcaggaccaatccaaacgagggcactgcttatgtggtccttccggagcatcctccaaggcagagcctggcttcgggccctccctgcaaggacacctgcctccactccctgccagaccaggcctggctgcagaggcggaggggcggcagggctgcctgtctccactgtttggcggtgtttacacgtgtcgctgtcagggtgtctggacagtgggggtcgggggcctcccgggcccagacttccccaggcctattctcacactggtgagagggccctaggggaagggtgtgggctgggtggcggggccaggccagctgagacctacaggaccgtggagcatttag

SEQ ID NO: 2508 - DNA, 1124 bp, Homo sapiens
tgagcatctcacctgtgttcaaaacaagacaaagacgaacaaatattttaaagtattgataagaaaaagcaatgtttggattgtatctgctgaatcatattccaacctatatctgatttctgtttccggggccagttggtctgaggccaaggagtctggcctccacccagagcagggaggggctggcccctcgcccccctcaccctcgccgccctggcacactcgggaagcagggcccagctctgagcccctcctcacccctggggtcctaactttcctgaaagtagtaggtgccgtgagaaggggcagtttggccaggttcctgaactgggcagggctcggggcctatgagggcaggttcacagtcccaccagattctctcctcacccccaagcagaatgcatgcaaaagacaccccttttcccacccaccttattggtgcccccaaacccctggcctgctgcgtagatggtggtgaggccaggccagcagtgctgtggccaggggagaagaaaataaaacgcaggccctgcccttggggaaggcccctttctgggcccccttttccaccagccaaatctgcctggccctcggacccctctgcctgccccaacccctttggaggtttctcggccttttctgtgccacttggtggggcagatggcctgatgggctagtgcttggggcatagaatgagggtccccctgaccacctgagcccaaatcctggccccaggtgcaagcagcacccctcgagggctctgccccagtatccccagggaattcacacccctccccttctcccacagccaaggacagacaggctgcctggacctgagcccaacagccttcagcctcagaaacgcatggggggccacacactccttatatcctcccacactaaggttcccctggccccacgggagcttcaggaaagccccccaagttagccactgctctaggacgagctctgtgtcccccacaccacaggcctcgaagcagggtgctggtgggtgccctgtaccccaatcccaggtccccttggccccctatttttctcgggcccattggggcctgtttctcacctgctggctggaccccctgaagggccgttcccagaggctc

SEQ ID NO: 2509 - DNA, 1512 bp, Homo sapiens
cacgagaccaccttcaactccatcatgaagtgtgacgtggacatccgcaaagacctgtacgccaacacggtgctgtcgggcggcaccaccatgtacccgggcattgccgacaggatgcagaaggagatcaccgccctggcgcccagcaccatgaagatcaaggtgagtcgaggggttggtggccctctgcctggctcgggagagctgactggggggcgctctgtgagctgaagccgtgcctggctgtctttgcagatcatcgcacccccagagcgcaagtactcggtgtggatcggtggctccatcctggcctcactgtccaccttccagcagatgtggattagcaagcaggagtacgacgagtcgggcccctccatcgtccaccgcaaatgcttctaaacggactcagcagatgcgtagcatttgctgcatgggttaattgagaatagaaatttgcccctggcaaatgcacacacctcatgctagcctcacgaaactggaataagccttcgaaaagaaattgtccttgaagcttgtatctgatatcagcactggattgtagaacttgttgctgattttgaccttgtattgaagttaactgttccccttggtatttgtttaataccctgtacatatctttgagttcaacctttagtacgtgtggcttggtcacttcgtggctaaggtaagaacgtgcttgtggaagacaagtctgtggcttggtgagtctgtgtggccagcagcctctgatctgtgcagggtattaacgtgtcagggctgagtgttctgggatttctctagaggctggcaagaaccagttgttttgtcttgcgggtctgtcagggttggaaagtccaagccgtaggacccagtttcctttcttagctgatgtctttggccagaacaccgtgggctgttacttgctttgagttggaagcggtttgcatttacgcctgtaaatgtattcattcttaatttatgtaaggttttttttgtacgcaattctcgattctttgaagagatgacaacaaattttggttttctactgttatgtgagaacattaggccccagcaacacgtcattgtgtaaggaaaaataaaagtgctgccgtaaccaatgaatggctcctgtttggggaagtagcaagtgggctgggaaagacagaccaacctggaagtattgggtagtcttgggggtgggggcggtgggtgctgctcagcttggcttcgtgggctggtgagaaaacggcttaacaataaactgagcagttcgatttcttccaaatcgaaagtgcaagaacaaggcagcctagtgggtttgggtgttggagataactgaagcaacatcataagcaggctgggagggaagtcctgagacggctttttccattatttaggaaaaactagatgacttgacatcttgggtaaatatttggcataaaataaccacctgaatcagcaggggcctgccttagtttccccccagccctcaggtggacgtgtgatatgaga

SEQ ID NO: 2510 - DNA, 1216 bp, Homo sapiens
ccagcctcgcccccgcccccacgaccctggcggcctcgggtccgcaacgtggggaagaaaggtgggggacggggacgcgcgcccggggccggcacctccccgcacttcctagacaaagaagcttcggaggagaccagagacccggaggggcagggtccccggccggcccggagcagaacgtagtgtggggtgaacgcaggatggaggggcttgtggctattccccacccgcctcgtgtccctcggtgtgtgacgtcgcatcttgggaccccccaagtggaagtcctcacccgggggtcgagcaggctgtgtggttctgcccagggacgcgagtccgggtgggtctgttggaggcccagccccggcttcgccacgggagggaacatacctgacagccttgcccgggcccccggagattctgggcctgggggcgctcagcacccctgggaggcctggggcacgggggccttaggcacgggtctcggcgtccgggctgactgcagcccgcaggtgagctgggccggccgccttgccctgactcgctgttgtcactcccaaacacggggtcgcgagctaacgttgcagggccccggactccgcgtggggaccccggccccgccccccagcctgtcgagtcaatctgaacgctctgcgacctcgggcgagtccgtcccctcactgcgcggcctcactgccacccctacgcggccggcgctccaaccctgaaaattccagcagcgcacaaggaaaccgtagtgccgggcgcctctcggggtgtaaccaaagcaccggcgccgctcctggcgaggagtgagcgccctggacaagcctgtggctaaacccacgccagccctgatcgctgctcttaactagcatcgtaaacagaagagggtatccccccgaccgcccgaagctggggagccgaccttcaaaaaagtcagggctcccattgtctacctcagtttccctataatgtctacaggtgaccagaatgaaacaaaggcctcactccacaccaccttctcagcacataagggggcggggtagccccaacccggagcgcgcgcctggggacaatcaggcctgtgatttgaggggcagggatgtgtcgggtcgggtagaaaggggcctcggtcttcaaacgaacggagatccggggcagggcgccccgtggagggacctgcatggtggtggctgcgcttggggacgggcgggct

SEQ ID NO: 2511 - DNA, 1167 bp, Homo sapiens
tctctggtttggggagaattgtgggcctcctccacctccagctgcaggacccccaagcggcgccccggggcccacccacagctgcgggagagacacggttttaatgcgcgacaggctggtctgggcgcggcctcagtactcccaaagcgcggtcccggccggggcgtcggcatcggcccgcagcaggcccgaggcgccgccgcgcaggtacttgccgctccgggcgcggatggccaggcggccgcgctcacggaactcgaagacgaagtcctcggcgcgttcgccgtcgctgcacacgctgccgtggctgcccgtgtaccagaaccctccgtcgcggcctgggggacgggacggcgtcggcgggggtgcccacctgcccgctgccacccccgctcccgcgtgcccacccgccccgccacgcacctcggatccggtaggcgccgtcgctgaagctcaggtggaagacgtcgtagacggagcggttggtgtccagctggttggagccgcggtggtggcagacgaagccgtccaggccgcgcagcaccaggatgggccggttgatgagcttgagggtgaactcttcgtccttgcctggcggggagagcgtctgctgcgctgcccctcccgccaccttccctgtccaggccgggcggggtgggggccctgggaaacgccacacctggacttagggacccaggcctgccattgcctcatgtgcggccttggcaaggcgcctagggggttcccagcagcggagataaggacattcagacctgtttcccttgccaagacgagttatcttgactagcaagtatgactccatgacagcacccgttccgtgggctggggagggtccagctcttggtggagatggggtgtctgggcaggtcctttccctgggtggagacagcccctgccccagtacctggcaggcagagtgctcaccgacaaaatcgctgatagccgccagctgcccattcttcttcatgcacacgtagcgcccgttgctggctttgagtgctacccgccggccacgccactccatctcaaacatggtgttggcagaactggagggagcagcaaaaggtctcctcaggacagcaggagatgggggtgcagggtctcacttccccatcctcctcaggttccaaggagtgggacagaagc

SEQ ID NO: 2512 - DNA, 1176 bp, Homo sapiens
tccctgtggaccccgatgcctgcatccttcccgatgctgcgctgtgcgcgttcaccttgctggacagtgtgctggtcaccctggtgcagggccctgcccgatggaagatgcagctgtttgagcagccctgtcctggggaggacccccggccaggaggccagatcggtgaggtggagctgtcctcctacacgcccccagccggggtcccaggaaagcctgcagccccccacttccttccagtgctgtgctctgtgtcaccatcaggctccagggtcccgcacgacctcctcgggggctccgggggcttcacgctggaggacgccctcttcgggctcctctttggagctgatgccaccctcctgcagtcacctgtggtcctctgtggtctccctgatggccagctctgctgtgtgatcctgaaggccctggtcacctccaggtcagcccctggtgacccaaatgcccttgtcaagatcctccatcacctggaggagcccgtcatcttcataggggccttgaagacagagccacaggctgcagaagctgcagagaattttctgcctgacgaggatgtgcactgtgactgcctggtggcctttggtcaccacggccggatgctggccatcaaggccagctgggatgagtccgggaagctggtgcccgagctgcgggagtactgcctcccaggccctgtgctctgcgctgcctgtggcgggggtggccgcgtgtaccacagcaccccttctgacctctgtgtggtggatctgtctcggggaagcaccccgctgggccctgagcagcccgaagaaggcccgggaggcctgccccccatgctgtgcccagccagcctgaacatctgcagtgtcgtctcgctgtccgcgtctcccaggacgcatgaaggtatgagctgctgtctaaaatgaaagatgggagcccagggtggagcaccctttttggctgtctgctactatcaggccgccttcctttcctgggcttgttcttttgcaaggctgacgggtgctgatacagcctagtggttaactctcttgtctcaaggtcaagccaggggctggtggtgggcctacctgttgctctgcctctggggtctagggtgtggccctgggcctggtaggatctgagtttgctgcttgctggctgtggacttggaggaaactg

SEQ ID NO: 2513 - DNA, 1861 bp, Homo sapiens
ttattttcagtgctttttgtttggcctccctgcccccatgtttttctggctgggagctcttggttacccccttgtctgactgcttggtggcaggcaccctgcctgtgagggccactttcctcttctagtagctgttgtctggtggggacgcagtggccctggacacggctcccctctgcaggtctgcaggtcggtttgctgcctgccctcctcctctcacccgatgtccaggtgggattttaaagtctgcattggttataataacagttatcagtaattcctgcccagaagacttttatttatttttttttaagataaaaactgcacaaaaggggagtgagagagactagtttccacatccttccctcctttagtgaagcccccgaggttgtgtccagggtgatgagtgtggacgggggcaccagtcagttctcccttgaagtaaacctcagtgcctgagacttttctaccaagccacacagctgcagcaactgcagatactgcgggctgagcaggagcagtggtggcgcctgccctgaggctgccctgcgatggcctgggtgggagagctgggtcaccggtgccgatgctctggccctccccaatacgctgcttcgtcccactgcaccgcctggctgagggcgttaggggctgtgcctcttgtgagggccatttgggacctccctggggcactgcacaattgatagtgtaccaatagagggagactgggcgatctggaacagcacgtggtggggtcctgcttgtgtgctctgcgttcctctgtggcgtggccaggccggggcatggctcttacccggggagtggtgggcatctcgatgcttctttgccttaatgatggccacatctgggctgctctgcacccacgggagaggctggcccagctgcagactgcttagggacttctgtgtccatcctggggggtaagcccacgtgacccacattcttggcactatgaacagagaacatttgcctgttggcttctgaagtggtcagggccatggctgacacctccaggtccgcctggcatgggacaccaagtggaaggcccaagcagctcatctgctcttgggaccaggggccagttgggttgggtctggtcacggcagagctattgtggagggtcaggaagggtggagaggagctgggttgaagcggactgctgcggatgcaactcccagcttgcccaccgcgggctgtctgctctccctcctagcagctgtcacactgaagttttgtcctctgctgtctcctctggtcctgagatgagctgtgagcctaggtggccaaggcttcctgcattgcttccctgtgagtccaaggccttcccccaccactgggcagaggctggacagcacggacttctagagagagccgcgttgccagttcctctcccactcgctcgtccttatccaccacgctattatagtttccgttgtcctccaccagcatttcccttactctgaagttccggcattcacatcattcatgttttcttttgtcttttagctaaaggaaaagcattggcgatttgtctgattctggttttgagttactctttgttcagtaatgcactttattttattgtccaaagagagtcagagctaagcatacaggcttgggggtgagccctgctgtgagagttcaggccctgggaggctcagccacctcctcttgtgggaaggaggtctcagccccacctcgcatcttcacctgcccttggtgtggacacaccctctcatgctaccagcaccataatccagtgggggtgactgggtgcacacctgcccaggtgaacacagcggctgccagtctcctggtcccgagaggaggtggggcctgg

SEQ ID NO: 2514 - DNA, 1146 bp, Homo sapiens
gagcacgactgctttttcaggctgtggttataatgagctccaagaaatggtggaaggtggttttactgcaaaaatatgcacgttttcctttctgctatccatacacttcaataagatttgaagtaatttaaaaagtgaaggccggacgcggtggctcacgcctgtaatcccagcactttggggggctgaggcgggtggatcacgaggtcaggagatcgagaccatcctggcaaacacagtgaaaccctgtctctactaaaaaatacaaaaaaaattagccgggcgtggtggcgggcgcctgtagtcccagctacttgggaggctgaggcaggagaatggtgtgaacctgggaggcggagcttgcagtgagtggagatcacgccactgcattccagcctgggcgacagcacaagactctgtctcaaaaaataaataaataaataaattaattaattaaataaaaggtgagacaagcatgtgaaaggaaaatcattactactgatcgtctttgctcaccgctgttcccctctgactattgcaggacgtagacaagtttggcaacgagatcacccagctggcccggcccctgcctgtggagtatctcatcatagacgtaagtgccccccatgcacagcttgggcaggtggacccattgggcgccttgtaggtgggactgctgggtggtggctgctcaagggaggaggctgcaatttaaggcaccctctgccttgagcagtgcccaccccagaacaggcacccaggaggtggttgtagaatcactgagcatgcggtgttgctgaaatgctcacagttttaagggctttttgttttagtctcaggtttttatttccttgacgtcaacctaggggttaactgtccccatactaaagtacaaaggaccactgaccccaggctaggcagcctctggaaggcagcgaacccccattgcttgggtctccagtcaccggagcatcaagcagtcttgtccagatgtgctgtgcttggtgtgtggctgtcagctgtcctgcacgtgcaggtgcttgccctagccccagcacagctgccacagcccacagtgtgtctgggtcactccgtccagggtggtccccaggggacacacctgtaactcagtgttcttgagtgagg

SEQ ID NO: 2515 - DNA, 1167 bp, Homo sapiens
gggttcacgccattctcctgcctcagcctcccgagtaactgagactacaggcgcccgccaccacgcctggctctggctaattttttgtatttttataaaatacaaaaaaaatagagacgggatttcatcatgttggtcaggatggtcttgatctcctgacctcatgatccgcccgccttggcctcccaaagtgctgggattacaggcgtgagccactgcgcccagcccagatgtttattttttaagatacaaggggtctcactctgtcacccaggctggacttgaactcctgggcttaagcgatcctctagcctcggcctcctgagtatctgggaccacaggcatgcaccatcacaccctattggtttgttttttaaagaactaggtaaaagatatttatgaatggtttgtgttagaaaaacaagtgatttctttttgatggcatgttttcatcagcccactcttgttaactctacagaagtacaggcatgtggacaatatcatgtttgagaatcacaccgtcgctgaccgctttcttgacttctggagaaagacagggaaccagcattttgggtacttatacggacggtacacggagcacaaagacattccccttggcatcagggctgaagtggctgcgatttatgagccacctcaggtaaacatgacgggattcaagttcctgagtttctgtgtttggaggctgtgggggacgccctttcggagaggccttgccctgttcgctttgttgtttgttccccctttgtcacacaccggtgcacgtgcacaacattttctgagttattggagagtgagatcatggctcctaaaaccttcagtgtatgttactaaggataaggatattttcttacacaaccggtacatttgccactattgatccagtgtttttatctcgtctgctgtgtccaggtttgctcattgactctgtagtgtccaggtgctcagtccttgtgtcattctgtgtctcttccaccatgcagcagtcactgtcttaggaaccatggagaaggccacagacacacctcagcaccaatcaccagagtgtcaccagagtaacaaaaactgccaccaaaataggactgataacaatttaagatttgtttggaggggaaagaagtgtcctgagggtatatcccgcagggtgtg

SEQ ID NO: 2516 - DNA, 1210 bp, Homo sapiens
ccctcgagtcctgccctgctctgctctggagtgtggccattcggacacctgtggctgtggaaccactgtcctcactctgtggggacacttagaggagcccgcagaggtgtggttgagagctttggcgggggcagggcggtgtcagcgcatggtgacctgcagcattccttgtgcccacaggaaagcggagggaaaggccacttccaccactgagctgccccccgagtacctgaccagccccctgtctcagcagtcccaggtactcagccccctccgtcccgtgggcacctcttccccggcgccccccctcaccctccccgcttgtcctcagctgccccccaagagggacgagacggccctgcaggaggaggaggagctgcagctggccctggcgctgtcacagtcagaggcggaggagaaggagaggctggtaagccgggtggggcggggcggcctcaggaggggcccagctcccctggatgtgctgcggtggggccggaggggcgtcacgtgcacccaagtgacgccccttctgattctgcctcagagacagaagtccacgtacacttcgtaccccaaggcggagcccatgccctcggcctcctcagcgccccccgccagcagcctgtactcttcacctgtggtgagcggcccttgggctggagctccctctcctggaaggcagtagggttgatgggggacgcgggtccctgagctgatttagtcaggttggtgggggatgcgggtccccgggcttcccagagaggacagccccagcacacgggcggacatcagggcagagccccacggctccaggcacccgttgctcctggtccctggttcggcccttgggactgaggacatgggacaggctgtgggggaggcgccttgctggtgagaccccgtctcttccacacccctcccgccccacaggaactgaaggacttgctttctggggcatccacgtcacctctccctggcctcagccccgctctcagtagagggtgaagaggcagcctgttttgcagggggttgggtcggggacagcaggttgagaaagtcattttgtaggttccgtggagtggccaggccgctgcaggcccaggggtgcagaacagccctgccccagtgagccaccccttcccttcttcccttccttccgggctgtcggctggggccccacacgctggaccgtgggggctgtccagtg

SEQ ID NO: 2517 - DNA, 1196 bp, Homo sapiens
agacaggaaaaaccgtgaatttacttgaaaggcaaaggccgcatgagctggctgcatgagctgcagtccgtggacatggattacaagcacttgtgggtctgtggctctgctgggacaaaagccttcctccctgggctggggaagggaggaccagggccatgcctgctttcctcctgcacagatggcaccctctggcggtcccccccagcagcagccccccgtggcccagcaaccgcaggcacaggggccgccggcacagggcagcgaggcccagctcatttcattcgactgacccaggccatgctcacgtccggagtaacactacatacagttcacctgaaacgcctcgtctctaactgccgtcgtcctgcctccctgtcctctactgccggtagtgtcccttctctgcgagtgagggggggccttcaccccaagcccacctcccttgtcctcagcctactgcagtccctgagttagtctctgctttctttccccagggctgggccatggggagggaaggactttctcccaggggaagcccccagccctgtgggtcatggtctgtgagaggtggcaggaatggggaccctcaccccccaagcagcctgtgccctctggccgcactgtgagctggctgtggtgtctgggtgtggcctggggctccctctgcaggggcctctctcggcagccacagccaagggtggaggcttcaggtctccagcttctctgcttctcagctgccatctccagtgccccagaatggtacagcgataataaaatgtatttcagaaagcatcagcgttttttctttaattaatttttttgagatggagtctcactctgtcacccaggctggagtggtgatctccgctcactgcaagctccgcctcctgggttcaagcgattctcgggcctcagcctcccgagtagctggactacaggtgcaccccattaccatgcctggctagtttttgtatttttagtagcgacggtgtttcaccatgttggccaggctggtcgtgaacgcctaacctcaggtgatccacctgcctcgggctcctaaagtgctgggattacaggcatgagccaccgcgcccgacctgcatcaacgtttgctcagggggcaggtggtcaggctgatggcccagctgcaggcagggtcatttccagcctgcccctccctgaggctgcgtgcc

SEQ ID NO: 2518 - DNA, 1208 bp, Homo sapiens
taccagccagcagccgccgctcacacccacacccacacccacaccccacattgagaatgcccaggccaccgtgcctggctggtgcctgggaggggattttcgttgccttttgggtgagaagcagcctttttgattgtttcactgcgttttctgcagggcgttttccactgcgccgtggagacagcgaagctcgggcctctggccttttacaaggtgcagtggtggcggcagtggcggcttgggcaatggggagcgggccccttcgggctctgtgtctctcattttccctgtctccctccagggcctcgtcccagctggcatccgcctcatcccccacaccgtgctcacttttgtgtttctggaacagctacgcaaaaactttggcatcaaagtgccatcctgaccagccgtgggaatggctgggctgccaggccagacacgctaggttcttccaaagagtcccaagcccagcacctgctcctggggccacgacctccctggccgtggccacccgtcctccgcagcaggcccctgctgtccccccacctgctggctgagctcctcctggcctcgtcccctctcagctgtagctgcaccacccccgctctggctaccaggctctcccggctgggcactgcgtggccttgcccctctcccgctggcagctcctcaggggaacaggggctaccagaggctgatttctcccctctcctgggccaggggaggggtattatccctgcctcctgcccccgatgcccaaagcagcatcttccagcactttccatcgaggacttgggtggcagagtgtgggtgcagcctggctgttgctcacccaagtgctagctctgcacttcgtgtctgctgagagcaaccagaccttccatgtcctcgggcagctgcaactccccgcgagaccccgcagctgggtgggatgaacaagcaacgcagaccacaagcgagtgcctgggagggagtggcccagggtggttctggagccattgtgggtgagggtcgagggccaccgaggtcccgcgcaccgctgcctgccctgcagtggctttaacagttagttttgccaaagcctctccactcaccagcaggcggtctctgtcttcagggattgtgcctgcgtccctcgggcacctgggcccccccgcttggctccctgggggaatggcccaggcgggccgcggttcctccttagggcc

SEQ ID NO: 2519 - DNA, 1212 bp, Homo sapiens
ctgcccagaggcatgcccccctgccagccacagcgacccctgctgctgttgctgctgctgctggcctgccaggtgaggactcacagcaccctcagcacccaggggccctcctgtgaggactgcacactgatggctctctgtctgcctgcctgcctgcctgcctgtctgcctgcctgtctgtctgtctgcccgtctgcctgcccatctgcctgtctgtctgcctgtccgtctgtctgtccatctgtccatctgcctatccatctgcctgcctgtctgcctgtccgtctgcctgtctgtctgcctgtccatctgtccatctgcctatccatctgcctgcctgtctgtcggcctgcctgcctgcctgtctgtctgctgcctgtctgtccgtctgcctgtctgcctgtccgtctgcctgcctgtccgtctgcctgtccgtctgcctgcctgcctgtctgtctgcctgcctgtctgcctgcctgtccgtctgcctgtccgtctgcctgcctgtctgcctgcctgtctgcctgtctgcccgtctgcctgtctgtctgcctgtccgtctgcctgtctgtccgtctgtccatctgcctatccatctgcctgcctatctgtctgtccgtctgcctgcctgtctgtctgcctgtctgcctgtctgtctgcctgtctgtccatctgcctatccatctacctgcctgcctgtctgcctgtctgtctgcctgtctgtctgcctgcctgtctgtctgtctgtctggttgcttgtgcatgtgtcccccagccacaggtcccctccgctcaggtgatggacttcctgtttgagaagtggaagctctacggtgaccagtgtcaccacaacctgagcctgctgccccctcccacgggtgagccccccacccagagcctttcagcctgtgcctggcctcagcacttcctgagttctcttcatgggaaggttcctgggtgcttatgcagcctttgaggaccccgccaaggggccctgtcattcctcaggcccccaccaccgtgggcaggtgaggtaacgaggtaactgagccacagagctggggacttgcctcaggccgcagagccaggaaataacagaacggtggcattgccccagaaccggctgctgctgctgcccccaggcccagatgggtaataccacctacagccccgtggagttttcagtgggcagacagtgccagggcgtggaag

SEQ ID NO: 2520 - DNA, 1134 bp, Homo sapiens
tgggccctgcccaccctcctgccctcccccagccacctggctgcatttttgaagctgcctggcccccaggggccctgacctgacctctctcctctcccctcaccctcctgcccctggccactgcaggatcaggaggggagaagaaggagcctctgctgcctcccaggctgctgggactgggctggttttgtccttgaagtggtcaggatacaggacaagggcagccccaccccatccagcctgggctccccgcagacccttgctgctcccgtggcctggacacgctggggagcttctcacacctacccctaccgtccagcctggcctcttccctgaatcagcttcaagatggcaccagctctttgggcctaggatactgccgggccccccaagggggtccccagcaaccaggcctggcctcctggtgtctgcggtcacagtggcccctgggcaggggcacccaggctgaccctgaggtgctgctgctgggtctgtcttggctctggggtgtgctgggagggtcaccaggtcccttttccttcctgtgccctctgaaagctaagtgtctgtgtggctgtggagctcgagggtctgtgaataaaggcggcggcactgggcgtggcctcttggtggtctgtcaggcctctgcccctgcggcacacatgcacagccagctcccgggcagggctggaaaccccagatcatggcgaaggcttctcaagcccagaaattctcagtctaagccactgggcgtgctcaggtctcctagggcaggtggtggcagggagggcattctggagggagaggctgggctgcctgatatcactacccttgttctgccacaggggctgcccagggggccgcagaggtagtaggcaccaccctgaacccaccctctggggcactgtggcccctctaggagctggctcctcccctgtccagaagaagggggtgccgctgggcccaggagagagccacgtgcacttgaccttcaaacctgcaagctgccctggcaggccagacagggagctctattcctgttcctgttggaagcgaaaccagaatttattccaggaacacgctttcccagaagagtggccccacaggcgcctcctggtgggtgggctggtgcag

SEQ ID NO: 2521 - DNA, 1308 bp, Homo sapiens
cctttacctgggcagctgaggtgtcagtctcctgctggctcaggggctgccacctcaggtggccgtctgccgtgtgctgggtcttttccggctgcccccggcgcttctctgggcctgtgccattgtcccctgctcactctcacccactatggtcctgggtccctccacatccaccacctcagggaccccatgcatggatgttgtgcctcagggttccctctgcttagccagacaccagcctgctgcccaccaggcctgagctagggctgagctgcctgccagccacacttcctgccctcccccctcagctgtgtgcctcactatgctaggccgccccgctgaggttgttggaggccttattgtggctccatggtgacctcttggttcagagcttgcttgacctccagccctctccgtggatggctccttcctgccctcacaggcaccgtcctggccccggctccagttatgtccatgcctcggccctctgcagcttcctcccattccatgtgtcccagggcctgtctgtggcccctcaggtcctgctcttgtgcttggtgtccgtctctgcgtgggggctgtggtgccccctctggctgctgattcccttatgggaataggccaggtgtgcattgctacccttctgcggtggctcttccctttgggtaattacgagtgaaattctccagctgtccttgtacgcatcttgggtgtgtgtacctaggagcagaatggctgggtcataggttgtgcacagatacttgatttttaatggaaaattccttctgggtcagaattgggcacccagctccttggcagggccccaggaggcagtgaggctgaatgagctgcagaaccgtttattgtgcttccagggggacagcaggcccctggcctcttggaactgctggcacatccaggaaagcctggggctatgtgtgcagggtcggggggtgggggggcagtgtgaggccctgggggtccctaagctggaggaagaagtagggagaggtgggaagggctcttcgtgtctgggaagacttagaggacacagcctgtggtattgagggtgtgggtacatttcttttcctaacaagaggaggcaaacgagactccttgttgacttaaaaaactgtatgggtgcagctgggtgtggtagctcacacctgtaatctcagcactttgggaggccgaagcagatggatcacgaggtcaggagatcgagaccatcctgactaacacagtgaaaccccatctccactaaaaatagaaaaaattagctgggcgtggtggcgggcgcctatagtc

SEQ ID NO: 2522 - DNA, 1170 bp, Homo sapiens
cccgtctcttccttctgcttttcggtttttggaaagggatccatctccaggcagcccaccctggtggggcttgtttcctgaaaccatgatgtactttttcatacatgagtctgtccagagtgcttgctaccgtgttcggagtctcgctgcctccctcccgcgggaggtttctcctctttttgaaaattccgtctgtgggatttttagacatttttcgacatcagggtatttgttccaccttggccaggcctcctcggagaagcttgtcccccgtgtgggagggacggagccggactggacatggtcactcagtaccgcctgcagtgtcgccatgactgatcatggctcttgcatttttgggtaaatggagacttccggatcctgtcagggtgtcccccatgcctggaagaggagctggtggctgccagccctggggcccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggccaaggatgctggagctgaatcagacgctgacagttcttcaggcatttctatttcacaatcgaattgaacacattggccaaataaagttgaaattttaccacctgtccttgcctcgggtttatgatctcaccaagcccggagagctgggctggaatgcggacgccaaggccatctgccaggccttagtggggttactggtgctgagaggcctcgcccctgggacgaggtgcagatgcagaaacaggccccagtctccccagcagagctgtgcaggcttgcgattcccggggaggatgccttccctgcctgtaggctgctttacctggactctgatggggcttctgtgattctggaccctggatgtggacacgggtggagccacccagccccatgtgatgctcagactcctggtcattccctcccatccccgccgtggagtgacgagaaatcaggtggactcaggcttcaaggatgggtgagaggaacagggggccctgcttatcactaacccttcacacgataaagggcagggctgggcgcagggacgcgcgcctggaatcccagtgctggggcaacacggggaga

SEQ ID NO: 2523 - DNA, 1355 bp, Homo sapiens
tcacagagttctgccaccgcttcctggagggcaaaatcaaggtgcaggcgcgtccccgggccagggctgcctcccgggtagagccgccaccttggggtctctgggctctcagtgtcctgggcttcgtcctcaaagtaagatcttcagagtaagaggacggagcccaagatggtgtgaagaccaccattcttgtcacacctttggggacctgtaggagccctcttgtccacacggctggcccagatgctcctcagggaaacctcctggccggcgagggtgcggcctgcgtgggctcattgggcccagcccactggcccagccttctctttctggattcttggcactgttggtgtctgcggctgccaccctggtgtgcccagggcagccacgcacctcagtcccgggcagggtgagggttggggagctctgtggtcccccaggcatcgccgcccctcaccgtgccctgcctgccctccagccccacctgatgagccaggagctgccggaggactgggacaagcagcctgtcaaggtgcttgttgggaagaactttgaagacgtggcttttgatgagaaaaaaaacgtctttgtggagttctgtaagtgttgccctttcagctccccaggtccgtgccaccagggcacgcgcaaggtaggcagactcctggggaagcgtctgccagtggctttgtgtccaggacacaccctagaactgctttcttttcagatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtgcgccttccctccagacggggctggggcgggctctgggaagagcagtggtccccacgccagcctgggtgcctctctggaaggagcctggggctagtcaggtgggagaagagctgtgggagctccttcagaagcacccacctttgtttttcgagagagatgggatctcactatattgcctaggctgtttttgaactcccaatgtgctggattccgggtgtgagccaccggaccgggcctgctctgcctttctctagggaggaggagccaatgccaggagattggctctgggccgggaccagcccctgcactcatccctgtcttccacaggtcattgattacaacggggaacgcacgctggatggttttaagaaattcctggagagcggtggccaggatggggcaggggatgatgacgtgagtggggtcacagccctgggctggtc

SEQ ID NO: 2524 - DNA, 1120 bp, Homo sapiens
ggagataagccccttgcggggcccaccctgctgataaaccccagagcagtatggcctgtgtcagaatgaccagtaggagggccccggggtagcagctgcccagcccagctgcgtgtgtgtgtgaagtattttcctcaacaccttataccacagaaggcagattttgaaactcgcatcaggccagaaaaagaatttctgaatggacacttctaaggggtgcctggttactcatctgcctcttccccctgcagggtagaggggcatgggtttgaagttcccgggggctcttggagactgcagacacggacgagctggggttcctggatgctgcagcagttggggcccctggctgagcgcacctgccccaggaggccctgcgtggttcccccagtagccccttcacaccacaccgcagtgaggatgccctgtctcctgccgatcccatcacaccaagccttttcgctgttgggctcctggcactgcccgatcctggagggcacttggctgcggctgtggctgtgaagggctggtgctctaggcgcctccgtggcccccgttgcctgggcacctacttcctgcctcagccacagctgcatccacgtgcgccaggggccacaaggccgaccctggcttgggcctgttcctccctgggtttccttgggatccagtcattggagggcccgcgcacagctgggccaactcgacacctccaagcccggccagggaatcaagcagctctccctctggcagcatgagctacacaagccaggcccgtcttcccattcccttagcaaggaggggcaaccccagccaaggccttctgcactgttctagactgttgctgcctagggctactgtagctgggagtcacattcctttctccccagatagttgcaaggggcccagcagccacagcacttcaagggggccctgcccttcccctcccaccaccccaccagggtccccatcttcccctttgtctcctaaagcccgtgaggcagtagaggagccaggccctcccctgccacaccctggagaagccaagcagcagacacccccagctccttcaggggcatttatttcccggtcagaaaagaagcagggacaggcgcctctgcct

SEQ ID NO: 2525 - DNA, 1098 bp, Homo sapiens
ttccaaagcagctgcagcattttatatttctaccagcaatgtatgagggttccaatttctccacattctcaccaacacttaccttttttagtttagtcatcctactgggtgtgaagtaatatctcattgtgattttgctttgcagtttcttctttgtaatcttttttttaaatgtctttaatctctctttttttttttttttttttttttttttgagacagagtctcgctctgtagcccaggctggagtgcagtggtgcaatctcagctcacaacagcctctgcctcccgggtccccgttcaagcaattcttctgcttcagcctcccaagtggctgggattacaggcacgtgccgccatgcccagctaatttttgtatttttagtagagacagggtctcaccatgttggccaggctggtcttgatctcctgaccttgtgatccgcccacctcggcctcccaaagtgctgggattacaggtgtgagccaccgcgcctggccctcaatctctatcttttttatatctggattgaatagactttaccatggataaatctccaccctggcagatttaggactttacttggaaatacagatattctaaatggaattaaatgtcctattatcagtggcattcatcacattcaacaaaatagcatcataaaaggttgatattgttgagcgtaatgaatacctgaactccagttacataaagatgaggatcatgtctcttcatattaccttaatgtcattacattttgtagaaaaacttgtctcaggctgggcgcagtggctcacgcctgtaatcccggcacattgagaggctgaggcaggcagatcacaaagtcaggagatcgagaccatcctggctaacatggtgaaaccccgtctctactataaatacaaaaaattagccaggcgtggtggcgggcccctgtagtcccagctactggggaggctgaggcaggagaatggcgtgaacccaggaggcggagcttgcagtgagccaagattgcaccactgcactccagcctgggtgacagagcgagactgtgtctcaaaaaaaaaaagaaacttgtctcaaaagtgctatgatatt

SEQ ID NO: 2526 - DNA, 2067 bp, Homo sapiens
cctgaccccactgtcccacagctgggatgtaaggaagcccagggcagtgggcagtggtagtggagagacagacaggaatgcatgccgtgtctgcagaaacctttccctgcaccagcggctcctgcgggcacacatcccaggctaagcttgcttccacgctgggatgggcctggctgagtcatgggcaagggagtgtgactaagggtggttctttcgctgtcggtcacagatgtcactacagatcagcagctgccatctaagcagcttgcccaatgccagccagggccacagtctaggaacccagatgaacaggatgactaatcttggcccttccagaagcccagtctagcaggagaaaggattactaagtccccagctgtagtcgctgtgaatgtgacagaaaatgtcaccagtgcagtgagttagagtcaggttatccccaagcaggtgcccttggcccgggcctcggtgttggagcaaggcctgagcaggcccatgccaggcagggggtctgctctctggggccgtgctaggactggctccctgctgcttaggaagtggagagggcacctgatggactggtgtggtcagcccctgcagggtgtgacaaatgacaggactgacaagcagcattgctttggttgtgcagtagtggtgtaacaggcatttggagggaggaatgaccaggatttgggacttcctggcattctcgggagtgaggggcatgggaatgaagtaatatgaggccttggggaactgggtgggtaggtgtcactggagagaaggccccaggaaggagccagctgaggggcgtcagcattggacaggctgggcagaggcaccagctggcccgcaggagagcgttgcctagagccggacctctccagtttgtcagctgatagcacgtggacacgtcgaagtcgtgtccatatgtggcatggtcttgggagggttggaggtaaaggaagtagagagaatgatgtcatagaagcaacagctggtatttgctggggggccagtggtggggtcattgaggcaggtgctgccgagtggtcaaaggagaatgacctgattctgtgcctgtggtggaggtggggctggccatttataactaggatagaggctgggtctggaagccaccggggcttctggtgggcagcaggtcaggtagctgggctgagcctcatcatacccaatcttcatttccttattcataaaacacaaaaccttattttacttccaaggccagaggactatttaatttattgttccagcagggtgcttgtgagagaaagaagagcagggctcttccactgactgcacagacagcaagtagacatgaggccttggccagctgggctgtctggtcccctcttgaagggtgctgccagtcctccgggcacagggccttgcagggcggacactccacactgcccagtgccctgctgccccccacatggtgactgagtgatgctttgctcagacagcgagctatggctgacaaactgaactggcagcctgtgccccatgggcacttggggaaccccctctgcctctggctgtcctgtggttccatggtgccatgcacctgtaatcccagctactccggaggctgaggcaggagaatcgcttgaacccaggaggtggaggttgcagtgagccgagatcgcgccatcgcactccagcctgggtgaaaaagagcacaactccatctcggggcaaaaaaagaaagcacagggattggcccaggttggacacatgacttaagtgtcgacaagcgaaattacactcagggtggggagaaaagggaagccctgttcttcctggtccctttccctggccggcatgggctgagagtaggaactggccagccccgggcaggagaggcagcattcctgtgggacttggagctcttccagggtggctcatggtctgcccagctccgtcttcagcctgaggtccctggagagggtctcggatgtgagcgtgcacacgctcccacagtgctctggtttctggctggtgtgcacggagatctaaggagcagtctacactgggcagctgatt

SEQ ID NO: 2527 - DNA, 1046 bp, Homo sapiens
gattgacgcacagcggaggcctgcacagaggtgacttccggggcctctggggaaggggattggccgagggtgaggctgcgtcgctcttagggtccttccgggtgtgtgaacggtttcgtcttccttgctagcgtaaacagaggtggcatgactagaaaccgtggcgctggaggttttggtggtggtggaggcacccggagaggcacccgcggaggcgcccgtggaagaggcagaggtgccggcaggaattcaaagcagcagctttcggcagaggagctggatgcccagctggacgcctataatgcgagagtgagtcccgggggagccagctgggggcctggtcaaagccgcagtggggagcaggccgcctgtgaatgcaagcctctttctcctctgtgtttcagatggacaccagttaaacagaccagcaaatccgcgtgcggaacaggacccaggcgtctcctcttgctccctggttggggggcggtggctggggctgtgcggccaatgatggatttgtttcttttatgttttaaaataggatttaaaaactcatgtaaaggttttttttttttctttttttttttttttaattctgaaacagacctgttttgtaccgagttatttttgggataaattttactggttgctgttgtggagaaggtggcgtttccaccttttccataataaaatagaaatgtgtgtagaactggaactgtttgattcgtcccactgttggagtccaggcctgggccaggattttggtgtctgtccagctgggagggggtgggagaacctgagttggggatggagggagcagccccatctggtgttggacacctgaagttggcatgggttgtgggggtggcggggggtccccgctcctggagggccgaagctgcctgtcttctttcttatcttctttcctgcctcacacctaacaccttcctctctaactcaccaggtgggaggacacctttgcccgggagccacctgttgacccttgtgcctgtgcctccaggtgaggggaggttggggtgggatgg

SEQ ID NO: 2528 - DNA, 1305 bp, Homo sapiens
tgcagccctgaccctctgggcccagagccctttacttgttatttgttttaatagaaacggggctcatagcagggcataggggttcacgcctgtaatcccagcactttgggaggccgcagtggcagatcgcttgaggccaggagttcaagaccagcctggcctacatggtgaaacctcgactactaaaaatacaaaaattagtcgggcgtggagtcacgtgcctatagcctcagctactcaggaggccgaagcacaagaaatgagctgagatcatgccactgcactacagcctgggtgacagagtgagactctgtctcaaaaaaaaaaaattaataaaaataaaagtaaaataaaatagaaacagggctcacgatgtttcccaggctgggttcggactcctgggccggtatgatcttcctgccttggccccctgagtagctgggactgcactgtggcaggcttatacctgtgttggtgcctaaacgttctagctctgcagactcaatttagccagtcgtcctgttccctccgccgcaggctctgctgccatgaaggtgaagattaagtgctggaacggcgtggccacttggctctgggtggccaacgatgagaactgtggcatctgcaggatggcatttaacggatgctgccctgactgtgagtgtcccctccatgctgtctgagcggccccgactgtgagtgtcccctctgtgctgtctgctgcctgctggactagcctcagtagctcctgttaaatacctgcacgaaatacccagtttcattttctttttttttttttttttttgagaccgagtttcgatcttgtttcccaggctggagtgcaatggcgcgatctcggcttgccgcaacctctgcctcccgggttcaaacggttctcctgcctcagccttccaagcagctgggattacaggcatgtgccaccatgctgggctaatttttttatttttagtagagacggggttttgccttgttggctaggctggccttgaactcctgacctcaggtgacctgcccgcttcagccttccaaagtgctgggattacaggtgtgagccactttgcctggcccacatttttattttcttttctttctttcttttctttttttttttttttttttttgagatggagtttcactcttgttgcccaggctggagtgcaatggcgcgatctcggctcactgcaacctccgcctcctgggctcaagcgattctcctgcctcagccttccaagtacctgggatcacaggcatgtgccactacacccggctaattttgtatttttt

SEQ ID NO: 2529 - DNA, 1318 bp, Homo sapiens
tcccagactaccggggccctaatggagtgtggacactgcttcagaaagggagaagcgttaggtaagcgggccaggcatggcctcccacataggctgggcagcggcagcacgggcctgagctccagctctcctcaccttgccttcctttctgcctggcagtgctgccgacctgagcgaggccgagccaaccctcacccacatgagcatcacccgtctgcatgagcagaagctggtaagagccctgggtggctggtacacttgccagggaccaggcagagcaccttggtgcccagtgggcaactaactgcacccgccctctgtctgccagttgactcccatgatgagcacccaccaagcgggttaggccgcgggtttgatcctcctgtgcttgactctccaggacagaaggggagctccccctctgaaccatcccatccgcagccagcctcagcctcagagctgctggtggcctttcccctttgtgattcccttgcatttttctgtggacctcagaagccatcctagtcacaggggaggcttataggacatctctggggaccttctgctgaacaccctcaaccaatggggtgtagtggttgatctgcctaggtccccagggacctgaaatgtcatgacccaagagagcatggatctggggcagagtggcccttgccaaaccccgagccacttcccaaccttgccgggacggtgcaacctcttgccctcccagccactccaggtgcatcagggctggaggaaggacagcccctccccaccacaggccctcttgactcctggtggttggacctgttgtgtgttttactttctaaggctctctggggggacggagctgcccctggttttgggagccatcggcggggctcagaacagcctcgctgtggccgggtactgacctccccaccaccactggcagccatccctccccttgccacccgttctgccttccaggtgcagcatgtggtgtctcagaactgtgacgggctccacctgaggagtgggctgccgcgcacggccatctccgagctccacgggaacatgtacattgaagtgagcagtcctgcagggacccagggtctccatgggcaggcgggtcccactcactgtgccctcttgcctctaggtctgtacctcctgcgttcccaacagggagtacgtgcgggtgttcgatgtgacggagcgcactgccctccacagacaccagacaggccggacctgccacaagtgtgggacccagctgcgggacaccattgtgcactttggggagagggggacgttggggcagcctttgaactgggaa

SEQ ID NO: 2530 - DNA, 1099 bp, Homo sapiens
ctcaggtgaggtcaggagtttgcttcctcctcctctggccacttctgagtgaagcaacctcatgcctccctcttgcctcccggccacacacctgggagggcagaggccgggcgtctgcaccgtgttggatgtgggggctcccatctagcccggcgtcagggtccagcccctctgttttctgtccccctggctgtcctgggactgttcctgttgagtggacaagggagtggggagtgagggtgttgggtccattctaggactatgatggtgttggcaccccatcctccctctgggaactctgccaaactctgcactgtgacacctgagtccccatgaagcgctcgtgcccctcgacccgtgtgctccgggtgagcaggggctgaccccctctaggcctgctcttgtggggacccctcagtgtgagagacacagtggctgtcatgttcccccattctagaggcgtgggcctcagccccttccctccgtgaccagggcgggtcttgtctgcagagcgtggggcgtggagcatggggctcgcagcccagagtagtgcccgcccgtgctcgcccgtcgggaggcgctgttggggtggggtcttggctggcaggaggggtccaggggagggagcgtgtgcctggcctgcatggcgtgctgagggcctttgatctgggacttgggcagctgattgatggagggcgtcctgcctgccccgcgcctcccatcgccgccagccgcacacgcagagggcccggggccacatgccgctgctgggtccctttcagtgatggggggaggggagaagggaacaaaacagaacttttttggggaacttcaaaggtacactttagtaagcaaaaagagtttccaagtttcccattaatgttttgcctgtgtgtggtttttggacttaaataaagagtcagaaggaagagacaggataaaatacaggcaggtcctcggccgagacccggggtggttcacagacccgggcggttcctgcctttgatgtcaggcattaattattagaaggtagttttactggcgatcagaaccgggcgctgggagaggctggggctgcccggcgccccctggccctgtc

SEQ ID NO: 2531 - DNA, 1185 bp, Homo sapiens
gggagccacgtggcttgccctgtccgcagcgccgtggggaagacatgcttgctgatcagctacacgaccaacgccttccccggagagtacatccccaccgtgtgagtgtgggggcttcccgggagagcacaggccctccgtgtgagtgtggcatgggggggacacgggcagggtctcctctgggcttccacgtcggctcaggtggccctgtctctgggcttcccggctggagctgaggtgctggccagagttctagttctgtgcagacttgtgaaccccaagacacaggccagcagggctgggggtttctgggacccctcccaagccctgaccctgccctcactgctctgcagttttgacaactactctgccaacgtgatggtggacgggaaaccagtcaacttggggctgtgggacacagcgggtcaggaggactacgatcggctgcggccactctcctacccccaaactgtacgtaacaatggggccagccccgggagctgggggggtccctgagatccgcacaagggagggagcagggccctggggagcccctgaccactccaccaggtcccacctttttcccaaggacgtctttctgatctgcttctctctggtgagcccggcctccttcgagaatgttcgtgccaaggtagggcaaggctgggggcccctgtggggagagggcttgccccagtacctgccccgacaagttgtcctttagaggcaattgcgatacgggttctgcctggggtaggcacacggagtggggtctgaagatgaccatgggggctgatggggtgccgtggtggtggtcacagctctcagaatggagggttctgagggctctggctgctggggatgggccttgactaggaggccctgggaggtctccaggttccctggctgcgtgtttgttcctggtatctccccaccaaatccgcccctggtcaccccttgaaggaagaagagccaagtgtagctctggaacagtggggaaagtccctgagggccgtgacttgctcaggtggggctggggtagccgactccgggcctagggatcagagcgtctgtccctgcagtggtacccggaggtgcggcaccactgcccccacacgcccatcctcctggtgggcaccaagctggacctccgcgacgacaaggacaccattgagcggctgcggg

SEQ ID NO: 2532 - DNA, 1130 bp, Homo sapiens
gggcatagggttgggggcccaagctgatccacccaggtggtttgcatgtggtgtttcaggagcaggccaggaggccctcaccgtactgggcagagagggggtgtctgggccaggtggggagggtctggaggctacgggtcaatggcctgcagaagcccccggctctttttgctccaagaagcttctgttacctgggtgggatctcctaaggggcagcttaagaaagatgcctggggagtcccatgaagagtcaggggtgagaagccctgtcctgggcagctctgaccaccaccccatcttcaggtgaccacggtcaagttctggtttgctactggtggggccgggttctgcctcagcagaggccttgccctcaagatgagcccatgggccaggtgagtgggggtccagctgcccgggctgggaggcggaggctgagacctgaaaggtgctgaccggcctccccccagcctgggcagcttcatgagcacagctgagcaggtgcggctgccggatgactgcacagttggctacatcgtggaggggctcctgggcgcccgcctgctgcacagccccctcttccactctcacctggagaacctgcagaggctgccgcccgacaccctgctccagcaggtacaggcgccactctgggtgcctctgccacctgggctttgccccgccctgactcccccaggggccccactgccccggcccgatgcccggctgagcaggcaggtgggatttgcatgtggctgggggtggaccctggacaggccccttggcctgttggacacagggtcctcacgtacagatggggtatggtgtctggggcagaggaacgaggggagaagcacagttctcgggccagtgaggccccatgccagctgggcagtgggtgtggtgtgtatggtgatggtgagtcggaacaggtcccatcacgtggagcagggagggaatgagggtcagctttgccctggaggtttcagatccctatcttctgtcccccaggctctgcctgaggtgtccccctactcagctcatgccatgcttcaatgctgtttccaagcctggcctccccgagggcctggggagagggggtgggcaaaggggctctagcagggctcctggcc

SEQ ID NO: 2533 - DNA, 1141 bp, Homo sapiens
tcccggcggccgcatgagccgcgcgcgtggggcgctgtgccgggcctgcctcgcgctggccgcggccctggccgcgctgctgttactgccgctgccgctgccccgcgcgcccgccccggcccggacccccgccccggccccgcgcgcgcccccgtcccggcccgctgcccccagcctgcggcctgacgacgtcttcatcgccgtcaagaccacccggaagaaccacgggccgcgcctgcggctgctgctgcgcacctggatctcccgggcccgccagcaggtgcgccggaccccgaccccgacggcgagccccacgcccacccgccccgcctcccagggtctaggcccggcccaggcccccggaggctccgcgcggggcgggtcggtctccggcctgggcagcgccccagaagcctcatagattgtttctcccccagacgtttatcttcaccgacggggacgaccctgagctcgagctccagggcggtgagtgtcccccactccccggcgcccgcgggatctgccccccgagcctttctcgctccgaagccacggccccttcgctgctgtgggtgcctttctctgcccaggctcccgaggcccggggaggccccgacgctgcccaggtcacgcggcctgcggagggcccaccctgccagccaagctctgctccccaccagcctctcacactagccgcttcccggggcgtggggctagtgccacgtcccctgaagaagcgccagcagggaatccgcccttccaggccaggtcagggcgagctgcctccgtcctgtttccactcaagagatcccaaccgatggccgcctgcttcagcctcggtggcaccagcagggtcagcgcgtgagggctagggctgtggttggacccaggcaaggtgtccaggcatgtcagacagccacgttgtgccctggcccttgggggcaggtggggcacaggccttaccccaaccccagtgccatcctctacgtgcgtgcttcccgtctctgattcgcaggcgaccgtgtcatcaacaccaactgctcggcggtgcgcactcgtcaggccctctgctgcaagatgtccgtggagtatgacaagttcattgagtccgggcgcaagtacgcggcgctgacccgacccg

SEQ ID NO: 2534 - DNA, 1207 bp, Homo sapiens
gggctgggcagcaagggactagggcctggctgggcccgtggctgactcctgcatcttctccagttctgtgccaatgacccggaggtgtttgttcaggcggctctcctggctcaggattactgtgacgccattgacctgaacttgggctgcccacagatgatagccaagagaggtgagctccatgtggagcatgggggcacctggggcaggggccagagccagctcagtgcagccccaggtgtggtgagcttggaggacggcaggccctgcctctgtcgtgacagtggctcaggctggagccagctgtcctctgtgctccgcctctggagggtggctgtcctcaggccttgggggctaggggccgagccctactggctctctcttccctcagggagctccctctgcataaacatgattgctgatacagggtccccattacccccttgcactgctgtgtgtggggctgagcctgctacctcaccgggcccctgaggaggtgttacttggttccagaccgtgcagggtgggggttccattcagcaccttctgagcttaggcagctgggcaaatagagcccctgagtctgatgccgacaaaccactgctctgactgtcccactgccccaactggagacactgctggttctggggacctgtgtcccgcctgacagggcagctcctggcctgcgtggatgcaggaaagggtgcagagggggtgcaaggcttcggccccaccagccttaacacaggtgccagccaggccatgcttgctccttgcaggtcactatggcgcctttctgcaggacgagtgggacctgctccaaagaatgagtgagttggctgggtggatggtgaaggacccccagagaccctcaagagggacacatgggcactgtccacttggttggggctcaggagaggacaggcgttggcaggagttctcagcatcaccctggggcttcctgcccacagcagcctctctgctggaaggaggtggctgtgaagttgcctgtcctgcaccacccaccccttaaaaccagacagtaggtgccagggcagagtccttgctcgggcccagccccagatgtcctgggagacagagccggccttggccctgcttgtttgaacttcggagggccgggggtatggcggagggagcctgcccagcaacctgagggagacacccagatggtggcccgggctgcctc

SEQ ID NO: 2535 - DNA, 1145 bp, Homo sapiens
ctgccccccgaggctgctagatgtaggtgttaggcatgtcccacccacccgccgcctcccacggcacctcggggacaccagagctgccgacttggagactcctggtctgtgaagagccggtggtgcccgtgcccgcaggaactgggctgggcctcgtgcgcccgtggggtctgcgcttggtctttctgtgcttggatttgcatatttattgcattgctggtagagacccccaggcctgtccaccctgccaagactcctcaggcagcgtgtgggtcccgcactctgcccccatttccccgatgtcccctgcgggcgcgggcagccacccaagcctgctggctgcggccccctctcggccaggcattggctcagcccgctgagtggggggtcgtgggccagtccccgaggagctgggcccctgcacaggcacacagggcccggccacacccagcggccccccgcacagccacccgtggggtgctgcccttatgcccggcgccgggcaccaactccatgtttggtgtttgtctgtgtttgtttttcaagaaatgattcaaattgctgcttggattttgaaatttactgtaactgtcagtgtacacgtctggaccccgtttcatttttacaccaatttggtaaaaatgctgctctcagcctcccacaattaaaccgcatgtgatctccaccaccgtcctttcttccctcctccctgacctggcagctgcaagctctccagctccaccccacccagtcacggggccgtgaaggggatgccctctgtcctctggtccccagttcccacacacccctaggccatgtcccagagccggggctgggccggggagtgaggaaggagcccgcgtggcagccccgggcttcccgggaaagcgctgggactggcgggggggggggtaccgaggctctggccaagaaacaccaccagtgagaaacgtgtaggaggtacagacactgggaagttggcttcagctgaggagaggcccctcgtggagaatagtatttgcttgaagtcagtggattgcaggcattcgccctgccaaagatgccgtcacagcctcaccaagacggtgtcaatagcgccactggctggccaggttgacccagaagacttgggtttaggcaaagga

SEQ ID NO: 2536 - DNA, 1195 bp, Homo sapiens
actccccaccccgacctccccgcagctctgcccacctgccccctcccccacaggcctggccgtgcagtggggcgccatcggcgacgtgggcattttggtggagacgatgagcaccaacgacacgatcgtcagtggcacgctgccccagcgcatggcgtcctgcctggaggtgctggacctcttcctgaaccagccccacatggtcctgagcagctttgtgctggctgagaaggctgcggcctatagggacagggacagccagcgggacctggtggaggccgtggcacacatcctgggtgagcactcccagtaggagccgcgccaggtgtttcccctgctggcatcagggtcttgggacatagcagtcgtgcccctgtgcgcctcagtttccccatctgcagagccagggtgcgggcgcaggtgtcactgtggtggtggtgctttgggagatgcacagcccacgcacccctgggtgtcagccctgccgcatacaggccgtccccatgccccctctggagttgccgacccggcgcatcccttccaggcatccgcgacttggctgctgtcaacctggacagctcactggcggacctgggcctggactcgctcatgagcgtggaggtgcgccagacgctggagcgtgagctcaacctggtgctgtccgtgcgcgaggtgcggcaactcacgctccggaaactgcaggagctgtcctcaaaggcggatgaggccagcggtgcgtgtgggtggccaggcgggagtggggtccccgggcctccccagcccttcctccttgttgtctggaccgtgtcccggcaggcataccgcccttcgtcacgggtgccattctgagcgttcccaccccgactcccacctgacgtagcaccgtggggacctgcgtgcgtgtctgtgtgtccttgcgtgggtgccagggctctgcacccagaccagcctggcatctgcccctgtcttcacagagctggcatgccccacgcccaaggaggatggtctggcccagcagcagactcagctgaacctgcgctccctgctggtgaacccggagggccccaccctgatgcggctcaactccgtgcagagctcggagcggcccctgttcctggtgcacccaatcgagggctccaccaccgtgttccacagcctggcctcccggctcagcatccccacctatggcctgcag

SEQ ID NO: 2537 - DNA, 1099 bp, Homo sapiens
tgtgatgggactggtgcctgccaagggcctggccacctctgtcctgctgtcaccggacttcctctgggatgtgccttccaactggtgagtgtgtcgagggtgtgagcctgggccccacgtggatggcggccaggcctgtgctgacccacctgctgcatccccaggacgctggaggaggcggcctcggtgcctgtcgtctacagcacggcctactacgcgctggtggtgcgtgggcgggtgcgccccggggagacgctgctcatccactcgggctcgggcggcgtgggccaggccgccatcgccatcgccctcagtctgggctgccgcgtcttcaccaccgtgggtaaggccccgcccccggtgcctcccgctgccctcctggccccgccgccctggctcaccagccgcgcttcctctcttcaccagggtcggctgagaagcgggcgtacctccaggccaggttcccccagctcgacagcaccagcttcgccaactcccgggacacatccttcgagcagcatgtgctgtggcacacgggcgggaagggtgagtggcccccacagcccccacctgcctcctgcctagcctccggcccagggagaagcagggtctggccctctggactgtggtggctgggcttgcagtgggtgtgattgtctggcccctctggccccctaggcgttgacctggtcttgaactccttggcggaagagaagctgcaggccagcgtgaggtgcttggctacgcacggtcgcttcctggaaattggcaaattcgacctttctcagaaccacccgctcggtgaggccggcagcgcctgggcgggggtgggcatggatgggtgtgggtggacctgtggaaggccctgggtgagcacggcccctgcccgcaggcatggctatcttcctgaagaacgtgacattccacggggtcctactggatgcgttcttcaacgagagcagtgctgactggcgggaggtgtgggcgcttgtgcaggccggcatccgggatggggtggtacggcccctcaagtgcacggtgttccatggggcccaggtggaggacgccttccgctacatggcccaagggaagcacattg

SEQ ID NO: 2538 - DNA, 1185 bp, Homo sapiens
catccaccacgtacccccgcaggtgctgctgtccctggagcacgggctctgggcccccaacctgcacttccatagccccaaccctgagatcccagcgctgttggatgggcggctgcaggtggtggaccagcccctgcccgtccgtggcggcaacgtgggcatcaactcctttggcttcgggggctccaacgtgcacatcatcctgaggcccaacacgcagccgccccccgcacccgccccacatgccaccctgccccgtctgctgcgggccagcggacgcacccctgaggccgtgcagaagctgctggagcagggcctccggcacagccaggacctggctttcctgagcatgctgaacgacatcgcggctgtccccgccaccgccatgcccttccgtggctacgctgtgctgggtggtgagcgcggtggcccagaggtgcagcaggtgcccgctggcgagcgcccgctctggttcatctgctctggtgagcccacactctgcccccaaggtggtcccttccctggggaaaggcaggcgaactggagctggtggtcccctgaggtgctctctgggacggggatgggcacacagtggcacgggatggggctgagcctcgtgacgtgctctctgggacagggatgggcacacagtggcgcgggatggggctgagcctcatgcgcctggaccgcttccgagattccatcctacgctccgatgaggctgtgaagccattcggcctgaaggtgtcacagctgctgctgagcacagacgagagcacctttgatgacatcgtccattcgtttgtgagcctgactgccatccaggtagggcccagcctgccagcgtgtgagcaacgccagccccagggctctggctttccctggagcccaggagctgcagtgttgagtccggggcccctgacagcccctttgctaggcagagccttgtgctgggggcaggacgggaggggaggaggggtctcagtggggctgtgtgggggccataggggcttctttcctatcaggagacctgggagggtcgatggggcgcgggggtggagatggcctagtggggccgggggccgcccccaacagctgcacctgctggaggttgcaacctgagtgtcctgttcccaccccagataggcctcatagacctgctgagctgcatggggctgaggccag

SEQ ID NO: 2539 - DNA, 1477 bp, Homo sapiens
tttttagtagagatggggtttcaccatgtttgccaggatggtctcgatctcttgacctcgtgatccatccatctcagcttcccaaagtgctgggattacaggcatgagccaccacgcccagccatgccatttcttaagatccaggtgctccctccccgggcggagaaggacctcctgagggggaggctgagccctgggctgcccttgggtgtgagcggttcacacacccacccaccctagggcagagccagcccaccaggggcgaggaggggccctgctggccgagaggtggaagcccttctcctgcgcccttcctgctgccagaccccaccccaagactaaggttatgctccccgggggtgaccggtgtccctctctccttcccgagcctggacacttggcctttgtctcctcggttccttatcacggcctgttctggtgcaggctgcccttggcgctggagaggccactggccgacgggctcatcagagctgccggtgacaccaggggccaaaggcgtcgcctggggacaatgctgccctctgtccttcctggagccactctggccgtgcctggtgccctcccctgggcccgcctgccccctccgcctcgttccctctgtgacctggttcctgttccaggcctcacctgggctggctgctggccacaggctctgttctggcccctctgcaggacacctcaccctccttaggccccttccagggtcccactgggatggaccccccctcaccccaagccagtgaggccaagatgggaccttcgccccagagccgggtgggtgggtgggctggctgcgctgtggggcccggccgtggcaccttgaccactgtttgtggcaggcatcaacccagattcactccgaggaacacacactggcgtctgggtgggcgtgagcggctctgagacctcggaggccctgagccgagaccccgagacactcgtgggctacagcatggtgggctgccagcgagcgatgatggccaaccggctctccttcttcttcgacttcagaggtgggtcctgcccagcctcctgcggaggtgggtggccttcaggtccccacatgctgagcagaaaccacgtggcgtgggctcactccgtgcagtgtgtgtccagcctggtggcaggaggtgtgctcaggggtctcgtgtgctcacagccccacctgagccgcagcacccttccttgcagggcccagcatcgcactggacacagcctgctcctccagcctgatggccctgcagaacgcctaccaggccatccacagcgggcagtgccctgccgccatcgtggggggcatcaatgtcctgctgaagcccaacacctccgtgcagttcttgaggctggggatgctcagccccgagggcacctgcaaggccttcgacacagcgggtgagtgtgcggctgcgcggccagggcaggcgggacagtggcacaggacggccccccgcacagt

SEQ ID NO: 2540 - DNA, 1038 bp, Homo sapiens
gggtccgagcgccccgccgcagccggctggacccccggtgtggccacggggtagtccccagtgtggcccaagcattcccatcccgcacacgtggccccggcggacacgggggtcggggatggctcgggaggcgcgccgcgggctcggtcgcagccgcgtgcgcgtcggggcccgcggggcgggaggcggaagtcggggggcggtggtttcccgcccgccccgcccccggcgctcctcagtcccagccccacccccccaggcgcgttcccgcgcagggtcccggctcgggcggcggcgcgcacgagcatcaccccaccggcggcggcgcgccgggtcccggggcgcagccccgacgctcattggcctgggcggcgcagccaagctgtcagcccatgtggcgtggccgcccggggatggccgcggtttaaatagcgtcggcgccggcctagagggagccagagagacggcagcggccccggcctccctctccgccgcgcttcagcctcccgctccgccgcgctccagcctcgctctccgccgcccgcaccgccgcccgcgccctcaccaggtacgagcagccggcgctggggccggggcgcgggtcgtggtcggggctgggcccggggttcccggggtggcccggctcctcatcctccgctctcggggcgcgcgtggcccggccccgtatccaggggtcgcctgggcggcctgtccgggtctcggtgttcgtgccccttcggaggcgcccggggccccgcggagtaggtgggcggatggcgggggaaggacgccggggaaagccaccaacagccgccttcgcttcccgtgggggaggccgcggaccctgaagggcctggaggagcccccggctcggcctccccgcgcccacaaaggcgccgccgcatcctcctcccggagccgccccggagccgaggcccagcccgaaggggacgccgcgagggaggaacgggggggcgcaggggccgcgccgggaccggcctccccatcacgtggcgcagcccggccgaagcgcagggg

SEQ ID NO: 2541 - DNA, 1148 bp, Homo sapiens
gagactaacctgggcagaatagtgacaccctgtctctactaaaaaacaaaaaacttggctgggtgtggtcccagctacttgggaggctgaggtgggaggatcgcttgagcccaggaggtggaggctgcagtgagccgcgattgcaccactgcactccagcctgggtgacagagcaagactctgtctcaaaaaaactagttttctttttttttttttttttttggtactatacatataaaatgtactgttgaaagctcatgaagtatacaaagtatacagttcagtgcattaagcacgtcaagaatgttgtgcgagcatcatcatttgttccagaattcctttcacttcagaggaaaccccacactcattcgcagttgcttcctgtcccccgcccagcacccacattctgcctccatgcctttgcctgttctggacgtttcacttcagcaggatcccacaggatgtgtccctttgtgcctggcttctttccctctgtgtcctgtttgagggtccctcgtgctggggcgtctgcacttaattcctttccatgggaagagctctttgctgggggacaggccactgtaggcatttgtccatcagtttgatggacatttggatggtttccgcctttgggctattgtgaataatattgctgtgaacattcagttctcttggatgcctccctagaagtggccttgctgggtcatgtgggaattctgtgtctaacctggtaaggagccaccaaaccgcctcccatgcccaccagctgcgcacgaaggttctgatttctccacatctgcaccagcacttgctattttctgtcggggttttttttaattaagaatacttttattgcatatctttaaaaactttattttttttatatttaaaaaaatttcttttaaaaatagaggtgggatctcactgtgttgcccacgccagtatccaacacctgacatcaaggatcccccccacccggcctcccagtgtgctggggttacaggtgtgagccaccgcacccagctgttttctatcctgttgatcccagccaacctagtgggtgtgaggcgggatcccatagtgggcttgattttacattctcctggtgaccaatggtgttgagtgtcttcaggaggtttttgcccaca

SEQ ID NO: 2542 - DNA, 1162 bp, Homo sapiens
accctggaccctgcacaggagagatggcgtcagggcgttatctggacggttggtgacatttgcacacgggccacggaccaggtcacgtattgtgtacacccacccaagtactgaggtgtgacgcggcactgcgtctccagcctacctcctgtagtgcaggaagccagtgcagggtgggtgaggaagtgcacaggggtccagggactgtcccacagcactcctgacgaaagctggtccccttccacggccctagccaaggagccaggtctgcaaagctgggaccaggtgtgtgcggaggcacgtgttcccacttctcccatggcagagggagagcctgtggacaacagtggggcactctgctcccaggcaggtcccactgggctgagccgcacagcctggctttgggcttccctgactgcaccacccacatcagctgcctctagcccttaaaatacaaaacttcccccagtcactggccgccagggctgagttgggggatgtgttacatccctgggtccactggggggcagtgttggccatggtgttggtgctggctctgccgagaggcgttggagtggctgtgtggggcggtgagcgccggcccagcctgatggaacccactgtaccaggcccaggcctcagcctctgagaaggacttccctgtgtcactcactcatacatgtcctcaggacgtgaagacatttcagcagaccaaagtttccttcgaattttcttcgaatcgtccagatacttggagacatctcctcctcacctgtggggtgctggggcagtcctaggcgtgggggcagatgggtggacagctgctgctgccctgctgggggtgggcagcccttggagcacacagtggtgaagacattcctgaatatgtctcaggctgtagaaatcttattttgtggaaagattttagagaatcatcaaaataaacttttaccaaataacattttaccagaaactgaatccgagagaagtagaatcgttcactccctgccccccaggtcactgtgtgcagaatcacgtgactaggacatgggccctgtgatccatgccctccttcctttgcctgtggggtcaacagcaagaaggcccctcagtgcccctcaagcctggcaccagccgcagggcctggtgtaactttgcaggg

SEQ ID NO: 2543 - DNA, 1062 bp, Homo sapiens
cccatagttgtagggccccgccccagcccggactccgcctgggtctgttccctcttcgccccctctcttttcgggctgttggtgttcggccagggctctttggctacagtagcctgggccctaaaggccatctagttgctgagtctgtttggggtttttacttggtgagaagaaggccttgtcattccaacagtcgatgactcgctttgatcaactcctgcccaggactaggcctgagccctgtcgtcgtaccggcgaggatgtgcgtctcccctgccttcaggctgtgccctgagacccagttgtggggctgcccagcacctgccatcctgctgggatcaggttttcttagtgcttgagaagactcaggagggcctgtcccatgccattgttggccttaagagcaagtgattccagaagaggagtgggcaccactctcatccagaggcccgtcctgagaggcaagtgaggctgtgctctgtgcctgggctcccccaggtggcacctgtcggtctgtggacctggttgaggcaaggatgcccatctggacatggagccgacacaggtagtcagggggccagcgggacgcttaccaacagctgtcttttccccacctcagaatagcattcctttcgaacaccacggcaagtagctgctcgtctcccatcggaaggcagcactgggtgagtgtgcgcgtggcgggcgccaggcagcagcgccaggtgggtgggagccaccatgccccacccatgggagcttgcaggtgggctgggcttgcatgccaggtgctggaggtagagtgaggcttcttctgctctgttcttcttgtggggtgcagagcggcggcagtccgctgcccagtcttggggggaggctgtccacagagagctttggaacagagtgaccccaggagaccatcctgttggcctgtggcctccccgtgactgcgttccgtgtgccgttgctctcctcctgtcctgggtgcccacccgtgaggcaggagtggcaaggcgggtgccccgagcacttgagttgccttgtctgcggtcggccgtgcctgga

SEQ ID NO: 2544 - DNA, 1102 bp, Homo sapiens
ttagtgtggagctgaggcagggcctggactgaaacactgtgtctgatttccttgcctagtgggcatccccaccatcagatggtgcggggcagagggggactacaacgtcatggtgatggagctgctggggccaagcctggaggacctcttcaacttctgctccaggaaattcagcctcaaaaccgtcctgctgcttgctgaccaaatggtaaggactgtttcctgacagttggcacacacttgctgtctgatagaatcagccactcgcttgtgctgttcttgccattattatggccattaattcacagaggaaatggaaatttgctgagcctcagccttgaggctgcagtggctcagctcactggcttctcgaggctccggtggctccgctcactggcttctcgaggctccggcggcccagctcactggcttctcgaggctccggcggcccagctcactggcttctcgaggctccggcggcccagctcactggcttctggaggctccgacggctcagctcactggcttctcgaggctccggcggcccagctcactggcttctcgaggctccggcggctcagctcactggcttctcgaggctccgacggctcagctcactggcttctcgaggctccggcggctcagctgactggcttctggaggctccggcggctcagctcactggcttgtcgaggctccgatggctcagctcactggcttctggaggccccggcggctcagctgactggcttctcgaggcccccggcggctcagcacactggcttctcgaggccccggcggctcagctgactggcttctcgaggccccggcggctcagctgactggcttctcgaggctccggtggctcaccgcactggcttctcgaggctccggcggctcagctcactggcttctcgaggctccggcggctcagctcactggcgtctcgaggctccggcggctcagctgactggcttctggaggctccggcggctcagctcactggcttctcgaggctccggcggctcagctcactggcttctcgaggctccggcggctcagctcactggcgtctcgaggctccggcggctcagctgactgg

SEQ ID NO: 2545 - DNA, 1137 bp, Homo sapiens
gcgtgaacccgggaggcagagcttgcagtgagcccagatagcgccactgcagtccagcctggatgaaagagcgagactccgtctcaaaaaaaaaaaaaaaaaagattttgtgtgaatttcaatgcatgctccccgtggtgtcgtgtgcccctcagtggtcactggagctgttgccagtggcacgtgtgttgctcagtggggccttcctgatgtgtgatccctgagtgaggcctctgctccttcgcatgctttgcttatagcttgggggaagtcccttcatactctctgggctcgttttctccgagcaaaacaagggttttgaacttggcgaccatcatgacctcttccagctcagttactgtcccagttctgcgagccctcagcccagggccttaggtacctggtgttccacggtgggccaggtgtggagcagagcgctcctgtcctcccctcagagtccagctcttgcgagttccctggactttcaaacagttgggctgatggagcaggagggtattctctgcggggatttcagagccatgaagcgtgtgtctcaacagcagagcttcggtctggcaggagccctctttgggaacagagctttttgtctgaagagtggctgtgccacgtctgtggagccctcccagtgagaaggctccgcggcacatttgtaggtggatggttgggtgagtccccttgggcaactggccaaaggaaaacctgttcagggcctctgttagcccttttgtcacgggaaagggaggactgttgatttgattctttgacatcttttctcagcacaagcacgtaatctgtgctactacaagaaaccgacgtttctaagtttatgtgacacaaaatatctttggcagcacctgtggtcctggggaacccgttacagagaggggcacccagtgtgtcccatcacgggcctcacgtgaccagaggaggccacaggaatgaaaaatcccatcaccaacccagggaaagctcagcagagactccgccctgggagcctgtctggcggcccttggtggtggactggcttctcaagggcctggagcctgcattgccttgaaggtgtgacgagccaatagagcagggtggtgcggggtgtggccttggcctgcgggagcc

SEQ ID NO: 2546 - DNA, 1192 bp, Homo sapiens
ctctccaccctgcctcccggggcccgttctgccacagagtgaggtgtcctttcctctttggaagcccatagcagccttgggctgaagggctcaaaccccaggctgctacttcccttgagaattgctcacccaggcgggagggctgctccttccacacagcacagcctgtaaacgtcactctctgtcatcgtttataagcatgatgactgggttttcacgcttccccataggatgggccttccttaaatcttgttatgttgtcagcacattacttgtgtgacgcaaaagaaaaaaaattcactcttgcagtctgccaggcccaacatgtaggtttctgctttttagggcactaaaacgaggacacatttttatttctcagcaaataaatatatgaattctacgtatttttttatgtttcatagaattcaattcgccacaatctctctctgaatcgttatttcatcaaagtgccgcgttcccaggaagaaccaggcaaaggctcgttctggaggatagacccagcctctgaaagcaaattaatagaacaggcttttaggaaacgacggcctaggggcgtgccctgctttagaacccctctgggaccgctctcttctaggtaaggaaaaagaagaacaaaaggcctcacttcgtgcttactaaacttaccttcagtgtattgggaaaatttccttttgaaaatgaaggaactactaaatgcattatgattaaatgttgggatggggatttgagcaaaagtgttgggtgctgcccaggtgtttctggttctagtggctgaaacatttgagacgatttgcaaagtttaaactgcactcgacgcagtgattgttgcttcatggggctcatcgcatgttgttcataccagtgccacgtcgacgtttttcctttcccttggcacaggaaaagttctttaaaactactttttaggccgggcgctgtggctcacgcctgtaatcccagcattttgggaggccgaggcgggcggatcacctgaggtcaggaggtcgagatcagcctggccaatatggtcaaaccccgtctctactaaaaatacaaaaaaattagccgggcgcggtggcgcgcgcctgtaatcccagctactcgggagcctgaggcaggagaatcgcttgaacccggaaaggcagagattgcagtgagccgagattgcgccact

SEQ ID NO: 2547 - DNA, 1236 bp, Homo sapiens
gaggccgaggcgggcggatcacgaggtcaggagattgagaccatcctggctaacacggtgaaaccctgtctccaccaaaaatacaaaaaattagctggacatggtggcgggcgcctgtagtcccagctattcgggaggctgaggcaggagaatggcatgaacccgggaggtggagcttgcagtgagctgagatcgcgccactgcactcccgcctgggcgacagagcgagactgtctcaaaaaaaaaaaaaaaaaaaatgctccagacacttcagtttgaaaatattggaatttatgtggggaggattagtgtgcatggaaggccaaaaatgtgaatgcatctccgcagtcatctttccaaaagccgccctctgaatcagtgaggaccctcagggtggggaacgtccccttgtgagtgtctgcagattggagtaggcagcagcggagcccgtctctgtagatggactcgcagaggaacttagttctttccctaaaggagtaggaacagctgggcgccgtggctcacgcctgcaatcccagcactttggaagaccagggtgggcagactgcttgtgcccaggagttcaagaccagcctggacaacatggtgaatctctgtgtctacaaaaaatcacaaaagtggctgtggcggcagcacctgtagtcccagccaccaagaggctaaggcagggagatcgtttgagccagggaggttgaggctgcagtgaaccgtgatcgccccactgcactccatcctgggagacagggtgagaccctctccacatagtaagtaaatggaggaatagaaacgcaagccggcatacattgtctttgacagcattttgtggataggcaagttctaaccatgggggcaacgtgggatgcagcagggtttggtgtgccgtggggcaggggtaatttgcttgtttctctaagactttgtacagctctgtaaacagattcccattaggtcgtcctttccttgtgacaggtaatagtggaggtgtcacaaggtaagtggcctgtcttgcctggttttcaggttctacggcttttgtcttgttttttgagaaagggtctgtcactcagactggagtgcagtggcgtgatcacagctcagtgcagccttgaactcgtgggctcaagtgattctcctgcctcagcctcctgagtagccaggactacaggcacgtacaaacatgtccagctaatattttttttcttttgtagagatggg

SEQ ID NO: 2548 - DNA, 1278 bp, Homo sapiens
cttaaagacagaagtcacacttgaacaaaacccacacacaacaaaacctgatttgggagacggtgtctccactgagcacctgctgggctgagcttctacctacgagtgaaactctgtcctcccgcgaggaccaggcatcgctgtgtgaggacggcacggccagcgcctgctgtgagtgggtctcccaagactaggcctcaggacgcggggggagccatccccgccgccctcacaggacccaccaggcagcggagacatgtggaattagagtattttgaggtgtcctttctttacaaaataatggggtcttgggcatttcacatcactccatttctactgagactttcagaatcacacaggccctttccgtggatttcatttggggcaaagaaacaacgtagttttgtttttgttttcagcctatggaatgatttccttttgtctgtcttgttcaagttcagacgaagctactctggcatctgcacatttccgtgttacagcagctgcctgatgaattttatccacctccatttcagcatgtggctcgcgtggacaggtggacggacgctgtggccgcatggaaccttgagaacccagggacgagccagtgccgggaaggaactgccgggactcaccgagctgcacttaactgttctctttctggctattttttgttgtttgtttctttgtgttgactttgtccctggcaaaattttccactctgagtaaaacaagtctcctaagtattgtgtatgtttaaaacgacagaaccatttctacttcatttggaaaaagattcagtcttttatcacaggcccttttgaaactcagatcccaggtctctccgtggtatgtttgtatttggggtgtccctccggctctaggcggcctctgacctgctgtctactccccaccttcggtgagcggccgccatggtggagcagggtccgagccacgtcctgcagggcacgtctggggcatttcctgttttgtggtaggaaatgtccctgacctttcagaaccgaacccaatcctgaggctgactcctctacggaaaatgaggacaggacgggggtgagggaatgagagtgggaggtccctgcacctcctcgcccggctcctcaggaagaaaaccgctggcccttcccgagtgtgccggccgagggccgagggccgtgcacatggggagagggcgtcagcctgatggctgagcttttaaatgtcatcatcataacattatttatttaaatgtagttattttggtatttaatttttttt

SEQ ID NO: 2549 - DNA, 1219 bp, Homo sapiens
gttcaaccccaagggggagtgcatccgagatgtctacgcgcagtttctagagatgaccgatgacaagctgtgactccagctgggggcgccacagcacccaccacctgccgccttcagactctcggggctggtgccagtgccccaggggcctcctgggccacgggctggaggggctgcccagggaccttggtctcgaagccatacgtggttgtctgctttcctaaggactcccatttccagtattaaagagagaatcatcatcaaggcaccgtaggtaactcagtggctgtgaccagctcgactggcggccactggctgttcccatgagttcagctgtgacgttagcttcagtggctccgccgcatcctcacactgacgggggctccatacggacctggggactgggctgagagggtggacgagttcaggtttgtttttgcagcagattccgtcgttcttactgagtctgcagcgggggagtgaacaagtgtgcagatgtaagttcttacatgataagcagattgaatacaacaccagcagcttgccttagaaaaggagaaaggaattccttttcccgcccgaacatgaagaaaaatgacctgaccctgtagagagaacacagtgtgaatgtttcccctcgtgtgagcccagcctgtggtcttctccgtacccgcaacgtggtcatctgtgcccgtgacgtcacctgtgcccgtgcgtggcgtccccgtctccgttggggccattagaatgaggcagacaccaggccactctagaagccgagccgtcacacctcaggcgtgtgcggggcggggacggggggtctcctggttacattttggattaaacctgtttcccggttatgtgtagggaacagcagagtgatgcacgaactttgaacattcgttatggggaaaacatcctttaacttcggggtcgtctgccagagcagggtctgggagggtccatgcagttcccgctggtgtggagggaaatgccctggtctggcctccgagcccccaggtccaccgtctcccctcccctcatttgtaagaatagctacacactaacattttgggaaggagaggcacataactttttttaacatttggtaactaggttatgggctctacattgtcagctacttgggatatatatttaattttcttaaattcccgttaaactctattttatggttttgatttcagattgcaaacatgta

SEQ ID NO: 2550 - DNA, 1099 bp, Homo sapiens
taaaaatacaaaaattagctgggcgtggtggcgggcgcctgtaatcccagctactcgggaggctgaggcagaagaatcgcttgaacccaggaggcagaggttgcagtgagtcgagatcgcgccactgcactccagcctgctgggtgactgaatgagactccgtctcaaaaaaaaaagagtgttcctagcagcggtgacatggcagctgtggtggggctctgaggctgaggaggtggggactctgaagaactgaaagaaggatgaagacagctggaagtcaggagcacgaggagagtgtgtgtgtctatgtgtatgttgtgtgtgtgtacgttgtatgtgtgtatgtttgtaatgtttgtatgttgtgtgtatgtattgtgtgtctgtgtgtgtgtaagggtggagccccaggtgaggatgggagagtgggcagggcagtggtgtgtgtctcaggagaaaaagaaaggccgctggccctgacctgttctgcggggatcactgctgtgtatgttgtgtgtgtgtgtctgtgtgttgtgtgtgtatggtgtgtctgtaagtcgtatgttgtgtgtgttgtgtgtctgtatgtgttgtgtgtgtgttgtgtgtctgtatatgttgtgtgtgtgtgttatgtgtctgtgtgtgtaagggtggagccccagatgaggatgggagagcaggcagggcagtggtgtgtgtagcaggaggaaaggaaaggccgctggctctgacttctactctagggatcactgctgtgtggtgagccagggggacccaagggaggagttgctgtggtcccggggagttggatggaaacggcatctcaagatgaggtggtttccagtgctgggcaggaggtggcatggaacttggtggtctcttcaggtgaaaagtgaccccaggtcactggcataggcagccagggtgccgcctgcacctgagaggtcgggtgagtctgtgtcctgtaggtggaacaggactgcagttgaggtgtcgtctgaggacactgacaggtaacccatgttcacagtcccactgttgccggatcttagtggaatattagtgccttcgattttcctctctccagagaacctcc

SEQ ID NO: 2551 - DNA, 1169 bp, Homo sapiens
catataaatgaacatatttaatgactgattccgtaaatatggtaatgaataacactaccaatttaggaaggaaatctttttttttgagagatggggtcttgctctgtcactcaggctagagtgcagtgatgcagtcagctcactgcagcctcgaactcttggtctcaaatgattctccctcctgcctcatcctctcagactacaggcatgtgccaccatcctgtctaatttttaattttttatgttgcccaggctagtctccaactcttggtctcaagctattcttttgcctcggcctcccaaagtgctgggattacgggtgtgagccatcgctcttggccatgggtagctttcttggggtgactacggtcttactaaattgtgtcactgtaatgtcacagaattctctttgatcagtgggtcgcgtagctggtgatttttgatgaaagggtagaaaggcaattttgctgctctctgtatttttaaatgttataattcagcatctctttatttgataggttcgaggctataaaacatttcttcgtttatttcctcatgaagttgccgatgtagagcctgttttagatttggtcacaattcagaatcccaaggaccatgaagtgagtgtctctgcctcccccctcgtctccagccctccgtgcctgtccttcctccctgcttgccccaccctgctgcaccttccccttcctgtttctttcattttatctccctttgttttgtgtcactcctcttttctttcttttcttttcacttttcctttacttcttgtacaagttgctttaaattattttcgtttaaaatagcccctttataaaaaaaattatgcctaggtgtagtttaacaataaatccgtcattgtttctatgtttttttaactgtgtaagtataactgtgttgggttcccaagaccacccccaggtttgatacttcctgagcgggactcacagcactcagcatagagtcctccttttggctgtcacttgttatggcaaaataatacacagcaaaatcagcaaagggaaaaggcacatgggtggggtctggggagaaccaggcgggagctcccggggtcctccagttgggtcccacagggcctgtgtcattcccccagcagtgagatgtgaccacacctgtgaggtgtctatcag

SEQ ID NO: 2552 - DNA, 1197 bp, Homo sapiens
aatggcgtgaacccggaaggtggagcttgcagtgagcgaggttgcgccactgcactccagcctgggcaacagagcgagactccatctcaaaaaaaaaaaaaggaactcctgacctcaggtgatccgctcgtctcggcctcccaaagtgttgggattacaggtgtgaaccaccacacctggccttttttctttattcttaggtgtttttactttttatctgtttttcactttttcaaaaggccagtttgtatgtggagaggtgccagcgaagagaagctgctatactgatgtattatgatttttctttgttcattttgatgtctctcttgtctgctgagctaagttacggcggtaggtgtgtgtggtggggattccgggggggatgtggcgaggagttggtgaacggcttgcatttctggccctgagggtgatggcatttgaatggctttcataggcattgggtgggcatggagggcagtgactttgagtagattgtggccagtggcctgtgattttcaagcaagactcattcttcccgtggtttaattttttaggcttgggaaacccgctacatgcttttgctctggctctccgtgacctgcctgatcccttttgatttttctcgccttgacgggaacctcctcacccagcctgggcaagcacgaatgtccataatggaccgtattctccaaatagcagaggtaaatatcatgcagataattagctgctaattagtactcactttcatgttcatgctgtcttgatgttagtggtttactcggtaagcttctgatatgtattcaactgctgtttttttcagtggggtaaaatcccataggataacttattttgaaattgtgataattcatgtaggggtcaggttgagttagcaaatctcatttctttgtagatgatgcaaatactctgttgagggtaatcatggcagataaggaagggtttagtggcatggtgagagagaataaggacccattttacatttagttcttaacgttatataaataatagatgctcatttgtaggagaactagaaaataaagataagcaagaaaaatactaaatttaaatttatgaaattctagtgccaagagataagttgtttattttctccgaacttttcctgatgtaaatattatgcatataaacacagcttattgtattagttatctattggatcat

SEQ ID NO: 2553 - DNA, 1177 bp, Homo sapiens
ggatctgaggtttggaaactccctttatgatgctcctgtgcagatgagaaaacagcaccccaggacctctgctcgcacacattgacctggtcatgttgtgtgggtgccagtgtgtgtgtgtgtccccggccacctgccctcccctcccgtcctgggggttacaggtggactttggactcacagagctgtaacgctgatctcattgcatagataagaaaccatgggcccggcgcagtggcgggtggatcacttgaggtcaggagttcgaggccagcctggccaacatggtgaaaccccatctctactaaaaatacaaaaattagcggggcgaggtggcgcgtgcctgtaatcccagctactcaagaggctgaggcaggagaattgcttgaacttgggaggcgaaggttgcagtgaaccgagatcacgccattgcactccagcctgggtgacaagagcaagaccctgcctcaaaaacaaaaacaaaaacaaaaacaaaaaaaaccatggttaccaacgttgactaggttttgatattgaggatgaagaatggaagtacatttaggtgtcttgtaattctctgacttcctccatgcttagcatttctttttccttagcatcttcaattttcttattttttttttcttaaggaacttgaacattctgtaggatccaagtaccgttctactaattgaatttgaatgcatcatgatcagtgcctcaaaattttatttcaaaagtccatgattaattcacactggccatgatgctggtgcactttgcccctgggattggcacaggtggtgactcgtggaatgcagcaccctgtagacgacgcacctcctctgctcatggcccccacctgccccgcccccagtgcctctccaaggctgctctgttggcctcggctcctgggcttcgggggagcggtggaaagaacacgtgggtttggtgtttgccacttgctggctgtgtggtcacgagaggctcctccgtaggtggcagaggtgggggttcgaggagacagtggcactgagccccgcacgcggcgggactggtgactctctgcccgctcctgctctgtgcagcaattgccgtccctcccaccacggttcctggtggccttgggatgggttcccgggggtctcctgctgtccggccccaactcctgttcccagtg

SEQ ID NO: 2554 - DNA, 1204 bp, Homo sapiens
tacctgggaggctgagataggaggattgcttgaggaggtcaaggctacagtgagtgatgatcacagcactggagaagggacacgtcagccacgtcatgaagccccttgagccccgtccctgtggagaagggacacgtcggccccgtggtgaagtctcttgaggccctgaccctgtggagaagggacacggattcatctgtcactttctcgtgacactttgtggaaataaactgcaggttgtttgtgacaagctgttcttttccgctaactctgtcaacgttaattgcttctaggttttcacctcaaatggccccacggtgatcatgcccacctggttctgctcgcgagcgtggttctcccacgtgggcccctttaacgagggaggtcaggtaagggccgaaggcgggaatcaggtccctcccccaggttcggggccctgtctctgtgtgtgggctctgcacactggccaccctccgccttgccatgcctccggggctctgcagatttaggaaacccctgcctgagggtcctcccggtgccccctcctggcacctgccagcatcttagttgttttgctgaaagcagggggtttctgcatgaaggctgtgggtgccctgggcatctgcacctgacctacactggctccaggttactgcatcctggtttaaaagctgtgtctgggaaagcgcaggacacggaagcttttggcagagctgtctctgggacaacagagggagaaggggagcccatcctccccccgggggtgcacctgcaggcgtctgtgtccccgtcccccccatgggggtgcacctgcaggcgtccatgtccccgtcccccccgtgggagtgcacctgcaggcgtctgtgtccccatcccccccgtgggagtgcacctgcaggtgtctgtgtccccgtcctccccatgggggtgcacctgcaggcatccgtgtccccgtcctccccatgggggtgcacctgcaggcgtccatgtccccgtcctccctgtgggtgtgcacctgcaggtgtccatgtccccgtcctccctgtgggagtgcacgttcaggcatccatgtccccgttctcctgtgggggtgcacctgcaggcgtccgtgtccccgtcctcccgtgggggtgcacctgcaggcgtccgtgtcaccgtcccccccgtgggggtgcacctgcaggcgtccgtgtccccgtcctcc

SEQ ID NO: 2555 - DNA, 1119 bp, Homo sapiens
cctgcttcaggatatcagagttatttagatgagctgacattcactctatgcttagaaagatggagttgaaatttaccatgtggtaaagaggaggaagagtatgcagaaaacaacattgtgaacaaaaccatggaaggatgaacatggcatggtgtttgggaactggggagtgggaactagaaagggatgtctgtggcccaggtaagggtaaggagagagattggtgtggaagctgggacacaggttgtgaaagctcttgggggaatcacactataacccaatggttcccagacttgctggctcatcagaaccaccagtgaatctatttttagatgagattcccaaaccttgcttagttctactgactcagaattttggcagtagaatctagaaaaagttctataattattaaatgtgagttaacttattccaggctatactgcaactaagggcagaaaatatgcttctcaaatctcttggatgtgcagggtatataatatcattgaatctaagtattgttagggactttagaggtcacctagtccagtctcatctctggcctagactgcttctctgctgtaacatccctggtgggtggtcattcagcctctgctgaatcatgctcattagtggagctcactgtttgagtcctgttagacaaatgtggttattggtgtgttcccttgtattgagttgaaatctgctgttttatttcacccactgcttctaggcaatatccctcacgtcgcattccagatatgatcttactagtgcagagtacagctggaaatatttcttccttttttctggacatagtatattaatgcactgttttgggcttagatcaccctagatatttttcctccatataccatgcctaagtgactacttttcttaaacacttatgagtgttagtaagtactcattgccttaaaatagaaggaagaatgagtagggatataaaagtattctaagtagtctagatagactacgtagaccttttcttaagaaaaatcttaattttgttgttctttaaacagtaactttctacttttccattctttcccctgaaacaatactgttattttaaatgttgaatcatagttaatatcaaacctt

SEQ ID NO: 2556 - DNA, 1213 bp, Homo sapiens
tcttttgtatgctttgtttggccatttgggatttgagtagggaccaggctttcccagaataggcttttcaaaatgaaacttggcttttcaaaatgaaacttatcttttcatccaaataagatcttctagacatttctttgaaaatataagcattgttgaatgatgtattttagacactgtcctataaaaatacacgttccctttttttgaattgcacattaactttattatttaagaaaaactaatgcccattcttatttctctcttttagtactgtcatctgcattataacggactgtgatgggatcacatgagcaaattttcagctctcaaaggcaaaggacactcctttctaattgcatcaccttctcatcagattgaaaaaaaaaaagcactgaaaaccaattactgaaaaaaaattgacagctagtgttttttaccatccgtcattacccaaagacttgggaactaaaatgttccccagggtgatatgctgattttcattgtgcacatggactgaatcacatagattctcctccgtcagtaaccgtgcgattatacaaattatgtcttccaaagtatggaacactccaatcagaaaaaggttatcattggtcgttgagttatgggaagaacttaagcatatactgtgtaaacagtgccatacatttctaaaatcccaagtgtaggaaaaatatgcagacatacagatatataggccaactattagtaataatatgaaatatacttaaagagcttttaaaactttgtatttttgtacaaaatatttgtcttttacaatttttttcctttttttttttttgtcattttaccgacataatacatggagccaaagaaaacaataatggtactaataaaaactcctagggtttcctgtcagatttaattctacccagtggcaaagaattttttcaattgtggctttaaaaaaataattaaatatacatgtgtatatatatatatatatatatatttttttttttttttttttttaatgtttcatttcctcagaggaaccaatcacttggaatgtctagaaatatccttgcagattttgccagtgtcaatcaagcctgcacacatgcacagtgaagcgggctgtgcctgccttgagcccatcaccagccaacattcttgacgtgtgcctgaccagacacagaagaaatgggcaactcaagacgtgcttccactt

SEQ ID NO: 2557 - DNA, 1211 bp, Homo sapiens
ttgttttgaacaaatgagtgggaaacgtatttacagagaaagcttcttgggctggctggctgtgggtccagttgtgtcttatttctaaaaactaagaagtttatataaacaaaaaatcaaagtaggaatttaaagagagcattagtataatttttaataacttacacgttttatctcatgggtttcataatgtgtatgagcaaataaccggactcgccccatacttccatatgtacatgcttagaatgtaatgcataggttctgtgtgtgtgcacgtatgcatctatgtgtatgtattttgtaaataatctataataatctataaaatatatttataaaataatctataaaaatataaactattaacagtagttacctctggggggtaaaattggaaaaggtaaaggaaactcacatttttaccttatatattgctccttgtttgaatttttcttttaatgagtatgcatttgtatatcttgagttcttagcatatggcctggcacttaataaacattttattcaatgtttaacaaataggggaatcagtcaattgagtggcacaaaaattatactcaaacatttgattttgagaggtttaggagaggaatgatgataaagaaattgaactgagggcttaggaaagagagcatggtctggatgtattgctaaaagaggccgtcggaaataaaggaatactttggggttaccattgctaaactgcgtattttctacccttaaaggtgccccaagttagatacctgtctggcaaattacgtagtcctaatcataggtgttcttaagggtttatgtcttgactgaaaagggacaaatcacctggcaaggagaccactacctaaccctggtgactcttaccttacagggctggacagacatgacagtgtgaaaggcctttgtactctcagccatgtggcttgctggaccatctgaaggcctactgagactgtcctgggaaggggacagcaatccagtgactcacccagcagtaatttgcctgggttgactggataggcctgtcctgtagattggtatccaaagattaatatgatgggtgagaacttttagctccaatccagctggtgtgacccaaatgcataaaactcactcttggcttctcatcgaggaactaagttggagatattttaaaatgcttgaatggcagtttggagtctatttgaaaacactggcag

SEQ ID NO: 2558 - DNA, 1277 bp, Homo sapiens
gttagccaggatagtctcgatctcctgaccttgtgatctgcccgcctcggcctcccaaagtgctgggattacaggcgtgagccaccgcgcccagcctacattcacttctaaagtctatgtaatggtggtcattttttcccttttagaatacattaaatggttgatttggggaggaaaacttattctgaatattaacggtggtgaaaaggggacagtttttaccctaaagtgcaaaagtgaaacatacaaaataagactaatttttaagagtaactcagtaatttcaaaatacagatttgaatagcagcattagtggtttgagtgtctagcaaaggaaaaattgatgaataaaatgaaggtctggtgtatatgttttaaaatactctcatatagtcacactttaaattaagccttatattaggcccctctattttcaggatataattcttaactatcattatttacctgattttaatcatcagattcgaaattctgtgccatggcatatatgttcaaattcaaaccatttttaaaatgtgaagatggacttcatgcaagttggcagtggttctggtactaaaaattgtggttgttttttctgtttacgtaacctgcttagtattgacactctctaccaagagggtcttcctaagaagagtgctgtcattatttcctcttatcaacaacttgtgacatgagattttttaagggctttatgtgaactatgatattgtaatttttctaagcatattcaaaagggtgacaaaattacgtttatgtactaaatctaatcaggaaagtaaggcaggaaaagttgatggtattcattaggttttaactgaatggagcagttccttatataataacaattgtatagtagggataaaacactaacttaatgtgtattcattttaaattgttctgtatttttaaattgccaagaaaaacaactttgtaaatttggagatattttccaacagcttttcgtcttcagtgtcttaatgtggaagttaacccttaccaaaaaaggaagttggcaaaaacagccttctagcacacttttttaaatgaataatggtagcctaaacttaatatttttataaagtattgtaatattgttttgtggataattgaaataaaaagttctcattgaatgcacctattaatcgttttagttgctattcatattctcattcgttttttaaaaactgatatattctgaatttattcttccattgagaaaaaaatgttcagttacttgtaactactgagcagaa

SEQ ID NO: 2559 - DNA, 1197 bp, Homo sapiens
ccttcaggcttaagtatattgagtcaaaatcttccagtctggtaaccacaaaaggtatcttcttataatgtgcatttcttggaagactgggaaggttggatgcattttcatatgttaattggcctttcctgtgttgtgaattgtctcttgataggttttcatgtttttctgttggactttttcttttcatgcataagagttgtctgtattaagagtgtcaaccagattccacatgtgtacatttattatatattgagagaacaagaaagcatgagcaagtacaaagatattttagcttctcttaaacttctgtccccacccctgcccctctcaatgtggaagttactttatactttaaaagacttttccaactttagattatgaaactacttacctttaattttttctaatacttttagaagcaactgccttttatatatttagcttataattcctttacaatattttcactttagtcatccctcaagatccatgggaaattgtagagccttctagaacctcctgtggataccaaaatccccagatgctcaagtccatgatataaaatggcatgtatttgtatataacctgtgcacaaatcccccatatgcggttttttggggtttttgttgttgttgttgttgtttgtttgttttttttagacagaatctcactctttcacccaggctggagtgcagtggcataatcttgacttactgcaacctccgcctcccagattcaagcgattcttctgcctcagcctcccgagtagcggggactacaggtgcgcaccaccacacgtggctaacttttgtatttttagtagaggcagggtttcaccatgttggccaggctggtctcaaactcctgacctcaggtgatccacccgccttgtccctgcaaagtgctgggatgacaggtgtgagccactgtgcccagtccccctgtatgctttaaattgtctccagattgcactattcacaataacaaagacttggaaccaacccagatgtccctcagtgatagactggattaagaaaatgtggcacatatacaccatggaatactatgcagccataaaaaaggatgagttcacgtcctttgtagggacatggatgaagctggaaggcatcattctgagcaaactatcacaaggacagaaaaccaaacactgcatgttctcactcataggtggga

SEQ ID NO: 2560 - DNA, 1219 bp, Homo sapiens
agaaaagtaacagaatgtttatgaattagacctttggattgaagaaacttaaatgaaactttctctttctttctaattagtaaaatctcttttagatgttgctgccattgatccatgtttctctgataactgttaagataaaattatattaagctgttatgtattattctttcaaaatgaaaatgatcttattagaatatcatcaaattattctattttaatgagttcaaaaaattagggtttaggttaataaacactatataaaatggtaaaaatttgtctaagttataaggatgatatcatcctgaaccttatttcttttgcataaagtgttaattatctacagatcacaggttattttgctattcctcccaccattgcattatttgaattttaataatggacttttgtatgtacaatgtctccattcaaaatactgactcactcttgatgtaacttgtgacactaaattagaacctcaaacatgttcagttgaaccaaactaaattaatgttgtgtgctgctccaattaccaatgagaagatgttttatcctatcactataattttccagtggatgttggtagggaaagtgggaagtgtcaaagtatgaactaattaagcagatctacaataactacattttcattctcataccaccaagaattataacagtataactgaaaaatattgccatccacttttgagcacagtaacagatcattgattctactttctacaaacccctggtaaattctctagactgtattaaagatgactaacatacatatctctcattgcttacacagtcttttacataaataactcataggatctcactcaactcagcgaagtaaataagacctttcaaaggtgtgagaaaactaagcttcagaaacatttactgacacctaaagtgcagcgttaccaagaaatgaaactataattcaaatgcatcatccaactcaacatttcatggttttcagtataccacacatatatttatagacattatcatatgtattatttcttctagcaagaaattaagtgaaattccctcacacaaattttaagatggtaaaaatgagaacaccataaattcctccaatcagatcaagcttcacattgatcttctgtctctcacagccaaatctgccccttcacagccttgttttaaattttgattgtctataagaaaaccacaaacttccaagagcatt

SEQ ID NO: 2561 - DNA, 1221 bp, Homo sapiens
tagatggttgggtgtaatgaagaagtctgagatcatagaaaagctgtctggcttttctggaaattaaaccctgacctttgtctcagtagcagcaggctttaagtagcacagcccagtaccatgtcttggttttggtgatttcttatacgactagggtgtaataaataattttgaatgatgccttcacattctgaagccataagcctgttaaacattaggtcacgaactttttctggtttgtctaagacattgttggccctagcactggaagtcccacatccaggaatcccctcgaactagggcaaactgaaatgattgaccccccccccctttcttaaaaggtataatgcagctttcctaggattggatctatttctctgtttgttttgtcgtctagatttcttgttatatcagtgccctcccatcaggtatctccactatataagcggcaccaaccagcacatttaactgagggaaggggtgggcgtgaggcgggaggatggaatgagggatatagagagcaggaagattaatgtcatattggagttggactgcagggcttcctttacacaataaatattgtatgaagtgctgatgtaacctttactgcagcatgacatgggatttggctgtttttatggctcatgattaaagtaagaaacaagtctctgattagatgattctttttcccccacagacctctgtccttcatatttccaagaatgctattttatttatgcaatccatctaactcagacaccaaaatatgtagatcacaacctagacaacataaagaagcattctttttattcttggcctcagattatttataatctaaaatgctagctttgatgagcattgcagggaaagaaagagttgagactggcagattttacctccttttaaaaagtatactatctgcaagtggtgaaacccattgatattttgttgaggttgcataagaaaatagatgggtttttaatgatattagtttgttttagttgcagatagctaaatacagtcagctaaaaagcaaattgagctctaaggaacagaattaaataatttggttttctccttctggtctatcctattcagtaatttaattatttgtgaaacttttaaactcaattgactcattgaatttgttcaagttggttggtgtatggtgttacactcattatatattttttggtcctggtccagaaattagcaactcag

SEQ ID NO: 2562 - DNA, 1255 bp, Homo sapiens
ggaatacattttgatggccacaaaatgacataaagaagacacatatctggatacccactttcaaaatgctctttgttattgtgtctttcaaaagagaaagccactttcctagtctttgttgaatggtaaatgttccttcaagagttgcaggaagagcatgccttgcttgcgccatggggtggggctgcaccatcttgcttgctgcgtgtgcttgtattgttcatcatacacaattcatggtttcttttcaggaatttttgaagtcgcttgtccattctatgaaggtcagtttggttaaaattaaagcattttaactgagtacttacaaactgtagtagacccagataggctgaaagcaaaagtaggatggagggcttggcttcggtgaggaccaagcctcttctgtcagccactcctgtgcgactgtcaggcccagggatccactcagggaaggtacctgtgtcaacctcaatattaactgttatcaaagcttcctgtctcttttattttagccagaagcaatacttttaatggattccttccacgtccaaatggatcatgtgtacccctcctgggcacccaccggaagactctgggtattgtgtgcgttgtccgcctcagtgacgaggatcttcataactttccttcctgcaaaaaggaacattagttttcagtgtttccaacaattatccagcaataccatctaaacaccattttctgtattctaggagcaagctgaagaggaaaagaagcccaaggatagcacaacccctttgagtcacggtaattatcaccaatatttacagtggtagttcacagtgaacaaattttaagtgaatttttattagattgcttagttgttttaggtttattaattaaaatatgtgataataatatctaccatttattcagggtattgcatactcttctgcagactttatcagtgtcatctaaggttttcaaatatatgcttcaaaaacatctgaagctcttgttatctcatttatttgccttttaaaaaggctttaaataaaacaacttatttgtaaattttctctgtgaacaagaaaataaagagatgctatttagttttttaataatcctttgtgtgagcttttcccagactgatttgatcttctaatgattgcattgtattgaagtcatgttgtagaggagattgtgcattttctctaaaatgaatactcctcattatggttattaatacatcaataggttttagataatagccttttca

SEQ ID NO: 2563 - DNA, 1177 bp, Homo sapiens
ctgtaaaaaatctcatttcaaataacttttcaaagaatgtctaccactgtttatgaatatacagaagaatgatcatgattaattggattggtgaaattttttcttattttctgtttcagattgctatgctatgccttgtatgactaagacctcttaccaagaatacgtgtcagaccatgtgagtacagaagctgtgcaggctgattgcagtgaatcctaattggttaggtcagctaagcaaaaaagcaaacattttatcccagataagaccaaaagcaataatatctattttccccatgatataaattctagatgaggtagtaaacgcattgccctcccccttgtcttattattatattaagtactataaaaccaattgcaaagtttttgtcaacttatcaggttatttatagtaaccaactatgagaagtataattgaaagcattttcttgtttgcttctgtaattctgaaggggtcacacccccatccccaacttcttatgtaaccctgttttacagaaaaccactgccaaggagtgcgggggtggcaatgaaacagcccaacaggaaaaggaagcttaatatggattccaaagagcgtttggatcaggacggacgcttggtaagatgtccatccctggacccttcctcacagtgtgtgatcgctaccaaaatgcaccatggaatagtagagttcacataaccacactcaggggcttttcagtcacttgaaacgatgtggcttctgcttgagctttatgtgtaggggtatagaatataagtgttcttaaagtctgatatatattttaaaaggtgatcttaactttaaaggtgaaaggagaccttttcttttacaaaggtggaggtaatcaatcattctcaagtaagagaacggaagctgtaaactgcatggggttacattagggttctccagagaaacaggaccccctaggatgaccgtatgtgtatatgtgtgtgatatttttgtgtttgtgtacacacacacacagagcgagagagagctagcaagcgagagagagggtgagagagagagagacttatcttaaaaagaggaattgattgaggcaggttgtgggggctgacacgtctgaaatatgcagggcagcctgataggcaggaggcccagggaggagttggtgctgcagtcttgagtcca

SEQ ID NO: 2564 - DNA, 1233 bp, Homo sapiens
tgttagcacactgagtttttatagttgcacatcattcctcattgtgccttgttttatccattttataaatagagtagatatttgatataccactctgataactcatataaaaatatcatcataaaaagcttaatttcatcccttttatgttggttttaaaaggtaaatgcttaccatattttataattgagaactcttacatagtagaatccattctataatacatgtgttgacaaagctttagagaaagtttcctattctcttccatttcccctgcccaaagtgctgacataggcagtgatgaagaatctttaccaagattttcagggtgtacctatgaaattgctttaaatgcactgctggtgtaaataattagcaagcaaagcgtttctgtgacttcaggtaccagcttaaagagcactagggatggggaacgaatgccaaatcagactccacctagagcaccaggaaacagcttgtaccctggtagggaaatggtgttgctgaaaggggaggctgagccagtgcgagactgaacttgtgcagccttagccaagacaaagcagtgtttttcagcagacggctgatgggacaggaattgaagaagagaattgactcgtatgaacaggacagggtgaaaatgctgggaattattatgggaaacaaaactatctatgttcatattttgtaatatttcatttgttaagtttatatctggatataatgttctttttaaacaagtataatcatatcgtcggaggttaagattatgaaattttagaatctctattcaagatgatgttcactccaaatacactacagaatttagtcaacattttatataatgtttcaataaatgtttctttcaataaagatactatgtgcccttcatagtaataaaatctcaatcttaaagcatgaatctaaaacataaatatttatattacagactcaattttacaaaattactaattgctctagtgcatatttgaactacaagcaactttttaggaatacctctttatacgtctacatattttagtatataaaaatagataatgctcttggacacattttgtattattcatgatctgaatagtagttagttaaaagatcatttgtaatattatgatcaactgttataaattaaggtcttaataccttttctgctctttcaaataactctaatgaatattcaagatattttagccttttaaaaagttgagatttagc

SEQ ID NO: 2565 - DNA, 1192 bp, Homo sapiens
gatcatttgaggtcagcagttcgagcccagcctggccaacatggtgaaactccgtctctactgaaaatacaaaaaaatcagccaggtatggtggcacacgcctgtaatcccagcttaccggggaggctgaggcaggaaaatcgcttgaacccgtgaggtggaggttgcagtgagctgagattgtgccactgcactctagcctgggctacagagcgaggctccatctcaaaaaagcaccaccaccgccaccaacaacaaaaaacacacaaaaaataagatgtttaaatcagttaatactgtgatagaaaaaataaacaaatggatggcatcaacttctctatccttttcttgactttttttcccttcagatctttctggtgcttgaatacatgatttaactcatattttaccattttcttcttaaattggctattaactagcaaagactgtgttgtcattactgggtagaattttctttatgtgtccaggattaaaggatatattatgtaatagacacaaataagtgaaatagaatgatagttttaatggttttcttgtaaatctttttttcttagatcagcaatcgagtcctgtatgtgtttttcacacatgtgcaagaactctttggaaatgtggtactaaagcaagtgatgaaacctctgcgatggtctaacatggccacgatgcccacgctgccagagacccaggcgggcatcaaggaggagatcaggagacaggtgtgtgcaccctgcctgccacagcctgcctctgcattggctgttgtggagtccagtggtgatgggctcttgtttcctgaacactttctgtgtgtctggagctatgttaggcacactgaagtcagaaattcccatctggtactgtttcatgccaaataagtcagaataccatggtggaaagagcatagtttttggaatcaaaacacctggctttaaattcttgctctgatctagttaactgattttaggcaaattcttaaccaccttaagcactggtgttcttgctttaaaatggatcctcttataggattgatgtgaagattaccccaaatgagataatatatgaaacatgccaggcacgttgtaaatagtctaaagatgtttgccttttcttgacaaggttgctgtcatcagccatattttatagataagaatattaaaattcagggaagtta

SEQ ID NO: 2566 - DNA, 1205 bp, Homo sapiens
ccagatgcagcgagccaaggccgagcagcaggcgcaggaggacgaggagcctgagtggcgcgggggtgccgtccagccgcccagagacggcgtccttgagccaaaagcagctaaagagcagccaaaggcaggcaaggagccggcaaagccatcgcccagcagggataggaaggagacgtccatctgagcagcctgcgtggccgtctggagtccgtgagactgaaaggacccgtgcatcttactgtaacccgggggccaggccggctctctcgctgtacattctgtaaaggtgtcttctcttctcagactcttcctctgtcacacgtctgactccttcacgtcaggctcaggttccatgggaggacgaagcagtggacgcattgtgggctttagggacagatgagttttccagatagtgtcagcttatttgaagattaattttctttgttaacttaaaataactattttaacccttgagtggcttctttttaaaccaaaaaccgtctttctttgcttttttatcacagcagaatcaggatctctttctcattcaaggggggaaccaccccaggtcagcgctgcgcctgctgtggccgccgcgagccacgccctctgggatctctggtaccgtcactcttgcttgtgccttccacaccttctcggtgcagatccctatgggggagctgcctcacgttctctgactggtcagagcagcgcctggtgggtgttccctggcccactctcctctctccttctgcagttctaaaccacagtctataagcccgagtcaccaggacggcctgtctggccacagacaggggctgcctgtggagcctgcccaccggcccccggcagtgcagtccagcggggaggaggctgcccgttcctgccagttcctcactgcggggaccagcaaaggccttctcactgggttggtcaaaggtagtcaccttggcctggtgcatccacagaggatgttgttcaaaccagaaatcttttaaacgactgaccttccttaaaaacagaatgactccgattgcttgcttgggctagaatgtacacgtctccttgcctgaataagccatatatatgctcttaaacaaaagtttgaaattatccatatcatctcagtgaacctactggtggactcccaattgacaagattgagcaatagaaaaaaattcctttcctttgaatgatagctg

SEQ ID NO: 2567 - DNA, 1232 bp, Homo sapiens
ttccttgtgtaatgtaagcaaataggctttaggtctcagctttgcaatatgtcgttggagtagagaggtaatacaaataaccctaaaaataaaataatttaaatgttgttatgtatcttaaaatgattgtaggaatttctgtttccactacttttctttagttatttattattgaaattagcatggtgttatagaatcccaggattcttaaatgttaccttctctaactaatatatattgcttgactatctagacttatacttaacaggtatttacatctttgaacacagaacagctgatggagaaagaagcattataaataatatacataaactcagtttgtacagataatccgtaatttttaatgtttaacttgtctaaatgctatatgtaatatctttcatcagtttttttaaagtaattatcctttcatattgtttttttcccaccaaataaaacaataaaaggaccagagatcaagaagccccagaggatgtacaagtcaggccagaggatactccttcagatctcagtgttagtaattccagtgtcatactggaaaacacgatggaagaccatgctgctgaggcatccgggaagcctctaggtgaaattagtgttccactggacagctctttactttgtactttgtcctcagaatctcaccaggaagcagctagtaatgagaatgataaaaaacctggtaactacaaatctatgttacgaccagaggttggcaccacttcacaagattcagctctcttagatcaggaattgtataactccttccatttctggaggactcctcttcctgaaatagatctagacatagagcttgaacagaactctgggggaaaacccagcccagagggaccagaggaagaatctgagggccctgtgcccagttctccaaacatcaccatggccaccagaaaggaactggaagaaatgatagaaaatctagagccccacattgatgatccagatgttaaaggtatggaagtcaatcaagttatttattctgaaattgattaaaaatattagtgtctatcttaaaaaaatttcatttcagaaaaaattgtcatttaataatgtattatggactgggcacagtgactcatacctataataccagcactttgagaggttgagacaggaggatcacttgagaccaggaggttgagaccagtctgggcaacatagtaagaccccatctctacaaaaaaataaaa

SEQ ID NO: 2568 - DNA, 1148 bp, Homo sapiens
cacctgtcatcccagcactttgggaggctgaggcggggggatcatttgaggtcaggagttcaagaccagcctggccaacatggtcaaaccccgtctctattaaaaatacaaaaaaaagttagctgggcggtagcggcgcatgcttgtaatcccagctactcgggaggctgaggcaggagaatcgcttgagcctgggaggtggaggttgcagtgagccgaaatcacgccactgcactccagtccgggcgacagagtgagactctatctcaaagaaaagaaaacaaaagaaaagaaacatcagtcatatcacaccacatttgtggcttcctttttttttttttgagggtggctgtaagtttcagttttattgaaatcagaggacattttatttgaaagaccaaatgaccttgttgtccacactgagtaagatttgccacatcccctcgtttggctggctctttcctgggtgagatgtgtgcagcaggctgtgtttctagctgctcatccaattaggctgattctctgggtgggataacattgagggagatcaaaaccatttgactgtcttcggtttactctcttctctctctctctctctcctcttttttgttttgagacaaggtcacattctgtcatccaggctggagtgcagtggtgccatcatagctcactgcaccctccaactcctgggctcagtggatccttctgcatcagcctaggtttattctcttgattcgagagaccctgtggatcagtcagtgctaagtccaaaagtcctttaaaaaatatatgtatatttttgagatagggtctcactctgtcacccaggctggagtgcaatggtgccatcctggctcactgcagcctcagcctcccaagctcaggtgatcctcccacctcagcctgccaagtagctgggaccacaggtgtgtaccacccagcccagctaatactttttattatttttgtagagatggggtctccctatgttgcccaggctctttcaacattttaacaggaaccttgggctcatttgtgctttgcgtagggaggtctgtcttttctgggtgaagttttgtgtgtggctggcattcagcttcctgttttttagccatgagacacctccctgaagtcttgctatgaccaag

SEQ ID NO: 2569 - DNA, 1192 bp, Homo sapiens
taattgaaccataaccatgtaatattatgtaaaggcctggaaattactgttgctaaaaaaagtcatgtagtttcatgtagtgtagcatccttggcatcgttttccaaaatttgttccttctcccttttttttttctttcgtgtgtggcatgagtgtgtatctgtgtaaatatgattgtatatgtgttactccgatatgtaatccatttcactggctgagtttggcccctagccatgtgttaatataaagtaggcatggcttcccaatggaaatctctgagaatgacagtggagttgtgcaagcattttacattgccacataattgacttgccattttatggttaaaaacggcacattaggcagttgaatatgacgttaccttgcagactaaaaggttgaaggcccgaaactaacttttagctaacaataagggctgtgccccaatggaaactgagttcattttctgagaaaggtttggatgactgaaatatttcctctacagtcaaggactttggcatgtggtggctgaaactgagcttttttgtgtgggctccagttctcactgttctgcaatgctcatggcaagttgaatggtgagctagcttataaattaaagagctctgaactgtattcagaccgactgggtatctagcttactgttttaacatcattgttgaaaccagaccctgtagtccagtggtgctgccctgttgtgcaaactgctcctttttctcgtgtttttgtaaagagcttccatctgggctggacccagttcttgcacatacaagacaccgctgcagtcagctaggacctttccgccatgtattctattctgtagtaaagcatttccatcaacaatgcctaattgtatctgttatttttggtttaacacacactgattcatactaataaatattttcagttttaccgtttgtctttttcttattacactgttcagtagaatcattttttaaaaatcacagttaactcaaacagagaatgatgattccccagggaaatgtgtgcacctgcacatatgcagacatgcataaggatgttccctgaaacactgtttgcagtagcaaaatgttgccttccactaaggaaatggaaaaatgaaatgcggcccagccacatgatgaaagctatcaggtaatgaaaatgaactcactgtcatgcatcaacattgatc

SEQ ID NO: 2570 - DNA, 1183 bp, Homo sapiens
cctatagatttttagctccagtagtctcgttagtatgcttgtttttaaaaaccttttgtgtgtgtgttttttttctaggatgaaggtttaaggctcagaaaggtagcacattcggataaacctggatcaacctcaactgcatccttcagagataatgtcaccagtcctcttccttcacttcttgttgtaattgcagccattttcattggattctttctagggaaattcatcttgtagagtgaagcatgcagagtgctgtttctttttttttttttctcttgaccagaaaaagatttgtttacctaccatttcattggtagtatggcccacggtgaccatttttttgtgtgtacagcgtcatataggctttgcctttaatgatctcttacggttagaaaacacaataaaaacaaactgttcggctactggacaggttgtatattaccagatcatcactagcagatgtcagttgcacattgagtcctttatgaaattcataaataaagaattgttctttctttgtggttttaataagagttcaagaattgttcagagtcttgtaaatgttattttaataatccctttaaattttatctgttgctgttacctcttgaaatatgatttatttagattgctaatcccactcattcaggaaatgccaagaggtattccttggggaaatggtgcctcttacagtgtaaatttttcctcctttacctttgctaatatcatggcagaatttttcttatcccttgtgaggcagttgttgactgagtttttcatccttacaatcctgtcccatggtatttaacataaaaaaaaataaaactgttaacagattcttgctcgatagcttgtttgtgtctgtcgtgttattagagggaactccactatatatggtcacttgaaattatgatgcaaaggtttctcttgcattgaaaccctcttggatattacagtatttttaattgaaagtcctaattctgttaaggaaaggagttgattaaattttaaggtaccactggtattttgggagattataatcagtttgttttcaagataatagaaaataaggtccatgagaatagaagttatgtgatttcagtgagttgatgtgtacagcatggctgtgctccatctgatttaccccattcttaagttctgagagtatgttctcaaggaa

SEQ ID NO: 2571 - DNA, 1174 bp, Homo sapiens
gctgttttctcttgctgtaaatttactttactacctgtgaagtaaaatgtttttaaattagaaaatgattagaaaaattctgtatttttaaactatgaaggagcgtttataatgaagtttgattataaggtccacactggttcgcagagctacaatacttactttctattgtttgtgattttacttgatgatggttttacttgggatgaagtaaagtaaatctgtagacatgtgctgaagaatgaagaagtagcacaggtattgaaaacacgtgaactactgtatcaatttttttaaatacagttttccttaggtatttgaaataaaaattataagtagtttaaaacagtacattttcttgaggtgtttgcaaacttatcaataaaaaatgtttctcttatttgcaaactgtagtcataataactttgtacttcagtaaaacttcagattattgcgtaatagaaatagtttaaaatctgtgcagtgttttgttagtggttttgggaattatgtagttttaaactatattgacaggtattgaattacttcttttttacctgtttgtaggatttgtcttttggaaccaactgggtcagtgatttagttaactgtctttaaatagttgatctatagaaactattgatttttttcttttttccttaactttgacttcgttacttccattcagtctttttcatgctgccaagtaagtattcttcatgttttcatgtatttgcaaattatgttttaaatgttgctgtttttctgtaggttggtaattttttcccaaattataaattttgtattgatttaaataataatcatttctctttgcttcagtttttacctaaaccttaaaaaccaagacttactcctaactgtaagatgtaaagagtttaaattaaatttgccataatattttattaggagcattttgttcagtagcctatgggaaaaaaataagttaggatctcttttttcctctgtttgatagttaatggtgcctgtggagatgaagcaggaagctttctcttgccttgtggagagtagttatttgttggccgaggcaggcggatcacttgaggtcaggagttcaagaccagcctggccaacttggtgaaaaacctcgtctctactaaaaatacaaaaattaactggatgtggtggcacgtgc

SEQ ID NO: 2572 - DNA, 1182 bp, Homo sapiens
ctggcaatttgctgtaaatacctagtttatttccatggagctaaagttgtaaaacttcctaacaggaaagaggtgtcagggtgagctggaaaatacagtaggcaggaagtcaggggacttgatttctcatcctgcctcttcctggaacctcctctgccaggtcatgcctggactcgttcctcattccagtgttaaggttctaggattttttttctttcttttttttaagagacagggtttcggccaggcacggtggctcacccctgtaatcccagcactttgggaggccgaggtgggcagatcacaaggtcaggagatcgagaccatcctggctaacacggtgaaaccccatctctactgaaaatacaaaaaaaattagccgggcgtggtggtgggcacctgtggtcccagctacttgggaggctgaggcaggagaatggcatgaacccaggaggcggagcttgcagtgagccgagatcacaccactgcattccagcctgggcaacagagcgagactccatcgcaaaaaaaaaaaaaaaaagacaaggtctcactctggagtacagtggcataaccatggctcactgcagtcttgacctcctgggttcagatgatcctgccacctcagcttccagagtagctaggactagaggtgcacactaccacacttagctaattttcttggttttttgtttgtttgtttttagaaacagggttttgctctgttgcccaggctggtcttgaactcctgggctcaagcgatctgcccacctcagcctcccaatgtgctgagattacagggatgagccagtgcgcccagccaattctgtgattctaagaaagttcctgtaccctttctgaaaagaccctggttgatccattccaggcagctagaactggtgggacttgaaacggggaagtcaattactttagaaacctgaaagtaactcttgtgggtggttcttttctcctccagctcagaaatatgtgcccagggccgccctggtggacttagagccaggcaccatggacagcgtgcggtctgggccttttgggcagcttttccggcctgacaacttcatctttggtaggttccatctttctcactttcttcttcttcttttatttttttaaatcaaatattttatatgccagatttaaagcatcatgtgtcatagaaaa

SEQ ID NO: 2573 - DNA, 1232 bp, Homo sapiens
ggcatagcttccagttcttccttccgtgtcctggtttcttgttcagttttacttctaatccaacaacaaaagaaatgtctggctggtctcagctagagtctgatgtgtcttagagcatgtgtgcgtatctgaaccatcatccctgctctcatctcagctccctccaggcctgagcaccggttccttttgtcccatacgtcatgaagtcacactattgggaaacctgtgcttccctctccatggcttaactccctgtcagtgtcggagtgtataagaatgcttgtaaatactgtaatatatttattaatatttgaaaggcattcattcagtggacagtgggaattaactctcccaaggcaagtgaaaatgaatgattgacgtacgttgatttaacaatcttactagattttaattcttaaggatttcaaatgaaaccagaaggtggttatgtaagaggcttaaaatgatcttatgtttaaagagattctgttattagcaccatgaactcgtactatgaaatttttaagccttttatttttctaactatattactgtaggactggatattaggtgtcatataggaaacacaaaagtttattgctgtttgctaaagcaaaatagcagaaaattttgtatatgcaaaactgttgaaggaccatagagaaatgtgtactactgacggggcttttactaggcttcctgcgtgtgtaaaagtcgaggtattgctggcattcagggtgacatgatggtactaaatgttttccattaaagtcttctattttaaaatttagagaaaaataaaatggctttccatcagactttctgtgttgagttgctatcgtaagacggtgatgtcttttggtaattagctgtcagaaatcacctcaattgggaaggcagggtacttttataagcagcctgtgatctttgaagaaatacagtctaggccgggcatggtggttcacgcctgtaatcccagcactttgggaggctgaggcagacggatcacctgaggtcaggagttcaagcgattctcgtgcctcagcctcccaagtacctgggattacaagtgcccgccaccatgcccagctaatttttgtatttttgtacatggtggccaacatagtgaaaccccatctctactaaaaatacagaaattagccaggcgtggtggtgtgctcctgtaatcccagctactggggaggcaaggcacaagaatcgcttgaacccgg

SEQ ID NO: 2574 - DNA, 1179 bp, Homo sapiens
aacttctgaaatacattaaaagctgagaaatgccatcattcggatgtattcagccaacactacttacttagtgcacagttttaatggcctaaccctcaaaaaggccgtttattgttcccacctaacactactctttttctgaggatggagcaaaacagagtaggtatcaggcacgctgatttaattctgtcatctctgaaagtagttcctgttgaaagagaaaactgtgatcgttaattttttaaatgcgtattttaggcattttagagcaaatgatataatctttctgagtaaactcatccccctgtcctcttatactaataagcttctcatgttaaaaattcaaatgcaggatttttcccaaagcatttttaagcaaatgtaatcttccttaagttagcttgaacagagatggttttgcattgatttttagtaagaagcagtagttcttcagactacttttttaagtaaaatgctaatgtttgacaagtttgcaacctagattgatttttgtttttctctgattgaaagacagaactgattgttaaaactccataaactgactgcattcatagtcatgtgctttctcactggcgtgttggattcctgagtgcctgtgagcgatgctgttgtgtgtgtgtgggagtgaattataatgtgtttgtgctgagaacattcagtttcagtgtcactgcaccacaatggccccttgcagcctggcagggtccgaatgcacaagactgttctgtctttctctgagatccaccaatcaagtgcggggccggatggggagcggatgggtgtgaggctcttattcaatgagatcagttacatcaacatcttccgcagctgcttgtagggaaaccattaacacaagacagccaacataaatatttattatgaaatcttttacatttctctagtctttccattgctgactatacatttagcatttgttgaaagtaacaacaaatctagagaactgtggggcagcctggagagactgccttttggatataaatgctccagtagtttcatgttccagttccactcgtaccattaggatttgtaaaggtgtgctgatgtaactgatcactaaataatgcttgtcagtaaaaattactaaccatcttcttttggctattctgggtaccacaaatgagttttaaaaacagggcc

SEQ ID NO: 2575 - DNA, 1227 bp, Homo sapiens
ctcatttgtttgcatcgtctgagagagatgtgttttcagtgattgaatggaactagagaagtgtgtatacatggatatgaatagatttttgttgttgtttaggcttgagttaattgctacccgtaagtgagttttcagtctttcagatacttgggatgtctgtgcatctctaattagataaacattggcataagagttctgagaggatatattctttgataactatatctgttctcagaaatacctttgggaaatgtggaaaatcaactcggttaatattttatatatgaatggcaaatacaaattttaacacaaagtataaatctaagagaatataaaaagggtttgtgtatgtgttgtatgttggtttgagggaaaaaatcatactaaacatcttatgcctcacaattagtcctagaaagctcttcattcatctccattaaccacttttttaaatgttcctaggtcattgaatctttgggaattattatttataaagcactggactatggtttgaaggagaatgaagaaagggaattaagccctcccctagagcagcttatcgatcacatggccaacacggtggaagctgacggtagcaatgatgagggctatgaggctgcagaagaaggcctgggagatgaagatgaaaagagaaaaatctcagctattcggtcatatagagatgtcatgaaggtaaggcagcgttttatgcagtacttgtttttttcaagagttgttatttcttcttcttttttttccccccctggagagatggtctcactctgtcgcccaggctagagtgcagtggtgtgatcatggctcactgtagcctctgcctcatgagtagctgggactacaggtgtatgccaccacacctggctaatttttaaattttttgcagagatgaggtcttgctatgttgctcaggctggttttgaacccctgggctcaagtgattctcctgccttggcctcccagagtgctgggattacagaaatgagccactgtgtccaagctgttattttttaaaaaattgaatggttgacacatatctacatttatttaaaaataataacgaggctgggcgcgatggctcacggctgtaatcccagcactttgggaggccgaggcaggcggatcacgaggtcaggagatcaagaacgtcctggctaacacggtcaaaccctgtctctactaaaaatacaaaaaattagctgggcgtgg

SEQ ID NO: 2576 - DNA, 1124 bp, Homo sapiens
tgcacccaccgcttccagggctcaagcaattctcctgcctcagcctcccgagtagctgggattacaggtgatcaccaccacacccagctaatttttgtatttttagtagagacggggtctcgccgtgttggccaggctagtcgcgaactcctgaccttaagtcatctgcctgcctcagcctcccaaactgctggtaaaggcatgagccaccgcgcccggccaaattttatcaactcaattaacatcaaatttagaaatgtaaagattttatttccagtttgacgataagctgcctgccctgtgacagaccactgaaaaattcagctgtggctgacacctaggaatttgcagttacaggacgtttccaagttccatatgcgatgtcatagtgccgcctgctggctcctgtctcacaggaatgctacacatgcagacggtgggtctgaccccgcagctcacacacagttcacggatgaacctgaggaaagtaggaatgaagctcacaaatgtcatgtagaacaaaaggagctgggtaggaaaagtatagattgtgtaatttcatgtacaggaagcacaaaacaagtgaaacttcacaaaacaagtgaaactaactgtaccagtcaaggtttcgcagagaactaatgggagatctatggatatattttaaaggaatttatttaagggaattggctcatgtgattgtggggcctggctggtctataatctgtagggcaggtcagcaaaccagaaaaagtctggtaggatttctgtgttacagacttgaggcagaattccttctttttccctgctctcttgagagtctttgctctcaagtccttcaactgaatgggtgaggctcactctcattattgagggtaatctccttaaagtcaatggattgtagatattaatcatacctacaaaatatcttcacagcaacttctagacctagtgtttgagcaaacaactgggcaccatagcttaaccacagtgacacataaaattaactactgcaggctgggcgcggtggctcacgcctgtaatcccagcactttgggaggccgaggtgggtggatcacgaggtcaagagatcaagactatcctggccaacatggtgaaaccct

SEQ ID NO: 2577 - DNA, 1155 bp, Homo sapiens
ccaaaattctgggattacaggcgtgggccacctcacctggcttattttattttatttttctgagctggagtcttgctgtgtcacccaggttggagggcagtggcccgatctcagatcactgcaccctccgcttcccgggtttaagtgattcttctgcctcagcctcctgagtagctggaattacaggtgcccaccaccacacctggctaatttttgtatttttagtggagatggggttttgccatgttggccaggctggtctcggaactcctgatctcaggtgatccacccgccttggcctcccaaagtgctggggttacaggtatgagtaaccacacctggcctttatgagattttaaaattacactgtgcttaaactctataccctaacatcagtttttgtggattatgtagcagtgtctgtctttttacttcctaatggttaatgattgattttcaaatgaattgatttaaaatggaaacctaagtattacctaatttttttgaaaaattgtctttgtagaagctgaaacctatcaacactcttcaaaatgcaatggaatgtaccacggactgtatctcgactggcacgcaggacatgcttggaaccacataatgctggtctctttggacactgtcaaaatgtaaagggacctttacttttatacaatgctgaatccaaagtggttttggtacaaggccctcaaaaacaatggttgcatttatctgctgcccagtgtgttgcaaaggaaaggaggccattggatgctcatccaccccaaccaggagtccttcgccataagcaagggaagcaacatgtttcattcaggagggttttttcatccagtgccacagctcagggaactccggaaaaaaaggaagagcctgatcctttgcaagacaaatctattagtctttatcaacgattcaagaagacatttagacagtatggaaaagttctgattccagtgcatctaataacttctggtgtttggtttggaacattttattatgcagccttgaagtaagtttttgcttagttgaatgtctttccctgtcttaccagaatattaatctttttaattgtactaatgatagctttagatttttaaatgctttaatgtttttcatcaatagaggataactgttttttca

SEQ ID NO: 2578 - DNA, 1183 bp, Homo sapiens
tgtcattactcacctagaagctatagcgatttgagtttgccatctctacaatagtgaagagtatagtgatacccagataccctgaaatgcttagactaggatcatatgtggagtccattacattttaacttttgtggccttgggcacattacttctttgagactcagtttcctcatttataaagtggataatatagcggtaactttctcttaaggagtgtaacacactttactcctatgcaagtgcttttacatattatataataaaagcttagtaaaagttagctgtgattattattacagctactactgccatcatcatcatcacctgtggaatataaaaggtattcctgtatcatgctattatggtagtaaccagaacaatgaagaatctttttactttcaaaataacatttttataattttgttttaaaaagtaaattattgttacctatttttatataaacttgaaaataaataattttatttttagggttctgttagagtctcgtaggaaatctaagaagattacagccagaggaatctttgcaggtgccagagtggtgcgaggagtggactggcagtgggaagatcaagatggaggaaatggacgtaggggaaaggtacagtgtttctctgaattcattatgtattctagagtattatatgttcagaacctttttattactactataaatgaatttcttggtccattgttttccatgccagtaacagtttttaaaatcttgatttcttttttctctggaagtaaaaagattgttcttgctttttgtaagcattgatgttccttagagggtcattaggtaggttttaccttcccaccttcaggtttcatattgtcattttgttacctagcatgcttttctgaacgcatttgggccagtccctccctaagcagtatctcatgtcctcaactttcctgctatttaaatttcatttgaattgacttgttttatattctcttccctcaaagacctgtttctgaggcacagtgggcaattatgctgttatcgagcccacctacctctgttatcctttgcagatagcatagcgggctcagagttttaggagtaggtcaaagcagaatattctgtgtggtgaaatgagagacctcagctgatctaggtggcagggaatgggggtgaagaggagagtgggaatgt

SEQ ID NO: 2579 - DNA, 1211 bp, Homo sapiens
caggagttcgagaccagcctggccaacatggtgaaaccccatctctactaaaactacaaaaattagccaggcgtggtgacaggcacctgtaatctcagctactcaggaggctgaggcaggagaagcttgaacccgggaggcggaggttgcattgagccaggatcgcaccactgcactccagcccgggcgacaagagcgagattccatctcaaaaccaaaaaccaaaaaacaaaaaactgttcttaaaggaatctctttaagaataaaaatattttaaattttctatcaaattctattttctgataatctatcactgtaatccccaagcctcttgatttaaaaatttctacagaggttttagaaattaccttataattctggaaaaatatggctctaatgataatttaactatgttagcagtgacatatttggcaaataagtatttttcatgatcctgttacacaggttgctagatgaaatgatttttaagatttaaatgtaataattaaaagaactaagctcttccctcccctttaaaaaacttcttttctcaaaaactattctgttaggtaacagaaatccaggactggagtgcatcaagcccacatagcgcagcatatgtcctctgggataatggtgctaagaacctttacagagttggctttgagggcatggtaagtagtgaagagccatagcaggtgaaagaaaatgttggatgggtgaatagctcttactgctcttttattatttttcctttgtcatctccctttgtcagaacctttacgtttttactatgtttctctaaactatttaatagtaaatatgatttgcctttagtttaatgtttgagtaccttactatatattggtggtgtagaggtgacccattttcagtgtaagtccagggggtttatttacgaaaatctatcaaaaagattgggaatcatctgtaagaccattccttgacgtggatggacctggaagacggtattataatgaggttttgtgatatatttgtattctgtgctctggtagcttatataaaagtataaattacaacaaatattaaaattattttttaggagattcctctccaccccttggtattttttaaagtatagtgttgataattgaaaatgattgacttagaaacaccttgaattacttaagtgtttagaaaaataatggaggtttattcaatgagttgtccta

SEQ ID NO: 2580 - DNA, 1127 bp, Homo sapiens
agggcaagaatcacaggaaccatttgttaaaataagatagtactaagcacttaatggaaaaaataattccagggctttcattcatattctctagttagttattgtggttctaatgcagtgatagtaagttatccaggcataaaagtgagtattttcaacacctggaactttgtgttctgatacaaggttgaatagtcttttatagactctacttttactcagtctttgttataactcatattatttcaatttttgagtctgtttggcttttttctttttttaaaaaaagctttctagttctaaaattttatacttatagggaattctcaagaccttttaaaactagatggtacctgaaactaaaatatctacatgttatttaaagataatgcagctgcctgttgttgtgaggtttttttctccctttattcaattgcctctgaaattacaggtgagcagaatggcaacaggaatcctggtggattgcagattggtgacctggtaaatatagatctcgacctcgaaattgtacagtctttgcagcatggtcatggaggatggactgatggaatgtttgagactttaactacaactggaactgtttgtggcattgatgaagatcatgacattgtagtacagtatccaagtggcaataggtgggtgatatctctcaatttttgacaatgacaaataaaactaatatagagaaaagtcttagagaaagcaaataaagtgatacaaccaaatactcattaaagctagcttttagatggtaagtaaaaatccagaatatatattggtaaggtggagagaaacaaatgataagaattacgtgtgtgtgtgtgtgtgtgtgtgtgtgtgtcttgtgtgtgtatgtgaatttatatgaggatgtttatgatacagtgttctgtacactatttttccttcaagaggagaatacattatatcactattaggtctgaatacagcttaaaagttctgtgttcgtattggactatatcagtctaccctgaataggaagggttttacattaaaactcctttggtgcatatctccagggtcatctcttattttttgtttttattgatacacaagaggtgtacatattttgggatacatgtgat

SEQ ID NO: 2581 - DNA, 1102 bp, Homo sapiens
gttgaactttgtcctggtttgattctttttgcaagagattcaaagaatcagtgtagtgttacagagtgtatttcggaaacttaagatcagcctagtgtttcttcagtcttcagagtgaatttcttctttttttgtagtctgcttctagatcctacaggtagatagtaattaattaaattcaattttttttttacaaactagatatcttactcaaaacctaacaaattaaccaataagtatttctgatattgactctagaagttgaaacaacaaggagaaaaaccaggatgagtgtgggtgaattgaacttttttaaagattatgaatttttgttagtgttttataaggtcacagataagaactcgtgatcatttgaaaatttgtcattcttttttctttattagttccttacctgaagtttgcactttgatgcttctctttgggttaaatacaaatatgagttgaatacaaattcaaatagatgtagaaatatctaattttggtgagtttaagttgttttgattctttaatctttttagtataaaggataactgtcagaatcgtcaacttttagaaagtatcacttcaaagaactgaaaggttttagtctgtgagcacctgggttttatttaccttgatagtttagaatgaaaagaaattatagttggtaagtagccttcagttattgtggtattagaaggttaatttaaaacctcaagaaattttcagatttgtcaaaggaggaaaaaaaagggcagggatagtagaatttctgcagcttgtgataaaaagctagtgcagcttatagagagcaaatcagaatgtagcagtagatagcccagcactacagcagtttcagcaatgcagcattagaattacaccatgcacgttctgatttatttttgtggccaattattagtaagcattaaaaagtattttatgatctgccaagtttcttggttgactaaaccttgaaatagaagctaatagttttagaaaataagtatactttggaagcaggatgtgacttactagagatgcaaaatcatcacttaatctgaaacaataatgactaaatctttaataatgtaaatgacaataa

SEQ ID NO: 2582 - DNA, 1183 bp, Homo sapiens
taaaaaggtagaacatctgactgatgatgttcacataaagagacagacagactatcatgttgcagacatgaaaacagcatgtcaggtttttcctttccttccatgccatgggctacccatctcttcccactagatcacctggtgaggagggagcacctggctgactcatgcagagtttggccaatcagagaattgtgtggtctccagctctactttccttaaacaaatcctttctgttttctgagctgcagtgctaaaacagatccctaaaaggtaatagcatcttccagactagtttaattatttcctttataagaatatgacataaatttttattatagaaataatgtcattataattttagtgctagtacttgtgggttttctgtatttgtatcaccttgaaatttgttccatgaatagaaaatacttctttattcatgttttcaatcacttagaattattttaaatttattttgggtttgtgagagataataagattaagaacttcatcatttcagtgactttcctccaactctctgaatctgctacctcttattatatgtcccttagcagtacttttccagttaggttcgttaccctgctcattagctaaacctctttatcttgtgcctcaaaagagcttttacttttcttagaaacatttataaaaaagaaaaaaactgacacgcattcattcaaaaaagtatttattgggctttagggattagatacacaacagtggaaaaatggcatcttagcacactcagaatttattgtgcagcagttgtgtattttaaggaatctgtagttaaaaggaagagatccaaaggtcctgataacatttcctaacgtttcagaagagttgtcattgagtagtgtttggatttcctctctgtatccctcaccctaccattttctcctttattcttctaagattgttagcgttgttactcaaaacatacacatacaacataccagatggtgctgttctaatggtatttgttcacgtaatttaacgttcttactgcttatactatatacatatttaattttgttgggagcaagaaggttttcaagaaaagataattttgtattagtgtaggaatatattagacaaatgtttagttggtcaaattatgcataagatatttgtaactttaaacattgcaaattgaccagct

SEQ ID NO: 2583 - DNA, 1188 bp, Homo sapiens
cggccttgcggggtccaagtaactcgctcgcagtccaaaactctgcaacgctccacataaccgtcctgtagacccacaactctcccaggagcacagccccaggacctaacccaccgggttctgctcgctcacccaattcccagtgcgagcgcgcgggggaaacgtgctcgcctcccgcacctggcttccgcggccccgggagtcgccaactctcccagcaggcagctccgacaacccggacagccgggccgatcccccgccccaccacccgctcggctctcgcgtcctcctcttcctcctcccgtggccccttgcctcccgccgtctgcctctgcggccgccgcctgcggctttgttttcctcccaggtcgcattccccacacgtgattccgtgttattgcaaagagggctttggagcgcgagcgcggggcgcgcgcacctataaatacggacacccggccccggagcccgcgagccagcggccaggcgaccggcgggcggccagccagcgagccgaactagccgagctaggtagcgaggcgtgcgcgtgggccggggcggcggcgcccccatccccagcaccgaggggcgagcatggcccgcccgcgggggggctggaccgccgcgcacgccgcccgatccccgcgccctacccagcccgggtcgccgccgctcgcgcccgccgcttagcgctcgggcgccgctcgcttctccgggcatcgcggaaatcccgccgcagacggacacaatggcggcggcggcggcggccgccaccacggccgcctgcagcagcggcagcgccggcaccgacgccgcgggcgccagcggattgcagcagccgccgccgcagccccagcctcagcccgcggccgccgcgccggcccagccgccgcccgaacccccccggaagccgcgcatggacccgcggcgccgccaggctgccctctccttcctcaccaacatctcgctggacggccggctgccgccgcaggacgcggagtggggcggtggcgaggagggcggcgcggccaagccgggcgccggcggcgcctgcggcgcgaggactcggttcagcttgctcgccgctgccgagcggggcggctgcatcgcgctcgccgcgccgggcacgccggctgcggggttagccgctgggtccggcccctgcctcccacagccctcgtcgctgcc

SEQ ID NO: 2584 - DNA, 1189 bp, Homo sapiens
ctgcaggtggctgaaatttgtcagctgaccatcatcagcctgagggcgagtttgaatagaatagcatgtggtattcccgccagcgttatctcctgcagccagttatctcctgcagcatagatgagtgatttgagtgattggcgtaaaggcccagaagcctcgtagtcagccatgtggaaagctaaaagcagggagagcagaagcaggaaggagcattacagatgagaaccaagatgcagatacttcattcactggaaatgctagagccagtccactgagattaaactgagcaaggagaaatgtaattcaggtggactgctgattatagcgcaggatacagattttttagtacacatgaaaaataccttggcatttaggacagtgtgttccaccccaggctcacaatgcaatgccaatacagagggagctaatttagtttgtcctgatggaaggctagtatcacagaaggctggtgtcgcctttgcacccaaccagggcgggtcccatctgtggtgttgccatcagcatgcatgtcgtgtcatagaaagctagatgtgtattaggatggtcccccagcagtggactttgtggaaggagttgtgatgaaccttgaaaataagctgagtgaaatgagccaatcacgaaaggtcaaatgtcatatgactccatttatatgaaataaccagaatagtccatacagacagaaagtagataagaggttaccagggtttagggcaagaggaattattgcttaatgactctccagatacaaggtgcccaataataaggcagttccttaactacatgcactgtaggaacatgtgtcctcggtccaccccacacatgtttgctggcacctactctgtgactattgggatgtatccatgaataaaacaggttacatcccaatagggagggaaatgatacatgtgcacaggtgaaagatgagataatgtgccatggagagagactgaggcagccagggttggggaaggacactctggggcaatggggagacctgacagtggaggtgtgagggaggtgagggaggtgagggagccagccctggggctatcccagtggggaagcgcatgcgccctgatggaacagcagtcatggagacgctgaggcggaagggccggggtgtgtttgaggaactttaggaaagcccgcatggtggaggtgattg

SEQ ID NO: 2585 - DNA, 1223 bp, Homo sapiens
aacagtggcatgtactcctgttaacaatacaaaagcaaccaaatatagcacaagcaattttcaagatatgaacatcgaacttatgggaatggtgataaactaccagaattttggcatttttagggtacatcttagatgacagaacaatactcccatagtaactgctctccctttcttcctcgcctccaccaggagagtgcaccactgttcattgataaccactggccgggcgtggtgcctcatgtgtgtaatcccagcactttgggaggccgaggtgggtggatcacttgaggtcaggagttcaagaccagcctggctaacatggtgaaaccccgtctctactaaaacacaaaaaaattagccgggcatggtggtctgcgccggtaatcccagctactcaggaggctgaggcagaagaattgcttgaagctgggaggtggaggttgcagtgagccaagatcacgccactgcactccagtctgggtgacagagcgagactccctctcaaagaaaaaaagaaaaccattgatagcgccctcacccatcacacaacgcacgtccatggggaacctggtgctaaaccatttgtaaatgaccggcttctgggtcagggtttcgtacatagcagagcacctccctcgctgcaaaaatctattgaaagtcagcccttgacacaagggtttgttaaaaaagaaaaaaaaaaaccattgatatgagtcagggtttttattaacagtagaatttcctgggtccaactgtactgctcactaatcacctactaacagcaaccttgaatgcccttactatgcaaagaatgaagatggtgactggagccagggagatgtttatccttcctggcctaggaggacacatcaatgggcccaaacgagttaaaagattgcttagtgggtaccttgtttctcagggatgggtctgcccctgcttctaggagcagcgcaactgttttaatgtttccactgagcactgctgcatggagcgctgatgtcccattctaagagaaaatgacagtgtgtgtcaggagtgagctcacagccattggcattcagcatggctttcatcataaaccatctgggtgataagactgtaacctcatacccgtaaccttccttatcttgccttgtacttttcaaagtcacatcagcccctagtatagtgtccttggatacataaccaatggtcagtacaaatattgctaatgttct

SEQ ID NO: 2586 - DNA, 1176 bp, Homo sapiens
actctttcacccatgctggagtgcagtggggccctcatagctcactgcagccttgaacgtctgggcacaacagatccttccacctagaactatacgcgtgcgccactgtacctggctaatttttaaaaatcttttgtagagacagggtttcaccgtgttgcccaggctggtcttgaaccttaagcggtcttcctaccccagcctcccaaagttctcggatcacaggcatgagccaccacgcccagctgagaatgcttgtaaaacacatgcttccagagccgggtgtagtggctcacacctataatcccagctacacaggaggcgaaggcaggaggatcgcttgaagtcaggagttagaggccaacctgggcaacataacaagaccccctcttcccgccccccaccatatctctctctttctctctctgtctctgtctctttctctatagacagggtctcgctctgtcgccaaggctggagtacagtggtgcaatctcagctcactgcaacctccacatccagagctcaagtgatcctcccaccctagcctccccaggaattaggaccacaggcatgtgccactgtacctggctaattttctgtattttttgtagggacagggttttgccatgttgcccaggctggtctgaaactcctgggctcaagtgatctgcctgccttagcctcccaaagtgctggggttataggcatgagccaccgtgcccagccaagaccccatctctaaaaaactcaaagctggatgtatggcatgtgcttgtagtcccagctactctggtggctgaggcaggaggatcgcttgagccccaggagtttgaggctacagtgagtgagctatgatggcaccaccgcactccagcttggatgacagagcaagaccctgtctctaaaatagtaaataaacaaatacaataaatgcttcctatgttctgtgtctcagaaattctctctatctcacctaacatacagaatatatgtataatcctgggctttaggatttcctaggagaccatttctcatgtttatgtattgaaggcctactgtgtttcaggcgatgcccagacaacttgacacgtatcgtttcatttgatggagaatgactgccttgaaatatatacatataatttgttctagatctgttctcagggaagctgagat

SEQ ID NO: 2587 - DNA, 1127 bp, Homo sapiens
gaaattacagggtgatactgtatacctaacgatataaaaaaattttgtttattgtaggtacggctgcttttttgtggtatgacagtgttagaaatgattcgtttgtaatcttctttgcctgttatggtcaaactattatctaattatatttttaaatttatcttttagggacagtatggaaattaccagcagtgaaaaagtacttacattccagtagccagtatctattagcagccatattgtcacctcagcactgtggacacctccctgtgaagagatccttccattccatctagtttttggaaaaaccttgtggataagtggctgtttcatcagtaagcagcctttgtggtttagttataaaaggctttagtagctcaaaaatactcttgatttcacatttctactctagatggcaacattggacagaaaatgcaatgacataaccaatttgtaatgattttggaactgtgtttcaaatggactgttacagactgaaaggtgtgaacagctttgtatgtttatgaagggtaagggaatttaatacttttccacagatttttttgtaaggggaagagggaaatgtacactttttacagcagcaatattttgtatattatgtttatttcatgtggtgaatatgcaaggcggtacactacgcactggacagcatcagaaatcctctgttaatgtggactggaacatggtagatgcttgattgttttggtctcaaaatggtgtgctataaagataaaggtgaggggaagacaaagcacaccatatgtccactgttctgttctcatagaggaaattcaaatcccttttatctattagataatcaagggcactgtgatacagttttgagtaaaaagacattttttaaaagccttccagttttgtggattaaacctttttataaagatcatttataatactgttttaaaatgtgaggcaataagaattactttgtgttggatctgaggaggctttggtaaaacagtttcatctaaatgaaagtggtaatcctcttctaaaatagcaataactgaaaatgaaagtgttaattttaccttgtttgagttatcagggaacttagtaagtaatatcaaagcattttataaatgata

SEQ ID NO: 2588 - DNA, 1132 bp, Homo sapiens
gtaaaattgctaatttagaataatggtttagagattcttaaattatgcacaagaaccagaaattgtaaagggcattaagtgctttaattataagatgaccttgaacacagtccttatcagttttcctttttgaacatgttttgttgcttttttgttttttcctctaaaactataggtataaattactaaggtattccaaggagcgtcagtacatcgatggactgaacaatttaatatataggccaaaaatactggttgataggttgtatacaaacatatctgtaaacctcatgccagagttagctccaatcgaagactattaaaagaagtggctgtcgtggcaaggtagaccacaatgctggatcataaacttggagcgcgctcttagtggaggtcagtgattggctgtgtcacagtgcccttttctctgagaagagccagcagtccacagtgtttacagagtgggactatatacagtcacccttctctcacccgtcctccctgctctgagacacacccctgtggcgagcaccgcagaaacgggaagccactacttaagatcggaagttaagagagctccctccgaagagaaaatttttatactaaaatctataatttaattcaagagaatgcttttatttccgtttaaacatattttgtatatatgtgatataaattaatgtgtgcaaattgtttaaaaattagatgtgttgcagttttgcatgtaatcggttatacctttattggacttttatagacattttttatttgcatgaaaaaaactcactaaatttacatcactaaacaaaggttaacccttgtgtgaaatgaaggaactgtcaataattgacagccaactaatacagtaaactgttatactagttttgagctttagacctcagccttttgtgtggaagaagtcacagctttcttaggctttaaaggaaaagaaggaaggacttaaatagcttttcttcctaccgggattacctatgtttttccttgcttgcaatctcatctgattttgctagaaatcacaaccatattgtttatgcatattgcatgagtattaccaagaaaaatcttaaaagttgtgatgtgacatgatataaaggatctctttatgttaaat

SEQ ID NO: 2589 - DNA, 1140 bp, Homo sapiens
gttcagaagttgcctgtcattcagaatctccataaatcccagtggcaaccagccttctcctgcacctaacacaacgctctccacatatctggagggctggtgcttggagaatcagttgtgcagagtcactaagagccagccccgacttccatatcagaaaagaatatttatagaggcagaaacctctgaactggccatgaagagccaaaagggagggtgtgatattccaccccctgcctcctctccactcctgagagaagaagccgctaccaggaagggcactgattcctggaatgaccaactccatcacattaacctccttatgggccctcataaccaactgcttcctagaaaagagattgacatgttgggtttttgatagcataagtagcattttttgaatcctcagcaagaagctaccaagatagataaaagttttttggggaatgtgagggttatctggctgtgacatatgtcaccccattaatggccaggattgatttggctgacctggctggctaggtgggtgtcctcttcctccctcacccctacatgtgcgtccctcctgaagctgcatgctcgttccaagaggatgaccatccccaatagaggaggaccggtctttggtcaagggtatacaaatagctgcactcccctgctagaacctccaaacaagctctcaaggtaagagttttttggagagataaatagttttctgcattctttaaattccaatcggtatatcaagatttagaccttgctgacttcaccattaagccaggaatagggagaactcaggctatgctgtaagggagacctctgccatgtgggaagggtagagctgacatactccattcccagagcagggggcaaggagaaaagagatgggggagcaaaaagaggcaactcatctggcaacctgctccagaccaaattcccggaggggaaaaatcaatggacacatctaggcaaatatgaaggaagcttggggctagttgttttcttcaccctgtaaaacctaagggagctgagagcctccagaaaaagatcatgccctgtctgatggtataaccacccaatctgttcaccttgcccgctgcctagacagagccaatttaccaagacagggggatttcaata

SEQ ID NO: 2590 - DNA, 1129 bp, Homo sapiens
aaaaaaggaaaatgaatagctctctattacttcttttgtcctgtcacctgaagataactactattttggtgtttctctttccagctttaaaaactaaaaacaatgaaatgaaaacaaaacagttgtaattacaacagcttttctcacttaaagaatgcttttgttattatataatcttcataaacgtttaatgttagtaaaatattctattcagtgcttataaagtactttattttaacatccacttgatatatatagactgtttccatcttttgcttatataaaattatattgtggccgggtgtggtggctcacacctgtaatcccagcactttgggaggccaagacgggcagatcatgaggtcaagagattgagaccatcctggccaacatggtgaaaccctgtctctactaaaaatacaaaaaactagctgggcgtggtggcatgcgcctgtagtcccagctactcgggaggctgaatcaggagaatcgcttgaacccaggaggcggaggttgcagtagccgagatctcgccactgcgctccagcaagactgtctcaaaaaaaaaaaatcgtattgtgatggacatctttgtagataaaatttgttttttaaatgtcttatggaaattttcaaatgtacatagaagtaaagaacagttaccaatgttctgctgttcttgtaagacttttttttaaatgcaggatgatttatttaggattgaaccctagaatggcaataatggaacaaaagtataaatatattaagctcttcattatcttacattaaataactcagaaacagaaagtcaaatactacatgctcccatcgataactggggttggagctaaataatgtgtacacatagacattgagacttgggagggtagggaatgaaggatgagaaattacttatgggtacaatgtatactatttgggtgatggctacacgaaaagcccagactttgccaccaagaaaatatgtctgtataacaaaacataacttgtaccccctaaatctatacaaatatattttatataaatgcatatattttaaagctctcgatggctgttaaactttgtcattctaaacattcttatatttgaatttaatcaacgtttctccttg

SEQ ID NO: 2591 - DNA, 1199 bp, Homo sapiens
aaccaatttgtgtgctcttttgtagtagacctgtttatgtcttgtggaacaacatgtcgatatacatcagtttgagacaaaagcttatgttactcatccttttattttgtaaggggaggaaatggagatccagtgtgcgttaatttgttggcctaagattacacagctactaaatggcagagccaggatccggtttttcctttgtaccatgcttcctctagtaatattattaatatgtagcattaatatttattcatcatatattatgttaagaagttgtaaagcagacttgagtgtaattgttcaaatattcccatctagtccagttatcagtcttactctctgataaatacatatacagttactaaacttctgagatttatgtacatatgagtagcctaacttatttaatatgaatacatatttataatcacttgtttgtatttaattatagagatgaagagagtaattttttttgtaattaatgtgtcacaatgtttggtttagtttctgtagaaaatgtttcctgactgcaatgagggaaagcggagcacattgtcccctatgtcgtggaaatgtgactagaagagagagagcatgtcctgaacgggccttagaccttgaaaatataatgaggaagttttctggtagctgcagatgctgtgcaaaacaggtagagtaaatgtgacatctctcttctttggaagccaagtttctactctgaaattcttatttgaattttcttggttggtgttttttttttttttgaaaagatgaaaggtatttagactgggaattggatagaaaaggccaaaaaaagctgtggtcatagatcttactagattataaacttactgagaaatgagactgaaaaaaaaatcactgaatttcataatacttagcgtggcatttttctaaaagtaatttctcattgattacttgctaaagtaactaaattagcaagctggcatttagctcatttaaaccccattctggtacaaattcaccccttaagtttttctcatggtagcatcattattgcagctttacacatagaaatgttactagtttgggcacatggatttatgtagtttaaggaactctctagctcctcactttacttatgtatttatgtatgtatttaagaaatcacaagggccgggcatggtggctcatgcctgtaatcccagcacttatgg

SEQ ID NO: 2592 - DNA, 1221 bp, Homo sapiens
tgtcaactttctttcagacaaagaataataataacttgggagatgtgaatagcctctaaatggcagagctttctctagactatgcctgtgctaacaaaggtctgaaggaaagtgaaagctaggtcttggtttggaagcttagaacactgagccagcggtagggtgtaattcaaaaactgccgattagaataaaatcaatctccctcactttagaaagaactggagccctagcctcaaccctttctcaattttacttaaggatgccaatcaacttggattgacagcaaaaaccatcaaaatgttacaccttgtaatgaaataatgacagtcagccaaccagatactagataactacatagctgagaggaaaaccctttcaatatctgttataaatatctgtccttgtactgggcttcttaaatataaagaaaaacaaaacttaaagtgggttcatctggagaccactactcctgttataatgcctttttaatccactcagaattttccaaataaactcaatgatgttaatgatttgcctcaacacaggttcagtaacttctgtttgcaaatgtgacatcgcacatctctcttccagcttgtcgtgtcagtctcatgattttgtaaatagcagaacaaatggaacctaagtcctgctagaaaaatcaaagctttgaaaggccactacagaagtggaaatacatttctctcagatgtcagagttcttgtgtgctagtcttgtctctgctctaattaaattcaagtgaagctatttccctctcatgggacatctgtctcctctgtggaggtagagggtggagggggttgggtcttgacctatctccatcatgcttcaaggagaaccaaaaggataaaataacatctcttgttttagttcatgaaacgaataccattatctgaaaatttacgcatgtttaggaaaagtctgttaaaacattttcaagttatagaatcattacagttttggaacacatgtttagttatgtgcttagtactgttttattcaaggatttaaatttaatactgcaaatttaataactacagtaaatgcttaatgtcagctaagaagtataaaagtgaacacttaaagaataattgaaagaagtatcttctcaacacaaatgactgaataaaagattttaaataactttataaatactttttaagtaaaaatttacaaaatgttgtcaaaaagcataccca

SEQ ID NO: 2593 - DNA, 1199 bp, Homo sapiens
ttggataaagcgcagtagattctattttgaaaatccttgtttctttacttaagccaaacagggaacatttactgagctttgcagcacctgattcagagtgttcactgctgatggcacatttccaggatccttatttagtggttatccatgcaactaaactaaacagaacaatgaattacattgaatatatcatttggttgtacacatctcatttctatgctcccttctagtacaaatcaacatgccaacagcctactgcattgatagccacacaactagcccaggctgaaactgccaaggcaggcgcctgaccaaagggcaatgaaaccacaagtcaaacccacagccaatgcagccagaccggaaaaatgaattaggccaaaggatttcatctcttggaatttgaactaacactttcttcttaagggccaatgaccacatcaaaaccaccagtgaatttagaaatacagaatcagagactttatcccagacctactaaatcagaatctgcattttaaccagactcccagaagattcatttgcatggtaaaatttgaaaagttgaaaccactaacttcgttagtagctgcagcagaagtaaaagtggtaggggagcattgagctggagaagttacaggggtccatgatgaatacaaaactatttcaatattccaatttttgaagagtattatattctctctttgattaccaaagagtatatgtctatatccctttttcctttgtcccttcctcctttccttcctttttccatccttctattgagcaatttacttagaatctcttgagccaaattcatcagagaaagccaagtagggagacacgtagaaacagaaaagataagggaactgtgtagggtctacctcacacagtcttggtgtacagttattctctcagtacaattactaatcatgcccccctttggatctcaaatatatcctggtttagacaataaactatatgatatctcagtatgaaactcagtgaggtttatttatggcctagctgttctgcacattctagtcttgggtcccttaaatcactgtctcccttattgggacacatcattcttaaaaaaattgacacccttgtgccctgattttttgaagtagcccacacacataaaaattttactatttaattagtagatactaggtgccactaaagagtaattaaaaatg

SEQ ID NO: 2594 - DNA, 1188 bp, Homo sapiens
gttggtcaggacggaagttggggtaagtttggttggtcagagggagttgtgctggagattgtgaaaaatgggttcttgaatgatctactataaggcagggaaggttcatttgtaagtagtaatgtgaactgaattgcattaagagtgtgtggcctttgttgtgatatactatgtattttcttatatgcatgagccaaactgttgcatcataatttagcactgatgtctgcttttattttgatcatctttgtccacccttattagttcttggctgttaaccgtagatagatcttgtaaatccagcaacctttggttgctgcattccccttggttcgattccacgcaaggagccacaagtgagaactccactgtccttagaagaaagggcatttttacttttgaaccaaaaagagaaaaaaaaatcagaagtgttgcatcttgaggcgaattaactgtaagacatttttaattatgactactgcaatttgacaccatttgaaataatcaattcagagacactaaagatttcacaatattcattggtattgtaaaaaaaaaatactattgtatggatttttgtattgctgttaagtattgttttgtgtgtgtgtgtgtgtgtgtgtgttggaacctcctggggacatgttatattttgaagtgattaaactatttaattgtgtgtctatattttggagtggaataatttcttcattaaaaaatgtttttaaaaacactatatcttgggtggtttattcctttgtttcagtgaatctttcctaaagcaacgtggagtcagtctgttgaaagaaggaaggcaggtacttgcagtttaaagcaggacccattgatggaatattgagccaccgaggcaaaatagctcaccttctcttgccttgggggatgcatggtttttaccattctactgttttattagcatctgtgagcatctaatagaaatactattctgctatttatggaaatccttattataattgatatggaagtgagtttgaaattctaacagctaacatatttcatgtttgtatcacacactgttcttaacactttatgtgacttcactcaattctttgaatcctctgcatctagccatgtattctgcaaatattaagtgctcaatggtttttttgttgaattactgaataaatgaattagtggtgtttggtttgt

SEQ ID NO: 2595 - DNA, 1084 bp, Homo sapiens
caactgccagtgtagattttaaaagtgttaaatagtgactcccttgattaaactgtttgtaattatttgagtagattaataatgaaaatactttggaaataatatacattttgacattctaccaagaggacaactttggttctggaactggtttctatttgtcaaatcagtttccttttaacataattaatccctttaacaaaaagccgtctatgggattaaaagacacgtgaaatgatacttttattattcccttgctcatataactttaaaaataatacttttagctctaatagctcaagaacacaatattcgttaatgttcagtaaagtagcctgagacattttcaatgtttccttaaggtttttgaatgactgtatatttggcagttaagcagtgccacactacagggtagatatggtaaattttatatttgtatatttacagttacaaaacaaatgtacttttaccttttatttctgaccctgtgtgttagagcagttgcatgctctcctgctgttaaaaacacattgttaagctgtggatttgtactcaataatgacttaggataaacatttattttcattcattgctttacatactagacatttttcttctctttgtaagtagattcaaattagatagtcaataaaacatcttgaaaatcccacaagccaattatgtctctctagtctgaatggcttcattgtttctttctcagtattagaaattatagttacaatgaattgcatatgaagaaggcagacatttatttttaatagccaagtagttctgcaaatagttcttttaacaatttgacctctctccaaaacagagacacatataagtagtgctcatccatgcactactaataatacatggcttattccaaagtttttagtcaacttttgggacttggggtgcattttctcacagaaagaatagtagttaggttccctaacactaccgctgatagctcacctgggaactgaatccacctaaccatgaatgtccttcacttgtaacgtggttcacaggttactaatcatagatcctgaccagcatttgtaacactgctctaact

SEQ ID NO: 2596 - DNA, 1127 bp, Homo sapiens
gtatataggtcactagtgttaactatattcacatgattttgcaccttatttctagaactcttcatattgcagaactgaaactctgtacctacccattcaacaatttctcatttccgccttcacccagccaccaatttttctttcagtctctgaatttggctattccggataccttatataagggaaagcatacagtattctctttttgtgactggcttatttctttagcataatgccctctaggttcatccaatttgtagtacatgtcagaatttccttcctttttaaggccgaatagtaatccattgaatgtatacactgcatgttttcatttgtccatggctgtatacttgggttgcttccacctcttggctattgtgaataatgctgctatggactgttggtgtacaaataatatctttgaggccgggcatggtggctcacgcctgtaatcccagtactttgtgggtggattattttatgtcgggagtttgagaccagcctggccaacatggtgaaaccctgcttctactaaaaatacaaaaattagccggacgtggtggctggcacctgtagtcccagctatttgagaggctgaggcaggagaatcacttgaacccgggaggctgaggttgcagtgagcggagatcacgccactgcactctagcctgggcgacagagtgggactctgtctcaaaaaaaaaaaaaaaaagtatgtgaatgtgtgtgtgtgtgtgtgtgtgtgtgtgtgtatatatgtgtatatatgtgtgtgtgtgtgtgtgtgtgtgtgtatgtgagaccctactttcaacttgttgggggcatttactgagaggttgaattgctagattatacattaattctattttcaaattttcttgagaactgacatactggtttccatagtgctacaacattttgcattcccaccaacagagcacgagggttccattttctccacatcctcaccaacatttggtgttttctgtctttgttgatagtagctatcctaatgtatattaggtagtatctcattgtggttttgatttgcgtttccctaataattaatgatattgaacacctttttcatatgcttatggccatttgtttagctttggagaaat

SEQ ID NO: 2597 - DNA, 1205 bp, Homo sapiens
ttatgccctttatttgtttttcttgccttcttgcaacacctccaattaggtattaactggaagtgatgagaagagaacatcttcatcttgttctgtatctcaggaagaaatacatatttcatctttaagtttgatgtcacctgtgggtttttgggttttggtagatgccttttatatcccattgaataatttctcttttactcttagtttgccaagaatttttgttcttgtttttttgcttttactaatcatgaatggacactgattatttatagcacttgacttttagtatatgtttattgtctgtttccttcataaggcattatttctgtcttgtacactattgtatactgagattctaatacactaccttatgctcagtatgtagtcagtaaataaatacatgttacgtgaatgaattattaaatcagagttgcttgatcagaaaagatctgactcaagagaaaacttgcccgttagtgctgaatctgcataatctgacactctactgccacctggtgatagtatatctaaattgcaataaaagcttctcaggaggtgaataagcatgtgagctaaaactgcaaatgattggactgacgtggcaattataatttaaaaatatacatatactcatgatatgtatctggactgcatttgagatttagcacatatatttcacatttaaaagatgctgaaatgttttctgttttcctgactgctaggaaagaatgaagtggatcagttaaattacatatgttaaagaaatagaataaattgggaaagttggcagaagtagagtaagagcaaaggcacattttctatatttgaattcctgctctgtaagcattttcttgctgtaaggtgctagctaaattttaattttaaagaacaagaatttttaacttcttaatatcttgtattaatatttaatatattgcaagaaaatccagcttgtggccaagaatgaaatttaatgcttgttcttaaaaattaaatcctttagttacacagaattcactgagatttaagtgtagaatacaatgggatttctgttatattagacagtttcttggaatgaaatcatctatcatctacactgttatgattaccactatatactttcatttcttagcctctctccgaaaaaacaaaccatgtgccaaatatatgttagtaaaagtttttagagatgcaattcaaat

SEQ ID NO: 2598 - DNA, 1165 bp, Homo sapiens
gacaatgttaaagtgaatatagaagagttagtaggataaaactctgaacatattatttaggatagtagacatgttgaaaataaaatgaaaacactttcattggaccttaagttttttgaagagatgcaggcctcctatttgttatttaggtgaatgcatgaatgaaggaggtgtttgacagagaatgtgtatgtgtgtgtgtaaaacatatgaatggccattgaaaccaaggatacccaaatagtctccaagagagattattacagaaaactgaaactggtagcctcaaggctgaatcagacttacagacatagtatatagtatttggttggcatgatgtttttaaacatttagaatttgagtgcatttagatgacatgacatgaagctaaaatagaatcccaaataatagcaatatttcaagaattagctgtgaaagaggagtctgcaatggagactaatacaagcagtaagaaagactggtagaaaaccaagagaaaattgtgtcataaaagtcaaagggaaaaagaatttcaagaagagagtaataattattgtgtcgtgcttaaagggttatgtgataaggatgaaaacgtgtccattgaacttagtaacagagagagtgagaatggaagataatgggctttggattgagtgggaggtgaggaagtagtaatgacaacaggacttaaccatgaaggggagaagaagcagggagttgtagctgcatgcagacttagagtcaaaggtgggttttgttaagtcaagtaagtcacaaagatatttaaatgtagatgacaaggaagcaatatgaagatgttaaaaatacaggagagggtattattgatcaaaggagatcccagtgatataggacctagaatttgaatcacaggtggaaaaattatcgtcagtcaagagaaggaagattttactactgtaataggagggaatgtggaaaggacaactatgttgcagttgatgggtttgccagcaggtagtaagggtatttccatgtggtattctcaattttctctgtgaatcaggaggtgagatggtctgcttactatagtacgggaggtgaggaacatatagggctgatggatagtgaggttgaaggtttgaaacaacttctgtgaagagcttgagaagtgaaggaaagagtgatg

SEQ ID NO: 2599 - DNA, 1175 bp, Homo sapiens
ggctaagattatgaaccattatttctacatgagtacaattggagtgggccccaccatgttctatctggtgagacacaacagcaacaaaaaataaacaataacaaggaaaaaatccccataaccttgtaattcacataaacctgagtttgagtatcaatagcaatacttattaattatctgactttgaatatgttacctctaaaaaggccttacttatattatccatgaaatatggaaacttgattgcagataagccatgtgatttttttcaaggcttaaatgatgtaacagttgaaagctcctagcatagtgtccagaccttactaggccacaataattgctagttgattcttgactttacctttattatgagagtgctttagaccagataaaatccaggagtcccatggctgatgagatctcagccattgttgttttccttcaacagtcagctagcttctgcctctcttaccattagagcagtgttactcaaagaacagtaacccctatcaagaggatgagggacctaaatgtaacatctgaatgtagcacttccatgtgatgtggcccaaccagccattctggtgcctcctctgctttgtcgtaacttgctctatactccaaacgtagtccctcagagtggtacaggtgtgtaatgattttgcagagtataacagctatgatagaaagcaagtcactggcttgcataaagtgtcacaatagggaggtagaagatcaataataatctcacagtttgctaaaggctttttatttatgtgatgtctgctatagccctgctataggagtgaagaaagagtcccagttctcaagcaacttaggattctgaaagagaaaccaggtacaaagagctagaaacctttggtaaatacacttaggaaggcaaaccaatggagcggtcagtccagaaaatctctggtggaagggaatgcaggcattggagttgataacagggatagattgcggggttctggtattgagttgacactgaagcaccccccttaacttgagcaaaggtgtataaggtgctcagaatagaggtgcccaagagagaagttaatcaactatacttatgagaaacaagcatgaatgttaaaaagaaaaaaaagattaaaaataaataattaatgtaaaaataatttaaattgtcttagagt

SEQ ID NO: 2600 - DNA, 1226 bp, Homo sapiens
taattctggctggattctgggtattttcttttttcctgaaggttctaaatctttatgtatgatcttctctaaaaagcacaaaatatatgtgaatgtgagtccctgtgtgtccacatatatgacatttattgaatgcctactgtgcaccactcaccctctgcaggatttactgggattgctttcactttgtagattaggaaaatgaaccctgaaggagttaaataacttcttccaaggtcacacaaataatagggggtgaagctgagatctgaggttcacatcctttctgtcttatttgacttttattcactctgctacattattgggacagtgctaagggagagagagaaagttagaaaattagtttattattagtaaaaataattgaattttaagtgtgtatttttagacccgggttctaatttctagaaaccctgaggagtcaaaggtgataccaacacagtccttgtaccttataggcactagatgttagttgagtgttttagtcatgggggctctctaagcatgggtttacagactacttcatgggaatatttatgaccaggtaatgaaattcttccttacattactggttatgatactggcaaacctcaaatgcatttgaatggattcagaaattgtaggatttagaatcccatgtggtattccagttaggaagggaggcggtagaattttcagcacacatttctcgtaccttttcctgtgcctcatcgacctttctttcaaactaggcaagagcatgcattaacccaagctggactttaaaacctcctgagaaacagccacacactggcactggattggccaggactctacttaaattatacttattgaatgatagaagagtagaaaacattctccggtctcttttatttatatagtgatttgaggtgataatgttttattttgatttgagtttcaacattttaactacttaagaccaacatagccaaatatttttattgcctttgcttttgagggcagcttttttgaaaacctgtctttgatgcagggcaggtttccctctccctatgggtggggttttaacaccagtttttctacagccactctgaagggaaccaataaatctcagcaagttcgtaaggtttcacattctattagagaaagagaacaaaggaacaacagaattagagacaaatgatttgacggagtgccacgaagaaggttcattagatactaaagac

SEQ ID NO: 2601 - DNA, 1179 bp, Homo sapiens
tttaatgaaaataccaatcaatcttcatggctgttaaagggcattgctgctgtgtcttaataaatttaaatgatcagatgttctttaagaaaatcttgctgatagaagaagcctagttatttcaataaaagtattagacaatgttctggtgtaagaacagaattaagaacctaattatagttcaactatgcggtagtaggctacctaatttataaaattgatgcgtttcaacaggcatggctttttctactctgtgtgagagtgcatgtggtgtgtgtccgtgtgtctgtgtctctccatttatagcattgaactgcgttttactttaatttgaaatagctctgtgttaagaggtgttgtgtgtttgatgctgtgggcaggctggtaaggattttggcaaagatacattcctaaaaagggatggtaactgcattattgcactgtacttcaaggccctaagacataatataaataaaataaatttaatttattaaaacataaatctattctgcctaccttgtactttctgaagtagtcaaatattcaggatgggatacttacaacaaaaaaggagaacatgtactgaatgggccaatgaaataataaaattcggaatgacatccactaggtcaatctgccaccaaacgtttgccaattgcccactttgatgttagctttatattttgcaccatttggattgccaggaaggcaaaaaaaaagtttttttccctcaaaaatctctatagcatttctcggatattgatgctgatagaaagcaaaaaattgaatgtaaatagtataagagatatagaaagaaattaatattaattgagaatacattaagtgccaagaaaaaaaaagaccatttagttcacatatacagtataattaaactttatactgaggaaactgaaacttatttgattagataagttactcagattcagaaagcttgacttttctgctaactagattgcctcagtataagggctaaactccacagaaagggaagcgggagataccatatacactgttattagacaaatctgaatttgatcaaagtcccttgtttttccaattaaaaaaagagccaaatgaaatattttgcccaatttaaataattaaatgcaagatttgggggctgtaacataaatattcaaaagtctacttaaaacagtt

SEQ ID NO: 2602 - DNA, 1218 bp, Homo sapiens
tgctcaggctgaggtactggagtcggaaagagcagaggggacttccaggaagatatggtcgtgtacaaaacttgggagattactggaggcaatgagatcgtaattcagaggctcccagggctgacagaaggagttttagacattgcccagcacatctctcattttatagaagaggattttgaagtttggatgaggaaagtaacctgctgggaagtcacaaagggttgcaatgaccccagccctcttggtgtcgttcttacccagtgctgtccctaacatatcacctcattgtctaaagtcactcaaataaacaacaggaagatttgctggacctcctaccttcacataccactgcaggctcttcaataaatggtattgggtagggatgtgacttgggatcgtgattcattttgtttagggatgactattggtggcaaaatgtgtcttaggatctgagatttgtatgtgataattcttccttgggttatcaagcaggaaacattcatggatgcaagacattctacctaatattatagacgaggctcagatgcggtggaggatcaaggcttacccagatttgaaaatgtggcagaggccctcccctctagtttcaagaaaaatatgattcctgtgctccagaaaagtaagttgataaagtgctgcttctacctaagtgcaataaatctagtataaaatagcagtgtcttatgaggggatgttattgtgaataaggtcactgcttgccatagtcaatggtctaccagttccatggatattttcccactcctctctttctctttttcttgaaataccatgacttattaaaatgccacagtgatggtgatgagccctgaaatagcatgggtggtctcttagttgttcggtctcaggttccttttagatcctcatagtgtcaggaaccctgaccagtttataattcactcattgctacttggcacatcgaacaccaagtcttcttcctcatagcctgagtctccttcggtagctatagctgttattagaagtagagtgggagtgattgagcggttttagatcaggtttactgactaagagtagcaggggaaactgtgtctcattctgcccacctattgattctggggtttctaaactcatctactggttacatccagggtgattattatctgatgaaaacctgaagaatgtttttaaggtggaaaaggctacagataacaggtg

SEQ ID NO: 2603 - DNA, 1408 bp, Homo sapiens
tatggagcttctcacacataaataagatgataatcaaatttgtcttaagatttccatttggccttcatcactttatttcatactgatcacccagcccaagaatcattgccaaagaaaatacagtggaaaaaagcttattaacctgtccaatttctttgcttctgtaatagttatttgaggatatgatagtgagcatattaggcttatcaatgtgctgtcctaagattattcaaaatagcaattttaaaagtcttaatcagagagggttgtttgttagttggaaaagtactcaagaataaaccaggtgaaaaggacaatactgcttccccccccaccccccgactattttcttatgtagtattggtgtatggggaggagtgcccattcagcttcattgatgttcaattgtgtcttttgtgcagggtatgtccttgaacttggaacctgacaatgttggtgttgtcgtgtttggaaatgataaactaattaaggaaggagatatagtgaagaggacaggagccattgtggacgttccagttggtgaggagctgttgggtcgtgtagttgatgcccttggtaatgctattgatggaaaggtaggtttaatgttcgttagatatagttgcagcttctaacaaacatcaaaactgattatgcttagggtttttctttttattttttaacagggtccaattggttccaagacgcgtaggcgagttggtctgaaagcccccggtatcattcctcgaatttcagtgcgggaaccaatgcagactggcattaaggctgtggatagcttggtgccaattggtcgtggtcagcgtgaactgattattggtgaccgacagactgggtaaagactcaaaagcatattaaaagttctaactaaaatttgctcaatggaaggattatattttagtcttggaatggtaaatggtaatggggacattagaatctaatacgaggattaatagtaaaatttcagctgggaagtgaagggggccagcccctccacacctgtgggtatttctcatcaggtgggacgagctagctcagtcggtagagcatgggactcttaatcccagggtcgtgggtttgagccccatgttgggcaccagatgaagggggccagcccctccacacctgtgagtatttctcgtcaggtgggttgagagactgagaaaataaataagacacagatacaaagtatagagaaagaacagtgggcccaggggaacggcgctcagcatatggaggacccatgccgccactggtctctgagttccctcagtatttattgatcactatctctactatctcggtgtgggggatgtggcaggactgtagggttaatggtggggagagggtcagcaggaaaacgtgagcaaaggtctctgtgtcataaata

SEQ ID NO: 2604 - DNA, 1169 bp, Homo sapiens
ctcctaaagtgctagcattaccactgtggctagcgtgagccactgtgctgggtctgtagaatatatttggattattatgatcacaaaactagttttttgttgttgagaaatgggctttgaaaagatccgaggaccagatttttattattattattattattattattattattattattattattattattttgagatggagtttttgcccttgttacccaggcttgagtgcaatggtgtgatttcagctcaccgcaacctccgcctcctgggttcaagcgattcttctgcctcagcctccgcctcccgagtagctgggattacaggcatgtgccaccatgcccagctaattttgtatttttagtagagacagggttctccatgttggtcaggctggtctcaaactcctgcccttaggtgatctgcctgcctcagcctccaaaagtgctgggattacagctgtgagccactgtgcctggcccagattatttttttaattgaattgaattgtcttccatagggactgctgagatgtcctctattcttgaagagcgtattcttggagctgatacctctgttgatcttgaagaaactgggcgtgtcttaagtattggtgatggtattgcccgcgtacatgggctgaggaatgttcaagcagaagaaatggtagagttttcttcaggcttaaaggtaaattataaaataagattttggtgttttaggatctaagtcttctcagttattcatttagcgattcaaagattgtatcagatttttaaaaaactttgtcttaatttgcctcagatttttttcttgttattatcatagattgtaaagagaataaacttaagggtttgaattagccaagtttttttactctagggactgatttatacataacttgtagccactggctccaaaatataaaattgaataaactttcaccccaaatccaagaagtttaagtctgttctgtcttgctgttaagattattttatacaaaagcaaagcatttgataacttcaacaaaatttttctggtggaaattggaagtccgtgactttgtatttctagtgagtagacatattgttcaaaggcgagttttggtgtagctatcagaagctctctaatgtaagtctactttgtattgggttgagcctcatctgtca

SEQ ID NO: 2605 - DNA, 1199 bp, Homo sapiens
gccagaccgtgcagccagagaaaggcagagctggggctcgctagccctcagatccccctcccacccccggtcccagaccctgtgcccctgagccctcctggcagctgcctgttttcccagaagcagatggacagttgctccgacaaaggggctgtgtggcacccatgctgtggttcccatggtaaacccaggcccctcatgtttctaattactcctggtgttcttttcttcctgcagcatgagcagggccaggctggggcattcttgtcatccctgtcccccacctcccctccccaccaggggtccccttatggaaacttctcacacacgagaagactggggcccaggcagcttgaacgagtccgagaaactcaggggtcagccaggaagccttttttttccaccaaaatagttttttttcaattatttaattaatgaatttttatggtggggaaatatacatattgtatgatttgccattttaaccattaagtgccacagtttagtgatattagcagcattcacatcgctgtgctattatcttcaccatccatctccagaactttctcacctaccccaatgaaaactctgtccccattaaacacgaactccccattctcctcccgccagcccctggcagcctttattccactttctgtctctgtgaatttgactacttgaggcccctcatgtcagtggaatcacacagtgcttgtccttctgtgtctggtttatttcattcaggagaacgtcttcagggttcacctgtgctgcaccctgtgtcaggatttcattccccagccaggtggctttatgccttctctttgtgctctaattctttggtttttaaacttaaaaaagaaaaaagcaatggaatcctcccccatcttttcccccttcaacagagtctcatacggaggtctagtaaatacagcacacaaaagcagcaaggctctggctgaactgggggggctagagaccctacaccccaagcctggcattcctggagacacttcctggggatggaaagtgcctgcatgcctggagagaggggccgatttgattgacttgggtcatgagtgagaagccccttgagtctgacatttggtcttgagggcctccccagtcactgcacttccctactgccctcctggcttccctcctaaatgtcctcttcaggtcttgggccccagccaggc

SEQ ID NO: 2606 - DNA, 1272 bp, Homo sapiens
ttattcttgattacttcacactttacgcattttcccttcttgtaactgtagattttgcctcctattagttatgaaagtttaaaacccgggggagagtgggcttacaaattttcaatgtatttttgtatagtcttttgagattagagtgaagttctaaaaagtaagagaaccttttgtgaaaatattttaattgacactactaagagtttaaaatagtattggtggtgaaaaatcgttaaaagtatctgattttacttgcaaaattactgtattttcccacaagaggagtccttacaacattcttgtttttagaagggtttgtttccatcattcatttaaattcataaagataacgttttcatgggtggagaagtctattgggaaagtcataattcgaatttctatcttgctttgcagtttgctttctatgataagttgaaattattacttgatgttcaaggtagtctctacatcatcctttcaatatttctgctaggttcgatacaagaggctgttttcctagcgtggcttgctgcctttggtaagaacatgtcgtccatcttgccattcacgccgccagttgtgaagagactgctgggatggaagaagtcagctggtgggtctggaggagcaggcggaggagagcagaatgggcaggaagaaaagtggtgtgagaaagcagtgaaaagtctggtgaagaagctaaagaaaacaggacgattagatgagcttgagaaagccatcaccactcaaaactgtaatactaaatgtgttaccataccaaggtaagttttgttagatcccaggtttgatcaaattatgtcaaggaatctgaaggaaagttactgaatttgtgttcctttcaagttgcctgtaaaaagtgatgattgaaatatgactgtttttaaccttgtataaattgtttttgctagctgacttgttttataaattattttcttgaatagtgaggtttaatcaagctaaataagatacttagatttattatcttcattgcctacatttgtatgttatcctcatttccgtgattgaatgatacttgaataaagaattgaagctttttctatcactaacatagtagcaacctacagttttctcctcctttagtcaaaactttcatcaggggtgaaaagaggctgctcactttttaatgaattttatatggtttttctttgcgttgcagcattgcttccaagaaagaatagtgtgttaggtggcttcttaattgttgtaggcattagtcagaacctgtct

SEQ ID NO: 2607 - DNA, 1146 bp, Homo sapiens
tcgaattgggttcttccttacccctcagctctccacccgtctaaggatctttgggaaggccactcatagacaaaatgtatagcacactgagtttggtggcaatttagacatgtaaaggtgaaggcagacaactggttaaaaaaatgctatttgcagaataaaaggattgccttttaaaaatgatttcattgaggcaggactctggagcaagcctgggaattcatatttagcaatgatagtttgtggtgttttactaattaaggatgttcctggtttcattctccttcctttcttccccagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaaggtaaataagtagttgctcggttttgtttgtgatagtagaaagatttgtggttgctgtgatgactatcttaggacacctttggaataactatgaaagaaaactattctgagcaaccctttcacctgtcttattttggcttttgtaagtttgtttcttgactaataataaatggtaagttttctgtaatcccagcactttgggaggctgaggtgggtggatcacaaggtcaggagatcgagaccatcctggctaacacagtgaaaccccgtctctactaaaaatgcaaaaaaaaattagctgggcgtggtggcgggtatctgtagtcccagctactcaggaggctgaggcaggagaatggcatgaacccgggaggaggaactaggagtgagccgagatcgcgccactgcactccagcctgggtgacagagcgagacgctgtctcaaaaaaaaaaaaactggtagttttatattcagtacctcaggcccgtatgattatctgctgatggccccacttagatgtacatagccacttcaaaatgggccctctccccaaatctaagaagcttgttttcagtaattgatcacatttagttcttttaagtcaagaacctgagtgattctgtacacttctttttacatctaatgaacttaagt

SEQ ID NO: 2608 - DNA, 1146 bp, Homo sapiens; identical to SEQ ID NO: 2607

SEQ ID NO: 2609 - DNA, 1146 bp, Homo sapiens; identical to SEQ ID NO: 2607

SEQ ID NO: 2610 - DNA, 1543 bp, Homo sapiens
ggtcagtcggcctctgaggtccgcagagggacgtgatgggcgggaatggggactaccgggctcctccactggtgggggcgccggcccgccgtggggtgcgggccgcctggggtccgtgcggactccggaggtccggtgtctagtggtgagtggtggccgcaacgaggaaaaagttttgggggaaagaaaagtcgggtggaggcgtaacacgttactacaagagtgttgcgtacaggagggctcttaaagtgggtcatagcccgaaggtgttgagagagacggcactcactacctgcagccctgacagcaaaggggtttctgtagagcgggagggaggaggtgtagagggttacggttgagttgtgccctgcggatgcgtcgagtcattttacgcctggaagatccagcattggattgaaacaggctgtattttcttccaaagggttgactggattggtgaggcccgtgtggctacttctgtggaagcagtgctgtagttactggaagataaaagggaaagcaagcccttggtgggggaaagtatggctgcgatgatggcatttcttaggacacctttggattaataatgaaaacaactactctctgagcagctgttcgaatcatctgatatttatactgaatgagttactgtaagtacgtattgacagaattacactgtactttcctctaggtgatctgtgaaaatggttcgctattcacttgacccggagaaccccacgaaatgtaagtggacaggaggtagatacccatttcctacttggggcttggcataagataccaaaaattaaccaaaacgttttattttctagcatgcaaatcaagaggttccaatcttcgtgttcactttaaggtatgcgattcatagttgtgatccaacagttcctcatgttccactcaaaaaaggtagctgcagtgatgactttcttaggacacctttggatttaccgtgaaaattaataaattctgagcagccaccttatatttaggcattgatgatcagggtgtaaggatgtagcgtttgtgaaattgagaagtagtaccagaaaaccatttgaaaacctagtgtgcagatcaagatggggcattttaattgtaattacatgatgatggaatttaaacgttttatagtgaataaatggagttttggagttttctctagcttcaacgaagtttacctggcttttagtcacaagtttttttaattgccttgcccccaaagaatagaaataactcgacattttgaaaagctgaaaattgaaaatttaacgtttactttaaaaattaaagctttgatctagttaaccaacactttattcttcatacttagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggtgagaattcttagttgccatttgaaaagacagattttaatggaaaagtgatgggatagg

SEQ ID NO: 2611 - DNA, 1543 bp, Homo sapiens; identical to SEQ ID NO: 2610

SEQ ID NO: 2612 - DNA, 1543 bp, Homo sapiens; identical to SEQ ID NO: 2610

SEQ ID NO: 2613 - DNA, 1543 bp, Homo sapiens; identical to SEQ ID NO: 2610

SEQ ID NO: 2614 - DNA, 1259 bp, Homo sapiens
ccacgcgtagcgctgcccgcctcaccccagcccgagggagcccaggggacggggctcggatagaccacaacgcgccttgagagcggactctttcctcacatcctcatttttagattttctccgtttccaaaccgagagaatttggtttgacacctctcacccatcatatcctagccccgacaggcgatgactcttcccctttgtctccgccaacaccctaaacactgggcaggagccaagggctgaggaacttggcgcgcgggcggccgcggccgccagctgggggcgggaccgaacgtcctgtgggcggggcgcggcggcggcggcgggattggctggggcgggcgggtgcgcagtccgctgggcagaggcttgggccgccgagctggacccggaccggttttgggtactgtactgggggcagggcagagaggtgggcggcagttggggtgcggtgattgtagtaggctagggcgctttcgggtccccattgcagcccccggatgagcccgcagtattttccttatatgatcaggtcccattgcgggcggcgccgcttgcccggagcctgagaggattatgaaaacgtggcgagcgaaatggggccaggggacctggagcaggggcgtgaggagagtaggcagcgggtgaggctggacgggagggaggtctagggaggcctctgccgcgggcactgtgagtcctggccgatgatgacgagaccactgcgcaatctgagttctgggaaccaggtgatggagtatgttctgagaacagactgaggccgggcaagcaggaggcggccgcggcaggggagaggcggagagcccctcgataccagggctcggagggccgggctgcctagcgagggcttcttttgagtgcgtaggggtggtgggtggcatggacggtttctctgagtcgtcagcgaatgccccccctagaatcctgcttttcaaacactttggtgacactcttgcaatgttggggtgtttttaaatccaaatttgtattatgaaaacttacaaacttacagaaaagtgggaagacttgtacagtggacacatatcgacccaattgttaacattttgctatattgctatccacctgttcttccatcaaaccatcttatctttttaatgcagaccttagtactctacacccatgaacacatcagcacacattattcatttacagttctttttaaggcaaaatatccacgcaatcaaatgtacaaatcttagacaagcttcacaaat

SEQ ID NO: 2615 - DNA, 1101 bp, Homo sapiens
aggttcactcctttttgctggcaaaaaccatttagtatcaaaaaaaaaaaaatgcgtaatttcgtaattagatttagaacaaggcatttgaataatttttatggtggatttcataaattacttttgccataccctgcagagactagataatatatatttcagttgaaatctaggaagttctaaaatgtaacttttttttaatgctaaggacttactctctctatattggaaagttctgatatgattagtacataatattccaaactgtaaaatgattaacatttaaaaatacggtttttaaaattagtgtttcttccataatgctgtcatgattttgtttacttaaatgggtttgttacagaacaaatgtaatagagatggaccaagcatttgtaattcggagtagctttaggtctaaagacgatggtgaattatgtaggtttaagttgttggaattaaaactaaaagcttcttttgataaaagtcgttataacattttgtgactctattaatagaagtggctttttctttgctttccaggtttttgggcgagttttaaagaagtattgcatcttcgttttttttatttttgaagtgggagtgtatgtttctgtttaggtcactgccttcattgtaaatcttgagtttagaaaaaaccaaactgcaaatctgtttttcagacttaatgaaaatttgtgccgagaaagtcactttgaaatattttggaataagttttacatgaatgattgatcttttatgatagctttgctgtttgaagcaattctccctctactaggaagcagcaaatcttacttttaaaaacctctgcttcactttcttaagctacattttagtcgagcgattgtgtgtgaattctttttctgtattccccttcagtttttctttctccccgcaaattaaggagcgagaattaacctaatttatgctgcccagtcacactccagctctcccacttggaagcagtttttttctgattgagccagtgttatagtaacatcattagacactattctaattgaggtgtgagttactgaggcctctgctagggaggttaaccctacagaatctgtagggttcatt

SEQ ID NO: 2616 - DNA, 1175 bp, Homo sapiens
ttctccatgattcgtgcatctcgaaacaaaaatgggcctgccctgggaggattatcatgtagtcctaatctgcccggtcaaaccaccgtccaagtcagggtcccttatcgtgtggtaggattagtggttggacccaaaggagcaactattaaaagaattcagcagcagacccacacctacatagtaactccgagcagagataaggaacctgtctttgaagtgacagggatgcctgaaaatgttgaccgagcacgggaagaaatagaaatgcatattgccatgcgtacaggaaactatatagagctcaatgaagagaatgatttccattacaatggtaccgatgtaagctttgaaggtggcactcttggctctgcgtggctctcctccaatcctgttcctcctagccgcgcaagaatgatatccaattatcgaaatgatagttccagttctctaggaagtggctctacagattcctactttggaagcaataggctggctgactttagtccaacaagcccatttagcacaggaaacttctggtttggagatacactaccatctgtaggctcagaagacctagcagttgactctcctgcctttgactctttaccaacatctgctcaaactatctggactccatttgaaccagttaacccactctctggctttgggagtgatccttctggtaacatgaagactcagcgcagaggaagtcagccatctactcctcgtctgtctcctacatttcctgagagcatagaacatccacttgctcggagggttaggagcgacccacctagtacaggcaaccatgttggccttccaatatatatccctgctttttctaatggtaccaatagttactcctcttccaatggtggttccacctctagctcacctccagaatcaagacgaaagcacgactgtgtgatttgctttgagaatgaggttattgctgccctagttccatgtggccacaacctcttctgcatggaatgtgccaacaagatctgtgaaaagagaacgccatcatgtccagtttgccagacagctgttactcaggcaatccaaattcactcttaactatatatatatacataaatactatatctctatatggactcgtaaaggcatgggtataatggtaccccccagtaaacttcctaatgatttct

SEQ ID NO: 2617 - DNA, 1186 bp, Homo sapiens
ggaaaatgtgtctgtacacataccatgcttatgaactaaaaatacttttaactagattgaaaaggttaaagaaatgtacatacacatatatacatacatatgcacacacaagaatgtgatcactgctggtgcagcatgtaaatacgaacacattcctgatggttgctatatatggatgagtagttgtagtaagttcacttcacctcaactaaaaaataaaagtgatgtttcatagaacttagtcttccacttgatctggaccctcatcttgaaacctcatatgataaaatggagaacttcttttaaacataagaaggtagtaatcacctgtggtcccagttacggggctggggcgagagaatctcttgagtccaggagttcgaggctgcaatgacctatgattgtgcctgggcaatagagtgaaaccccatctctttaaagaaaaaaaagaaaaagtgtgatagtcttggtttgtatttcctcatcattaaatatttgatttaatggtaagaaagttattgtgagcactttcacaggtcctccctcaggctgtggggccaggatttggtagctggtgctgagagaaaacctttgttggcatccttgccctgggactgtgccagtggcagctgtcattcaatgggacaatttcttctgattaaaaaaaaaggttattgtggttaaaaaaagattagttttctcaagttcattagtttcatttagtgccgttcacaattgttcgttttctagtattctttcattaacagagcattctgttttctttctaagcaggctgtctgcataaccttctgtgaactatgtgctgatgtcttgtaggcaattatatttgacaagattattctgtatctgtgattgaactccttgaggaatagatgactaggctattctcagtagaacatcttaaactttgaattttactctgtggcagttctcctgggatatggtttgtttggttttgggatgatgtttttgttcagactgactttgggtattgcagagctttttgtttgttggttttccttgtagttggaaaagttatttcaagaagtcagattgttgtagtgctcatttggatttgtggccacttaacattttcttggatgttgtgtaaattttctgatgttaaatttattttattttttttgagatggagtctagctctgtc

SEQ ID NO: 2618 - DNA, 1185 bp, Homo sapiens
tcctccagtagaggatttttctaatcattgacagaaacaaggtttattcatttcatttttaatagtactcttaaagtaaccaggatctttttcttaaaccagaaaaaattagtcacttttaatctgttttcattgcatgtcagtgtattgagggggaaagtctggaaatttgctatattgggcatgaaggacatgagtttaacatacgcttctaattccagattcttttgtgatcgacatttgatttctaactatctaaaaatagtatgtcaaatatgttttactcatatagcatcattttttaaattaacttctctaaactttcaaccttgtttttaaaaattgctatttaaaaaaaaaaaaaaaactgtgtgaaaccaaaaatagcctgcatgtgttttatttttaattccttgtggctgggattggaggggaggtcacagtttgcttcaacagtgaaaatacattgcatgccagaaaagatccaaggataaaaattaataccaaggttttaaactgattattagtatttttaataactcatatttaaaatcaataggatgtacatataaacttatttttgtttttctaggtagttggcaaaaaaggagaaagccactaaggtacaaaagacactggacaaccatattgcaatcagatctacagctcctggataattgcttgattctcgccagagactgtcaatgtttcattcattgccattaccaataaatcattgcttttgttcagatggtatcactagtgtttccattgtaatcttgacacatgcaattgtaaataaaagtcaccacttttgccaagcttaatttttgtctttctaaatcagtattttctctttccatgtatttgaaaactggttaacttctgattttagtagagacttaagtgtctggtagtatattgattgaaagccagtttctttagaaaaggagaaactgttctagggaattaagaagtacatgtgtacacattcatggcaagttattttgataagtgaacctggaacagctaaccatgttaaattattactgcatttttattaaaggacatttgtatatctgagctatggaaattactcaaattataaattagaagaaataaacaggtttaatgagatttagctactcttacctaaaacttagctaatgggtccacagattcttt

SEQ ID NO: 2619 - DNA, 1211 bp, Homo sapiens
ttcctctgactgtaacattactttattaatcttgttgcttttaagattttccgtttatcactggttttgagcagtttgattgtgtggttcttcagtgtagtgttcttcatgtttcttgtggttggggttcattgagtttattaattttgaaaaattttcaataattatttcttcaaatattcattctgccctttcctccctcctctctctaagggactgaaattacatgtacgttaggctgattgaagttgtttcacctatcacggtgctcttttatttcgggattatttttcctctctgtgttttgattgagatagtttccattgcaatgtcttcaagtttattagtcttttctcagcaatgtgtaatatgccattggtcccatccagtgcactttaaaaatttatttttatttttttttatagagacagtgtctcgctatgttgcctaggttggtcttgaacccccaggctgcagcaattttccctgtttggccccctcaaagtgctgggattgcaggcatgagtgaccatgcccagctgtcatccaattcacttttaatctcagacattgttatatgtgtccccagaattttgatttgggtcttaaaattttttttccttgtctctacctaactgctttgaatacatggattgcagttataataaatgttttaacacccttcactgataattttgatagctctgtcagttctgggttggtttaaattaattattctcctccttgtggactgtgctttcctgcctctttgcgtgtttgataatcttagaatagatgggagatgtttgaattttgcctgtttgggtgctggacacttttgtgttcttaaaaatcttgagctttgttgtgggatgcagttatgtcatgtggaaacagtttcttttttttcctggtcttgcttttatgacttgttaggtggatttggagcagtgctctaagatgaattactccctattactgaggccaaaccttccagaatatccaatgccctgtgaattatgaggttttccatttaggctgttgggagcaggcactgtttctggtcctttagatattttccccccagctcgagtagtttctttacagacatgtactgattggtattctgctgtatacttgagggagatcctctgaagaactttgatctttgcagctcccttctttctgtacattgaattctagctgccctg

SEQ ID NO: 2620 - DNA, 1192 bp, Homo sapiens
ccactgactcctctccttcttctctttcccttcaagcgtgcaaacgcaaagagcaagaaccaaacaaagacaggaacaattcccagaagaagtcccgcctggtgttcactgacctccaacgccgaacactcttcgccatcttcaaggagaacaaacgcccgtcaaaggagatgcagatcaccatttcccagcagctgggcctggagctcacaaccgtcagcaacttcttcatgaacgcccggcgccgcagcctggagaagtggcaagacgatctgagcacagggggctcctcgtccacctccagcacgtgtaccaaagcatgatggaaggactctcacttgggcacaagtcacctccaaatgaggacaacagataccaaaagaaaacaaaggaaaaagacaccggattcctagctggggcccttcactggtgatttgaaagcacaattctcttgcaaagaaacttatattctagctgtaatcataggccaggtgttcttcttttgtttttaatggctatggagtccaagtgcaagctgaaaaattaatctcttagaaccagacactgttctctgagcatgctaagcatcccagaaacccaaatggggccttcctggagcgagttaattccagtatggtgtcaaccaagctcgggattgcttaaaatatcatccatcccacttcaggtcctgtcagcttcttgcagtcagagttcctatgagtaacaataggagtttggcctatgtaaggactctgagtttaggcttccaagatacaacaataagagaagaatctagcaacgagaatgacctcatttgctttccacatgcttagcctcattataccatgttatgtccaagttcacagccacaacatcagaatggtaattactgagcacaagttttaaatatggacgttaaaaaaaaaaatccaaggacctgtttttccaacccagacatcttttcattgaatgatttagaaagctttaagttgatccagcttacaattttttttttctttacctcctggaaatctcatatggtcttggatccgtcaaaaaaaccagtcagttcacttgcgctcaaagtatcaagcacaacaaagataaacagaagtgaggaaggttctgggttcactacatctggattttcaagacacctattgtgaagtcattagggaattgatgagaatat

SEQ ID NO: 2621 - DNA, 1122 bp, Homo sapiens
tggtttccaggattgagacaatggtactgcggtcttggggagactgcgttagctagtggggagtggtgatttttttcatgcttgtcacatctaaatggtctttaacatgagaaagttttagaggttataatttcctgctttgtttttatttagactatcaaatgaagttatacatgttgtcagtcaaaaaatgaagacaccctctgccccaccccacagaatgctttttatcttgtctctttgggttatgacccaacaagctaagtaccattaatgtaattaacttatttaaattagttcctagtacataaatgtataggatttgggtaattatttaatcatccttccttagtttgattctactccttgtacttatttatcaaaacctagaccaatggtgcatcagagatgcaaaattctacttggaatactcttgaagtttagtttgctttataaagcagtgaaattctgttacagacagggaagaaatacaggttacaaaaagagaatttgggatattcttccctcttaaattaacttttaaaatagtctaagtaacaatttttaaattatttaacttaagttcgcagccccacctggtaccaggcgaacttcacctcttaattattgtggccctcggagccttcatattgtaacttatttatttaacttattcagcatctgtgaaaggtgcactgtatagtttatatttttaatttaaaacaacagagagcactgcagtttgtttgctgtcagaacaacagagcaaattttgtggacaagcaatgactattcagcctgaacctgtgcattcagaaaacataagctgagaccctgcttcaccagcctggatttcggggcttctatacagaaactggaaaaataaattttaaaaaaatcgtaaacaaaaagagagaaacccttacactagctgcttccaagaatgaactctgtgtgtatgtaaagcaacaaaacaaaaaaggaaaaaaacaaaaagcagaaaaaagaaaaaaaaaatgaaaaactttctatttctagtgagaaccaaagaaggctacctcactgactttttccatttgtaattttaatcgtgttgatgacaccaaagataccaaagatttc

SEQ ID NO: 2622 - DNA, 1160 bp, Homo sapiens
aaattattctttacacaaatgtgtatgggttaagggtaggtgtgtatcctctactctgttgaattgataggaggaaggactggtacagggtgaaggagctgcttctgtcttgttgcgatccaagttgtaaatgttaatgaagtcttgtttgacctcaggatatcccagaagctcctgagagactgatgacagacaccattaatgaaccaatcttgctgtgtcgatttcctgtggagatcaagtccttctacatgcagcgatgtcctgaggattcccgtcttactgaatctgtcagtttctgtttcaaagagtattaataattttgctttttaagggggtggggactgtcatctggaatcaggtacagctcatgccaaatatttcattctctatctagaataacaatatttaaagacgttgggttttttcaccctcccctgattgaagttgacatgctttgttaaattagagaaatgtaaacatttgaatattacatgatcatagtggctcctttagcccttggagcttaattgtaattttcatttaaactctagggcagtgctgtgtctgatcgcttgatagtaattgtgtatcttctttcacttatatttaaaggtcgacgtgttgatgcccaatgttggtgagattgtgggaggctcaatgcgtatctttgatagtgaagaaatactggcaggttataaaagggaagggattgaccccactccctattactggtatacggatcaggtaaaaccaattttttaagtactcaacatttttttccactgtaatcgttctgtatatattgaaatttttaaaaggggagaattcagggtagtactttggtatttgaatgagctatattcagtttgcaggttataatgtggtgtgtgaatattgccagctttgttttggccaagttatatgttaatttcatttgaaaacctgtttaacggccggcttgttgattgcaactgagttttaaaaaattgatcctaccagtatctagtacccttcttcattttcctcttataaatagacattgacttattttaaaagtttttaaaaatctcttctttccagggtagtacttattccctggttgattttttcataccaaattatttctttatgcatggttcatgaaggcatagagatta

SEQ ID NO: 2623 - DNA, 1200 bp, Homo sapiens
gaattcagcggcctcaaaagtcccgcctcttccaagccccgcccaccgcagtccatctttaggccccgccccaattcggctcagcccgccccagcgtagaggcaccacctttcctcgctgcagtcatccaatagccaagatacacggctaggtgatttgcgagcgggagttaggtgtcctcttggcgcctgaccagagtcgggaaattcagctcctcttgagtagtcccttccccgagttgccccccgaggtatgcggggtcactcgctgctcgatgttccctccgaagggtcggacaaggctccggagccctgtagctgccctccctaggagccccgggtcttcactggccgaggtgcccaccccgcagcattctgggagtggtagttttcttccttcaggttcattcctggctggccagtgcccaagactggcgagactacgattcccagacgcccaagcgagtcgccggtcacgtggccgcaaggacgctgggccggtgggcgggggccggcaggtgctccgcagccgtctgtgccacccagagccggcgggccgctaggtccccggagaccctgctatggtgcgtgcgggcgccgtgggggctcatctccccgcgtccggcttggatatcttcggggacctgaagaagatgaacaagcgccaggtgacggaggagggtggtgagcgcgccgtggccgggaccgcctgtgctagcggggagtcggggcttcccagtcagggctccggctcccagtgaatgcggccgggcggccacccgaagctcccgcgctgggctctcaggccctgggttctacgcctacgtgtgggcatgggtgtgcacttccttgccctgacaagagcacaattaggggagggtgcaggaaaggggagaatagaaaccccgtgccatggaatgtcaaatgtggttgagaatgccacagccacgcttgtgggagagatgactcggtgaacgacagctctctgagcgtatttgaagggccacccggtgaagagggaaccgatttctctgtggggcttcagaggcctgactgccggcaggtggaagaggcagaaaggcaggcgagagggaagaactttcctacaacgggagctgtccagcgatgcctcccaaagcagtttcttcccagcctgggcagttgtttttcccctgaccgtgggtcgggactaaataatgct

SEQ ID NO: 2624 - DNA, 1214 bp, Homo sapiens
actttgcttgaaaatcactcagcaaagtagttcacatgatgtgtatcatatttgaagtgtggtttttctcaaaatcattgactttaaggagctcatttctgaacaaaaaggtttgctctgtggaaaaatcaatcactgccaggattctttcatttctgtactattttgtataattgaatttgttcacttctctcacaccagcaagtgttttacaggtgccttggattaaaacaaaattgattttaaaatttttatgtaagtcattgtgtctatgatgccacttttaaaaggaaaatgcaattgcgtaatggcttatatccttatttaatgtacctatttgtgttctaataattgtttgaatgttttattcagcttaaaactttaccatgaagtcataaacagtaaacaatgttttgttatgtattaaggggatatcagtgtttctcaaagtatgatccatggaccatctgggtcatggcgcctggtttcagacaacctgaatcaaatcttaggggtggggctttgggatgtcattgttcaataggcacctcaggagattctgagcacaccaatgtttgagaaccactaaaatgaggagtgggaaaaaaaaaataggtgttttgttaatttagagctgagctgagaagataatatatttttattgtcaatgacattaacagatatgcactgattcttttatacctacaatttacttaatgttccttttattaaaacgcgtggttcatgagcaactacagactgaatccagattattacctgttgctttcagtattttcgtgatggcttttaatcttatgaaatcatcttgagatcattcatggtcaagccatgaaaactcccatcttcaagcctgcctgctaaagcttctttgccttcctgattgtgattatggtaacaatttatatcagacagttgtactttttgataacttagggaaaacagaaatgacttgaacaagggattgcctgcctcactgcattgcagagatacaatttttgtaaagaacacaaatagcagttgtgaatattaaggtgtgattatctttccctgtccatgtgcttattgaaagaagatagtgaacaaatgattatattgaggatttttttaatttataagatctaatgtgaaatccacacttggaactttttagatctgtctgttgcttgtttaatatatttcttttatgacattac

SEQ ID NO: 2625 - DNA, 1194 bp, Homo sapiens
tgtgcctgtacatgggtctgtgtgtgtgttgtgtgtgtgcatttgtgtgtctctatgtgtgcatgtgttgtgtagtgtgtgtgtcttttgtatgtctgtgtctgtatgtcagtgtgtgtctgtgtgtgtctgtgtatgtctgtgggtgtctctgtgtctgtgtgtcagtgtgtgtctgtgtgtgtctctgtgtcagtgtgtgtctctgtgtctgtgtgtgtctgtatatgtctgtgtgtgtgtctctgtgtctgtgtgtcactgtgtgtctttgtgtgtgtctctgtgtctatgtgtgtctgtgtatgtctgtgtgtctgtgtgtctctgtgtcagtgtgtgtctgtgtctctgtgtctgtgtgtctctgtgtcagtgtgtgtctgtgtgtgtccctgtgtctgtgtgtgtctgtgtgtgtgtgtctctgtgtgtcagtgtgtgtgtctgtgtctgttgtgtctttgtgtctgtgtgtgtctgtgtatgtctgtgtgtgtgtctctgtgtctgtgtgtcagtgtgtgtctgtgtgtgtgtctctgtgtctatgtgtctgtgtgtcaatgtgtgtctgtgtctatgtgtgtctgtgtgtcaatgtgtgtctgtgtctatgtgtgtctgtgtgtcaatgtgtgtctgtgtgtgtctctgtcagtgtgtgtctgtgtgtgtctctgtgtctgtgtgtcagtgtgtgtctgtgtgtgtctctgtgtctatgtgtgtctgtgtgtcaatgggtgtctgtgtgtgtctatgtcagtgtgtgtctgtgtgtgtctctgtgtctgtgtgtgtgtctctgtgtctgtgtcagtgtgtgtctgtgtgtgtctctgtgtctatgtgtgtctctgtgtcagtgtgtgtctgtgtgtgtgtctctatgtcagtgtgtgtctgtgtgtgtttgtgtgtgtctgtgtgtgtctctgtgtgtgtgtgtgtgtgtatgtctgtgtgtgtgtgtctctacatctttgcgtatacaggggcatagcatagtcatgcaaaaccgtcttccttcaactcatagttctctccttcctcaaccagaagccactctgctttgttgtgaaaacaaataaactactttcttacaaaagaaagaccaaataacctgaaaagctcaaataaaatccaccttatgatacaatattaagaaacagaaattttcaatggagaaaa

SEQ ID NO: 2626 - DNA, 1264 bp, Homo sapiens
cttgaaatagtcttgtaccgttggatgcactaaaagctctctctttatcttgcaggtggtcaccatgggccttttccgcactattgctttgttttaccttggaagttttgacagcatagttcgtcgctgcatgatgcagagagaaaaatctgaaaatgcagacaaaactgcctaatcttcttaccccttggaagaagactgtttccaaataatttgaacagcttgctgctaaatgggacccaatttttggcctatagacacttatgtattgttttcgaatacgtcagattggaccagtgctcttcaggaatgtggctgcaagcaaggggctagaagttcacctcctgacagtattattaatactatgcaaatatggaataggagaccatttgattttctaggctttgtggtagagaggtgaaggtatgagaattaatagcgtgtgaacaaagtaaagaacaggattccagaatgatcattaaatttgtttctatttattcttttttgcccccctagagattaagtccagaaatgtactttctggcacataaagaaatcttgaggactttgtttaaaccttccataaaaaaacaattttcggtttctcgggttctctctctctctctctctgtctctctgtctctctgtctctctgtctctctgtctctctgtctctctctctctctctctttctttctttgtgtattttattcaagatgagttggacccattgccagtgagtctgaatgtcactgacagccctgtgttgtgctcaggactcactctgctgctggtggaaactcatggcttctctctctctttgatcccataaagctacgagggggacgggagagggcagtgcaatgggaagtaaagagatattttccagtaggaaaagcaatgctttcttgtctttagactcaaatgcttagggaacgtttcatttctcattcatggggaaaggcagcctccttaaatgttttctgaagagcggtaaaatctagaagcttaagaatttacagttccttcaataaccatgatgacctgaagttcacctatcccattttagcatctacttgtttttcccatctcttcctttccaattttgcttatactgctgtaatatttttgtaaaaaaaaaaaaaaaggaaaaaaaagaccagctaaaattttcgacttgactttttaacttaactcatgaattaattaaagcaaatgaaaaaattaaaaagtgtgactttttctcggagcatatatgtagctt

SEQ ID NO: 2627 - DNA, 1181 bp, Homo sapiens
gcaaagagcatttatattttcttttttttttactaaaatgatatagggtttattttatattttcaaaaaaattgttaaacatcattcttatcaatgtaaaatttacgttattaaaaaattacaaatgatagaatctttactcagggatgggcaataaaacagcaaagagctttgtgattgggtttgaaagattttgaattatagacagtgctcttaatagtttttaataagttgatatttttttctgtgtagatttaaataatttctttaaaagcgtaagctttggctgggcatggtggcttatgcctgtaatcccagcactttgggaggctacgatgggtggatcacctgaggtcaggagttcaagaccagtctggccaacatggtgaaatgccgtctctactaaaaatacaaaaattagctgggcatgatggcgagtgtctgtaatcccagctactcaggaggctgaggcgggagaatcacttgaacctgggaggcagaggttgcagtgagctgagatcgcgctactgcattccagcctgggcgccgagatagcgccattgcactccagcctgggcgactgaataaaactctgtctcaaaaaaaaacaaaaacggtaagcttttatatttaattaactgatacctttcactgtgcaatctcaagaggaagattttctaaattagacattgtctttaccttaaagaagaaaattgtctatttcagtgtcttttttagcaagattgaccaaaacaggtggtaggtgtgtaatttttaactgtcatgaaatactgtaatgcgcacctttgctaataaggaaatggtctccctttgaattatgggaagtttcttgtctgtgatatggggtgtctgtgtacatatatgtatatttccttttttaatacaggataataatatggggtcttgtccttcaccttttaagttcagggaacagtttgtcctgaccacacatatgttatcagtgtaatgctttatgaagctttagaaatgagctcatgactcattaaaaaataataaacgatgctattttaatattttcaaataaataatctgaggatgtgtttcatactttagcatcaacgctgagttgtgccttgtagaattgcattgtctatacatgcaaaagactattaagttaggatgaactagattccctaatt

SEQ ID NO: 2628 - DNA, 1159 bp, Homo sapiens
ctgctttcggccccgccccgcccgccgccggcctgctcacggctcctcccgtcctccccgaagccccgcctctgaccccgccctgtcctgtctccgtcccgccccacgcccgccagccagcgtcgctgtctctcgccttccctgaggccccgccttcagccccgccttcaaccccgccccgtcctgcctccgccccgcccccgcttgccggcccgcgtcgccgtctcaccctccccgggctgcgcggccggagctggcacagaggatcctcggccgcggcgacatcaccgcctgggcacgcgggcgctgctctggatacggcgccaccgagagaacccgccgcccgcgggtctctgtcctgcggtccgtggttgcccccacaagcgtccggcgtttcctgagggcgggcgtgtccgggccgtgcgggtcgcggggaccgagcgcggctgaggagaccgagctggggcagcgcctgccgtagcgcgggagacgacgcgggggtcttgcggagccccgcgggagcctggcccgccgtgcagagcagttttctggaactctccacctccgtctcccttggggcccagtgcggcgccgagcccccgtcgggatctgcctgaggtaagcggacttggtggctcaggggtctctcgccatcctgcctcactcagccccagagcggggagcggagaatgggggcggcagggtcggaggacgccagtgaaaaaatgcaacaggcggggcggatcaggaaactcctagcctgaatgtttcctacagaggggagacttgtccaagactgaaacttgcttaggttcttccagccgcggacgggcacggagaggcgtctttcgacaccggggtccgagctccctctggcggctccacctgaggacagggactcggccacaggtgagcgccgagcgcggagctcccgcccctcggcttggcgcctggtcacgattcgcggttaccccgccgagaaaagtgactggtccgagtagttctcattaggaagataccttctgatcccatgaactctaaaccttcccccggaattaaaaaaaaaaaaaaaaaaaaagatcttttcaactttcagttttttgtccctcggtccttgggaacaagaaataacaaggatagcaggactcatctttgtgta

SEQ ID NO: 2629 - DNA, 1137 bp, Homo sapiens
atctcttcaggtttctactttttattatatttggaaaatttctggtcattatatttttcaaatatttaacttcccctcctctttgccaggaactctatttacagtatattaggtggcttgaagttctcctaccatctgtccattggcagtcattgagttctcactagggtgggctattggaaaagtactggaggatgttagggagttttgatcaatgggttgtatccgtcactttgaggtacgcctcagttttccagtgttattctctgtgatttggccatctatctttgctaactggcacccattgaagtgagatttctaccttgccacagagaaagggagaaataggatcactatcttttgtaatacatacattttaaggagatggctttcagatctttggaataaatatttctgggatataaaactgtcaagaagatgggaaaatatttattccttaaaggggcagagaaataacttgcaagtttttgtttttccttttaaaaatacatgctccagtgcttgcttcggcagcacatatactaaaattggaacgatacagagaagattagcatggcccttgcgcaaggatgacacgcaaattcgtgaagcgttccatatttttcttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccgtatttaataaatggtgctgggaaaactggctagccatatgcagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcat

SEQ ID NO: 2630 - DNA, 1208 bp, Homo sapiens
tctgtctggagtctgtcttgcacccagcactgtcagtctatgctctggggacaactagaccctcaccatagtggctcgctggcagaccaatcccatgtccttgctaggtcatatgcagggatttttgaatcccttcagtgttacaatgttgctgagggaaagagactctaaaccactatttcatgttctttctcaaccaaataatctatgtaatgattttaaatggctttgaccacatgtcttgctatggaatccactggagggaaactgtctcctacgattacaaatagaagcaggatatgttccttctgtgctgtccctcttgcttttagcttcctatccaccctatctgggtttttctatcacagccctattggaagtgcacacctttcccccatgcacccaagcttttaggactctgaaaattcaagaaggtcagccttcagactcaatgacacattggtttccttctgttgaagccaaaaatcatggaaagaggcttcattaaagtagaatttttaggaaatgaaaatacattgcaaaatatttttaaatccctcatatgttaatatagattttattatatgtgtccttggtgagggggggccttctttccttctttcctccctctcctgttctctcacacactctctctctggtttttgctctgtcttctttcctctcctttcttctcccttcttctccatcccccttccattcttcctttctctctttcattttccttttttactttctttcttgaaatcgtatgtgaacaattataaaagcaacatggccccctaagtattggagaagcagaaaagctttgaaagattgaatgactctgatgctgaatttttcagttatgaggcaaactcttgcctgatttattctaatatcaataagaattgttcattttagactcatcagaaaatatgtgcttcgatctttaaaataaaaattttacctataagcaatttgcatttgacttttgatatggtttgtacatggtttaatgtattccaaaggcccattcattgaaaaatgtgttgaaacttcttataatgccatttttcgattttgaaccaacttatatagcactccttggggaactgccagtgccttctttggcaagaaaatctttggctataggataactaaaatagttcaaaaggtttcccagtgcaaaatttaacaatcagtgtatt

SEQ ID NO: 2631 - DNA, 1168 bp, Homo sapiens
gcacctggcaaattatttaaaactgaagccagaatcaagaaggaacactatgagaataacttctaggtgctaaaatgttttatctctagctgggttgcctggactacatattcttaggttgcatctggcttattcattaattaaaacctgatcatgttaatgagtgtcaggagtttgggcaggagaaagacaattaattctgttttgtccttgttacatctgatacctgggagataactgatccatgatttggaaatcacaaaagagacaataatatttagatttgggaaccatcaatgtgtatgtggtaatcaataacataagggtggatgaaagcactcaaagtagaatacagaaagagtattggactgcaagcagaaccctggaatgccaacactaagatatgtgcaagaaggaactgtcagaaagcagaaagaaatagttttagagttcagaaacctgagaaaggacaaatttcaagggatgaaaaataagtaaagccaggcatggtggcgtgtgcctgttatctcagctacttgggaggctgaggcagaaggatcacttgatcccaggagttctgggctgtagtgcgctatgctggctgcccatgctaagtctggcatcaatatggtgatttcctgcaagtggggaccacctggttgcctcaggaggggtgaactggcccaggtcagaaacggagcaggtcaaaactcccacgctgaagtgggattgcatctgtgaatagccagtgcactccagcctggacaacacctcatctcttaaaaaaaaaataagtcaaatgtagcaggaaagttgcatgagataacagctcaaaagtgttcatttggcggtgactgacgtctgagagcaatttcatgggaatggtagaaattgaagctagatttgagagaatgaagcagtggatgggagatggggaatgtgggctgatttttaaaatacgtttcattgagaagggatgataagagaaaggggagcggtgaaggaggtaatacgcaggggaagagggcatgacaatgtgaggtcacattgccataaatgtgaggtgtgtcataaatgtgaggtgttggaaagagatggaggataatagaaataacccagtccaagagaaaaagaaatgagtgggattaagaggactcataggtgaact

SEQ ID NO: 2632 - DNA, 1177 bp, Homo sapiens
ctttcatctcttccgtgcatgcgaacggctttccgagatgccccctttatgggcttggccatcgctacttttgttacaaattaacgtctgggactcggactgctgccaataggaaactcccgcgattcgctgcctagttcgccgccctcacaagactggactctgcacaggccatccatgcccgctggtgcacctcgctctctcgcacgcttaacccgcggggacgcccccgacctcccacctcagccctcgccacagttagtcccgcccttccgcgcagactccgtggagtcctgtcacgctctccgcgcgctgcggcagccgggagattgtgaagggcacctccggcagccaattaacacccgcatactgggcgggaccacgcttgggcaggcggagggggtcgaccgaaggcggggacttttgagtgacaaggatgatggccaaccgtcggaggcccttctactgcgccccgcccctgagccggccgcccagcccccagtggggttcccggcgcggggaatgtcccgggtggagctggctgagtcgcgcgctctgctccacccgacggggctgtgtgtgctgggcctggctcgcggcgaaccgagatggcagagcagtcggacgaggccgtgaagtactacaccctagaggagattcagaagcacaaccacagcaagagcacctggctgatcctgcaccacaaggtgtacgatttgaccaaatttctggaagaggtgagttggggatgagcggcttggggcgcagggagcgtgggccgggtttgggggttcactggcatgacctgtctttcgcggcccggagtccgcatacctacgcctaggcgcgccccccgagttcgctcacctgcgcgtgtacgcctgggcgcgcttccgagtccgcacacctgcgcgtgcaagcctgggcgccccccaccgccccaagtccgcacacctgcgcgctcacacctgggagcgctccccgagtccgcacacctgctagtgtacacctgggcgctctcctcgagtccgcacacctgcgcgtgcacacctggggagcgctccctgagtccgcacacctgcgcgtgtacacctgggagcgctccccgaatccgtacacctgcgcgtgcacacctgggagcgccctgcgcggcggcatcctcgctaggtggtgctgg

SEQ ID NO: 2633 - DNA, 1201 bp, Homo sapiens
tattttttaaagttgttcagtagatgtcatatattttcctaactactatttacatagatataggatggcaaattttacaggtttaatgggtaaagaactcttagagggagtgtgactacctagatgaatactgggttgggtttaaaataaagaaaaactgtgatgtgtaaaatgctcaatatgattactagaaatgatgtatctaaaaataaccataaaataattctttacaaactgtttcaacctacttttgttttaattagaataactctaagattggggatattcctgaattgtttcttcctaattaaaatatatttaggagtgtctgacttgggttgatgttacgtgattttttgcttggagtgttctcataaaaccaagtagacatttattcaactatgatagtcactaactttggcttaaatatccgtaaatatatattttagctttctctaaactattaatgtaaatctctgaaggaatttaaaacattatatatctatctatatatatattcttcagattgtgtaattaaaatctattgtatacacatggtgtgttttcactttttttatattccatctagggacatgtgagtggacattggtattctcccccagatttacattctctgggtatttaaagctcatggattttttgaaatagatgaactacatagataacttaatactggtgtgttttgggcttgctttctgatttcataatacgtaaatatatcattgtggtttagatttttatttttcaaagattggattttgatgatttcatttttatctttgaaaattcttttgtgtttgatgagataaatccatttcattttaattaaaaatgcttaacctatgtagagctggttgaacaccatgtaggatgctagtgattacagaatctatgcatataaaatatatctatttatgaaattgaaaacaattatgaggtaaaaaagatacatttatgtttaattttgaaattgacctttgacttcagttttacttagctaaaattcgtggctaaatttgtatatatctgaatattctaagaagtttgtttatataattgaatggtagaatcatcttaaaattaccctgacaatggttactggagctatggtctgtgattgtgcttgagaaacaaatagataaaacatttgtgactcttttaatgattatatttcttgata

SEQ ID NO: 2634 - DNA, 1202 bp, Homo sapiens
tctgtgacgttttgggaacagcagcagttgactttggccatgtgaagggtaacacagaaaaatacgttcattaggttatgtatttaatcaaaactagttttcatggaagtttagaaggccatttcctttagccatttcctttgttttcattattcatttaataaagactttagtaatgatgcttgttttttattttctttattccttgcttttgacatggtgtcagtggtgtgtttgctcatcactatctgtatcctatacatcagggacattttcatgtcattgaaatggaagcaacacagaaactttcttttgagtgtttcctaatgtatgaaaaattccctttggtggttttactgtatttactcagggacacaatgatttcctcaaataccccaaactgtaagtatcttcacaacagcccaaaacattcagcatgatataatgtcatttggcatactctctcatcttaaacatctgtcagatgcatactgacatggcgtgggcccctgtttctccagcacagaggacccaggggctagagcaggatctggcccacaatagacatttcctaggtgtctctgtgggaatggatgggcctaggccctttgtgaactgacccccgccactcttgggctcattcctcttcattccttcccacatcctgcgcctcagccctcttgaactacgggtatacgccaaatatgccatgcccagtcctccatgtctcgtctcctaaggccttggcctttgcacacatacagcaccctcttccctctcctggtgctgggaagctgagccgctctgattccaagagtcaattctgaaacccttctgagtggacacagtgccctacctacctcccttcagcacttacgtgctctgttgaaatcacctggttggctgtccagctctcctactgtaaactctttgaaggcctgagactcggctgagggttttgatgaaagaattaacaaatgaatgaatgaatgctggcagtgtctatgttcctggctggaaatcttattcacctgaacaatagatgcctatcattcttgtatacaaagagattatcctgctctgacagttaatgcatggtcttcatcccacatcagccccttcttccagcagccacatagaatcattggagctccacagttctccccggtttctttgtaaaatccaatcgcactttctttagc

SEQ ID NO: 2635 - DNA, 1150 bp, Homo sapiens
gcgcacaagccgttcaagtgcaggctgtgcagctacgcgacgctgcgggaggagtcgctgctgagccacatcgagagggaccacatcaccgcgcaggggcccggcagcggcgaggcctgcgtggagaacggcaagcccgagctgagccccggggagttcccgtgcgaggtgtgtggccaggccttcagccagacctggttcctgaaggcgcacatgaagaagcaccggggctccttcgaccacggctgccacatctgcggccgtaggttcaaggagccctggttcctcaagaaccacatgaaggcgcacggccccaagacgggcagcaagaacaggcccaagagtgagctggaccccatcgccaccatcaacaacgtggtccaggaggaggtgatcgtcgccggcctgagcctctacgaggtctgcgccaagtgcgggaacctgtttacaaacctggacagcttgaacgcccacaatgccatccaccgcagagtcgaggccagccgcacgcgcgccccggccgaggagggggcggaggggccctcggacaccaagcagttcttcctccagtgcctgaacctgaggccgtcggcggccggcgactcgtgccctggcacgcaggccggacggcgggtggctgagctggacccggtcaacagctaccaggcctggcagctggccacgcggggtaaggtggccgagccggccgagtacctcaagtacggggcctgggacgaggcgctggccggggacgtggccttcgacaaggacaggcgcgagtacgtcctggtgagccaggagaagcgcaagcgtgagcaggatgcaccagccgcgcaggggcccccgcggaagcgcgcgagcgggcctggggaccccgcgcccgccggccacctcgatccccgctcggccgcgcgccccaaccgcagggccgcagccaccaccggccagggcaagtcctccgagtgcttcgagtgcggcaagatcttccgcacctatcatcagatggtgctgcactcacgcgtgcatcgccgcgcgcgccgcgagagggacagtgacggggacagggcggcgcgggcccgctgcggatcactcagtgagggtgactcggcctcccagcccagcagccctggctccgcctgtgccgctgctg

SEQ ID NO: 2636 - DNA, 1246 bp, Homo sapiens
aataaactagagaaggatggcccacgtgttgagtttggggtttaaatgaagatggggtggttgaggaaggtggtttttgaatgaagagcggaacccgtgaggacccagtcgcctctctctgggaaggacgttcggatgaagatggggtggttggggaaggtggtttttgaatgaagagcggaacccgtgaggacccggccgcctctccctgggaaggacgttcgggggcttgtgctgctgttaggggaggaggggaggtgggcagtgaggggctcacgggagccttgttggccaggtgggactggggctgtcactccaagtcgcccggagctgtccggcagcgtggtctcagggacgtttgctgaggcccgctccttggggtccgttggtcgaggccgggggttgctggccggccctgagttcatgggtttctgctttgtgatgcccagcccctcatgctcccatctgcttctttttctctctagaacactatggctatgcatcctccaacgtcagccccgccctgccgctccccacggcgcactccaccctgccggccccgtgccacaaccttcagacctccacaccgggcatcatcccgccggcggatcacccctcggggtacggagcagctttggacggtgggcccgcgggctacttcctctcctccggccacaccaggcctgatggggcccctgccctggagagtcctcgcatcgagataacctcgtgcttgggcctgtaccacaacaataaccagtttttccacgatgtggaggtggaagacgtcctccctagctccaaacggtccccctccacggccacgctgagtctgcccagcctggaggcctacagagacccctcgtgcctgagcccggccagcagcctgtcctcccggagctgcaactcagaggcctcctcctacgagtccaactactcgtacccgtacgcgtccccccagacgtcgccatggcagtctccctgcgtgtctcccaagaccacggaccccgaggagggctttccccgcgggctgggggcctgcacactgctgggttccccgcggcactccccctccacctcgccccgcgccagcgtcactgaggagagctggctgggtgcccgctcctccagacccgcgtccccttgcaacaagaggaagtacagcctcaacggccggcagccgccctactcaccccaccactcgcccacgccgtccccgcacggctccccgcgggtcagcgtgacc

SEQ ID NO: 2637 - DNA, 1208 bp, Homo sapiens
gtgctgggccaccgagcacttccatcacacagtggctggcggcggagccttgggtcgttttctgaaggtcaccaaccctttggcatcagagcaggcagagccttttgcatccccgccagtccccttgcccaggtggccccgggcaacctccaccctcaggcacccggtcccagttctgtttacagcttctcttttcctggcttctttccccatattgacaagatttcagtcttaggttggtcttgtctgctgtgctgctctgaggaagcctctcggctcctgggtgtgcaagaagccaagggcagccccttccctgtgagcgtgcgtgtccacacgcgtgtgcaggtggcacagagcatccagggctgtcatcagctgcttctggaccgcccaggtggctgcttgggagtttaccgtcacggcagtcctgtgctgccgtggaaacgcggggttgccgtgtggccgccgtggaaacgcggggttgccgtgtggccgccgtggaaacgcggggttgccgtgtggccgccgtggcgcggcagccatcgcctgcccggtgctgattgtgcctcctgtgtgcccttctcctgtagaattctctggtggttgagatcccgccatttcggaatcagaggataaccagccccgttcacgtcagtttctacgtctgcaacgggaagagaaagcgaagccagtaccagcgtttcacctaccttcccgccaacggtaacgccatctttctaaccgtaagccgtgaacatgagcgcgtggggtgctttttctaaagacgcagaaacgacgtcgccgtaaagcagcgtggcgtgttgcacatttaactgtgtgatgtcccgttagtgagaccgagccatcgatgccctgaaaaggaaaggaaaagggaagcttcggatgcattttccttgatccctgttgggggtggggggcgggggttgcatactcagatagtcacggttattttgcttcttgcgaatgtataacagccaaggggaaaacatggctcttctgctccaaaaaactgagggggtcctggtgtgcatttgcaccctaaagctgcttacggtgaaaaggcaaataggtatagctattttgcaggcacctttaggaataaactttgcttttaagcctgtagtcctgatgtggtctttaaggatggtgaatgagctttgtgctgggcggacgtccccgagacactt

SEQ ID NO: 2638 - DNA, 1137 bp, Homo sapiens
cttaagtacacaatttacaaccctgtccaaatgatatttcaagtaatttattatttgcatggtgattccgtaagttaatatgatgttactggtatttattgtatctgtccctgagcaaggcattgaagggagaataatgaaatattattttgactttcctaatgcctgtgaccatttattttgttggtgtatttattttagcttctgtagggaagtattttgtgtttaagtcaaatcaaaagacagtttattagtttaccatgaaaataaagctggattctggcaacctgaccaacacattctcactgtggacgctgcgggaaactagagtttcagaaatgggcgttgtcagagtgaccggactcagaggggcccatgtctaatgcaaacatcactttggggttttgaaagcacatggacggggagtcgcatgcccctgcagtgggccgtgtgctcactttggggttttgaaagcacatggatggcgagttgcatgctcctgcagtgggccgtgtgctcaccttggggttttgaaagcacatggatggcgaggcgcacgctcctgcagtgggccctgtgctggagttctgatacggtttttttcaccaaagctgaagggcagtggagtctttgtgaagtgtgggctttccccctccccctctccccaccctgctccatggtttacatttccatcttaatttttaaaaaatatttcccaaagtagagaatatagtgaacccgtctgttcctattgttccacttcaacaattgctggtattttgctggtcttgtgttacctaacccctcatttttttaggctgtgtgtttcatggaaatcccagatataattatttcacctgtaagttacagtcaggttgtaaagatttagttttatatgaagaaatgttgtgcatatcccattgatttcccgtgactgctgtgagaggatgctgcaagctgaggggcttaaaacaacagaaacttctctcacaattctggataccagaagtccagaatcgaggtgttttccaggctgggctctctctgaaacctgccaaggagagtcctcatgcttctcccagcttctggtgctgccagcagcctcttggagctcctaggcttgtagacgcctctgca

SEQ ID NO: 2639 - DNA, 1248 bp, Homo sapiens
tgacaatgctaccgtgttagaagggtttaaaaataacacactggggaccactgccactatagtgcctgctcctctccagtgcctggggagaattaagtgtacccaggagccatagagaaagtaaagccctgttccctgaagggatggttttatgttgtggttcatgagagtttcagctagatttagtccaggccttataaggttgccttccctatatctaatggcaatatctttaggataaggatatccatacttagtctagttatccacagtaccatttggaactatacatgctgcgtaggaagaatctttttggcaaatagagttttgaaaaattagagacacagaatgtcctggccaatatcttagacaaccctctttacagggtctgttggtttagacatcccattagtccacaaatttgcagattacttccattaaattttttttttttttttgggaccggggtccagtgcggagtgcccttcctcctgggaaacggggtgaggccggaaaggcggccggccgccccctcgcccgtcacgcaacgcacgttcctggggaacctggtgctaaagcattcgtcgacgacctgcttctgggtcggggtttcgtacatagcagagcagctccctcgctgcgatctgttgaaagtcagccctcgacacaagggtttgaagaaagaaaaaataagagagagagaacaaaaaaaattaaaaaaggaaaaaaaaaaattttttttttttttttgagacggagtctggctctgtcccccaggctggagcacagtggcgcgcgatcttggctcactgcaagctccgcctcctgggttcacaccattctcctgcctcagcctcctgagtagctgggactataggtgcccgccaccatgcccagctaattttttgtatttttagtagagacggggtttcaccatgttaaccaggatgctctcgatctcctacctcatgatccccccgcctcggcctcccaaagtgctgggattacaggcgtgagccaccacacctggccccattaaatattttattattattattatttttgagatggagtctcactctgttgcccaggctggagtgcagtggcatgatctcaactcactgcaacctctacctcccaggttcaaacgattctcctgcctcagcctcccaagtagctgggattactggcatgcgccaccacgcccggctaattttttatttctttttgtatttatagtagaaaggg

SEQ ID NO: 2640 - DNA, 1981 bp, Homo sapiens
gtgcatgatgtggaaatagttggccgccccagttagcctgctcttttctaatggtgaaaatacagattttactgagctctaagattctatggagaacagtatctatagaggatctataaatatgaaaacattgaactatttcatagttaattcatccactgggcattttacatggaatattttatcttaggattgataaattatgctataagaatggatctaagaatgaataaattgtggtagcttagaatggataaattatgggtaaaagtcagcttcccatccccaaagtggttggcaacagttatgaaacctgtaatttacttgcattttattttttatcctttgttggtttccctaaagcagttaggaaactgctaaacaaaaaaaaaaaggaggggggaacttttccccctcctttttttaaatgaaaaggtatttgtgtgcttgtgttttgttttgtttagaagggccacaataacgatgaaggaatggaagcactttcatttgagaataaaaagttcctatttttcaaattcaagggaaaaaaataaaaaagtgacaactccttggccctagtcccaagccttgaacaagtaaccacagacccctgcccaatctctgagagcctcattttagtaacccctttctgaggttcatgtatgtacaaccatgcttacatgaatcagccaatccccaatcactctgcttttaaaagtccaccagtctttgtatcccaggcttctcaaaactctgtgataagatcagctctggctgtgtgagttgagattttcttggaagcagtaaatttagcttccctgtttcagatacatatggatgatggtccctactttagacaacactgtttgtcagccagcttttggagaagaaccccagaggatagagaggatagtggaactttaaggaggaaatgaaatcaagtctgatagagtccctggaaagcagctaacaaaattttcgttgagttttgctctgaccaaagaagctggactgggccagaaagtgaccttgagcttagtgtttagaaatgcataatgaggttatggcagctcttgtgtgagagtgtaagcttttgaaggctagaacccaaatcagtgcattttattaaagaaaatttttaaacttaaaattttataaagaaaatttttaaatttttatcctcccagttctacaatgctaatgatccttaaatctctccttttgctgagaccaggatacatttttcacatagataactttgaaaagaaatttatccgcttcaaaacagcttctcaaaaacttggtgtttgcttgttacccaccaaaaatttctccctattatatgttaaccctttctgcctcccactcctctcccagtttgattccagtccacctttttggttttacttttgccaaataaattcagacttttccttctttacctcaataattttttgatgctaatttattcaccttgtatgtcttgggcaccagctttccatagccatgtcctctttagaacctcctagcactttctgcatatcttacggttcttatcctgttttattttatatcttttgttcatttaatgaacatttgctacgtactgtgctctgtgatgggaccctctcaagcaaatataacatgatttctgccctggagtagttcagcccaataggagaaatggatatataagtagataattgcaacatggtgagtcgagtgcagtggagtggtatgtggttatggtactaagtcctaggagggatcactaagcctgtccttgggtggtggatacaagagaggaatgtagaagtagaattgcttactcagaaattgtccttaaaaatcatgagagagctgggcatggtggttcatgcctgtaatccccgtactttgagaggctgacggggaggattgcttgagctcaggagttcaagaccagcctgggtaacatagggagaccctgtctctaccaaaa

SEQ ID NO: 2641 - DNA, 1252 bp, Homo sapiens
tcgaactcagatatttcctgctcccccagaagctcaagccgtaaggctttagcccccttgggccctgcctgtgccatggccgttgttgtctgtcccccaggctggcagggccggaggagtcggcctggggggacgaggaggactctttggagcacaattactacaacagcatcccggggaaggagccgccgctgggcgggctagtggactccaggctggccctgacacagccctgcgccctcacggccctcgaccaggtcagcctctgccctcggggggatggggacagggatgccccagctgctggttccctggacctacctccagctcttctttctgctcctgttctcctcgatcctagaggagggtctctcactcagactcactcactcactcactcatgatttcacttactcacagactcacaatctcactcacaatctcacaggctcacgatctcactcatgatttcactcactcacagactcacgatctcactcacttgctcactatctcacagactcatgatctcactcagtctcactcactatctcactcacagactcacgatctcactcagactcatcatctcactcacgatctcatgatctcactcactcatgatctcactcacagactcatgatctcagtcacgatctcactcactcatgatctcactcactcatgatctcactcatgatctcactcactcatgatctcactcaggatctcactcactcactcaatcacaggctcacaatggggcgccgtgtatctgcccggcctcctctatctctcactcactatctcactcacgatgaagcgccatctgcccggcctcctctaactctcactcacgatctcactcacgatgaagcgccatctatctgcccggcctcctctaactctcactcacgatctcactcacgatgaagcgccatctatctgcccggcctcctctatctctcactcacgatctcactcacgatgaagcgccatctatctgcccggcctcctctatctctcactcacgatctcactcacgatgaagcgccatctatctgccccgcctcctctatctctcactcacgatctcactcacgatgaagcgccatctatctgccccgcctcctctaactctcactcacgatctcactcacgatgaagcgccatctatctgcccggcctcctctaactctcactcacgatctcactcacgatgaagcgccatctatctgcccggcctcctcta

SEQ ID NO: 2642 - DNA, 1170 bp, Homo sapiens
ctaatttattaatacgttcatatatatatatatatatgtacatttttaaaggcagagatgtgcgtctcgccatgttgccgcgtctggtctcgagctcccgggctcaagcgatcttcccgcctcgacctcccaaggctctgggagtacagacgtgagccacagcggccggcccgtgtttaactcagataaaatctgggtaacacactttcaacgcttcaaccccctcgggcgcaccgctctgcgctcattgcaactttgaaagcaggaaggaagaaatgcgcaggctccagccgcgtccccgcaggccccactcccgtttcctagcaacgccgggtcacgtgcgccgccgcccggattccgtagcgtgagcctgccggagccggcgcgtacatgcgagcgtgtgcgcgcgtgcgcaggcggggcgaccggcgtccccggcgctcgccccgcccccgagatgacgccgtgcgtgcgcgcgcccggtccgcgcctccgccgctttttatagcggccgcgggcggcggcggcagcggttggaggttgtaggaccggcgaggaataggaatcatggcggctgcgctgttcgtgctgctgggattcgcgctgctgggcacccacggagcctccggggctggtgaggagcgggtagggggcgggggtgcggtcctgcaggggccgggaatggaggccgcggtgccgacccgaagccgacgggagcctggggcctcggcgcggggcggcctggggtgcgaaaggccggccccgggggcttcccgcgccagcatggagcttgggggtgaagtcccagggtttgaggggggactagaggttcctcccggcgcggcctgccgggctcccccgggcgctccggcctcgagcccggcctctgtgtgtgggcgtgaagctccctgcttggaggcgggagccagggggtcctggccaggccggtcttggtcaggggaggtgggcgtcttgcttttcggtcacctggggttgggggtgacctgcttcctgggtgagggcgtctgcgaaggcggttggaggtggcccgcccgccggtcccatcggccaggagaagggagacccaaagcctgggtgagcgtcccctttggcctggagccaggggtcaggggctggttggtgcctgcccaacccgtcctgctggggctg

SEQ ID NO: 2643 - DNA, 1421 bp, Homo sapiens
cagagcccctgggcttcagtattcgggggtcctgggggccggggtgggcaggggtgacttggagagagtgacttgcgggggacaccctctcacccggcccctcgtgccccaggaagagcagcgggcagcaccagaatgacaaaggcaagaacgtccgccagaggaactcttcctgaggcaggtgcggtgggcgggagctcctcctgagccaggtgtggtgggtgggtgggcgggaactcctgagccaggtgtggtgggcgggatctgctagccaggtgtgggctcctgggtcccgcctgtgggtcgctgggaggtgggtccagtctgagcgcccctccctgtccacaggtggcccgaggacgctccctgctccacgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggtttttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctcaccctctcctggctcctgtctgtgcctgacggggttgggttttccgagagcaggtgcaccctgggctctggtggtcacagcaggggtgcgtccagtactgggatttcacatgcgaggacgggtctgctgagaccgcagtgggtgttgggtggctcggggcatgggctggacagggcctgaggctgtcagccggactgggaacttggaaggtggctggggccgaccccgtgcctcagagccacacagaagagagtgggcactgacctgagccttctctgagcctgttactcctctcggcatgttttgggcctgacaaaggctgaggctttc

SEQ ID NO: 2644 - DNA, 1170 bp, Homo sapiens
cacctgttccacgacggctgcatcgtgccctggctggagcaggtgagtgccccgcccacccgcccccccaccccgaccgcggccctcccgcctctaacctgccccttctcccgtccctgcctctgtccccacaaagcacgacagctgccccgtctgccgaaaaagcctcacgggacagaacacggccacgaacccccctggcctcactggggtgagcttctcctcctcgtcgtcatcgtcctcctccagctcgcccagcaacgagaacgccacaagcaactcgtgagcccacgtcggccgtcgggaaagcacggggcctttcccacccaccctcagccagcgccacacggcacccacagactgggtgccccggcggcgccacgcttggctggtcagcgctgcaggtcccgcctgttccagggcaggacccgggcccggcccaccggccccctggcttgggaaggcgtgggccacatggtcccctctggggcgtccccagcctccccgtcctctgtctaacctcaccctctaaacgttcagcggtggaaagatttttataattttaaattattactgctttgaaataaacggacgtttgagctcacgtggcggccatgcatggtttgtggcggaagacggggcccagcggctcccccagcgctgaagcacggggttcagcggctcccccagtgctgcaggtgccgccaggacgggccacgtgggcccccagcctccccctcggccgcctccacgacccggagtaggggggctcgggaccatgaggatgaccagcaaaattcaagaacaaaactgctccaacagacttttttaaaggaaaaaatatgtgtatcttgaaagctatttaaaatacactacttacaaagagaagccggtgctgtggctttccttctgcgcccgtgcgtcaggaaaaggccaagctgggaggctggtcgggctctgcagagtccggtcctgtctccaggggtctgcgcctcctgcagggcttggcacccagggccggctagcaaaactgctctcccgaagttaagcccaggagggctgctggcgaggtagcagggtggcagtgtcactgggtcgtgaaatttaaaaccagaaacaccagcgttaaagcgccagggcccagcgcctctgccccacgcttcggtcaca

SEQ ID NO: 2645 - DNA, 1127 bp, Homo sapiens
tcgccccgtggccttggacacggaggaccttgacctcctccgactgtcactgggcctggggagggccttcctgtagtgaaaggaactctgtggtgacaggccgctgtggtctttgccctcacagaatttacaggctggccagggagccagcatggaacagtgattgacaaatatttaatcatggacgttggtagattccttaagagcaaataactgcagagagggctgcgggggcctgcccgtgtccaccccgcgggtgatcccaagggcatctgcttgtgcctttggagcaggacgcaacaaggcgcccgtagacagcatggcagtgtcagaacttctccgtacgtggcaggaccctgtctctacagaagactaaaacaattagtggggtgtgttgttgcactcctggagtcccagctactggcgggggctgaggtggtgggaggagcgcttgagcctgggaggtggaggctgcggtgagccgtgatggtgccagtgcactccagcctgggtgacaagcaagacgctgtctcaaaaacgaattttttatgctgggaaatgggcacacctggcgtttgttctggggagggacggctgctccgtatctggcaatggggaaagtccccagccacaaccagtgccctcgaaacggggcgtctctgccgctggggagcttgcccggcggctgagtcaggggcggcactgctgctgctgagacacctgggctggctgtcgggaagctcctgcctgcctctgacgcaggggggactggctgccatgggctgtgtgcctgcccacgagggcttctcccaggcagctgggccgttccgggcctcctttgctgtcctgggctctgggatcaggctgaggccccgcgcagctgggtcattctctgctgggcagccttggcctcagtctcctcacctgccaagtgggtttagtgatgcgattcgctccccgtggcatctggtgggcacgtgtgtgcagagtggccggcacctggccgctctcctggtgactcgtgagggtgtcctgagcggggagccacacttgcggtcgggggctcaggcgacgacggcacaggggcagcagttgcccccatgaaaggctgtgatgaggccgagcgc

SEQ ID NO: 2646 - DNA, 1276 bp, Homo sapiens
aaaagagggaggactgagctgcccccaacgggtgggaagagccagggtgggggcaggtgtagggggcagattgggagtagtgttatggacgtgtgagagtggggcccctgtggataggggctgagtccaggtcaaggtccaggtggggatgggtgtgcgggagattagagccgagtgcctgggcgaggtccccggcgcagagcagagtccagggccgcagccgggcctaagcgtcgaggttgggtgggaggagggaaacgaggtggctatgggggccgaggggccaggcgatggcagggctgcccacgatggggaccgatggcccctcagaagtggtgaggacatgcagctatctggggggtgtgccaggcattgggaacagcctgtgcaaaggccctgaggctgggccgcacctggggtgcagtgtcatgggtcaggccagtcctggcagccctgttcagctcccgctgcggggcggggtctcagggaggtgcctggtgatccccagtgctcgtcatcttcaagcaggcctgggggtggcgggcagccaccagtcgctgttaggatgcaggctctgtgtggtttctgcaggaatgatttttacagagtggggcgaggtgctggctgtggagttagggccctgatgagtagcaagttcgactatctcaggagggttccttcattctgagtctaaatagatgacggcgtgtccaaccgttggctggaaggaggcgtcaagtcctgggagcttggatggtcggggcgggggctgtgggtctgcagactgagccccagtctccgccgtgaccccgggcaaggcaggatctctctgggattcacctgctcctctgagaaaccaggaatggtggggctcgagggctcacgtttataatcccagggctttgggaggctgaggtgggaggattgcttgagcccaggagtttgagaccagcctgggcaacatagtgagacccccatttccaaaaaagataaataaattagccgggtgtggtggcgcacacctgtggtcccagctacttgggaggctgaggtgggagaatggggtgagccaggaaggtcatgactgcagtgagctgtgatcgtgccgctccactccagcctggccaacagagggagaccctgtatctatttaaataataggctgggcgcggtggctcacgcctgtaatcccagcactttgggaggccaaggcaggtggatcacctgaggtcaggagtttgagaccagcctgaccaacatagagaaaccccgtctc

SEQ ID NO: 2647 - DNA, 1099 bp, Homo sapiens
ctattccggcgcctccactccgtcccccgcgggtctgctctgtgtgccatggacgggtgagtcgcacgtcgccccgcgccccaccgccctccccgcgccgcagccctgcccccgccgccgcgccggcctccccggggccgatctcgccccctctcgggcgggagggggcggcgggctctccccttcctctccgcgtggcgggcgcgggtgcggggcgggtcaggggcttcccgggggtctggccgcgtccccatcccccgtccggcccgcttccggcccccgcgcgccccgtccctagcgcacgcggcctcccgcgcccctccccctccgcgcgcgtccccgcacttcgcctttgccccgcctcggcggcgcgcggcccttcccgcttcccgtccggccctcgcgcgcccggatggcccttcccgcctcccgtccgctcccctcgtgcgcctgcgtagcccgtcgcgcgtccccgttggccccagcgcgcgtgcgcggccgccatcgggggcgcgcgcctttcccgccgcccggactctgcccccggcgcagccccggaagcgcaggcggggctggggcggccgccgggagggaaagctggcgccggggcctcgccgcgggcccgagtctctgcgctccccgccctacccctgccccccgtgcgccccgggccgcggccaaggggtttcggtgatctcgggagagaagcggccgccccgagggtctgtcctccgccccggggccggaggggcctctccagggacccccgcgggcgccgtcatggggaggggccttcccggctctcgggccggggcagcctttccgggcggctttgctgggcgggcttcccttgggagaggtgggagccccctccagaaaggccgtgtcccgccgagcgcttcctgcgcgaggccctccctgggaataggaagcgggagaggctggagatgtttcgcattctttccgttttcctgagaagtttttcttgggttcagtcacttttaaaagtctgttaaacgtggtccgtgcagtctgtggtgtcagaagaggcgcagccctagagtgggtctggaccccttagcatgcgtgcgggcaggtg

SEQ ID NO: 2648 - DNA, 1247 bp, Homo sapiens
cctcaaggcggtgcccagcctggccctccctcgcgggggcccaggacgcactccctgcctgtgcctcttaccacgagccgggtgctgtccctccagctcctcctgagcgaggccgtgcactaacagactcgatctcccttcacgcctgtaatcgtccttagagactgacttgtgccacagctgcgggagacagcgctgctgcagggcttggctgaggtggccgcgagcggagctgcacgcgcgctcctggggggcgtggttgggatcggcttctgggagcccctccagcagcgctgtctctgccggcatgtgagtgaaggtgcttctcttaccgtgtgcccgtcgaggtaaacctgtaactggaatgtgtgtggagtgtgactgatagaacactacctgattcttatgtatttactgacctgtgtttttttgctactttttttcttttctccccttcccctttccctattttttttcttgccctgatccggaatttctttgccaactgactgcacggtacttctgcttcctgttgttgcttgaaacaaaacaaaaacataaacaaataaaaaacaaaaattccccctcaaaccctgctctccggaaaccaacctgcccttgaatattaacatcctgacaacttcatcatccatcaaccactgcacgcctgcggggactgtcttcctcgtgtggacgattggcaactcgccccccttgacctctccctctcccctgtccctccgctgccttgctctgctgtctctaaagagagtcacaccccaaagcctctttattcttttcggtatgttatcgttcacacttttattaccttgttttcattaattgagatgattttgatgccctgagacgtattatgagtttgcggtttggcactctgatgctccgtggcatccgcctcgttttatggtttgctttcggtttgcgaattttatttggtcccgtagatacgtacgcatggtttatcgccctgcatgcttttcagagttagacctgtcggtggcatatgccaccgtggccacccgctggcagcttacctgtcctggatgctatgactttgctgaacggagctgctcctgttagcgcgccctgtggctgcgagacgcagctccgcagtggccgataaagcaaacccggccgggctgagccgggccttgtgggggtgcgcggggccggggctgacggggagatgggcggggcaggcagcaggagactcaggccccatccct

SEQ ID NO: 2649 - DNA, 1194 bp, Homo sapiens
taatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtcttctctgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttggccagtctgtacctggacttcgaataaatcttctgtatcctcgctccgttccgccttcgttgctggcttcctctttctgtgccgcgggcggccccgactcccgcccgggtgtccgccgaagcgccaggtggggccacgggcggggtgggcccggccctgagagtgggggtccctgcgtggggcgtgcgggccagagcgaatgaccaagagccggacctcggtttctgccgctttattgagcatccgcg

SEQ ID NO: 2650 - DNA, 1104 bp, Homo sapiens
cctcccaaagtgctgggattacaggcatgagccaccgcgcctggcccatcagtctttttctacgatagcgcctggctgcccctccaccaggtgggagaaagggcacagggcctcaggtgtcctccctggccttgccaagaagggtgacctgaggtccagggcctccagcaagcaggtgccgctgctcgtcgtcctggtgtgggtctggccgcacccagggtggtttgtgaaggcaggctccgtggctctgggctccagtccaggctgtgtcctggagcttctgtgtaaggtcaggagagtcgcacagtccctgtgagcctcagtttccccttatgggatatgggtcataggaacacggcctcgaagggtttctgtgcacctgagtctcagcccacagccttgcacacagaagacgctcacattccccttggtaagcaaagggaaacggtatgagccagaccaggaggggacacccatgcctggcgggccttcgcgcgtgtgtgtgtgtgtgtgtggcaagggcgccgccgtgtggccgcgtcagccccacggaagcgctggacccggaacttcgctgtattctccgttcttgcgcttttatctgtagcttcccgcgttcctctttttttaatgtttctgtttttgttttgagacagagtctcgctctgtcacccaggtcggagtacagtggtgcgatctcagctcactgcaacctccgcctcccgggttcaagctatcctcctgcctcagcctcctgagtagctggggctacaggtgcccaccaccacgctcagctaatttttttttgtatttttagtagacacggggtttcaccatgttggtcaggctgatcaggaactcctgacctcaaatgatccgcccgcctcggcctcccaaagtgctgggattacaggcgtgagccaccacgcagaattttttttttttttttgtagagagagacaaggtttcactctgttgcccaggctggagggcagtggtgcaatcacaactcactgcagcctcagcctcctgcgttcaagtcatcctcccacctcagcctcctgagtagctggaactacaagcacccacctccatgcccgccaa

SEQ ID NO: 2651 - DNA, 1189 bp, Homo sapiens
ctggggcaacatggcgagacctcatctctacaaaaatcttaaaaattagctgggtggccaggcgaggtggctcatgcctgtaactccagcactttgggaggccgagggggggcggatcacctgaggtcggaagttcgagaccagcctgaccaacatggagaaaccccgtctctactaaaaatgcaaaattagccgggcgtggtggcgcatgcctgtaatcccagctactcgggaggctgaggcaggagaatcgcttgaaccatcaggcagaggttgcagtgagccgagatcgtgccattgcactccagcctgggcgacgagagagactccgtctcaaaaacaacaaaaacaaaaacgtgaaattcacacagtgagctccaacttcgtggtggtcaccagacggctgaatgggcccccttccgtgcagtgcagtatttaccaaattcctaagagcagggctggggcttagatgtgtcttaccgtgcccggcccagggctctgcacacagtaagtgctcaatacgtgcttgcacgtcagtgtgattcctaggtgagtgttccatagccccaaaaacacccaagcacagtgttcatcaatccatccccccttttcccagcggacctgcctctcagatcatcagtcttttttttttttttgagatggaatctcgctctgtcacccaggctgcagtgtagtggtgtgatctccactcactgcaacctccacctcccgggttcacgccattctgcctcagcgtcccgagcagctgggactacaggtgcctgccaccacgcccggctaattttttgtatttttagtagagacggggtttcaccgtgttagccaggatggtctcgatctcctgacctcatgatctgcccgcctcagcctcccaaagtgctgggatgacaggcgtgagccaccggcacccggcccatcagtcactttttcttttctcttttttttttttttctttctttttgagatggagtctccttctgttgcccaggttgaaatgcagtggtgctatctcggctcactgcaagcttcacctcctggattcaagctattctcctgcctcagcctcccaagtagctgggactacaggcatccgccaccacgcccggctaatttttttgtatttttagtggagatgggatttcaccgtgttggccaggatggtctcaat

SEQ ID NO: 2652 - DNA, 1189 bp, Homo sapiens
ctggtgggcattgacaaccaggggaaggcgagctgctggggcacgtgggtctggggctggggctggggctgggagggtgccagagggaggcgcccccgggggaagggaccacaggtgcaagcccctcgccagcccctgcctgcgctgccttgtctgtgtgatgggttcgtcttgttgagcgaggtcagtggggtggctcacagcacgtattaggagcttcgtaactaggagctgttgagaggaccgcctttcacggggtagactcctcaggtaaagcagacgagtgtaagcctggctcggcatccagtgcagtcggggctcagggaggtttccttccctgttcccagaggcattgtgcatgaccctgacagaaaggtacagacgctacagacacatgcgcgcacacaggcccacacacgggcgtgcgcgcacacagatccacacacgtgccgcagccccagggccccattcctctcccggctgagggcgcagccccatctcaccgggctctccttgggctctgtctctggcagctgagcgtgctccgcctctcaccttccatgggccacccgctggaggtggggctggcgctgcggcacctgctcttcctgctggagtactgcatggtgaccggctacgactggtgggacatcctgctgcacgtgcagcccagtatggtacagagcctggtggagaagctgcacgaggagtacacgcgccagaccgctgccctgcagcaggtgggggcccgtggcaggtggggccccgtggcaggtgggggccctgtggcaggtgggggccccgtggcaggtggggccccgtggcaggtgggggccccgtggcaggtggtcccgtgccaggtggggctgtccctgtggcaggcaggggccccgtggtcagtaaagtgccagcagcagggagggagttcccttggagggtggaggaggtctctgcagcagttgtagaggtccccacggcagatgtgggggttgtggcagctggaggggtttccctgcggcaggttgggggctctatggcaggcggagggcaagaggggcaggtagcctgtggcaggtgaggctgcgtgtggggtgtgctcccagaggcccgtccaggaaagctgcacctcagagaagcagtttccttccttacctgggaagtttcttctgtaacacgttaagccccacag

SEQ ID NO: 2653 - DNA, 1141 bp, Homo sapiens
tgccatcccagctccaagcttcccactccgggacttgtgtttgggtggggagacctgacctgggcatgttcctgtttcttcatcgttgagcttttctggcccggtctgaagctcaagtgaggagggggaggctgggtttttatcacttttaatgaatttggtgtgatttgttgtagatttttaaatttcccttttggagagaaaaaccaaaaaaactcgccccactggtaaaacatgggtcttggtcccagcccctgctcagcccctcccagtttttagcttgaatgagggtggggtctctgggaccctgcccctcatgccagaagcatcttgtgttgtatatgtgtgcgcgcgtgtgccctgagacccaggacagaagccacggtcctaagagccggttttatcctcgtcattctgcgtgtcctcccccacgccacctgtgtcggggctcagggtctcctgctttatatgagcccccttcctttcctcccctcctttatgctgggggtccaggacttccagccagaagcctctgcccttgcactaccttgtctgtcaccccatcccgtgtcccctcgtcccccagcctgactcctgcctgatagctcctgtgtccccatgctggtcctcctggcccaggctgcaggagccaggctggggggcctccgcacccccttgctgcgtgtgggtaattgtgttttgggggaaagtggggaatttaataaatttctggtgctctggcctcgggctatgtgtgtttttcttcggggcagggccgggggcttagtaggtcctggccaccaagggctgcaggtgcccccctggctcctctgcccttggttgcctggattcaaaccctggctctgccacatgcctgccgtgtgaccttgggtgaggagcttgtaggagtgccttggggcccctgtagaccttgagtgagtggcttgtacgagtgccttggggcccctgtaatggagggtctcacacagggggcttgaaacgacagaaggccagtgcagtagctcatgcctgtgatcccagcaccttgggaggccaaggcaggaggatcgcttgagcccaggagtttgaaaccaaccagggcaacatagcaagaccttgtctctacaaaacatgagagaaa

SEQ ID NO: 2654 - DNA, 1179 bp, Homo sapiens
cgctgctagtgtccctgcgggtatcagacaccccttgtcagtcatgtgggacacattcagtcccaaaccaccagatcggggacgtccctcacctgccctgaactttccatggctctccagggtcctggggacaaacccaagctatcctcactcagggtctccgctgagggctggcctccccgccaggctgggcccaccccctggagccccagcccctacgagggtcaaagcccttcccatattcacaggccttagagttcgcgccttggctgggctcctagtccgggctgagcgtctactcgctggttaaggtcggtccttccaggtccacagcggcctccacgcggcccaccccctgcctgctccgccccctccagccccctcccgcgctctcactccgaccttgcaccgggaggagggaataggggggttgccgctgggtgaatagagggcgcgtgggcaggggagggagtggcgagcggctgccggagaggcgggaaggcaaggccaggggaggggggcacgggctataaacgctcggccgcagcggcgccggcagaggagccgccgagcccagcacagctgccctctggaccctgcggaccccagccgagccccttcctgagttccacaggcgcagcccccgggcggtcgggcggaggggtccccggggcggtgccagggcgcaatcctggagggcggccgggaggaggaggtgcgcgcggccatgcacaccgtggctacgtccggacccaacgcgtcctggggggcaccggccaacgcctccggctgcccgggctgtggcgccaacgcctcggacggcccagtcccttcgccgcgggccgtggacgcctggctcgtgccgctcttcttcgcggcgctgatgctgctgggcctggtggggaactcgctggtcatctacgtcatctgccgccacaagccgatgcggaccgtgaccaacttctacatcggtgagtgcgggcgctgcgccgcacctgctgccgtcccgggggctccgagggccgagcggcctggggcgccctctcgcgacgcatcggggccctctcggacccggctctgtcccctgcaggggtcccccccaacctcgaatcttttccctgtggtccctgcacctgaggctagaggtcgcaaactccagcgcgggcgggcccgggcggg

SEQ ID NO: 2655 - DNA, 1161 bp, Homo sapiens
ctgagcccctgagtctaggttcactttcccgtcgggctgtgggaggggactgtcactttcctgtgtctttggggaggggacccccacttccttctcggatctcagggccgtggacacacaccccctttccaggagggggtggtgggcgtctaggttttccttgtcccttcctggggccagcaccgtagcagcacaatcaccccgggaagggggtgtctgtttgcctccagacacaatcgggccccactcgcagaaccacctggactctgtccgtgtctgtcccccggcctccagggctcctctcccgggacccccgtcccacgcctgggccccgcgccgggggaagcgcctgctgcctatctctgtctacctcaggtctgacttttgatgccaaaatctgagcccctggggtgcctctcccccgcctcccgtgcaccagggtctgcagcagccactggggcctggctgcctgctgcatctggcggccctggacccctggggcccccgtgcacctgcccacctcggagcctggggaggggccgtgcagggtcgagggctgggtcgtctccctcgggctgcgtgtgtgtgtcgggaatcctgcgtgtcgtgtctgtgggcgatccggcctcccggcggtgggtggacctggattctaactcagaggacttgagcctgctgttaactccgatgattgtagggacaggcggggtgggtggggggtgggcgcgaggctgggtcccggcccaggagaaggaagtcgctgaaggcagtggccatgctggccgtggaaatgggaggcggttgcagagggtctatggggcccggtcctggatactcggcaggaagccgtgtctgcagaggctcctccctgcctcaggtggccccgttcaaccccagccgtgcccatctcctgccaccgcctgtcggtgggggtttaaattcggtgtggctttctggggtgcagctcagcacccccccttatgcagactgggagggggtcgggcagtcccctcagccacgaggaccctggatgggttctagttcacttgggaccgtggggcctggctgcgtactgagtgggtgccccacagtcaaggccaacgggggctccccctgctctgagatgttgggagaaaggcggcttctggaaccttccgtggg

SEQ ID NO: 2656 - DNA, 1104 bp, Homo sapiens
gggcccgtcctgactcccactctccctcccgcagcattccatgatctacttcttccaccactacgagctgcctgccatcctgcagcaggtccgcatccaggagatgctgcttcaggcgccgccactgggccccgggacccccacggcgctgcccgatgacatgaacaacaactcgggcgccccggctacagcccctgactctgccggccagccccccgccctgggccccgtctcgcctggggccagcgggagtcccgggcctgtggcagcggcgcccagctccctggtggccgcggcagcctcagtggcagcagctgccggtggtgacctgggttggatggcagagaccgctgccatcatcacagacgcctccttcctgtccggcctgagcgcctccctcctggagcggcgtccagccagcccgctgggccctgctgggggcctcccccacgccccccaggacagtgtccccccgagtgactccgcagcttctgacacaactcccctgggggctgcggtaggcgggcctagcccggcctccatggccccaacggaggcgccctcggaggtggggtcctgagccgcacagctgagccgcctctgacccctgctggctgggcctgaccttcccgagcccgtgggggtgggggaggccagccacctccttcctctgggactgcccagcctgtgtcgggggctttcagggtttcgtggggtttgcccggaaggcggctttcctccccctggtgtgaggtcgcgcccgaggcttgtacccgctagtgaggtgtttgagctggtcagcaaggagagggggtggggttccgcggaaggttctggaggggtcttggtaggtctgcagtgaaccgtcctgaggatggagtggggtcccatggtgcaggtctctgagcaaggcggaggtgtggaggagaggccggcttggggtggggcctcgcgccctagtgccggccggcctcagcccggctctgcctggtgctccctgcagtgccttctccatggccccgccctccccgcgtgtgcgccaggcttggggtccccgggagagcagagcttgcgcctcgggcatagggacgtggggtgcaggcg

SEQ ID NO: 2657 - DNA, 1244 bp, Homo sapiens
agagggaggtcacctgggggcagctggtgccgggtcttcacccagaccacgctgggtcccctctgttgggggtttggggtccgggtctcccaccagccactgcttcctcctgggccctcggccttccacccctcgtcttccctccctcgggggccctgatgcgtggcggcccccgcccggcctcggctctttactccattcacagccatgcacgcgctcaagccaccagggtgcgagatgccagctctggagttctcggttgttgtaggaggttgggtgttttcaaatggtaaagatgttttgagcaaataaatttgcttgatacagaaaccaggccgactaacaaggtttccagcaggtggccttgcctcaccccaagcacacgaggtcagcctggcaggtgtgccctcctcgcgctggcttcaggggtcagtgtctccccaggccctcgccctgccctcccacttcgtgctcctgggtaaggcgtgagcgtgtctgtctcttcccttcccgtgagggtgtggagttgttctctggcttgtgcagctgtggtttgcggccagttcctcttacagacgtttgggatctggctctacttccccgtttgcttactgtctgatttcagaaggcctcgcctgcccaagtttaacctagccacgtggttctctcacagtagctttattaagatgtaattcaccctcgggcggtcggtggtctgtaacgcgcccactgttctgtgcagcagggtccccagatccccaggccgcggactgtgtgtgtgatggggacagtgcttccccttctctccaaatgtacttttttcaaaattgtcttggccaaagcaagccagacccaaagggacaaacactgatgtcactcctaggaggtcactagagtcgtcagagactggaagtaggatgggggttcccgggactggggagttgggtggggatgggggttcccagggctggggaggagggaggggacagagtgtgtcatgtgcacagttttagtttgggaagatgagaaaattctggaggtggccgggcgcggtggctcacgcctgtaatcccagcactttgggaggccgaggtgggcggatcacctgaggtcgggagttcgagaccagcctgaccaacatggcaaaatcccatcactgcaaaaaatacaaaaattacctgggcgtggtggtgcatgcctgtaatcccagctacttgggagctaaggcaggagaatcacttgaa

SEQ ID NO: 2658 - DNA, 1098 bp, Homo sapiens
acctttgtggcctcctggggacaggatggctcgggggcctgtggggggctgttgggactctcacactgcatggcctcctggggtaagatggctctgggggggcttgggggcactgtggctgtggaggcagccggggaagctcacacccttgtggcctcctggagacaggacagcttggggactgtggggggctgctggggacgctcacgtccatgtgcttcttttccagtgccatcaagtggaacttcaccaaggtaagggggctgtggggggtaggggaccagcttcccctggccacagccgtggcccagatgggcagcggacaggaagggcagcctcagccccttgcaggggtggccccacagtttggacaccgtctctccacagttcctcatcgacaagaacggctgcgtggtgaagcgctacggacccatggaggagcccctggtaggtcctctctagggagcccgcttgaggctcgggggcttgggaggtagctgccctaacccagctttcctccccgacaggtgatagagaaggacctgccccactatttctagctccacaagtgtgtggccccgcccgagcccctgcccacgcccttggagccttccaccggcactcatgacggcctgcctgcaaacctgctggtggggcagacccgaaaatccagcgtgcaccccgccggaggaaggtcccatggcctgctgggcttggctcggcgcccccacccctggctaccttgtgggaataaacagacaaattagcctgctggatctttctgcgtaggggcttggggggcccttttgccaggggcccctccatgtcagggccagttgccgtcagctgccaggctgggggtgccatggaggtggcgtgttgttgccccctcttcctccaggctcggggggctgtgctggctgcagtgctggggtgcagtgagatctgggcccgttggacacccagccctggctcttaatccgtgcagccccacctgctgtgcacaggcagggcctggtgtagtgccgagtcttggaggagataattctaagtggctgtgcttcctggccccgggccttaactgttaggaggtggcta

SEQ ID NO: 2659 - DNA, 1151 bp, Homo sapiens
tggcacgatcttggctcactgcaacctccgcttcccaggttcaagcgattttcctgcctcagcctcccgagcagctgagaccacaggcatgcaccaccatgcctggctaatttttttttttttttttttggtagagacagggtttctccatgttggtcaggctggtctcaaactcctgacctgtggtgatccgcccgcctcagcctcccaaagtgctgggattacaggcgtgagccaccgtgcccggcctgtctctttcttttctctgtctctctctctccctcttccccctgctcctagtctctctctctgtctccctccctctcaatctctctctgcctatctccctctctgtctctgcctccctctctgcctctgtcttcctctctgcctctgtctctctctctgcctctgtctctgtctccctctatgctccatctctctgtctccctctcagtctctgtctctgtctccctctttgtctctgtctccctctctgtctctgtctctctgtctctgtctccatctccgcctctgtctctctgtctccctctctgtctctgtctgtgtctccctctctgcttgtctctgcccctgtctctctgtctccctctctgtctctgtctctctgtctccctctctgtctctgtctctttgtctctgcctctgtctctctgtctccctctccacctgtctctttgtctccctctctgcctctgtgtctgtttccctctctgtctctgtcgccctctctgtcttcgtctgtttccctctctgcctctgtctctgtcgccctctctgtcttcgtctgtttccctctctgcctctgtctctatgtctctatgtctctgcgtctctgtctccctgtctctgtctctctccatgtctctgtctctgtctccgtctccatctctgtctcatgaattctcctgctcctcccctcctgaacaattgctgctgcatctgttcagcccggagccctcggggccactgtgctggttctgtgagcaccgcccgcccggctccctgcccaccctgcctacagccgcctcatgctccagcgtccgtatgtggggcagcttggacccaaatctccctgttaaagcagcagaacttcatttggaggaagtctgaccccggtgccaagtgtg

SEQ ID NO: 2660 - DNA, 1166 bp, Homo sapiens
gctgccggggcagcttcccccatcacaaacaggtgccaggcgcaagctgcccaccagcacccacagccagagggcgggtgctgcccctggggtggaacgtgtgagagggtggtgcgggaatgtggccgcgtggcggggcaggcgggggcacccggaggctgatggctgcagagagcagcactggcgtgggcaggggcagcgccggacactctggggtctccctcacccacctcccttccctggccccctcctctgccactgcccagctctgtggggggcgaagtcctctcaggcaggcaccttggcccaggagtaggggaacctcacggatgtcttgaatgtgtcccctcctgtccccccactgtccccccgctgttcccccactgtcccccactgccccccgctgtccccatctccccgctgtctccctgttgtcaccccgtcccttgctgtccccccgctgtcccatccgccgctgcccccccactatcccccactgtttccctactgtccccctgctgtccccccaccatcccccgctgtccccccactgccccccactgtcccctgctgtccctccactgtcccctgctcttcccccgctgtcccactgtcccctgctgtccccccactgtcccctgctgtccccaactgtcccctgctgccccctgtccccccactgtcccctgctgtccccaactgtcccttgctaccccctcttgctacccccgtccccccaaggtctctcactgggctgaccctcccttggctccagcccttcaggcctcccttgccccgggctccatgttgagggacgaagcgctctgtctgcaggggtcaggacctgagacggcctgcagtgtcctccccaccagacggtcctggcggccgagttggggcctgcccaggtgcctgagcttgcagggctctctgccccatattagctgagccttgtgaaatcgccagcccccgccccctgcacccggtcctaggatgcgagttgtgcgcccgccaggtagagggtgattgccctgtcttgagcccatctggaggccagtgtgcggtggtcatagctgcaggtggggtcacggctgtggggcggcggttgcagccgcaggtggggtcatggctgcaggtggggtcatggctgcaggtggggtcgcggg

SEQ ID NO: 2661 - DNA, 1220 bp, Homo sapiens
ggcctgtggcctgcatcccctcccagccatgctcggctctcatccctgggaatgtgagtggaaggcgggttcccccggggcccctccctcgcccgctggcagaccatcagctgctgtgtgaccttggccgaggccctctgcctgtctgggctctgacttcctctaacacgaagtaagtgttggactgggccaggggtcagcagacttttcccatcaggccccggatggtggtgttcgtggggttatggtcagagaggctgtgtctccacaactctgctgctgttgaggcgaggaagcagtcagaggcgctgcatgacgaatgcacgtggctgtgtgccagtaaaacttaccgaagctccggggcagggggtgcttttgccctctgggctgtagcacatagatccctggactgtttgacagtagcccttcaattctgcaggccttgggtcaggcaggatcctggagacagggctgccttatctgggctcgaggcaggagtttgtgtggggagcagaggtgtcccatctgtagcactggcagcaggcaccagccctgctcagccagctcagcagggccagggcagcccagaggggctggggcccgctctgccttgtggacagggtggcaggtcctgtcgtcaggtgaggccaggataggggacaagtgcagagagaaggtgctgtcagcatgacagaggacacatcatcagacagtgggagaccctgtgttgtggctccagccagcgggggtggggtgagttctcccagcccccacccccaaggtagctaggggccagggaggggaaggcctcctctggctgccccgctccagctgagagaatccagatcttgaaatgaatggggcccaggggtgactagagacatttagagtccaatgtggttgcagcacatcccagaacctgtttgctggggcctgcccactcaagctttgctggggaggctgttgggagaagggggccgaggcaggggtggggcagtcccccagcgctctccagaccagggtggagctggcaggagagggcacctctctccctctcctcgttggcccccaccagcctgtatgtgactctctcatgccttccgtagtttcagccaggctgtgcaggccaccaggtgtccaggacacgcccttatgagtggccacatgttgaccagggctgccacaaggcactatcggtgccagaggcccttccactcact

SEQ ID NO: 2662 - DNA, 1119 bp, Homo sapiens
cccaccaccacccgccctgcaacttcctccctggggaaggctaatgggcgggcatgactcggtgccaggcagggaagcaaccctggggagcccagtgtctccgcccagcaccccctccagccccccccaacccagctccttcctgacgcaggcgcccagggaggagggtgtgaagccaacacgccctgggccccctgccaaccgcagccccccagcggcggggagctctgctcacactcgccccaggaaatcacctgcagcccccgccctggctcgggaccccggctctgcccccacgccactgctgctgctgctgtggccacccccatggcagaccacccagctcccggcccccgccctgcccccgcgatgtagggaaagggcaggactctacatgccgctgggaaagcggaagggggtgcgggcctcggggccagggaggcccgggaagccggccaccccttgctggggcgggtggcagcctgcgtcccccaccctggcagcgggcggattgctgaggcctgtgtcaccctcctgggaggtggccagggcccttgtctgaggaaggcttggccgcagccaagaaaatgaggaaagaaggagaaaaaaaaaaaaaagtccgcagcaaaaccgggaaccgggtgagggccagccccagcctccctcctggccgcttactaaatattttcctaacatcctgtctaggcctcactggccccagggctgggcacccccgccccctcccctttcggggtagagaacaaaggccagagagaggaggggagggtgacgagatccccaccctctcacgatgggggtcacggaaggcggaaggagtgtcacccaagccgccacccccagccctcagcagaaatgtaaaaaaggagaaactcgctctggggaagccacagcggctggaggggggctcctcggtgggggcggagggggctggggatgcaggccagggtgtgagcggggatgaggccccataggccaaggtcatcctgcaggcagtcttgtgaaagccaggcccccttcccccagggcagccaccgtgggagagaaagccctccgggtcaggtggtgaatcttgggggagaggaggtggggaggccaggc

SEQ ID NO: 2663 - DNA, 1128 bp, Homo sapiens
cagccggcggactgtgctgtttcctccgcccccactcccgtgttttctgacctcctgcctgagtttggggtatttatagactattaattttctgactgagccaatagtggttggggaactcttgaaaaaggggagagaatggctgggtgctggggagttcccccctccgagccctccttcccggcccaacctgagggatgtggatttgggactgtctgggggcccctcctgcagcgaggatgggagggggtgctgagctgtgaatcccctgggcagggggcgacaactccgtgtagcattaacccccgtggcggggtccgctgctggtctaatttggaccccctgcctctcagtgcccctgccctaggggtgtctgtctccagaggggagggacaaatcccctactggggccatttcaatggggtagtttttggatttttttccccactcactttttattttttaatgataatggagatgtctggacccttcctcaccccacctgtcggtcttgtcctggctctgcctgtcccccaccgttgttctcgtaggtgaaccccaggtcctcaactccccccctttatgtgttgaaagttaatggtttcagatgtgaacatcacgtgttataactgtagcgctgtaaatttttttgtgggagggtgggcagggaggggtcccagagggtagagctcaaggattttgggttttgttttgttttcatttttccaaaaaaaaaagaaaaaaaaatagaaaaaaaaggagtaaaaggggcgggtttgttttttgaagaactgtcttggatacctatttaaatgtgtgttctgttttgttttttaacgatttttaaataacgtctgtgcctccactggttgagggtggaacctccaggcaggaaccggctcgccaccctctgcccggtaagggctgcccaagaaagcattacccgccctcggggggtcgggctgtgggggtcccggcacctggcgtgagtttcatgtatgaaaacataaaattgaaaaaaaaaaaaaaacctacacgagcaccgtgatttcaagtaataaacagaaaatgaaacacacattgactcccgcctgctcgcctagtggggggatctggccttggttggga

SEQ ID NO: 2664 - DNA, 1528 bp, Homo sapiens
tggcatgggggctggcggctcagcctgttgtggcagagcagaagtagacgggtaccttccggtactcaacgtttgtctgtcttgcagccggagtcagagtggtggctacagtgaccggagctcgggcgggtcctacagagacagttatgacagttacggtaagtcacactccgagggcgccacgctgctgtggcctgcggtgggagctcggttcaccttggtgccctctccaagcactttaggctggacactcagaccttgtcactgtgcttgcccagaagaggcgcatctgtcctctcagagccatttctatcgcaggacgcaaaagccaaatgagactgaccaaaaaggcaagggagagcgagggcccgctgggcagtcagctaggtgcatgtgtggccgcaggccagcctccctcggctgtggggggtggttgctccccggccgcaggccgcgccctggtctggcctctggggtgaagctgcctcttgttgcttcggtgcctttacactgtgcctgcttcttgtcctcagctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatgaaccttgctctgacaattcccttgcattgcaccacacactccttgctgcgggctcctgcagccagacctgagcagagagagaaggtggagaagcagcgggtctgcaagccttccctggggcctgcagagctagaaagggaggcccagcagactggcgctggtcagggtaggggagccaggcgggggacgggagcgggcagctcaggcctcagggcagccctgggaggcttctggcagtggtggccagaggg

SEQ ID NO: 2665 - DNA, 1196 bp, Homo sapiens
agtttgggtgtttagtgttagtttttatatcattagtactggttgtaaacttatcaatttaagcaagatggaaaatcgagggtgtgtcagggaagggggaagtttgagctgaaattatgacctcttaggggtgggaagaggaggctttggggttgtgaggtctgagcccccttactttgggatgagtccacatcgcggcgactcctctgcagaatgcggtgatgttgcggtaaggggtccgggatagctgcgaggcagctggaccaatcctgaacgaaagacatcagtgatcgcaagaggcgctaaaacttctgccgaaacccgggatcgaaccagggacctttagatcttcagtctaacgctctcccaactgagctatttcggctgggcggcagagtcgctctcgccgggactccgtcccgcgctgcgccttccctgcgcaggcgcagtcgtttcgcgtcagcaggccccacatcctttgtaaggtctcccagggcgccggagcgcagtgtcgtctctgtggcgcaatcggttagcgcgttcggctgttaaccgaaaggttggtggttcgagcccacccagggacgcgtggtgacttttgccctcctggaataacaagaaaatgagtgtcgcctctgtttttgtcggtccgccgcagacccgcggcccccacgtgcgcactccgatgacctttccgcctcgggtgatctgggggtgcacggcgcaacacgaccacggaggccgaaagcgcagcggaacctcccggctccaggttccggtttccgcatgcgctccgagccgctttgggcggcggccccgggaacccggagcgctaaggagaacggacctcagaggttgtctgaaggccgaggccaagatggcggtgctgtcaggtgagcgcggcaccggcggcgggtgtggggccgcgcgggtctggggccgtgggagcctcgggtgtcgtggtggcgtcgggggtcggtgccggcgtcgtggccgcggtcctctccgggcttctccgagccggccgctcctcgggctccccgcccggcttgcgatgaacggtcgccgttattgcgtccagagtacagtcggggaaaccgaggcccggtaggtcatgacgcaagcctccagcctcaggaaggcgctcggggtggaggctggaggggccccattcacgtccccgagaccagggcacg

SEQ ID NO: 2666 - DNA, 1181 bp, Homo sapiens
gtggcggccccgaacgggaacttgggggggtctggagcgtccccgttgccgcctgtagggcttcctggcctgggggaccccgaatgagaacctgagggagtctgcggggagtccagggcgccgtcgccgccgcctcccggcttcctggccagggggaccccaaactgtggcgtggggggtggtccggggcgcccccagcgcgcgcccaaacttggcgggcggcgcacgtggcgagccgaggcgagggttccggttctgccaccgcccaacctatcccactcggggctccgggctccccgctcccatcccacccccccaaagtggtaaggtcgggaggggttcgcaaacccagggcccagggggctcgggtcagccggggcctgctgtgtttacgttgcctcggcgcctccccgccgggggtgggcttgagctgcggaagggagagtcagcgcttccgaggcggcgacgggcccgcggatctttgctgcgccgaggcgtcccctcctataggagcctgacctgctccggaccccgcggggccgggaaacctcatttcgctgtgccccagggctcggcgccattctttggtaggagcggctcctgccgcagcgacgtcgttttagagttgcattcttccggcaaaacagtctgggttgggtttcctagtggtctggtgtaaatttctcggtgcccttagctttgagcagcgccctgtgttctcagcgctgggcttggctagtgcgggagcggttgctgctagagggttgccttggcaggcgcctctcgcaccagctacaggtcacacttgtggatgggaaatgccttttgtgggctctccccctccccagacaaaacaaaagagcaccttccgttggagaaccaggatgaaagcacttagcccctgcctagcccgtgctgtgagtcctctccaggcactttgacttggcagggtccgtgtgcctgtgtgagggacattgcagggatgggcctgagcagggagtccaccggccatgggggatggagccatcgactttggggtgaggcagggaaagggctcccagatggggtacctggattaggtccattcaagccgcgggtgaacgtgggcccgctccacccaagccgtggctgtgaggaggctggagagaggtgagggctcctgtcccctccctgcatggaca

SEQ ID NO: 2667 - DNA, 2107 bp, Homo sapiens
tgcggggccacgggggctccctggagtcgggtcctggcagtggggactgcctggtgaacacagatgtgcttgggatgacgggtgcctcccaagagcttcccatctccctagaagagcccaagcgtccccgtcccgtggagtcgctaaagccagccctccctgtcctttccagaggccctgccgagagcccgtgctgcctgctggagccgcctgcagacgcggtcctcggccccacgtgaaccaggctcggcggcgaagcccagccttggagacacccaggaggaaggccgtgctcctggctccctcctcggcccgtccccacttcccggggcctcggggcacacagctggggctgcccccacccgaaagaccctccacgctcgtcctctacagagtccggcttcgggaagtgccgggtgctcctgggccctgcctggctccctacgacctttgggctcgaggccagctcctccccatgcccgctgtcccagctccttgagactggagagcagccagcaggtgcccggcagctcggcgccacggcttgctgacagctgggagggtttctcggtctggaggcgtagttttgaaactcacatcacccactgtgcagcgtgaggacgggactctggtctgctgtggggggcatgcaggacggcgccactctctgccctgccatgcggctggtggtgccacagagcctcaccgtgcctgagtggcatgcccaggaggccgctctccttcagtaaatgtaacacagtcgaggcacgtcatcgggcagccttccctgtgtgccaacgccagccttcgcttctgaaaaccaaactccagccgctgccagtcgggacttggtcgcccggcgctgccagaatgctccactgccagccggcccccctgcctcggtttcccttctgtttagtggcgacacaggcacccagctttggggtggtgctgacgctcccaggggtgccaggagccactgggacagggtgaggctcccagacgctcctcgaggtgcccagctctccagggagcttctggcccaaggccgtctgagggatctgctccttaaccccccagtgccttggcgagggcaggttccaagccacagacgcctgccccgagtggactctgcggccagtccctggtgccctcctggccctgctgcccagtgagggctcctacgggtgggttcattggcctgggcccagcgagcccccacctgcattgaccttaggcccatagagagggcctgtcccggtgctgccccagccaggatctggtcgctgccccagggggactgatgggcagagtcgcccctgtggctggactgtgaccatccctgatggggcctgaccgcgggagctgaggaagcgccgctccaccgtctgccctccaaggacccgcatggaggcagtgggctggcagcttcctgctgctccctgtcagagtcaaagcacaaatcctcaggacgggctcaagggccagggcagccgagggaagctccaggtggggaccacgtcttcctgaggttggtgcccactggctgggaccctttgcagtggggtggcctcccctctgtctgcctggtggagggagccgtgggcgtggggacgtgactgaataaagccaccatgggtggatgtgcttggagcctggagttcggtgcgtccgctagactttggtgcccacgtttgagcttctgtctttggttgggtgatgaaaggctgaaagcggtgtggggacagggccagcaggtcccccaacctcgcggacattcacaacccaagagtcaggcttaggggtattcagagaagaccaggccggcctgggcatctgtgggcaagggccgtgccccctgaggtgccgctggctcagcctagggatcgtgggtcttggccctgctgccccggtgaggaagatgggctggggctcagacccagcaccgctccttccaaaggaagggaagcaggaggggctgcctggcagggagggccccccaggtcctcaggtcctgcacagccgctgcagggaggggagctgtgccccgggaccctggacttcagctcactagccatggccactggaagctgctttctggacctga

SEQ ID NO: 2668 - DNA, 2609 bp, Homo sapiens
ggaggccaaggcagccagatcatgaggtcaggaggtcgcgaccatcctggctaacactgtgaaaccccacctctactaaaaatataaaaaattagccgggcgtggtggtgggcagctgtagtcccagctactcgggaggctgagtcaggagaatggtgtgaacccggaagtcggaggttgcagtgagccaagatcgcaccactgcactctagcctgggtgacagagcgagactccgtcttaaaaaaaaaaaaaattaggccgggcacggtgactcacacctgtaatcccagcactttgggaggctgaggcggacagatcacctgaggtcaggagttcgtgaccagcctggccaacacagtgaaacctggtctctactaaaaatacaaaaatcagccaggtgtggtggcgggcacctgtactcccagctactcaggaggctcaggcaggagaatcacttgaacctgggaggtggaggttgcagagagccaagatcgagccacttcactccagcctgggcgacagagtgagactccatctcaaaaaaaaaaaaattaggcgtggtggcttgtgcctgtcgtcctagctacttgggagactaaggtggaaggatcaccctagcccaggagttcaaggttgcagtgagctgtgattgagccattgcattccagcctgggcaagagtgagaccctatctccaaaaggaaagagagaaacgaagtcctgtccctatcagcagccactccacatcctgcaccccagcctctggcactacgcgtccccttcctgtctctgaattatcctgttctagacatttcttagaaatgggatcacacactgtgtggccttttgtgtctggcgtctctcactgaatgtggcgtcctcaaggtgcatccacgctgtggcctgtgtcagagcctcgctccttttcatggctgagtatgtcccatcgtgtggatgggcgtttgtccgttcatccattgaaggcgtctgggctgcttccaccttctggctcctggggacatccgtgtagaagtgatggtgtggatgcgtgctcatttttcgggcagatacctaagagtggcgtggccgggtcatctggaaactcagtgaagagctgtcaggcttttccaacatggctgttccatcttacatcccaaccatgatgacggtgtgttgggttgggtgcttgtcatcctgtagtgtgacctcatgtgacacacagggcaacccattggtgggtgtccttatgtcctggagaggatgagttgccggcgcttgtccatggcaggctgagagcagagccccgtgtctgagagcaggtctgtgtttacctggctgccttgttgcgagctctccagtcgggttatgcccaagcagctgttagggcctggccccagatcttagaacgagaccccttcccagtctggccctgctgctgtaaccccaaggtggaagaagattgcttttagggctgtccctcacatacctgttctccgtggggtcttttctcaagaatgtgacctaaattccatgtctggaatgttctggacatgtgagccatcctcccagagccggggcccaaagccctgtaggtagtagcgtttgtacccgaactcagcgtctgctgtgcctgacgctgccagggcctacggtggggaggattcagaggggaccggggttgggggtctggagcaaggatccgatgtggaggctggggctagggccagggtgtgaggatcggggccagtgctctgggtctggctggcgcccagatctaggggccagttgtggggtgctggggtctgggatgaaggtctggggtcacgccagggttggggtctggggctggggccagggcctgcctgggtttggggtcagggccgtgttggggtctggggctggggtcgcgacctgaagctggggctgggactgggtttgggtctgcggccgaggcctgggtttggggtctggggtccgcccggggcgccgaccgtcccgcctccccgcagcccgagcgggaagaagttccgcagcaagccgcagctggcgcgctacctgggcggctccatggacctgagcaccttcgacttccgcacgggcaagatgctgatgagcaagatgaacaagagccgccagcgcgtgcgctacgactcctccaaccaggtcaaggtgagtggtggcgtcacgcaggtgacgtcggcgcggggcgttctaggcggggacgcggccatgacgtgagctgcaggcgacacagcccggcgtcctgagcgcaggaggtcacagcgggcggagggcacagagcggaaggcgcaggccacagggtgcagagcgcaaggcgcatggcgaggacgcggcccgcggcgggcgttccagagccggccggaccgaccctgcgggagcggcctccccggaccgtgggggtcctggcgggcgcgggggacacgaggggcgccggcaaagcagggggtcacccgggccccgcaccccctgaggctccgcgccgccggggcgcccccaggccggactgcatatccttcctcccgcagggcaagcccgacctgaacacggcgctgcccgtgcgccagacggcgtccatcttcaagcagccg

SEQ ID NO: 2669 - DNA, 1242 bp, Homo sapiens
gggactggctgccggacggcgactgcggcctttgttcgtgcgcgctgggccaggggcgcctggcggcggccagatgctaccggggggcaggggtggagggtgggctgtccctttggttcccgtgagacgcagggggtgccttcttggggcgctcctggggtggcgcggagcccgagggggtggccagccgggatttcggggagcagggctcatgggcggatcggggagggcgtgcgtgaaaatacgggttcttgggctcgccccagtcctgggaataagcgcctcagggtgactggtctcccacgcagcgttgctttttttaaaggtattccccttgactccttccgaggcctctggtcctcttgggtcgtggccccctcagggtggagacctgaggctttcgactttccgagcccacctaacggtagtctttgcgtggatgttactggtggtggaaggctttcagagacccccccgtccccaaattggaacaaggcgctgctctgaaaggtcgcagggaaccccctccgtggaacaaagacttagtcgcctgctgcagccaagtcccagacagtcggccacctgctgtttgtcctcttttttttttttttcctggctcgggaaagatgcttttgattctgggccagctttgattgcgccctccccttggttcagtgtcccgtggcgccttcaggtcccccaggaggggaaagcggaggacgcctgccatgtgccgagcacctgggtaaaggggggtgtgcggctggtccccctttttcccacagctcggggtcgtgggcaggagaccgcccaggtgagggcgggtggtttccacgagccaaggaggggcagaacgaccgctccgtccactgtgcacttcggtcctctgtggttcttgactgtcccggtttggggagataaagtgagaaaagtgagcggggaaaggatggctgtgatcagaagcaatgtgtggggcctcgtcctgcaggaggagctcagggactggttcctggaaagttggaggacagcaagagaggggaaacttggtccccaaatgtgtacccttatgagctggaaccctgtacacgtcctgagatctgcagtgacacatgctgaaatctgggagggcagatgacggggcctgaatgagactggggtcagggagggcttctctgaggacgtgacattgagtgacagggagaggcgtccaggcagcaggaaccccctaagaggtggctgcag

SEQ ID NO: 2670 - DNA, 2318 bp, Homo sapiens
catacactttgtcagagaagaaaaaaatgccttaactataaaaagcggagaaatggaaacatatcactcaagggggatgctgtggaaacctggcttattcttctaaagccaccagcaaattgtgcctaagcgaaatattttttttaaggaaaataaaaacattagttacaagattttttttttcttaatgtagatgaaaattagcaaggatgctgcctttggtctctggtttttttaagctttttttgcatatgttttgtaagcaacaaatttttttgtataaaagtcccgtgtctctcgctatttctgctgctgttcctagactgagcattgcatttcttgatcaaccagatgattaaacgttgtattaaaaagaccccgtgtaaacctgagcccccccgtccccccccccccccggaagccactgcacacagacagaacggggacaggcggcgggtcttttgtttttttgatgttgggggttctcttggttttgtcatgtggaaagtgatgcgtgggcgttccctgatgaaggcaccttggggcttccctgccgcatcctctcccctcaggaaggggactgacctgggcttgggggaagggacgtcagcaaggtggctctgaccctcccaggtgactctgccaagcagctgtggcccccagggctaccctacacaacgccctccccaggcccccctaagctgctctcccttggaacctgcacagctctctgaaatggggcattttgttgggaccagtgacccctggcatggggaccacaccctggagcccggtgctggggacctcctggacaccctgtccttcactcctttgccccagggacccaggctcatgctctgaactctggctgagaggatgctgctcaggagccagcacaggacaccccccaccccaccccaccatgtccccattacaccagagggccatcgtgacgtagacaggatgccaggggcctggccagcctcccccaatgctggggagcatccctgggcctggggccacacctgctgccctccctctgtgtggtccaagggcaagagtggctggagccgggggactgtgctggtctgagccccacgaaggccttgggctgtgcgtccgaccctgctgcagaaccagcagggtgtcccctcgggcccatctgtgtcccatgtcccagcacccaggcctctctccaggtctccttttctggtcttttgccatgagggtaaccagctcttcccagctggctggggactgtcttgggtttaaaactgcaagtctcctaccctgggatcccatccagttccacacgaactagggcagtggtcactgtggcacccaggtgtgggcctggctagctgggggccttcatgtgcccttcatgcccctccctgcattgaggccttgtggacccctgggctggctgtgttcatccccgctgcaggtcgggcgtctccccccgtgccactcctgagactcccaccgttacccccaggagatcctggactgcctgactcccctccccagactggcttgggagcctgggccccatggtagatgcaagggaaacctcaaggccagctcaatgcctggtatctgcccccagtccaggccaggcggaggggaggggctgtccggctgcctctcccttctcggtggcttcccctacgccctgggagtttgatctcttaagggaacttgcctctccctcttgttttgctcctggccctgcccctaggtctgggtgggcagtggccccatagcctctggaactgtgcgttctgcatagaattcaaacgagattcacccagcgcgaggaggaagaaacagcagttcctgggaaccacaattatggggggtggggggtgtgatctgagtgcctcaagatggttttcaaaaaaatttttttaaagaaaataattgtatacgtgtcaacacagctggctggatgattgggactttaaaacgaccctctttcaggtggattcagagacctgtcctgtatataacagcactgtagcaataaacgtgacattttataacgatgccctgcagtccccgggttctttttggtgtcacatgtttaggaagggaagtgggggggggccctgacgttcacctcgggtgcagcaaggaccgtggtccaccctgtgcactgggcttcctcgaagcgactcctcactctgaggagcccatggctcccagggcggctgggaacctgcatgtgtactcagggctccaggccacctggaagcaggattggctcccggggaaaagcagctccctgggggctgcacttgggcgcgtaggaacca

SEQ ID NO: 2671 - DNA, 1185 bp, Homo sapiens
aggtgttgcttctgagacctgggatggggagggaggggacctctgggttcttccaaagaacatttgactcagtggggtcgggagggaatcctggcttatttattttcctctgtcctcgggtgtgggggccctagctcgccctctctgggtgggtgggtgagagaggctgcaggggaggctggcaccgggcttgggcctccagtccctgccttgctgactttggccgttgcggtatcacgtgacaatcaactctcccttaacgacgactgcggctgttgggctgcgctgccctccctggcctgcaggtggggccgtggagcccatgcccgccggggttgcaggctcttccgggcctgggctgcagcctggcccggccctgcttccctggcctcccctccttctcctgggtgcttggaagaggtgggtcctggcccgtggttgaggtcttgcctcgtggactggaagcagagggctggctgtgcagcctcctggggtagctcgttttttttgcaccgggtagaatattttttcaggcacggattcctttttttctgggcccccatgggtggtccggcatcctcagggggtgtgagtgtgtgtggggggtctctgagctgaacttgggtggggtggggacttgttcctcgggggccacctttgtgtccttgtcagcggtcgtcctgctgtggcctgggttgcatttcctcttggggggggtattgaggacccccagcctggaatgagaagggtccccggttccatgtcagacccagaaaggtggatccccccactgttggctgcaggaggtttttggtacccccttttgttccagaaccgtcctgcctctcgcttggggacaggggggctttggatggcactggtgtgcacctggacccagccccggcctggcaggatccagggatgggtgcctgggatcctggggggagggaggcaggggacgcccttctggagctgggctcggagggtcctgccccatccagccctcggctctctgtgttctctgtccctagcctcaaaccctcttctggcagcgctagtgagatgccttagtctgtgggggtgggtgggggactggggccccgttttcctttgtgagtcttggttggccccagccctggcaggggcctgtctggagcaggggtaggtagggctgtgggttccaga

SEQ ID NO: 2672 - DNA, 1224 bp, Homo sapiens
ctgctggatcagggcagccggggaggtggccaggccagtggccaggccctgtggagacaatccctcaggactagggacagggctgtgccggcctgggccagggcccacggacccgcagctcagggcgcctgcccacgtcgtctgccggcggtgcgccgcgggcgtccctcgcgtctcttcactgcacattgcaatgcatttgcgattcccatttctctgctaggagccagcctgggtggcgctgctcccagagccgtgggtcccagaccttgcgttccttttgttcctgtccgtttatcaggacacgggccccacctgtcacgtgcccgaggccacccaagcccagcctgcggggcgttcccactgcctggatgccggcttgagttctgcgcacgcaggattcagtgtggggacggcccctgccggataggcctagccctggcccaggtggtgagcggtttgcagtgtccgttctcatccacctgatgggcccagataaaggcccccgctgtccagcctccctggacggccctcgcggtccctgcagcccaagatgggactcagaccctgtgccccagagctcccctgccgcagaatggggccccagccggccccgaccgggtccaggagcactgctcgcctgtacatactgttgccctagcccacctggtgccgtgggagccacccccaggtgctgggggcacagcccctccccactccggccacgcccccacccaccccgcgtgtttctgccctgtgactcctggaacctgcgtcctccccaaagccatgggaggggtgtcctcctcagaccatgcccccagatgatttttttaaataaagaaacaaatgcacctgccttgagcgcacactgctttgctccccttcactctctgccctgtcatccgggctgcagtgggcgagggatgtcgtgcgccgagaggggccctgaaccccgggtctggtcgccagtgctgcgagaccctccttaagtacccacaggccacactgaagcccgggaggtcgagactgcagtgagcagtgatgcaccactgccctcccccctgggcaagagcaagaccctaactaactcaacacctccccccaaacccaaatgcaatggacgtgtgtgccgatttccccgtggggaggccctgctggctgctgggggaccgtggatgtgagagatggagagaaagcagggagtgcccagttgtggcctca

SEQ ID NO: 2673 - DNA, 2271 bp, Homo sapiens
gcattgcaggcacccgggaaggtgagcagagggtaggtgggtgggcttgtcccctccccggtcccccgccctgctcacctctactatgaaggtgcccccaggtcacctgtgctgcccgccatctgcccacgtggcttgcagtgactcaggagagcaggcccacagcgtttgccatcttgcagagctggggaggggcacaggaccctgccctcgtgttccctcccagcccgcagtatttcagggacaggctcttcccctctatccctcaccctgagagcacccctggtggcttggttggggaagggaggggctgcctgtctctggaggtgtcaggcaggcaggtggcaggcagctcacccacccaccccatgggatcccccagcccttcacccgcgcctgccttgtccccatgatagttgacaatcggggcttcctgcaaggcccgtctgtctgtccaggactcctggtggccagattcggcctccgaccttgaccttaaactgcagctgaccccaggggctcgccgctgcccctcccctccacaccaaggcctgagacagcaggagccccgcctggcccgaagccgtttccaccgcagcaggcagaggggctggacaggcactgtcagccaatgtggggggtcctgaagacacccccttggggcacccgagtgccccttctcagggctcagtctgaccgtagccacgtcctgcctcgcgccgcccctcgggcctgacctggaagctccgtcagctccgtccttgtccttagagctgagcccagaccccggggtctggccgaatcctcacccccagggcagtgtttttggtctgccaccttcaggaaaacggctgcggcctcggcctcccttcgggcacccaggaatgcgggggtctgctcagtccccccaccctccatgctccaacccccgggggctgcggagcctgctgccccctccccgcgggtggggacgttctatgcaatacagggttccactttagaagtgcgcgcggctagggtcaccgcccgcccttcccggcgcagcccccgagctccacagctggggcagcccctctggcttctaaatccgcggtcgggattcttcctcctgtttagttttttagtttttccttaaaaaaaaacaacacatcgatggactttgcttccctgttcttgaagaatacttgaatgtcggggggcctgggggtgggggcctcggagaccgtctgcctggccctgctgcccctcctgaatctcgtatgatggtcacagtccggtggccgtgggggtgctctgccttccctggtccccactgcccatatctgtggactgccccttccaaagacccctggggggggtggggcattccgcccacccctttcccccatcacttctcgcctgtcagtgattccatgtttcgtaacgggggattctctgcctttttgtatcaaagaacaagcaaatggacccccgcccgctgcaggcgcccatagccatcgggtctctaaagctgagtggctagcagcgtttgtttgtttgtttttttttttttttctgaaggtgggacagtcacttcctcctccctccccacccctgtcgcatccacgtgcgacctggaggactggtcagaaccgttactgtgaatgagtgaagatcctggaggaccctgggccccaggccagctcccatcgctgggggacggtgaacggccatgtgttaatgttacgatgtttttaaaagacaaaaaaaaaaaaaaaacctcaaaagtttttttaaagtgggggaaaaacatccaagcactttaattccaatgtaccaggtgaactgacggagctcagaagttttcctttacaccaactgtcaatgccggaattttgtattctgttttgtaaagatttaataaaagtcaaaaaacttgctgtgtgcctgagttttagttttctgtcaccgcataaggagccatccacaaccagttggtgcaaaaccacgttgttgctggtgatgctgagtcaggagttttgagggggtgcgctcctgtggggtctgtctctgctccaggatgcctggatgcactgctgggaagacaggcaaaaagctgagctcggctgggagcagtggctcacgcctgtaattacccagcactttgggaggccaaggcaggtggatcactcgaggtctggccaacatgatgaaatcccgcctctaccaaaaatacaaaaattagcccggtgtggtgcaacatgcctgtaatcccagctactctggaggctg

SEQ ID NO: 2674 - DNA, 1231 bp, Homo sapiens
tctcgtagggctgcctgggcgtggcgtctgagccggcagcaggcgcctctgttggtaccgtccctctcgtcctctctgacatggcttctgtccctcggcagcatgcggtgcacagaggtggtgcagggaatgggcttggggctccatggagcggaggcctgtgggacaggctgggttctgggctggctgcggcatccttggggtgtcatccctcactggggacagccttgtttggacgggttcctggtcctcagtgctgtgttcttcatgacaagccagcaacctcggggtgggcagtgttctctcccgccctgttgtgatgcagtctcaggtgctcctcccatggaccctggggatggcgtcgcgtgtggccctccctgtagggtgtgcgctcccctttcagtggctgagtggcagtgggatgggtgtgggggtgggaaggggatgctgtttagggagcaggaaggacagttttcctgacccaggttgggtgattaatgggccatagcttccaggagtagccaccactcctgcatcctcctgggaactccttcccaccccacgctgagtccttagacaccaggctccgccctggtcctttccacacagaggcctgcagagctgggtccttccttgacctgtgtgctcctcctcacagtcccagctgctcaggcgctcacctgtggtggaggctgatggcgccccgggcccatctgctctgtctcccagcgacgtcccagacctccccgcccttatggggtgtgggcttggtgctggtgcagctgctcccgtgatgtggattggagggtggcttggggtctggggactgcaggaaggtggatgcttcctattctagacctggagcccctggagtacagagcccgcagcccctcgagcctcagagcccgcagccccttgagtcctgagaagcttcccttataaggcagaaggagtgctgggtggggcgggcaccaggtcaccaccctgggaggacgatggcacaggggttgccaagctgcccagcagagcggctcaggatggaacatggcaaggccaactcgtgatcccaggtgcctgcgacgacccagttcctgggtggaatccgcaagtttgcagaagcaacagaaacaaagtgttcaggggtcctgttgtcattcgactctcacagttcagagggatgcatgagggacacaggtggcatacagttccagtcccctcccaggtggtgccc

SEQ ID NO: 2675 - DNA, 1133 bp, Homo sapiens
ccttctgtggggtggggctgtcctgggcagtgcagggtgctgagcagcgtccctggtgtccacccactccatgccaggagcacccctggtcgcgacaaccacacacgtccccatagagcactgtgtgccatgggggtagaatcactcctcggggagaccccggcttcgaggggaggcgtgaaggatttacaggacttttgtggacagagacaggcccacggtgggaaggagccggcccctcccatgccccctgcctgccttactgtgctgcgtgctctgtcagctcccagccttgcggggcagcacggcctcctctgaggggcttccctgaggagcgcccacccgggaggtgcctgtgttgctggatgctggccgttcttgcagccgtgatctaagtcgcttccagatcttctccccctccttttccattccactcagctgggtttgtggctgtttttctgaggttggaggggcccaggccaggtggtgttgaatggtgcacctccctgggccggcctctgtgggccactgtggcctgacgcagtgtgggagaagagggaagacgcgcagctcaggcttctgtccccacgcctgccctggggtgggtgaggtctgcatggaggggctgtgggcaggcgcaggccccggcctcacctgtggctcctgcagacatcggcaccatcatgcgcgtggtggagctctcgcccctgaagggctcggtgtcgtggacggggaagccagtctcctactacctgcacactatcgaccgcaccatagtgagtatctcgctgcgcctcagccgcagggccgtcctggtcttccaccccgcccacgtcacactgctctctcctttctcatgtggcctctgagaccctcccctcagagccctcaacgccccccggcccctgagctcaggcccagctcctcaaggcccctcagtactgcttgcaccgcaggacccaccagggtcctcccaggcactgggcgtgtcctgggtgagggctgagtgctgtctcccctagtctacgctcagctcctggggtggggcggggccatcagagtgatgtgtgaccataagggtcccggccgccatatccagaggcccctgtggataggagtcccacgtccctgtt

SEQ ID NO: 2676 - DNA, 2192 bp, Homo sapiens
tgcgcccttgcatgtgaaggggcctgcgcggtgacgcagctggccatgtgctgcgcgatggtgctgtgaggacggcgcgggcacgttgaacaagtgcatttacttttgtatttctcggctgtccatggctcgcagcatgccctgcgatgcggggcaggcctgtcgtgggtcccttggtgtttctgtacaggagagagtcacactaatgagtggcagtattttatagagatgtgatgagaatttataaatttcatagatttgacagcttttatttttagatggtataatgcacagtgaagaggaaagaaaagcgaggggaaaaaaccttatttattcaaacagtgcacaaaatggccccagcgtcagccccgaccctagacccctcagttgcagctcccagcagcccagacagagctgccggcgcccctgcctgccccacatcccttcctgtcagggccacgcctggcacccatcccttggagcctgtgctggttctcccagctgctgtgggtgtgctggggccagggtgcactgctgaaacctggcctctctggccctaggccccagggtgacgtcggccccccactctgcagccttggcgggtgcctgggactgggtgtggaaggagaggagctgaggccggggtgtagcaggcaggcagggccactccagtgcttctggagccctgagcagtcagggcctgggttgtctgagcagtggtggctctgtgccctccctggaggatgggatctgggagtctgagctccccgcatctggccctgggctgtgtggcacttgctgagcccaccttctcaagtgcttgctcctgtgagatggcatcggggagccccttccccaaggtgccacagatccaccctccagggagctgccagccctgtgttctggttcccaagggcaggatggacacacgtcacatccctaccacgtggcctccaaagggagccacggaggaaaggcttctgtggttgctaggtgggggagtcctgtgtgggagggcctgaagacccctgcttgtgcctggtgaggggggtgctgcctcccccagcccccaacaacctctcagacccccaccctccaacatagctgagttctgaagatggtgctccggacctgtcctcttaagtggtgcccagtgccctccccaccccacgttggtgctctcagctagaaggtgctgtgcctctgcctgagccccaagccccgagcctggccttcaggacaggcagcctgctctgtgtcgccacgggccggatacgccacagggttgatggcagagacggccgagtccctggtctagaacaagacacattctttaaacactgtattacttctgcctccctctaggtgacagtggcagtccgggtgccatcacgggtcctgcagatggccatgcagggctcctgcccacgcaggccaccgtatgttcaggacacgcactgggtctcagagccactggcccaggcagaagtctccttgagcccactgggtcatatgcgtgtcaccacacgtgaactagtgtggtggctgcctgcggacaccctcctgttctgagccctgggcctgtgttcttctcagacactcccagactgaggggtggtgtgtggcgggtggcagggtggctgtggagactggggatctggagcctggtgctggcacctggcctgagtttccgtgggcagctggcggggacctgtgctgctgctgctgactgtgggtgggcgggcggcgcctgggagtggctcttgctcaggaattgataggaaccctaaaaactaggataccccctcctcggcccatgaggcacgcacagtgacttatttaagacttcccccttaatttatctgcccccaggatgcgtcagtctgttcagtggtcagcaggccccccaccccccgccgactgccctcgccatcgtggtcagacccccctcccaacacaacacgctgctggtctgtgtcagcctttgtaacgtgggaggctctgccgtgtcttccgggtgaactgtatttggattgcgcgcattgtcacggtccgcccctgggctgcaggcgccccttcctctgggcacccctgcattctgcatccccacctctagacgctgtaataaacagactgttttcactcggacctggtgtgaatggcagcctttcttccaggtggcatgaggcgtc

SEQ ID NO: 2677 - DNA, 1172 bp, Homo sapiens
ggtgggcacagcagccatgcagagcgggcatttgaccccgtgccacccttttccccagctacgagttcatgcggagaagcctcatcttctacaggaacgaaatccggaaggtgacgggcaaggtgtgtgcagggctgcagagggccggggtggggctgcaggtggcagaggcagtcctccagccctggctcatggccacccgtcctccccacaggaccccctggaacagttcggcatatccgaggaggccaggttccagctgagtggcttgcaggcgtgagcgcagggcacggtggtcagcgtgcagcgggacgggactggccctgcccagccatgaatcgcttggccatgcctggatctgttttgttttggtttttggtttttgggtcagggtttcactgtgttgcccaggctagagtgcagtggtgccacagctcactgtgaccttgaccttctggactcaagtgatcctcctgcctcagcttcccaagtagcggggatcacaggcatgagccgccacacccggccatcacacctggattttcagtgggaggtttttggtttggagacatccaaagcctgaagccaggtgggtgtgggcaggggctgcattttatgaaactgcccagcaagctgcgctccctggggccccaggatccacctaactggcctggcacctggtgccacgtgctgctgccgccaggatatgcgccttcccacaggtgccctgcctgagttgtgtgcatccaggggcctggtgagcccccaggctggtggcatggcccccctgccccgtgctgaatgaatgtacagagccagacaaagctgtgaatggcctaggggctgagtcccacaccagctgtgaattctcctgcagacaggagggccctggctgtgcacctggggaagtggttgccctggggccagggtgcttgttctgttcaaataaaggtacctcttttccacactggatggcggtgaagtgaaggagaggggaggggcagccagggagcccccacccaagggaagtaaggctcagggtcctgagaggcagtggctgggcctcctgcactgaggggagagctagaacccccagccaggacaggtggaggctgggacccaggcctggggagaacagagctgctgtgtggtatcaggaatcctgtggtgac

SEQ ID NO: 2678 - DNA, 1172 bp, Homo sapiens; identical to SEQ ID NO: 2677

SEQ ID NO: 2679 - DNA, 1218 bp, Homo sapiens
gctgtaccttggagatggcctggtggaggacagaccccaccagccagctaggaggggatctggggtcctgttctggggagggaagagcagactccacgatatccttggggtctccagatagcccaccaggggtggggagggtgagcagggacagggcgcccccactgacttgggaccctcctcctccaggcccacacctcagcacccaggacatctgggccccccgcccccagcgctgtctagtttggttgcctggccgtcactcccagcctggttcccactcctgtgtcttctggggatggccctcaaggacggcatgttgacacatcaggcccagctctatcactggggagggagataggctgccagggacagaaagggctctttgagaaggccactctgcctggagtgggggcgccgggcactgtcccccaaggtcgcggcagaggagataggggtctgtcctgcacaaacaccccaccttccactcggctcacttaaggcaggcagcccagcccctggcagcacccacgatgcgggacctgcctctcaccagcctggccctagtgctgtctgccctgggggctctgctggggactgaggccctcagagcagaggagccagctgtgggcaccagtggcctcatcttccgagaagacttggactggcctccaggcagcccacaagagcctctgtgcctggtggcactgggcggggacagcaatggcagcagctcccccctgcgggtggtgggggctctaagcgcctatgagcaggccttcctgggggccgtgcagagggcccgctggggcccccgagacctggccaccttcggggtctgcaacaccggtgacaggcaggctgccttgccctctctacggcggctgggggcctggctgcgggaccctggggggcagcgcctggtggtcctacacctggaggaaggtatgtggggcccagccccaagcttggcaccgccgtcttccttcaggtgggccgggtcctcctagggaagatcaggggctggcagagcccccaccctgggcagggaggctgtggtcttgttcctaggactgggttgcgggtccgtggcctggaaggtgggcaccacactctgtcctgtccccgaagcccagctcttagacttgcccctgcctcggtgccagggagagagctgctgccttctccccacccctgaagacgacgcagggctcgggg

SEQ ID NO: 2680 - DNA, 2443 bp, Homo sapiens
ctccgcccggagcctggcgctgcctcgtgacctgcatcatcttcagttccagggtctccctccactgctgtagtaacccgggtccggggcctcggtggtgctcctgatgcccctcacccacccctgaagatcccaggtgggcgagggaatagtcagagggatcacaatctttcagctaacttattctactccgtgagtatggggccgggcctgctggggctgctctggggccacaggtactttcttgtgcaccttgctgcccgtacctgtgattgaatgtaatcgtgggaaccctgagtttcatcagagccggcgcacagtctcctgcagcccaggcgttgcctgagctcaacacggcctaggcccaagctttagcgctgccgggttcttggagtcctgtggggtgagtcagggttctgaattgggctgcaccccctggacaggatgatcggctgaatgtaacagaggaactaacgtccaacgacaagacgaggattctcaacgtccagtccaggctcacagacgccaaacgcattaactggcgaacagtgctgagtggcggcagcctctacatcgagatcccgggcggcgcgctgcccgaggggagcaaggacaggtgaggggcaaggacaggcagggagtgctcacccaggggagcagggaccaggtgaggggcaaggacaggcggggagtgctcacccaggggagcagggaccaggtgcgggttgctgcccaaggggtgcagggacagatgagggagggcactgccttcaggcagcacatatgggggccaccatcgctttgttggtggggacagggtccccccttttttttttttttgagatggagtcttgcttttgttgcccaggctggagtgcagtggcatgatcttggctcactgcaacctctgccttccgggttcaagcgattctcctgcctcagcctcccgagtagctgggcttacaggcgcccgccaccgatgcccagctaatttttgtgtttttagtagagacgaggtttcgctatgttggccaggctggtcttgaactcctgacctcgtgatccgcccacctcggcctcccaaagtgctgggattacaggcgtgagctaccgctcccggcctggggtccctttttaaaaagtgcactccaaattcgtaccctgggattctaccctccaagggatgccaggcagtgtcagagcttttctgtcatggggcatgcacgtgggtgggtgcagcggtgctgctcaacactgtggtgtcaggacggccccacccagaggacgatctgggccccagggggaccctggagtagagcgggcctcagggtagctgctaaggcccaggaggtaggcaggtgggtcgggccagccgagacgctgacactcgctgcagctttgcagttctcctggagttcgctgaggagcagctgcgagccgaccatgtcttcatttgcttccacaagaaccgcgaggacagaggtaggtgacccgtatcgcctgcagtagggtgcgtgggggtgcctgcgccgccccttcattctcagcccgcaggcacggtctccctgcgggggtggggggtgcgggcggggggttctggtcggcaggggttctgacggcttctcccccgcagccgccttgctccgaaccttcagctttttgggctttgagattgtgagaccggggcatccccttgtccccaagagacccgacgcttgcttcatggcctacacgttcgagagagagtcttcgggagaggaggaggagtagggccgcctcggggctgggcatccggcccctggggccaccccttgtcagccgggtgggtaggaaccgtagactcgctcatctcgcctgggtttgtccgcatgttgtaatcgtgcaaataaacgctcactccgaattagcggtgtatttcttgaagtttaatattgtgtttgtgatactgaagtatttgctttaattctaaataaaaatttatattttacttttttattgctggtttaagatgattcagattatccttgtactttgaggagaagtttcttatttggagtcttttggaaacagtcttagtcttttaacttggaaagatgaggtattaatcccctccattgctctccaaaagccaataaagtgattacacccgatgcacctggctctgtggtggtgacgctggggactggtgggaggagtgcctgggaccacagagggccctgggtggaggggtcgcgggggatttggcacccaggcagctgcgggacccctcccacggaggagaccccctgggctgggaggccgggccctcagcttggcgccagccttgccactgctcgcttgaagccccttcctgcctcgcgtccccttccgccccagcctgggcctgcgcatggggatgtctgtgctcccaactcaacttttgagttcgccgtgttactggccg

SEQ ID NO: 2681 - DNA, 1213 bp, Homo sapiens
gcctgtcctggacatttcatagaaatgggatctcacggtgcgcagccttctgtgtctggcgtctctcactgagcgtgacgtcctcaggtgcgtcctcaggcgcatccgcgctgtggcctgcgccagcctcgctcctcttcctggctggtggtcccaccgcgtacacgtgccgccgcctgttttgctgctgcttttgagctgagaattgtttttatgacttttaaatagctagaaagggatcaaaacaagactgtctcacgatgtggaaattacatgaaattcacagttcagtgcctgtgagtagagctgaccggccgcagttcagccacacatggactcattaccgaagctgcctccacccaggcagcccgagccagcagctgtgaccggcaccctgtggcccacacggccagaagtgtttgccatctggccccccgcagacgtggtctgctgcctgtggtggagatcactctggaggcggctgtcatcggccactcccgggagccctctcctaccctcagtcctccatccctggagcagttagccccatacctgggccatgctggggcgggccctgcgcccaggacggatctcatgccttctcttttctctcccccggtgatttctccaagccagtggaatcctgaagggcttcgacccactcctcaaccttgtgctggacggcaccattgagtacatgcgaggtgagtggggtggcggccgaggcaggcagcgggacgagggggatagtggggtgaggggggcagcgggacgaggggggcagtgggacgaggggggcagccgtggggctccctgctggctcttcttctctcaaacccacaaaacctctgagttaccaacgtgaagcctcgtggcggccgatggacgggcttgagcgctcactggtcctagacgtcctcacaaagcaggaaaccccattgttgtggggcctggagagacgggagctgccagctcacccactggtctctacacactgacggggcgcccggcacagttagaggacaacctttttaaatgttttattattttaatttttgttaaattggtgacgtgagaggccaggcacaatggctcacacctataatcccagcgctttgggaggccaaggcaggaggatctcttgaggtcaggagtttgagaccagcctgaccaacatggtgaaaccccgtctccgctaaaaatgcaaaaaaat

SEQ ID NO: 2682 - DNA, 1165 bp, Homo sapiens
acagagaggccgaagggccgcagcccgcggtgccgtcgggaccggtgccgcgctcacctgggccgcgaggagcagaaaggccgccaaaagccgcgccagcgcagccgccaccgctgccgccatgtcggccggtgcccgccgcaaccaacggcagatgtttcccagcaacgccccgagaccccgggccacgcatgcgccgcgcatgcgcgtgggggaggtcaaagggcgcggggcggtgcctgcgaagagccacacggcgcgacaagatggcggtgagcgcgcggcggaatctggagccggggggcgtggagctcgggccgcgctccaggtctcatgcgctctgctttccccgcaggataaggagaagaagaaaaaggagagcatcttggacttgtccaagtacatcgacaagacgatccgggtaaagttccagggaggccgcgaaggtgaggaggctcccgctgtcggtaccccctctttaaaaatttcaaataaacccagcaacagagatgatgaggacgcatgcggaagcacctcttttatttattttcattattttttttgagacgcagtctcgctctgtcacccgggctggagtgcagtggtgcgatctcagctcactgcaacctccgcctcccaggttcaagtgattcttgtgcctcagcctcccgagtagctggaattaatgtgtaccaccacgcccggctaatatttgtatttttagtagagaggccatgttggccaggatggtctcaaactcctggcctcaagcgatctgcctgcctcagccccctaaattgctgggatttcaggcatgagccaccatgcccagcctagcatttttgactgggcaagtgagctgccttctcctagcctccgtttcctcatttgtcaaatggggctggtaactccacccacttcacagggggtggtgagaatgaatggttacaggcatgtaatgtaattgaggcagctctcagcaggaagtaagcagtcagacaacacgtcacttattcaatagcctcttggatctttggtttcttttttttgtaagacggggacccaaacctctttgtccctggattgtagacaactgggtggcatgagagttattaaaaatcacagtgccccagccggacggggcggctcacgtgtgtaatcccag

SEQ ID NO: 2683 - DNA, 1107 bp, Homo sapiens
tcgccgtggccaacgcgcaggagctgctgcaggtgcggggctggccggggacgggcgctgggggcgacagggccacccctgggggccgacgtcgcggctaaagcctcgcgtgtctccacagaggatgacggacaagtgtttccggaagtgtatagggaaacctgggggctccctggacaactccgagcaggtgagacccgcggaggttcggggcaagggtcgcgagggcctagattcgaggggggaggtgtctgcgcgtgcgcagactaacggggaggtgcgacggagtggtcactgcacgtgcgtagtctgcagcccgggcgtcctggagccggggtcagggcggtccccggggccgcgaagtcccgagctgagccgtgcgcccctccgctcccgcagaagtgcatcgccatgtgcatggaccgctacatggacgcctggaacaccgtgtctcgcgcctacaactcgcggctgcagcgggaacgagccaacatgtgaccggcgagcgcgggccaccccaccctgttcatttccataaacgtgctttgagaggcggggtccgcatgtacgtactgcctgcccggggcttaggagggtggcaccggtgctgggacacacgggactgtgtcctcgccaccccccgccctgccccctgccagccagtgcagcttggatctcgggggtgtggggccctgtgccttcctgaagtgctggcagcccagtggcacctccttcaggcctttggggtattcccctagtgtgcccaagtcagcctcatattctgggcggacagcttgtctggacttcggagttgggggtggtcagacaccacaggagctgtcacctcctgcggatgggcaaataaattggtggaggacggagagaaacctctttatttccctcctgaggggtctctgggaagaggtgacgcgtgtccctggaaccccagctcggagggtctcagcctcccctgggttgggagaagtccatctttccccttagtgccaccgggctgctgagtcacgaggaatgtgttgctgctgccacccctgccccaaaggctaagggggacagccttccccttgtcagggcttgctttgaccctgc

SEQ ID NO: 2684 - DNA, 2911 bp, Homo sapiens
tcgcaagttcctgtgactgttttggaacccagaacagaatgtgtagctcacaggcgggctcatggggacatggaagtggaatggaaggctctagaaatagacactgttgttgctcagcccctccctggtggggaggtgggggcagccatctacctgccggctgcctccaggctggccctgatcatggccgaccttccttccttccttcctgcagggggacccgaggaccacctcaagaggctgctacgtgatgtgaacccacactcctcatccacacacctttctttacccagagccactgaaaactatttttatatcattggctttctttagttcttgatacatttctagagaatttctaagcgaactgccagaacgtgtgggtgggtctcccccagccctccctcctggcgggtctcctccagcctcacttcgctgccacttcgccgctgccccggagacttttcaatcccaccccactcctcatctcaccatttggtcaaattggaagcccagggccaggacccggaggtttagaagatgcttgggcttggagggaggagggccggcgaggctagcgaggggacaggagacggccctgctgcggacggagcgcggaaactgcgtaggaattcagtggtggtgggtttttttaaggctttctacaaaaccaaattcagaatccaggcgtcgacctggtggggcccggggccaagcctgcattctggctgcccagcttcggacagcgggaactcctcaggcagccacgcagcgggtgtgggccagcatggggatggcgtggcccccagggcgggttttcactccgctgcctgggcttccagattcccgttctggcagcgcaccggccgggtttctcggaccgttgactttatttgggggagttttcccgcagttcagttcctgactgtgcaaggccaacagggcaggggaggggaagacctggggaaggaagaatgaggacagtcccgtcgtaagacctgtcacaacaataagcagggaggggagatgtggaggggacacatctggttgccttggaggcagaagctgtgagtttcagaacagctgtctgcagggaacgccaccatgttgaccctctggaggagagcgctgtggagcccctcccgtgttccagctccgtctgccctgtgcctatatatacacatgcgtctatccatactgtgcttttatctgtgattttctcgctgaaaccatgtttctcagacaggccaaggccacctgactcctatcacgacgcacccaagcccctcagtccagcttcccaatgcctggcaccccccttcggcaatagctcaccgtttacaccctccctcatagatacacagaagttatttttttaatggatatttatttttttacattggtcagtacacaggtcaggagctcacgccagggccttgaggacaggctgaccctcctccccggggtggcgtggggctggggcaccctccgacggcagagcctccttcagaaagtgcagctcaagtcttaaagacaccaaaactgagccatgggcacgcgccgtctccgggccatggcgttcactgcagggcgggggcggcaccgctcccctgtgactgcatcccgcctccctggggacctgcctgtggcaggaaggaatggggggccccagccccaggccgggaaggagccagcggccgacaaagcagaaacacccgctgctccacgtagcccctgctcgctgtccttgctctcagaagtcccggtcccatgtagatagaggggggcgcatcttaccaaagcatttcctcctggaggctacgccgctgtgctcccagtcaggcggctggtagggagctttgcctgccccggggataccctctgccagccgctggaagtgggaatgctggcgacagactgtgtcctctttcccaccttcatagcaggaatcacccggacccgactggctgggcttcgtgctagcgagggttctgggggtgggtcttggtgatcttgtcctatggggagtctgcagtggtctcagccacatcctatgtattttggctctggaggagcaaagctgtatcctggagttggtctgtgatttgccgacagccttgcaggctgggctcagggacaaagtcccccccaaaacccgcaggtcctcatgtccagacgctgcccagtcctgtcctgaaaacagcacgccccaggcccacagaaccccccaccctacatttgccttgggtggagctgggggtggtcctaggactgcgggtgcccttagctgaagggggtggggagaagcgtggactgggcagcctgtgggtaattggaggttcattgagaattgagtctttggaaacactaagaaaatcaaatttttaaaagttatttatggcctgggaaacaatttgcatttgtccccaaatacgcttagctgtgtgccgcttagaacgatgcgaaaccatccctctgtgtaagcccgtgccgtgtgactcgaagcctagcgccctccctgcgaagcatcagacgccacccagccctggggggaggcccacgcctgctggaccaacgcgggttctggggtgcacagcgccaggttaacgctgaagcctgccccgctgagcccaggagccgggaggcctgcgggctgacccagaatccgatcatgcacctgtcctcatgccagcggctttggctggggttggtctgaagcctgcacgcggcagttctttgttaaagatctgagggactcctcagtcctggggcgtcgccgcctgcagcctcttccaagccctgcgtccagcgagcgtcacagcacaacctgcaaaaacggagctgggctgcagctggggctggcatggactttcatttcagagattcggtttttaagaagatgcatgcctaa

SEQ ID NO: 2685 - DNA, 1878 bp, Homo sapiens
cacgtggccccgagtgtgtggaacgcttctggtgcagctgtggctctgacgttcgttgaaatagccgctgtggcccctggctgtccactctgggcctctcctgctgcctggagtgtgtggtgcagccttggtccccacctgcgctctgacagccttcatgtctgtccccttccagctgctcccggtgtgaccgcgtccttccctggccgacccgaaggaagccttctggttgtctgccacttcctcctgttggactgcctgagagaggggaagagagagacctcggacctgcatgtcaagatggattttccccttttatctctgccctcctccactccctttttgtaactcccttacagcccccagacccttcttgaaacgagagccagcaagctgagcacagaccagcagcgacctcccttccagcccccagaaagctcggtcacttgagtgttttctagaatcctggggtgctcccgggccgctctcagagaagtggcaggtttcacgttcagccgtgtggcggatcgtgtggcttccaaagccttttacagcccccgccccccatcccgtggtctgtctgcaggaactctcccgtctgtgagaagcctctttccgagtcgacctcccggccaccccggccctgtgcctgctcggaagagctcactgccagctgcggcctgggcaccgcgggccatgtgtgtttgcatgaggaactctttagtggcagacacctaagagacggctgcggtcaccccacgcctccgcggctcaggagccgtcctgggtgcataggaccagtttctgtgacttttctccagttgggcatgttgacagacatgtttcccctcctcccaccctcattttctggtcctcgcgactgagagccaggggcgacatcatgaccttctgtcccggccgccttagccccgggcacagggaaggcagctgggccgtttctgtctgtgtcccatcctgctgtccttctgtcctggatgtttcatgggcccggggccccccagggaagcttacccctcctgtgctgggtggaggccacgggacacctcaggtgccacccaccttggccctaaaacagccaccaggaaagcagccggagagccggacagcaggcagcctgtctgggttcctgaggcctgggggtggcagacgagcccacggcgccgtggtcccagcagcagggttgtcagtcggagcatcctggggctccctggctcctggccgtctgtgaggtaggcgcagtaccgtgtatcgtaggtagcagtaggaacgggggccgccgcggccctgcagccgctcatggcggtgaggtgtgtgccaagcccacccggggtgcagggcgtgacgtgtggggaataaataggcgttgtgacctctgtctgtcttcgtgttgaccttggcgccaccgataccctccaaccccaaacctcgagaaaacccccgacgcggagtttgtggatcagctgggctgcttgtgagtgaatccccgcgacgccggagccgcacttcttgggtcacgggtcacgggtcatgggaggtttcggacagtcagcctctaccctctgctgtctcccttccctccgcctccgtccccagctgcatcccggtgtagagggtcaccccagggtggggtgagatgcctcggtcctcagcagagagtgatcgtattgtctgttgctttgctttgctttttttttttttttgagactttcaccctagatgcccaggctggagtgcaatggcgcaatctcggctcacctcaacctccacctcccgggttcaagtgattctcctgcgtcagccttccaagtagctgggattacaggcatgcaccaccacgcccagctaattttttgtatt

SEQ ID NO: 2686 - DNA, 1176 bp, Homo sapiens
gcttactcagcacctgatgaaagttaaccctaccgtcttgctagaagaagtcactgagggacaaacactgggtgatccactcctaggaggtcccagggtcgtcaggttcactgagacagaaagcagaatggggggtgccaggggttggggaggggacggggagtgagagttttatggggacagaaattcagtttgggaagatgggaaaattctggagatggtgctggggatggctgcacaaccgtgtgtgtgctttatgctgctgagctgtgcacttacaaatggttaaaatggactgtaattcggccaggtgcggtggctcctgcctgtaatcccagcattttgggaggctgaggcaggtggatcaccagaggtcaggagttcgagaccagcctgtccaacatggtgaaaccctgtctctgctaaaacttaaaaaaaaaaattagccgggcatggtggtgtttgcctgtaatcccagctactcgggaggctgaggcaggagaatagaattgcttgaactcaggaggcgggggttgcagtgagcagagattgcgccgctgcactccagcctgggtgagagagttagactccatctcaaaaaaaaaaaaaaaaaaagttagctcttctgagagtgccccaggttcctttcatcctcagtacctttgcacagtccctgtttcttttttctttttcttttcttttgtgtgtgtgtgtgtgtgtgatggattcttgctctgttacccaggctggagtgcagtggcatgatcttggctgactgcaacctccacctcctgggtgcaagcgattctcatgcctcagcctcctgagtagctgggattacaggcgtgcaccaccacgcccggctaatttttgtatttttagtagagacgggtctccctatgttgcccgggctggtctcgaacccccggactcaagcaatccgcccgtgtcaggctccgagtgttgggtttacaggtgtgagccactgtacccagcctgcactgtccctgtttctgtgtggtacgttctctcttcagagagacgtgaaagatagttctacttcagagtggatacactgggaggatccttgatgccttgaggaccaaacccagaggggagatgctcagtttgttcagattccactgagtctgagatttctggaagcttggggtgggg

SEQ ID NO: 2687 - DNA, 1184 bp, Homo sapiens
ggggccaacactggctgcttggggctgcccggggactccagagggctgcacggccaccctgccctggctagagcgcaccccaccggagcccacgtgggctgggcggctggagggatggtcccccggtgacactgggagaaaggccacttggatgggggcgtttctgttttgttccgctttgtgatgtcaccaatttggaaacagcgagggtgggtggggacttttacagaatattctcaggtgtgtacccgagaggcagagagagggacgtggccggcagctctgtgcgtggccttgtcccaagcacttgcgcccgcccccgagcgccgcccccggggagcgggaagccagcactcgcactttggccaggggcgcgtggaaggtggtggcaggcaccggcctgggcagcttccaggcctggctggccacgaccacggcccgagggggagcccgccaggccacgccgcactgagccacagccccgggggccgcctcccggggccccttgaggcactgaggcaccgagactggttctccccgagagactcggaaggtggggaacgaggggactgtgtttggggaggtggctttttcgtctgctgttgactgaacactacagcgccctgtggttccgggcttcgcacagctgtcccagggatggatcgcctgtgctgccttcgcccgccgccacaccgggaccctgcacggctgcttctggcctcgacagatgacaaaagaaacagccccaaaatacgaccactccaaccagcagttcccgcctgcctgcccgccactgtcaggcctgccctggcctcctcgtccgcagggctgtctgctggcttctgggggcagaagagcggggagccccgtggaagggtcaggggagaccaggtcagggcagctacatttctggtgatcagccccatggggagacggggctggcgggataccccccccccggcttccccacaccacttctgtctcacccggaagcgtcctttttttgtgccaggtgtctacctaagagggttggtgccagaagccccccatggcgagtgctggggcccggcggtgccctgggggagcagatggggccacccctggcagggccgctacaaccttttccagcagcggagccctctggggggcctgtgcttgtggcatctctgagggcctagattgca

SEQ ID NO: 2688 - DNA, 1099 bp, Homo sapiens
gccagccctggggttctgggattccagccctcctggagccttttgttccccatgtggtctcagtgacccgtccccctgacagtgggctcggggagctgcatcacccagccttccccttctccgactgcagggtctgatgtcatcattgacagcctttgcttcgtgggggcctggcagggcccctgcctccccgacccccgacccactgcaaatccccgttcccctgcactcctcttctcccagcccatccctccggcccctgtgcctctgcggccccagcccagctcccagggccgtcacctgcttggccctggcccagctccctgccctgagtcctgagccagtgcctggtgtttcctgggctcggtactgggcccccaggccatccaggctttgccacggccagttggtcctccctggggaactgggtgcgggtggagtactgggaggcaggaggtggcccggggaggccttgtggctcctcccctcgctcctcgccctgggcctcagcttcctcatcaatagaaaggatgtgttcggggtgggggcgtcaggtgagaacgtttgctgggaaggagaggacttggggcatggcctctggggccacccttcctggaactcagagaggaaggtccgggccctcgggaagccttggacagaaccctccaccccgcagaccaggcgtcgtgtgtgtgtgggagagaaggaggcccgtgttgagctcagggagaccccggtgtgtccgttctttagcaatataacctacccagtgcgtgccgagcaggcttggtggggaagggacttgagctgggcaagtcctggcctggcacccgcagccgtctcccttccgtggcccagggaggtgtttgctgtccgaaggacctgggccggcccatgggagcctggggttctgtccagataggaccagggggtctcactttggccaccagttcttcggccagcacctctgccctccagaacctgcagcctggaggggtgaggggacaaccacccctctttcctccaggttggcaggggaccctcttctcccgtctgccctgcgggttgcccgcctcctccagagacttgcccaagggcc

SEQ ID NO: 2689 - DNA, 1189 bp, Homo sapiens
cacgtgcctcttcccctagccctgacagcccaccgtgggctcccccagcctcaagtcctgccggctcagccagcccttaggaccctccccacccagaagaatgcagacacaggttgttgctgagatatgctttgtgacctcgagcaggtcacactgtgtgtgccccagtttccccatccataaaatgggatcatacccctaacaggcagttctgaggactacaggtggccaggagattagccaggctgcctgggttttggtctccaccatgctagcttggtgtccgacctgtgttgagaccctccctgcctctggcccgggtgtcccatccaagcaatggacaggttggaacaggcgttcgtagggaacgggctgaacgcccgcggctcccgcgatgtctcgcgatactacctccctcgcccccgctcacttaaggaccggaagtagcaaagcccgccgtcgcgccccccgccccgcgtctccctggtaaccagcctctccccttccctcgcccataaggagcaagcggcacaaatcgggctcgatggaggaagacgtggacacgagccctggcggcgattactacacttcgcccagctcgcccacgagtagcagccgcaactggacggaggacatggaaggaggtagggctggtggcgggggcggagccggccttccggtctgagtcaccgtggcgggaactacgtcttccggcagccactgcgcgggcgccgcggggcaggaagccggcctggagccgcggggcctcctgggaattgtagtcgtcccgagctgcgcttggctggaagtacggtccgggttcgcgttctcggatctctttggttccgctgcggcgaaggagggcagagactgtcccctgcctgactctcctgccctccggccgtgaatgccacatctctgtggggtccccgagctgcaggatggactcagtagtgactctgatcaacagggcgcctcttcctgggatctgtcatagaatccctcgtctgtagggaccctgtttgtcctcttcccctctagaaggtcctgagatgccggatcccttctcattggggtccttcttgaggttacttttttttttaaccaggttcccatctccatgggatcttctggttctgcaggagactcgtctcctttctgtagggtctccattcccatggcgtcgttt

SEQ ID NO: 2690 - DNA, 1178 bp, Homo sapiens
tttttttgtaaagatggagtctcactatgttggccaggctggtctcgaactcctaagctcaagtgattttcccacctcggcctcccagagttctgggattacaggcatgagccactgcgcccagcccaccgtcattttcttgccattaactgtgtctcttgcggtgtaagcttcagccattctttgccccgaacaccagcccaacctgaaacctatctagagagccagctcttggcatcatgtacccaggacagggttccacagttccaggcgctctgtcgtctgagctggttctttcgttctgcgcctgccatttagccaccagtcacaccagtggcataagacaacagaacttatcatctcttcgttctggagtccagaagtccaaaatcaaggcgtgggcaggtgtgggcaggaccccactccctctgggggccgaggggaggcccctcctgcctctcccagctccagtcatggccggtgattcctgggccctccctggcttgcagccgcagaacccggcctgttcctgtgttgtgtggcggtctgccttcccgtctctgtctccatacggccttctgctctgtgtgtctgtgtgtaaatgttcctcttcccatgaggacaccaggcattggatgagggcccgccacctccaggatgacctcatcttacctacgtctgcaagacctcatcactttttttttttttttttttttgagatggagtctcactctgttgcccagactagaatgcaaaggcgcaatctcggctcactgcaacctccgcttcctgggttcaagtgattcccctgccccagcctcccaagtagctggaattacaggcgggtgccaccacactcagctaatttttgtatttttagtagacagagtttaaccatgttggtcaggctggtctcgaactcctgacctcaagtgatctgcccgccttggcctcccaatatgctgggattacaggtgtcagccaccatacctggccaagacctcatttcacatggggtcatgattacagctgcaggggttcagacggggatgtgcctgtgggggacacagctcatctgaagcagcatccacttgtggagggggtggagcaggcaacgtgtgggctgggccgactgcacctgctcgccggttgcgcagttgggagctgtggggtctcca

SEQ ID NO: 2691 - DNA, 1127 bp, Homo sapiens
ttccatggtgttggggtcctgggatccttctggtcaccccacaccgccatcctcaatatacagctctgtgaccagtggtcccaggtggctgccaaagctcctgccatcacggctgcattccagccacaggaggcaacagaaggagaacaacagcccttccctttcggacatgaccagtgtttctgctccactcgtgtcattggctgagtgcagtcacgtgagcacacctagctgcaagaggctggggcggcatggtcctgttcttggcggccatgtgcctggccaacactgtgggccccgttgttaatgaaagaagagagggtggttactgggggacagtcccatcgggagccccctgttgcttgtgggattgggccgtttcaaggaagtcttggagctgagccgctagaggctcagctgctagaggcactaggagggaccatggcgggggtgggggagaggtgcccaccacccctcacaggtttcctcccgtccttcctccacagcgaaggcagcaacctcacccccgcccaccacttccaggacttccgcttcaagacctatgcacctgtcgccttccgctacttccgggagctctttgggatccggccagatgattacttggtaagcatatttgctgttacgggcttccaggcttgaaacagaacatgttcagggtctcggagggtctgtgggtcaggcatttgggggcagcctccctgggttcctcgtgtagggttatggtcaggttcagggccggagtctcctgtgagactcaccgggaaagcaggagagatcggcctccaagctcacatcactggcagctgcaggactccgtcctggctggcgttggctgggagcctccattcctcaccatgtgggccttgtcatcagagcaggcgagggtgtccactcaccaaacagttggtatagtcttctgcagcctggtgccaaagtgactgacccattttcagacttaagggttagaacaaggcactgggacgtgggtgccactggggaccagcgtagagtcggacctcctagctctagccatggctttattgtttcaggttagcaaagtcaaaatctaggccaacccctttgacctagcagcccattatccgggc

SEQ ID NO: 2692 - DNA, 3030 bp, Homo sapiens
tcccaggttcacgccattctcctgcctcagcctcctgtagctgggacttcaggcgcctgccatcatgcccggctaattttttgcatttttagtagagacggggtttcaccgtgttagccaggatggtctggatctcctgacctcgtgatccacccgcctcggcctcccaaagtgctgggattacaggcgtgagccaccacgcccggcctccggggcagtttttgagttacatcctgctgtcttctgtccacaaacaacacaaatgctctggaggggttgggacaggcctgctccagacctcgtttcttccctgttaatgcttaaaattccacaagcccgtggtttctgcgccggagagctcagtggagcccctgctccttgtccttgtctggagtgagatgcgcttggcactgcaacactgactccgcttcgttctgattgacgtggctctaccaggctgtatgaggtccgccttgctaggaaaagcttttaaggatgcgtctgtgtgtaaggtcacctctttctccaggcaagagtgggacttaacctctttttgcagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggaggtgaggcacggctcagcatgtgcagaccacacccgtttccaggctctagagggacctcatggtcctgcctcccgagacagagaccctaatggggccaaggcgggcaaggccccaggtccccctggtggagacctgcaggacttggcaggtggagggcaagcagccgaggtgtgtccggcccttgacggtggctctccccctcccccagggcgcactgtgtgaggagaacatgcggggtgtgcgcttcgacgtccacgacgtcaccctgcacgccgacgccatccaccgcggagggggccagatcatccccacagcacggcgctgcctctatgccagtgtgctgaccgcccagccacgcctcatggagcccatctaccttgtggagatccaggtgaggtctacccgcccaccgctgaccctgccaccgtcctgcccagcggccactgacaggttttctttcccttctggcagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggtgagtgcctgcccggtgtggcctgcagagcctggcaggctggtttgggggacagaagcccagttaagcttagcaaggtgttaaaggaggcgtcctgatgggagcaggtgatggatggagcaggtggtccagtttctgacagcttgtggaccccctaaatcactgaattcccaggggaggggctctcctatccccagtgtgagaagggctctgggcctggagctctgaaggcctacgccctgggccggtagagcagccgagctgtagcacagggttgtcccaaacgagcagcggcatgaggcccatgagtggcctgctaggcccttcgtgaagtgctgggcaccaggccgagtgtctggtctgcagggtgactcaggctgaggaactagcctgagctcctgacaggactttccttctgccctgccaccttctcgatggcccagtgagcctctcgcttccctctgcaggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcgtgccatcactcaaccataacacttgatgccgtttctttcaatatttatttccagagtccggaggcagcagacacgccctcttagtagggacttaatgggccggtcggggagggggaggcgggatgggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtgactctgttctgcatttttcacggtgtcttcgcaggggagcggggctgcccagtactgggctccctggagcctagaaggggacccgggccctagttaggtgcagcctggggctgcctcagtgttaggtggaacgttctggaatggtgggaatgccctacccctgtgtcattcagagaagcagctgccagctgcgcgggtctgctgagcatttgaagtaggatcagtgcggcaaggaattacgagatgtcactttgaacgcatttggatggccctgtggagcgaggggctctggattgaacttcgcaggtttcagcaactttccgaattgctgacgagctcacaagttctatctgcc

SEQ ID NO: 2693 - DNA, 1185 bp, Homo sapiens
caccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcaggtgggcacggagtgcacctgctgggagcagacaccctgaggggggacggcttgtgtcctgagttgtggctgtgtgggttgctgtggttggtggattggggtgactggtcatgaaaggaggggttcttggctgtggctgtaaatggagactcctgcccaggcagccaccaccctctcctaggctgctctgcgcgtgttcactgtagcttgtgggacttaacatttcttcaggagtttgtgctggtcccagtttcccagcaccttccctgaaatcttgttctggcggggtccctagctaaagggaagctgggagcctggtcccgcctgttccgagccgcctacccctttggtgctgacccgcatccctttcagtgcatcatcgaggagtcgggagagcatatcatcgcgggcgccggcgagctgcacctggagatctgcctgaaggacctggaggaggaccacgcctgcatccccatcaaggtgaggcgccagtgaccagccttccccacgccccaccccggacacctgccctctgctttaaagctgagctgagctaggctctgcagacgcctagacttgatctcggtcttggtctcagcttcttaagttcctcaagtttcttctttgcagtcttccacaggcatgtggggctgtttttgttgttgttgttgttttttttgagatagtctcgctgtgtcatccaggctggagtgcagtggcgtgatcttggctcgctagaacctccacctcccgggttcaagcgattctcttgcctcactcagcttcctgagtaactgggactacaggcgcgtgctaccacgcccggctaatttttttttgtatttttagtagaggcggggtttcactgtgttagtaagtcaagatggtctcgatctcctgacctcgtgatccccctgcctcggcctcccaaagtgctgggattacaggtgtgagccaccatgcctggcccagggctattttttttttttttttttttttttttttgagacaagagtcttgctctgttgcttaggc

SEQ ID NO: 2694 - DNA, 2632 bp, Homo sapiens
aggagttccctgtcatgggggtggcatgtctcggacagaggcaaaggacaagggtgggttggctcttgtgggagcctctccagggatgagtcatggagggaggagcagcctggcttctgacagcatcccagactccctgggccaggtgtgtggctcctgtccccctgacgagtccctccctccatcagtgccatctccctcttctacgagctctcggagaatgacttgaacttcatcaagcagagcaaggacggtgccggcttcctcatcaacctcattgactcccccgggcatgtcgacttctcctcggaggtgactgctgccctccgagtcaccgatggcgcattggtggtggtggactgcgtgtcaggtaagcagtgggtccccctgaggcacggcctggaaccgggggccatccttgcttgaggatgacagcgccgccctgtcccccgtgtccccaggcgtgtgcgtgcagacggagacagtgctgcggcaggccattgccgagcgcatcaagcctgtgctgatgatgaacaagatggaccgcgccctgctggagctgcagctggagcccgaggagctctaccagactttccagcgcatcgtggagaacgtgaacgtcatcatctccacctacggcgagggcgagagcggccccatgggcaacatcatggtacggccctccctagctgggtggtgggcttgccgcagcgggatctgcaggagccggtggggagtggagttgagctgagggggactggaagtgtgtttttgccaggaatgttgggtgacagagaagggggctggaatgttttcatccgacttgacccagcccttgatctttgggcagctggaagagacgagctcagggaacgctgccctgggtggtggaggggctggcccccctattcgtgatgactgatcatttcttcactttgaccagatgtctactgaagaaagcctgcgtctgaggcccatgcccaaggcgcccagcccgtagcttcaggctctgcgcaggggccctcacggctgcttctcgtttctcacacttccagatcgatcctgtcctcggtaccgtgggctttgggtctggcctccacgggtgggccttcaccctgaagcagtttgccgagatgtatgtggccaagttcgccgccaagggggagggccagttggggcctgccgagcgggccaagaaagtagaggacatgatgaagaagctgtggggtgacaggtgagccccgcgggatatggtgggggattcctgacacctgggggtagtggcagcgacgtaggggcgtggtgtgctattcacagcgtggctcaagcccaccaggtcttgcccaagcatgtccccttggcgaccaccctccccaagtcatcccctggagaccctaacttgatttggcttggcctctccttgccaggtactttgacccagccaacggcaagttcagcaagtcagccaccagccccgaagggaagaagctgccacgcaccttctgccagctgatcctggaccccatcttcaaggtgagtgagggctgcgccaggcaccccgccgatgcgactattggccctcggccctgtgggctccggccggtagcctgtcggctgactgggcccgtctccttgtggggcagatgcgagatgggaggaggcacagctcctaactgaggtggagtcagggctcctctcttaagatctggactgcatagccagagccttgggacctctcctgcattgagggggttgaataacttgtggctttggcggttcagtgcttgtaagtcagaacttgggtccttgtctgagtcagagtgggctttttcctctgctccaccacgaggtttcctccagctcccgatccgctcagctggctgggcccgtggtaggcaggccaggcctgctcctgctcccgtgctgcgtccccctgcgctgacctgagtcttccaagcaggaagcagtgccaggcttcctcctgctgttcccaaatgggctttcttgtttcttggtggggaatgtaggtgtttgatgcgatcatgaatttcaagaaagaggagacagcaaaactgatagagaaactggacatcaaactggacagcgaggacaaggacaaagaaggcaaacccctgctgaaggtgcggcctgggcccagccctcggggtggagggaacacaggctgctgtttccggatgctctgacagcccaggcctgggggctgaagtcctcagctgggcagggacagctgctgcccctttcgctttagactctgggtgctgctggagacacatcccagcagccagccccatccgggacaggtgtgggtgagggccttggcaggagtgtgcatggcctttgccgccttccagaagggactgtgctttggagaacgttagtcctgactttggcttccttggcttcaagagaggaagcgtgtacggggtggggccatcctgggctccccaggtgtctcatgcaccgctctctgcccccgcaggctgtgatgcgccgctggctgcctgccggagacgccttgttgcagatgatcaccatccacctgccctcccctgtgacggcccagaagtaccgctgcgagctcctgtacgaggggcccccggacgacgaggct

SEQ ID NO: 2695 - DNA, 2632 bp, Homo sapiens; identical to SEQ ID NO: 2694

SEQ ID NO: 2696 - DNA, 1146 bp, Homo sapiens
ctgctagtttgtggctgttgtggtcagttctgctgtgaacatccacggatgcgtctttgggtagatagactttttcctcttcttctgggggcgtttcttgttaaagtttatcctcaggtgttactggtttttgtttttttttttttggagagtgtttctctttgttacccaggctggagtgcagtggtgcaatcatagcttgcagcctgtgcctccatgggttcagacgatccccctgcctcagcctccaagcagctgggaccacaggtgtgcaccaccacgcctgggtaattttttgtggagacagtttcaccatgttgcgcaggctcgtctcaaattcctgggctcaagagctccgccagccttgacctcccaaactgggtgttttcttgccattgtgagccagctgctagattcccgcatgcacgttttagctatgtttcttcgcagggagaggcacctggctgccctctctggttcagggttttgctgtggattctgttgcattttccagggaggccagcccctctcctgacctcacagccactcctctcacccagcccgtacaaaagagtcctgggcctcagtttcccagctctgggggagggagccttgtggtgtggcggtctccaccttgtcgggtgggctggggtcacgccctcctcactcagctctcctttcctttcctctggtttgctccacacccacagggaactgcagcccggagttaaagccgtgcaggtcgtcctgaggtatgcccaggtgtgcccgcgaccccagggctggacccccagccacccgcccctccccgccccccagtcctggcccaggcccttctcagtctcccctgctaacagcagagcccagctctcctcacctgctgtctatccctgtctggggatacatcaccatccgacccccactcaggccacacccgggggccctgataccccccgtgtcacattctccggtgcccccatcactgccgcctggctaccactcgtgtacccccgcagcagcctagtccctcctgtgcgccccctccccgccccatggtccctgttgtcgttgcagaatctgttactcagacaccagctgccctcaggaggaccagtacccgcccaacatcgctgtgaaggtcaacca

SEQ ID NO: 2697 - DNA, 1099 bp, Homo sapiens
ccagggccaccagggctggggcaggcagctgtgtcccatgcaggccttggcctcagcagcccatgggactcggtgtagccagggaggcttcctggaggaggggtccttggttcatactttgttccatgagccctatcacctctctgtccctggctctgagctgggtgaccccagggtccccaaaagagccccgtcccagaccctgccttcagagtcttgttcttggccaggggagcggatagaggagcagagccagacataaacgttcccgttgctgtgtgtgtcttggggaggaggaagagaagctgtggggtggggctttggagggtgaaaagcagttttgcaagcagggaagtgggcaggcagggctgtgctacgcctggggcggccctggcacggtgggctccgagcatcgcctcagagagagctcggcggggcggaggggctggcctgggtgagagcctcagaaagggtggcccagagtgggacgagggctctcctgtgtgatgagaacgatgccactgcgggtgcctgggagcagctgtagccttgacagtaacaggccagcctgggccctgcatggacccgtggggcagggggcctctcctcagacgccccccagccactgcacctttcccttcctgcgggtggggagactgaggccctttggctaagacgggttggggagcagaaccagggcctgcctccagttggccttgtggcctcagggaactcgttcccttcccgagcctctgtttctgcatttgtaaaatggggctggtaggacctccgagtaaaaaggccggacacagtgggggtgctctggagaggctgtggctggcatgggcgtggggagcccgcactctgctcccattgctaccctcacagcctctgcaggggctttgagcagccagcaccttcactccagcctgtttcctgatctggcgggcacacagtgcaatgtgaaagcaggtgtgcgtgcacacccacacccgcatgcccacacatccatacagtccacaccatcacacacacacacccacacacatccatacagtccataccatcacacacacccgcacacatccatacagtccac

SEQ ID NO: 2698 - DNA, 1144 bp, Homo sapiens
ctctttagatgttcagaatgcgaaatcgcccccactcgtctcgtttttcgagggaccgtccccatcggggcaccgaaacctctggtgcacggtccgtgttctgcaagggtgatgatccagggcctgccgtgtccgtgagggtccctgggcggggatcgggggtccccggccccactgaccgtgcccgccccgtgccccgtccacaggcaggacaagctgaaggtgcacatgcggaagcacacgggcgagaagccgtacctgtgccagcagtgcggcgccgcctttgcccacaactacgacctgaagaaccacatgcgcgtgcacacgggcctgcgcccctaccagtgcgacagctgctgcaagaccttcgtccgctccgaccacctgcacagacacctcaagaaagacggctgcaacggcgtcccctcgcgccgcggccgcaagccccgcgtccggggcggggcgcccgaccccagcccgggggccaccgcgacccccggcgcccccgcccagcccagctcccccgacgcccggcgcaacggccaggagaagcactttaaggacgaggacgaggacgaggacgtggccagccccgacggcttgggccggttgaatgtagcgggcgccggtggaggaggtgacagcggaggtggccccggggccgccaccgacggtaacttcacagccggactcgcctaaaaaccaaaaagagaaaacagaaacccgagaaagagagagacagagagagagaaaaaaaatcacccaccacccccccaaaaacacaaaaaaagaaaatctatctatatacagatatctatatctatatatatatatacagatatatatatatgacgcgtcacagaatctagggtagcgctttctcagatttccctcctttctgacgtttttctccctccgcaggggccccggccctccctggctccccttccccccaccaccccatcgctgggtttcggggcttggtttggggttttttgtaggacacaaggaatccgagaccccgcacagccccctgggcacccggcatggggcctggggcccgatccgaggccctgggctggggggagggtagacgtgggggcgctggggggggactggggtgggcttttaatttcctcccctc

SEQ ID NO: 2699 - DNA, 1192 bp, Homo sapiens
ggcgtgagcaccgagccgggcctcaaagtgccctttcaacaggcattcccgggggccctcctcggaggggtggtgccagtgtgcttgtgaaatttaagcgtccagtgtgggttttgccagcctcatctcacgctgatgagacagaacagggcatctgactgctcttgggcacagctagggaaactgaggctgatggggggcaggaaacctgactgtcctcatgcacagctggggaaattgaggctgggggcaggacagctggccgcccttgtgtacagatgggaaacaggttgggagtgggacacctgattgccttcctgtacagctggggaaactgaggctggggacatgacgtctgattgcttttgtgtacagctggggaaacaggctgggggaggcaggacatctgaccattctcatgcacagctggggaaactgaggctagaggataggacatttgactgcacttgggaacagctggggaaactgaggctggggagccgggacatctggctatcctcatgcacagatggaaaacagtcttggccgggtgccgtggttcatgcctgtaatcttagcaccttgggaggcaggggcggttggatcatttgaggccagggttttttgatttgttttgtttttttgagatggagtcttgctctgttgcccaggctggagtgcagtggcgtgatctcagctcactgcaagctctgcctcctgggttcatgccattctcctgcctcagcctcccgagtagctggaactacaggcccccgccaacacgcccggctaattttttgtattttttagtagagacggggtttcactgtgttagccaggatggtctccatcccctgacctcatgatctgcctgtctcggcctcccaaagtgctgggattacaggcgtgagccaccgcgccaggccgaggccaggggtttgagaccagcctggccaacatggtgatagcctgtctctgtattaaagacacacaaaaaagaaaagaggctggaggcagggcatgtatcgctttggtgcacagctggggaagctggggctggaaaggcgcgacatctgaccgccttcacgtgcaggtgggaatgtgaggctgggggagcagggtggaacgctgcttctcaagggcctcgggcccttgtcagtgggcacaggaacccccgcacccccactcacga

SEQ ID NO: 2700 - DNA, 1135 bp, Homo sapiens
gccagcccactgcagcccagatgctccaaggagggctcctcaagggttggaatgctggcacgcttgctctgcgaccttggatgagccccgtgacccctgcagccggggcgcgctgtgttcctggggctgtggagggtcccccagctgctgcctgcaaagccacccgtggtgtcttttctcctccgcggcggaaactcccaggtcagctcagggcatggcagagacctgagtgtggggtgtgggtcagaactgcgtgagacacctgcacccccacctgtcacctgccagaccataaactgccctgcagtagccctgggcaacaaggacaagaggaacgagcttgggtgggggtgagccttgggtgggggtgagcatggtccagtcctagcccagcccttgggtccaccccagcagtcactccccctctgccagcctcagtcttcccatccagacagtggggagatggtcatcagccctagagtgttgtctcgagggttcgctcagcggctcattgggaatgcttgttgagcgactactgtgcactgtgtcaggcccctgcggagctgtcttgagagctggaggggcagaggcccctccctgagccacccatgtcagctggactccagccctgccccaggctcctgtgtgagagctcccttgcaaggcagctctgagggtatgaggataagccgtccttcctctcagcccccagggtagggggatttcatctcctgctggtatccgggggccaggaaaggggatggaaggagccgtgggaggactagttaggcaggccagagccagacagacggcccgtgctcaaattccagttctgctgcgcgaccctggccaagctgctccccctctctgatcccgttccccgtttgcaaaatggggcacagacacagatcctgccttccagcgctgtgggtgccgtcacgtaccgtgggtctctggggcgattatcaaggcccagcctcccccagctgctccgaggagcggctctggcccttgggccccgagcgccgagtccagagccccaaagcgcagaaggcgcccctcagagaatccggcgctcgggaggagcgtggccaaaggaccagcccctccatctgtccccccagcaggctgtgga

SEQ ID NO: 2701 - DNA, 1117 bp, Homo sapiens
gccccctgggggtctggacgggcacacagcgacccgccgcctcctcccacgcggggcagcacccgcgtctcctccgcgccctcaccctccccttcccttcgtgtgctgggaagaggacgcaggcccaagacgctggtctccagcctggccgcctcccgtggcgcacagacaagcccaccacgtaggctgcagggagtgcgggccccacagctgcctgagcccccggccgcggcttgggctggcccggagcagagcctctgccgtggcgacctcaggagggccgagtcacgcaactgattcgaggatgggacgggaggcgggggaaccctgggccctgttccttccccaccttgtgggtgggtgttcagacccaaaggcagaactgtcagaagacgccctgcccttggcccgtgggtggagttgggctccggcccctgcttcccgtcaggaggcagaccaccccctcgccgggagtggggggacgcatccgtggcttcccggccacctgcgcagagcctgcactcactccttgtgtgccctctaggacggcggctccctggaccaggtgctgaaagaggccaagaggattcccgaggagatcctggggaaagtcagcatcgcggtgagtccaccgcagacccacatcgcgcccccaccgcactctgcacggacctcttccacacggccagggttccgggagccactcacagtgtggtgggggttagggtggcccctgcagaaagagagtggccaaggctgtgcccacctgctgtggagcttgaacaagtgacgtcccttttggggcctgaggtcaccatctgccaagtgaagacgttataggtccctcttcactcttagtatcctctgtttgccacactggtcccctctgcccctcgtggcagggggatgttggcagctggcacgttgcaggggacaggagcttgttgaaagggagactctggggtgggatgtgggacgccaggacctccagacacactcaccattgctgttagaaatgtcaccggggccaagggcgtctctgctgcccggtctccagcacagctgctccgtagagccgtgtggtttcagcagaccgtgcgtgttgcttcttggagct

SEQ ID NO: 2702 - DNA, 1430 bp, Homo sapiens
ggagagaggcctggaggggagccattgccctgcctccctcctgggaaaggcaagcactttgtcaaagtctgatttgatggggaaaaatgctttcacacagctcccactacaactgagtgggaattaagtgtttgcttaattggtcttttttgaaaacaggtttattgaggtgtaattcacataccttacagtgtcccctttgaaagtatgtgactcagtggattgtaggatattcacggcatcgtcctcatcaccacagtcaattttacagtattccatcaccccaaaaagaaccctgtccacatcagcagtcacccccatcccctcctccagcccccggcacccacacatccccttcctgtctctggatcagcctgtcctggacatttcacagaaatgggatcacatattatgtggccttttgtgtctggcatctcgcactaagcatgacatcctcagggttcacccacgctgtggccggggtcttggcctggttcctctttacggctgagtcctgtttcagtgaggggtgggctgcgctgggttggcctgttctgccctgggtggacgcctgggttctttccacccttgcctgctgtgagtcgtgctgctgtgagcacttgggacacgtttctgtgtggacgtatgtgtccacttctaggcagacacctaggggtggaattgcggagggggtactgagttggtcttgaccactgttgggaacgcctgcagagcagaggccccaaatgccttcatcccgttttcgggcaccccccaagccagtctcgcccctctccccttgcagctgatccaccttgagatcaagccggccatccggaaccagatcatccgcgagctgcaggtcctgcacgaatgcaactcgccgtacatcgtgggcttctacggggccttctacagtgacggggagatcagcatttgcatggaacacatggtgagtgcgtccggggcaggggcaggggcagggcctccacggaacagagcatgttggggagaaggaagaccccctcacggcccctttcctcagaggcaacagtgcgctggcttccaggggatccttctcaaggcagtcgatgccatacaagtatgtatatgtagatgcctttggttttgttttgttttctttttgtttttttgagaggcagtctcactctgtcactcaggctagaatctagtagtggcacaatctcggctcactgcaacctccacctcccagattcaagtgatacttctgactcagcctcccgagtagctgggattacaggcgcccgccaccactcctggctaatttttgtatttttagtagagacagggtttcaccatcttggccaggctggtctcaaactcctgacctcaggtgatccacctgcctcgacttcccaaagtgctgggattacaggtgtgagccaccg

SEQ ID NO: 2703 - DNA, 1158 bp, Homo sapiens
tactgaaaatacaaaaattagccgggcatggtggcgggagcctgtaatctcagctacttgggaggctgaggcaggagaatctcttgaacccgggaggccaaggttgcagggagccgagatcgcgccactgcattccagcctgagcaacagagggagactccgtctcaaaaaaaaaagaaaaagaaaagaaaaagacggaggcttcctgggtcctttgagctgcagcttatccttgaggtcctgaggtctgctagacttgttgagacaggatcaaggcagcgtcctcagttcccggggagccgccctggattctggtcattggtgtgtctatgggggtacacagcatggatcctttccttctacaccatgaacccctcaagtgcaggaatccagtctgtgtcctcctgggggccgatgcaccacggccacatagcaaacggccagatggagtctccctaggtagctaacccctaccctggggggtctctgcagggcaaacctggtggacctgcagaagaagctggaggagctggaacttgacgagcagcagaagaagcggctggaagcctttctcacccagaaagccaaggtcggcgaactcaaagacgatgacttcgaaaggatctcagagctgggcgcgggcaacggcggggtggtcaccaaagtccagcacagaccctcgggcctcatcatggccaggaaggtgagcactgcggggtcggggaggtcggggagtggtggggaaggtccccctggaaacaggaggcaggttgggaaggcagccgggtctctgcattctgattagctccaggctctgtccctcatccccaccagggactctaggtcctgagaaagggcccagcttctgggcagatgggagccgtgccagccacaccagccacacacagctgtgccctccagtgactactttctgccctggagggcacttgaaatccatattcccagaaagctagcacgtgggggtttcagaaatgcgagtgtgttatggttctccagagaaacaagcgatgaagacgaagcgtgtgtgtgtttgcgcctatgtgtacagccacctcagggcgatggctcagccagtgacagaccgcctacgcagcggtggcgacgtaagatgatcaggccatgtttttgctgtgcctt

SEQ ID NO: 2704 - DNA, 1149 bp, Homo sapiens
ctatcattgaaagcgaaggtcagtgacaacatgagtcacctcatggtggacttcgcgcaagagcggcagatgctacaggcactcaagttcctgcctggtgagaggggcacgcactagagggccaggacttccggggaatgacctgggaggctaggaggccctgaaacaggacctggagtatggtggacgacccggtgtctgaattccgcctgggggaggtggagctctgagaattccacgccctgtggggggtggagttctcatggagccccgcccctgggtggagccatgggaagaccccacccactgtgtagtgacatcctgggaaaactctgtacccaggggtggaactgtgagaataccatgtcctgtggggttggttgagtcctcatgaggccccgccctggggtggagccatgagaaggtcaaactcaccaggtgggaaaatcctgtccccaggggtggagccctgagaatagcacgtcctgtgggggtggggtattcatcaagtcccgcccatgggtggagccatcagaaagccccacccaccagggggtgaggtcctgggaaaactctgtccacaggggtggagccctgagaataccatgtcgttgggggagtggagtcctcccgagacctcctccctggatagagccacgagaagggcctgcccaccacatggtagctcctgggaaaaccctgtttccaggggtggagccctgagaaggccacgtccccgaggagaaatggactgagaacccagcctgtctatgatgcagccccaaagaaagccgcatccctcattggcagagattttggaataattctgcctgtaaatgatggaatcccaagaaagctcagccctcccccaacccactgatggaaccttagcgtctccatggccgggcgcggtgactcacgcctggaatcccagcactttgggaggccgaggcgggtggatcacttgaggtcaggagttcaagaccagcctggccaacatggagaaaccctgtctctactaaaaatataaaaaattagccgggccatggtggctcacgactgtaatcccagctactcaggaggctgaggcaggagaatcgcttgaaccagggagtcggaggttgcagtgagccaagatcgtgccactgc

SEQ ID NO: 2705 - DNA, 1113 bp, Homo sapiens
agtatctggaggggatagctgggatcccgaggagtatctgggaggaatagctggagcccaaggagtatctggagggaatagcaggaaccaaggagtatctggagggaatagcaggaaccgaggagtatctggagggaatagcaggaaccgaggagtatctggaggatatagcaggaaccgaggagtatctggagggaatagctgggtccgaaggagtatctggagggaatagctggggcccaaggagtatctggagggaatagctgtggcccaaggtgtatctggagggaatagctggggcccaaggagtatctggagggaatagctggggcccaaggagtatctggggggaatagctgcggcccaaggagtatctggagggaatagctggggcccaaggagtatctggagggaatagctaggaacttgaggcgtatctgaagggaatagctggggttcaaggggtacctgaggggaatagctgggaacctgaggagtatctggggggtacagctaggaacctggggagtgtctctgcagggagcagctgtggtgtaaggagcaccttgggggctggccctttgtggaagggcatctgtggcccagttctatccagttcccctgcccacccctcctgccctgcgccacaggggacacgctgatcgacggcggggagcattactgggaggtgcgctacgagccggacagcaaggcgttcggcgtgggcgtggcctaccgcagcctgggccgcttcgagcaactgggcaagacggccgcctcctggtgcctgcacgtcaacaattggctgcaggtcagcttcacggccaagcacgccaacaaggtcaaggtgctggacgcccccgtgcccgactgcctgggtgtgcactgtgacttccaccaaggtgaccccaagccccagctgccgtctctggctgcccctgcctgagtcccctccgtctgcccccatcccacttctgaccggtcccactgtcactctgccccccgaccccaggcctcctgtccttctacaatgcccgcaccaaacaagtgctgcacactttcaagaccaggttcacacagccgctgctgcctgctttcacggtgagctgccct

SEQ ID NO: 2706 - DNA, 1072 bp, Homo sapiens
tgggatctgcctgaggacagagaacatggtctcctgcagggccctgcctcccaagccccgccctcagaaagccaagtaccttttcagctttttaactgcccccatcccaacccagggaggcctgtgtcactctggcacaagctgccaccaccagccacccacacccaccccagcacacctcacacgggaccacagccgcgctgccgagggccaagcacaaaggttccagtgagcgcatgtcccagcccctggtggccaggctccccttgctgagccgctgccacttcaccctgtgggaagtggccccagccatctcctctagaccaaggcaggcagccccgacatctgcttcctctatcgcccaatgcaaaatcgatgaaatggggagttctctgggccaggccacattcacattcccctccccctgtggtccagtgaagcctccggaccccaggctctgctctgccctgccctgcacccccctcgtcagaagtacatgaggggcgcagagatgagcacacagctttgggcacggtccagggcaaactgaaatgtacgcctgaattttgtaaacagaagtattaaatgtctctttctacagccccttgcctcgtcttggtgcaggggtgggcctgccacccaccgccttcctgaggggccggctccaaagccacacacaccccaggaggtccctccagcaccccaggtgctcctgagcccaaggtgggtgggactggccctgaggcttttgtgccagttcccaggtgcaggggctgaggggtatcctggaagttaatgccctgccctggaagtgaggaagctggggtgatggtaccagcctgggcacccagccaccctcaccccagccttggggagaccagcgtggctggctgctgcttccgtttctttattacctgagcccatccggaccctcaagacaactggagcccaccctgccctggaaggctcagctcccctgcttgaggacgccgcacacctgttccaggacgtgacacaggctctggtccttgggcgtcctgctggccaaggagatctgaaacgagggggctgg

SEQ ID NO: 2707 - DNA, 1088 bp, Homo sapiens
taagtgcctgtcattgtcatcgctttcaccgtagctgagagccgtgaggaccaaggtgtgccaggcctgtgttgactgccttgtgaaactcagtgtccacatggggcaagggctgggctgtcccatcctgcagacacgggcaccagagcacaggagaatggcggcctccctgcccggctgcctgcacctcttctcgtaactgtcagctcctgctgcctctcccagccaagctggcaggatttttttttttaagtagaccccacatactcaaggatgggggcagatccccacattgctatctgtggggatgtttgtgtaggcgcttctggaagcagtgtcttctgagccatgtgttctcaggctgaggctctggactccaccgtggcccagatggggcctactgtggcagggtccccagtgggtatgtgagtggcagtcgggacacacacaggtgggcaggccacccccaccctccccctccccctgcaggcccaccctgctctgcaggcagcgtgtggccctggggtgcccacggcagtgcctgaggtgtgtgtcctgatcacttggcctcctgcctccagctgtggatgcgatgtggctggaaggcggctcagggcctcctgtcctcttcttcctcctacccctgggctcacagcgtttcccctcttctgtcctctagctggtcagtgagaaggtcggaggggccgaggggaccaagctggatgatgacttcaaagagatggagaaggtgaggaagaaactgcgtgctctgtgtggtggtggcactgctggggcctgacctctgccgggcatagtggaggcggccaaccttgatgggcctgggtctggagtgatggggcccggcaggtgtggagagatggggtggtgtgggggcctcgtcagctggacttgacgggcaccagctctctcccctgccgtgggcaggcagctgtggggacatggctgagctgaagacatggagagggggttggggggtcctggtatgggctcttagggcaggaggcggtgcagcagcgggggtcttgtgtgccttgggcccccactggctgtggagtcttatatgctgc

SEQ ID NO: 2708 - DNA, 1099 bp, Homo sapiens
ctgctggggatgggatcccgtccgcatctgcaccgtggccccacagccccctcttgcctcctgcgggcctgctgcacaccatttcctcctgactgcccagctgctgtgacctagtgggctttctgccgatgctcaccgtgtctgtcgggaggccatgcaaagcagatgttcacagctttacatttttttgtttctttaagatggagtctcactctatcactcaggctggagtgcagtggcgcgatttcggctcactgcaacctctgcctcccaggctcaagtgatagtcctgccccagcctccctagtagctgggattataggtgcgtgccaccatgcccagccaagatttgtatttttagtagagacagagttttaccatgttggccaggctggtctcaaactcctgacttcagatgatccgcccacctcagcctcccaaagtgctgggattagaggtgtgagccactgcgcctggcctactttgtttttaataaggcacacactctgcttttctatctgatgaactcttttttttttctccttttgaggatgatgatgacgacatgggagaggatgaagatgaggacgatggtttctttgtgccccatgggtacctgtctgaggacgaaggtgtgacagaggtgagggagtgaagggggaggtcaccggctcagcaaaagttcatttctggactggtgctcagtggcctgacctgggagggtgacgggggtcccagcccaaccatacgagatttggactgcattccaagcacgcaagctcactcgtgggaacagctgggcctgaacttggtattacctgggagggtggcagacgtaggaggagcttgcaagcgaggggagccataggagcagacaccctggtgagggagcgtggccatggtctgtgggttagaaggctggaaaccacccgagctgacatacagtcagcatgcagcaagacatgtgcattgtaagtgttgagtttgatgacgtaacaatcaagtgaatgtgggcaaccaccgcccgaaataaaacagaacttccctatctctccagaagattgcccacgtctctgcaggcgaacctgcctgccacccc

SEQ ID NO: 2709 - DNA, 1101 bp, Homo sapiens
aaaaatacaaaagattagctgggcgtagtggcgggcacctgttaaaaaaaaaaaaaaaggcacagcaaaaatatcgttgcggctggggcagtggctcacgcctgtaatcccagcactttgggaggccaaggcaggcggatcacttcaggtcaagagttcgagaccagcctggcaacatggtgaaaccccatctctactaaaaatacaaaaattagccgggtgtggtggcaggtggctgtaatcccagctactcaggaggccgaggcaggagaatcacttgaacctgggagtcagaagttgcagtgagccaagatcgcaccactgcactccagcctggatatatggcaagactctgtctcaagatttatatatattaaataaaaatacagttgtctgtaatcccaggactttgggaggctgaggtgggtagatcataaggtcaggagtttgagaccagcttgaccaacatggtgaaaccccgtctctactaaaaatacaaaaattagctgggcgtgatggcatacacctgtaatcccagctactcaggaggctgaagaacgagaatcgcttgaacccgggtggcggaggttgcagtgagctgagattgtgccactgcactccagcctcagtgacagagtgaaactcccgtctcaaaaataaaaaataaaggccaggcatggtggctcacacctgtaatcccagcactttgggaggctgaggcgggcggatcacgaggtcaggagatcaagaccatccggataacacgatgaaaccccgtctctactaaaaatacaaactgggcgtggtgtcaggcgcctgtagtcccagctactcaggaggctgaggcaggagaatggcgtgaatccgggaggcggagcttgcagtgagtcgagatcgcgccactgcactccagcctgggcaacagagcgagactccgtctcaaaaaaaaataaaaataaataaatacagttgtaatctgatggggccactatcaggtatgcggcctgtcactgactggaaattattctgcagttggcaatgatggctgtttttggagatctgaatccagttcatttgagggaacccccaaggttctctggt

SEQ ID NO: 2710 - DNA, 1178 bp, Homo sapiens
acgcaaggacaaacactgtgtgacccactcctaggaagtccctagagtcatcaggttcactgagacagtaggatgggaggtgccaggggctggggaggggggtgaggagtgagtgtttcatggggacagaatttcagtttgggaagtcgagaaagttctggagatggtggtggtgatgggtgcacaattatgtggatgttcttaatgctagtgaactgtgtgtacttaaaaacagttaagggcccaccgggcaccgtggctcacaactgtaatcccagcactttgggaggccgaggcgggtggatcacctgaggtcaggagttcaagaccagcctggccaatatggtgaaaccttatccctactaaaaatacaaaaattggccgggggcagtggctcatgcctgtaatcccagcactttgggaggccgaggtgggtggatcacctgaggtcaggagttcaaaaccagcctggccaatatggtgaaaccttatccctactaaaaatacaaaaattagccgggtatggtggcgggcacttgtgatcccagctacttgggaggctgagacaggagaattgcttgaacccgggaagctgaggttgcagtgagccgagatcacgccattgcactccagcctgggcgacagagcaggactcttgtctccaaaaaaaaaaaaaaaaaaaaaaaagagcactcaccccttgggggtgctgtgaagattaaatgagttaatttaagtacttatgataatgcctggcacctagcaagtgctttatgtttgctaggtgtttttttgtcgttgttttaatttaaattaattttattttttttgagatagggtctcactcggtcgcccagactggagtacagtggaccaattataactcattgcattcttgaactcctgggctcaagcaatcatcctgcttcagcctcacaagtagctgggactacaggcacgtgccaccatgcctggttaattttttatgttctgtagagattatgggggcgtgtctcgctatgttgcccaggctggtctcaaactcctgagctcaagtgatcctcttgccttggcctcacaaagtgctttacaaaattaatacaaaaattaaccgggcgtggcagtgcacacctgtaatcccagcttttcaggaggctgagacacgagaattgcttgaa

SEQ ID NO: 2711 - DNA, 1162 bp, Homo sapiens
ttcatatttggagaatcagcaaccaaccagccaaccatgttgcttttataagacagagctgagaaagcaaagcttggctgtcgtcttggctctggtaccacccacgagatgcgggcgattctcagctcagggcgtggaggcgtggtgtgggggagtctatttgccatttttgtttgtcagcagggggcaggggttctcaaagattgcaaaatgctgctgcaggtcaggaaggttattttgggtgcctgtgggggaggtgaaacaaggtcccatgactgttttgcagaaccttgtctgtggagggtagaggttgcggcaggggcctgtgggccttacttggtgagaaggtaggtctagctggctccattcagtatttgagacatttggaatttgtctgcatttaaaaccaagagatcacacacacctgtctggatttggagtttctcttgaaaactcgccagtccggccgtctgagcctgcactgacgcctggtgaagctgtgcaggggccgcccctctccctttcaccacagtcctctccactccctttcgcctctccctggcctgctgcactcactgataggaaattctgaccccagactcggagcagccttcccgtggttcggtttttgcttccgcgaaaaagccaaaggccttggccagagagccagctgttcctacctctaccccacgcttccaaggcaaccttctccacttatcttaggccgagagacagctcttcaagaacgtacatggatcctgattttctcacgaagtcccgatggaaccctgtgctgttgagacatcagtgtgtaaaactctctgtgtccctgttgggctgtccagacagtctggactcttgtaaatttgagatttaattaaaggaaacaaaccaaataggactgcggaacaatttaaataaaagcacacaccagcctgggcgcagtggctcatgtcagttaaacctagtgctttgggaggccgaggcaggaggatcacttgagccaaggagttcaagaccaccctgggcaacatagcgagaccctatctctaaaaatatatatatataaggccaagtgcagtggctcacgcctgtcatcccagcactttgggaggctgaggcaggcagatcacctgaggtcaggagttcaagaccagcctgg

SEQ ID NO: 2712 - DNA, 1148 bp, Homo sapiens
tgcagcctgacccaccctgcatcctgttcaggccgggatcatctccttcctgggcttcttctggcccctttctgcatctcttcttgacaacatggcacaaatgaccagggttcttcccacctcaggtctttctgtggcttcctgctgcctgccatctatgttagccccaccgaccttaccctccacatcactgttttcctgtctgtcacccgtaagactttcagtgcctggggccttttcacatgggagtctgctttggagactgctccccttgcctgcttagcccccaccatgggccccaccccaaatcctccggacttctgagaattttcaatgttgagggcccaaccatgtgtttctttcttgcagtggctcacaggcccggggcattcaaagctgagctgtccaagctggtgattgtggccaaggcatcgcgcactgagctgtgaccagcagccctgttgcgggtggcaccttctcatctccggtgaagctgaaggggcctgtgtccctgaaagggccagcacatcactggttttctaggagggactcttaagttttctacctgggctgacgttgccttgtccggaggggcttgcagggtggctgaagccctggggcagagaacagagggtccagggccctcctggctcccaacagcttctcagttcccacttcctgctgagctcttctggactcaggatcgcagatccggggcacaaagagggtggggaacatgggggctatgctggggaaagcagccatgctccccccgacctccagccgagcatccttcatgagcctgcagaactgctttcctatgtttacccaggggacctcctttcagatgaactgggaagagatgaaatgttttttcatatttaaataaataagaacattaaaaagcaaccccacagcctgggccctcccggctggccgttgcgggtcaggagctcagacgcggctgacactgccccaccgtgggcgggtgggcggtgtctctgggtgggacttctctgcaggcatcaaagcgctagatcccaaggtggctgtatgtgaacttgcccccttccccccttggcactcgctgtccctgggtcccccacatgttgtgaattcacacccgggtttctgtggctgccacaggc

SEQ ID NO: 2713 - DNA, 1164 bp, Homo sapiens
aattgctggaacccaggaggtggaggttgcagtgagccgagatcacgccactgcactccagcttggcaacagagcgagactccgtctcaaaaaaaaaaaaaaaaaaaaaaaaagagacaaggtcttgctgtcgtccaggctggagtgcagcggcgtgatcatggcttactgcaacctctgttttccaggctcaagcaatcctcctacttcagcctcctgagtagctgggactacaggtgcctgccaccacacccaatatttaaatttttattaattgaaaaaacttttttgcagagacagggtcttgcctggtatcaaactcctgggctcaagtgatcctcctgcctcggccttctgagtagttgggactacaagcatgagctattgggcctggcctagcttttatacaatgcccatgttacaaaattccaaatgtccaaaaagcaaggagaatatcttccactctgccttgaccttcagtttcccccctgtagtaacctgtctgcttccagaagtgcttgaacatgtgtgcgtttgctatgggtttttttttgtttgttttgttttgtttttgagatggagtctcactctgttgcccaagctggagtgcagtggcgtgatcttggctcactgcaacctccacctcccaggttcaagtgattctcctgcctcagcctcccaagtagctggggttacaggtgcacaccaccacgtccggctaatttttttgtatttttagtagagacggggtttcaccacgttggccaggttggtctcaaactcctgacctcaggtgatccacccaccttggcctcccaaaatgctgggattacaagtatgagtcactgtgcctggcctgtttttttttttttgagacagagtcttgctctgtcgccaggctggagtgcgttggcttgatgtcagctcaccgcaacctccacctcccgggttcaagcaattctgcgtcagcctcccgagtagctgggactacaggcatgcaccaccatgcccggctaattttgtatttttagtagagacgaggtttctccatattggtcaggctggtctctaactcctgacctccagttatctgccggcctcagcctcccaaagtgctgggattacaggcgtgagctactgtgcccagctggttttttttttttt

SEQ ID NO: 2714 - DNA, 1100 bp, Homo sapiens
tagctcactgcagccttgaactcctgggctgaagcaattctcctgccttagcctccttttccttaacacttaatttgttgaggaatcctggtcatttgtcccaggagttccaaatggctctatccagactgtagagatgaccaggagatgtcacttgctgtgtgcgtctgtgctacctgtgagctggtaggtcagtgtgttcccacactgtcccatagccaagagccacctgtgctgtgcttgaaatgtggccaggaggaactggaatgtactgtgagtgtaaaatacacatgggtgccaggcgcagtggctcatgcctgtaatcccagtactttggggggccgaggtgggcggatcacaaggtcaggagatcgagaccatcctggcaaacacggtgaaaccccgtctctactaaaaatacaaaaaattagccaggcgtggtggcgggtgcctatagtgccagctactcaggaggctgaggcaggagagtggcgtgaacccgggaggtggagcttgcagtgagccgagatcgtgccactgcactccagcctgggcgacagagcgagactgtctcaaaaaaaaaaaaaaaaacacatgggctttcagagacctggtacaaaagaagaatgtaaagtagctcattaataactttttcatattcattccatgttgaaataatcttttgtctacactgggttctatggaacatattccaattacttccacctatgtttacctctcaaacgtgcttattaggaaatttagaattacatacacagcgtgtgttcaagtgctgtttccctcggacgttgctgatggggatgtcggattattgatctcgggggatcagtttcactcacaggagttcttgtattttgatgtaggccattggatcaagcgttgcctttatgattttttttttttttttttttttttgagatggagtcttgctctgtcgcccatgctggagtgcagtggcgtgatcatctcagctccacaacctccatttcccaggttcaagcgattctcctgcctcagcctcccgagtagctgggattacaggcacgggccaccatgcccagctaattcttgtattctta

SEQ ID NO: 2715 - DNA, 1146 bp, Homo sapiens
tcacagcgggactggggcaaggtgaggcgggtccttcccacgtgcccgtggcccctccccgcctgccagggctcacgctgttgttctttgtgtctgtgcctgggacagggcatggcctgtgtgggccgcaccaaggaatgtaccatcgtcccgtccaaccactacggacccatcccggggatccccgtgggcaccatgtggcggttccgagtccaggtacctgcagcgtcccggggctccaggggccacgcgggctcatcctgcttttctgggggcagtttctcctggctttggccagccaggggtcagggtggttaccagtggtgcctcggctagccgaggaggggtgtggaaagcctgcaggtttgggtttactccttattttaccagggacctgcaatgaatccttgggggtgggggctgctgctctgctcagagacacgtaaggtcattcccaaagctcctgtcccagggaaggggtggcatctgctaagagggacctgtctcagcgctggttgtgatctatcattggggcagcccctgcctgtgactgggtgttgacagtgctgggcgctgtcagctgtgggctgtgtgtcacggcagacgagacactttggcactagtgacattggagccagatggttctctggggcggggccatcctgggcactgcagggtgctgagcagcatctctggcccccacccactccatgtcctcccaagtcatgacaaccagaaacgtctgcagacatgagtgtccccttggaggcaggattgcccctgggtgagatgcactgagctgggtggacaagctgggcctcatcatggagttcatggggccaggcgtgcagggctaggagctcctggggcagcgctgtatccctagtgctcagcggccagccggggccccatgctcaggccagggcctctcaaggcattttgtggagtgagtggcaggctgcacctcaaccggcctaatgaaggccggcttttatatcataacctcatttagaactcagtcacccccacttttattttttttgagacggagtcttgctctgttgcccaggctggagtgcagtggtgcggtcttggctcactgcaacctccctctcctgggttcaagcgattctcctgcctcagcct

SEQ ID NO: 2716 - DNA, 1158 bp, Homo sapiens
caccggccgtctcccggtttttccctcgctgtctgggcctgaaacagcccagaagagaaatcggatctcttctcagcctgagcttctcttttagcctgagctgaaagagatcatcttgggaaggagctccccagcccggcttggattggtcccctctctggtgccccgggggagtagtgatggattcaggacttggtcctggtctgacctgccgtgggggctgtgatggggtcctgatgtgccccgtgtgccatggcgctcgccaagggccagcatgtctgcggcctcacaggggcttcacgagccacattcggggcagcgcttggtttggagtctagagccagagcctggcgtgggacccgagctcgtgaactctgtcagtgccactgacttggggcagtgtctccgtgtgcctccctgtggggcgatggcggagtaaacgggtgatggccactgagcgctggccgtggggactcttggtcctggctgccaagtagaagcttcaggggtgctcttcacagtcagctgactctgctgtccctgatagcagaagacagcgaaggcacctgccccctgccatggcaggtcggcgggcacagaggagggctcgggaggctgtgtcctccagcgtctccatgtttactgtgccaggccaggtgctgaggggccggcgaggaagacgtgaggactggagagagcctggattagggccctcgaggggcggcgctgctttagccgggggaacagggagggcctctcccagcaggtgacattcagtcagagacctctgagcgactcacacctgcccacctttgcaggatttgggacaagagtgctccaaagaagtgcaggcagcacgtgcggaggccccaaggcggaacgaggcgcagctcactgagctggcaggagcagagaggactgcaggggcacagaggccggagcagcagtgcctgctgcctagtcagccgtgagggcaaaggctggaggcactgctgtcagaggtttatgcctttttttatttttattttattttatttttttttttgtgagacggagtcttgctctgtcgcctaggctggagcgtagtggcacaatctctcggctcactgcaacctctgcctactgggttcaagcgattctcctgcctcagcctcctga

SEQ ID NO: 2717 - DNA, 1200 bp, Homo sapiens
ctgcctggtgcacgctggcatgtgcgatggggcccttcctggaagggccaagctggcggtgagcccttcagaaaaggtgtctgggctgggtatggcggctcatgcctgcagccccagcgcttggaggggccaaagtgggagggaccattgagcccaggagttcgagaccagcctgggcaacagagtgagacttcatctctacacagaaaaaagtaaaaattagccaggtgtggtttctcacgcctatagcctatagtcccaggtactcaggagactgaggctggaggattacctgagcctgggaggttgaggctgcagtgagctatgattctgccactgcactccagcctgggcaagaatctcacacaggttaagaccagcccctggtctgcagggtatgaccggcccctgggggggccgcagatactggggtggaggaggatgggcagcgacccctgggactctggggagaattagcctgcaccccagggctcgcaggttctgggggtggccgggcggttgccgacgctgctctgccgccccacaggacgtggcccagtggaacatcgggagcctccggaccatcctggacatggtggagcgcgagtgcggcaccatcatcgagggcgtgaacacgccctacctgtacttcggcatgtggaagaccaccttcgcctggcacaccgaggacatggacctgtacagcatcaactacctgcactttggggagcctaagtcctggtgagtgtctgcactggccctgccgccggccggaccgagagcccctcgggagggagtcaatcccgggtacacggctgggcgccgtggcaggggccccaccaggtgaggccgcaaaggtcggcctatgacggctggagatcttccggaccgcctggggtcacccaccagctttggggtgggggatgtgcacccccagagccgaagctcccaggcccctagagcttgcgctttgtaccccggagtgccccccattgagctgtgagcggccccaggtgtccccatggccaggagcgtggtcttgagcctcctgagctgcccaggctgtgctgcctcacagccaagtggagacgttcctggtgaagggacactgtccatgctgcccagaggggcctggccaggatgaccctgcagccgctccctcgcagtctccgccctggcacgtctgggccaggccctaca

SEQ ID NO: 2718 - DNA, 1187 bp, Homo sapiens
cactcagactcagaccccaggacgggtgtagggcagccggggcagggctgggcactgagtttggccagtccttggcccagaaggccctgggtgagtggacggctctggatgtccagggagaaccaggtgttgggggaggggctcagaggaaccatgtttgggggctctggcctcaggtggcagtcagccgagacagacgtgtccccctcctgttgatgggatgggacgctgcagtgtcagcttgatgggcattgtggagaatggggcagccaggaggcaggtggagggggagctatgggccagggaccctgtgggcagccagggctgtagacccggggccatcccctgggcagttggggtgattccttggacgagtttttagggggctcaagtgtctctctccctctcccctctgttcttctagaggcatcccctttctccggggaggaagatgtgagtgacccggacgccttgaggccgctgctgtctctgcagtggaagaacagggcggccagcttccaggccgagaggaagttcaacgcagcggctgcgcgcacggagccctactgcgccatctgcacgctcttctacccctactgccaggtgggcaggcgggcctcacgggtcccagagaaccccaggcaggggcggtgggagagggcgagggaccgggcaccccacacgcctccctctctcacgcagggcagggtgttggccagcaccccgagttgtgagggcttgttcctgacagccgtaggcagagcctggtctctgggttttattggaatgaagcttactaacgtgcccatgtgcaacatgagccatggtggatggggcagagggaggctgcggaggctcggggtcactgccctcagggagcgcccgtgtctggtgggcgctgagatgggccgggtggtgtgggagtgcagtgaaggcccaggtacaccacctgggtggccgggcggggctcccgcaaaccctggcctgtctagctgagctgggcacctggctaaggtcctgtttctggtgctctttccatgctggcctcgcctgtcctctgcacccagatggggagctggcctctgcccacggccatcccaggcatcagcacccagcccagccgttttcctcggatctcttagatccccccttctctcttcccctgggcatgcagcctccccaggaca

SEQ ID NO: 2719 - DNA, 1195 bp, Homo sapiens
ggtctgggtggacagagccagggagagtgctgtgccgagggtggtgagcctgtcttggggctctgctgctgggagctggatttagtgctctggttcctgagacaaacaagacctgacagccgacaccgtctccaggcacttgctgtcctttgtgaggccagagaggctgctgggagccacagggcctggaatgccacttcagacatgcgtcttcctaattccccttgccaggcagagtgtggagactcgttcatcacacaccacccccagcataccccagcgccaggggccacccagcaccaggggccacacaggccagcctgagctctgtgtctggatgcaaccctcatgggaaggtcttcggcgggttggggacagggtcagacagtgtttggggatcctgactttctggaggagtgagaagaggggccgaggtggctctggccatctccccgacctccccctccagagccagggggtgtcgaagcctggggcaggtgccctgagagaggtccgcgccgcccgcccgcctgccccacacatggctctgtcccctgaaggtcgcctctcccctacaggccctacagactgagaaggaggcacccatagcctccctcggaaagggctgcccggccacattaccctccaaaagccgtcagaagacccgaccgctcatccctgagatgtgcttcacctctggcggtgagaacacggagccgctgcctgccaactcctacatcggcgacgacgggaccagccccctgatcgcctgcggcaagtgctgcctgcaggtccatgccagtgagtgccactgtggggcccagaggagctgcgccctccttcagggtgttggtgggggtgccggtgggggctccatcctcccctgcggagggccacaccggcccctctccccaggctgcactttcagggccagggcaggggcctcccccggtgacttcctgcaatttctgactttctcatccttcccgttgtggtcccaccatctagagcagggggaaaggctgtggccatggaagggctggatgaccgcatgccaccctggggcaggacagggcctccaccgcccccagcatccagaagatgccagtgcaggcccaggtgctggcctctggtgccagcctctgcggaggaagcctctgctccaaggggcactgggctcatcccaccctgtccc

SEQ ID NO: 2720 - DNA, 1130 bp, Homo sapiens
tgaggcctggacccccagtgggcagggcaggaggtggcagcggcagcagctgtgtttctgcaccatttccgaggacgacgcagcccctcgagcccccccaccggccccggccgccccagcgacctccctggcaccggccgccgccttcaaatacttggcacattcctcctttccttccaattccaaaaccagattccggggtggggggtggggggatggtgagcaaataggagtgctccccagaaccagaggagggtggggcacagaccatagacggacccctcgtcctcccccagcggtggtagggggacccggggggctcctccccgctctgcagcctggggacactgggctgggaccagaatccagctttcttttaaaactctcagtgtaactgtatcccgtgacatttcattttttttaaatagtgtatttttttttccatttttttttttaagagaaacaaacaaaagactcgccagtcaatgactttcaaagagaactaactttggcttattcatattctgttcaaagacagtctattttttcactgtagaaagcgtccttgtgtgatagttacgttcgcaaacgcgcacgccaggcccatggctgtaccttggcttttttttttttttttttttttttaatttttcctaccatcagaaagtgtgctttgctcacagaagaatgggatgtccttttttctttcttggctttttttttccccctttttgtttcatttttataaattaaattttcagacatatcaaatacagttctgagggtaaggtcatgggggagctcggacccagtggcgttgggtgcggttgagggggacgctgctgtaagaggagagagatgacagtggtcctcctctgagagcctgagctgtctccccgtctcccgcccccaaggagacagagaggatcctacttcttcggggacagtggctgtatggctgtgctgccccacatcagggaccctttccccctgggactgtggggcagtttgggagcaaaaccagaaggacaggcccccctctacccgcctaccctgagcaagcgagttgttcctctttgtacaagggcaggtctgcggttactttcaacactgtttattccagcggaagc

SEQ ID NO: 2721 - DNA, 1157 bp, Homo sapiens
gttcaccaggatggtctcgatctcctgacctcgtgatccacctgcctcggcctctcaaagtgctgggattataggcgtgacccactgtgcccggctgataaaactttattaataaatacagctacagggctgtttttgcggccctttaccccctccactccagcattcctaccagatgcagaggagctgcctatttcttggtcttaacagcactgcgatttgtcacttttttgtcacttgtccgttggagtggagttgggggggcgggggggcacggttattagtctgccctacgtggctgtttcctaatctcttttttttttttttttgagacagtcttgctctgtcgcccaggctggagtgcagtagcatgatctcagctcactgcaacctccacctcctgggtttaagcgattcttctgcctcagcctcccaaggaactgggattacaggcgtccgccaccatgcctggctaatttctgtatttttagtagagacggggtttcaccatgttggccaggctggtctcgaactcctgacctcaggtgatccacctgcttcgtcctcccaaagtgctgggattacaggtgtgagcccccacggccggcccatcttggtttgtagagcaccctggatgcaaggcagcccgtcacttagctggctcacctcatcacctcagcccagaagcatgttcccaccgctcagggagctctgggaccaggagattccagggacctgagtttctcctccttgtccccgctcccccccgcccccacatcaccaccggtctccatttaccatggaggggagccagaacctcaccacccaagagggataccgagcgctggagacctggtgccactcactcacctggtgctggaggattgagtgctcaaccaggattgagttgtttgttcattgattgagctcctactgtatgcccggttctgcgctgggtgctacggatgctgtggtgacacagatgcaccgttacagatagaattccctgctgcagaggagagtgaggagtgtgggggcatttagagcaagggagttggagctagtcccaggtggtgttccgatcagtagacagatgtgggaacggggattccaggctgagggaacagaacaggtgacccgagggagggggcttgatg

SEQ ID NO: 2722 - DNA, 1166 bp, Homo sapiens
ctggctctgacctcatgtcccatggtcaccccccgcccccatgctgggtgcctcagtttccccacatgtctcaccaggaaattagaccaagttattctggcaagtgctttcagggccctccagggtttggctggtcaccatggagggggggttcaggtgctgaatttagggaccccagcatctcacaggtttccccttccatctttcccagtggcactgtgtctgagcaggtgtgcccaggtgaggttgtatccactgtgtctgagcaggtgtgcccaggtgaggttgtatccactgtgtgtgagcaggtgtggctgttgcaggtggaagtggggatatgtgggcacctgggtgcccatgggtgccgtggtggggggcgaggtgggagggtgtttgttgtcatccttgctttcctcctcctctcttcattggccacatggcacttccgtgggcagggcatggaatgcaggttttcgtggctccttggtatcctagccagatgcctggacccatcagcgcccccccttctttccactgtatccccagagccccccaggtttatcaaagaacccaaggaccagatcggcgtgtcggggggtgtggcctctttcgtgtgtcaggccacgggtgaccccaagccacgagtgacctggaacaagaagggcaagaaggtcaactctcagcgctttgaggtgagttggggtagggggaggcagcctggggtcaatgctcccccaaggcagggccacagcacctcagccacagtggacttcgtggacacgttccccaggtggagcatcatctgtggccaagcaagcatggctgcgcagcctccagccagggccctgcccgccttacttgctctaccagctccatgctgtgtggcctcaagcaaagccctgccctctctgagtcttcttcacagtgcagtgtacacagcaccactgcacacagaaggaactttacaactctcaatacacgcccatgatcacacgtgcacattgacacattccgcatgtcttcacatgcctttgcatgcctgtcacatgggcttgcagacatttgtcaccctcacacatgcacacaacaccctgttcttatatgtacccaaatctggtccctgtctgcggcgcatttatactggacaccgacacacgtgcacattc

SEQ ID NO: 2723 - DNA, 1182 bp, Homo sapiens
gtcttgctcttgtgaacggaaacctggtatgtccttgaaggtacaaccttaaaaataaatgtggtgagagcaaaacaagggcattaaattcttgctgcttttgcctctgtctgttccaggctgaaagctgaagcctgagcacccctgaggtgtttaagacatcctagcacccacctgaggcttttagccttaagcccagcacagaatgacccccttgctggttgagtcagtattttgttttgttttcttgagatggagtctcactctgtcgcccaggctggagtgcaatggcccgatctcggctcactgcaacccccacctcccgggttcaagcgattctcctgcctcagcctcccgagatgctgggattacaggcgtgtgtcaccacatacggctaatttttgtatttttggtagtgacagcgtttcaccatgttggccaggctggtttcgaactcctgacctcaagtgatctgcctgccccagcctccccaggtgctgggattacaggcatgagccaccatgcctgtcccagtgttattgaatgtgactacaactgtttggggcatctcctggactttctgggaggctgagccccttctgccttcggcctgaatttcttgaactgagcgttgcttccccatggcctggggagaaggtgatttcttcctgaattcaattaatgagcctattaaaaactatttattttccctgacagttgtttactgaggagaaggagatgaattggccggtgtcctcggcaggcaggaaggaggctgaatgggggtgcttggtggctcagccccagtgcttggggagcacagattgccggtgggggcctgtccttggggacgccttgggcagagcctgtgcttgggtcgtggccactgcttctgaccttggagtcttttgggaggtggatgttggaatgagtgaaaccgtcgtggtgtggaggcagggggccggccccgatgacgtctctcttctctttccaggttaaaatgtctcagatgcgctggtttgagacccaagacctggccccatggcccacatgagatattgtggcgggatctcccaatatcccatcatatcccccgactccgtagcagttgaactttacaatttttatctgggcacatggccacctgggggaaagaaaacatttctcagtgcaccttgcagc

SEQ ID NO: 2724 - DNA, 1200 bp, Homo sapiens
gttcgggatgggggcgagcgggagggaaaaccctaaaaataaaaagggatatttataaacccagcgggtttgggggataattgacaaagcttaatgtttttcggctgagagcaattccttccccctgctacccattaagctccatttgcagagtcggtcggagccacgggaagatcttgagatgagctttaggtttggcgggcgcagtgctgaccgctgtagcccccttctgggagggtctcgtactttctggaaggagacaggggtcccagaaaggggcactccccagctctcctctgcatccagggtaggctcctggctcaccttccaatgggtgggtgtcctcttagaatttgcaaggaggatgagaacccttctcgggcaaagcctgtgcaggttgcccttcctccgtccttccctgcggcaaaagatgcccagggaggggaatttgaagagagaccctcccccccaccacccgccgccgccccaccctccaaccgctcaccaggcagagtggctcagcctccggtggggacaggaggagaggagattaagacataactgctgttcctcgcaggattcgtgtggcaagctgatacaaaacaaaacaaaaaaaccaaaaattcaccatggattcacggaccaaggcacgtatccggggcttgaaggtttcaagggctttttaaactgtgaattttgtcattttcacaccttaccttgctctggaatcggaaagctgccagcttgtggcttgcggggcagaggagaggggatgctggaaggggattgaggctcaaatgcatgtcatcttatcaccaggtgacattctgaattgaggaagggggacacggagagaggaagtgaagtgtaggggatgtgatcgagggaaagggtggctgttgtctcacgcagagagtggcagccccaaaatgtctaggaaacaggtgacacctgggtctctctaaccctgaggttcaagagtgtggagtgtgtggtttcccccccgccccccccccttttcctttaaggaaagaaaagactctcaaccaaaaagggaagaaaaaaaaaaacccgacgtaccatttctgtcttgtctctggctgatatttgagaagcgctggggagggggttgtgtgtggggaatttgaaaaatcaattggcttacacttctccaaaggcgaaaattaacgggtaggagtg

SEQ ID NO: 2725 - DNA, 1209 bp, Homo sapiens
tgtctctttcatctctctcttttgtctgtgtctctcttttatctctgtctctttcatctttgtctctctcatctcttttgtggctgtctcatctccatctcttatctctgtctccctcttgtttctgtctcttgtctctgtctcttttatctctgcgtctctcatctttgtctcctcacctctctctcttttgtctttgtctctgtctctctctccattttggtctctgttttttcctctctgtgtgtctctctccatctctgcctctgtttatttctttccctgatgatttggttgcctgtgattgtctctgtctctgtctctcttttctctgtcactctgtgtctctgcccacttctctctctgctgttttcctccctgtttctccctcatctctgtctccctctctcttttctgtctccctctctggtctctgtctccccattttggtctctgcttttttcctctgtgtgtgtgtctctgtctctcttcccctttgtctctttgtgtctctgcccatttctgtctctgctgtttttctccttgtgtctctctgtgtctgtctcttttgtctctttgtccatttttgtctctgtttttctctgtgtctgtgtatgtgtgtgtctctctctccctgtctctctgtctctttgtccatttgtctctgtctctgctgtttttctctctgtctctctgtgtctctgtctctgtgtccctgtccagttctgtctgtgtgtgcgcgcatctctctctgtgtctctgtgagtctctgtctcttttgtctctgtctctctctgtgtctctgcccattttggtctctgctttctttcctctgtgtgtctctccatttctgtctctctttctctgtctctctccatttctgtctctgctctttttctctctgtgtgtctcttttgtctctctgtttctctgcgtgtctctgtccatttctgtctcttcccgctgtgtatttctctctctgtgtctctgtctctgttattttggtctctgctctttttctcgctgtgtctcaacatgtgtgtctgtgtctctttatctctctggtgtctctgcatttttctctgctgtttttctctgtctctgaagctctgtctctctcttccttctctggtctctccctaccgccttatctttcccacagccccactccagtgtccgttacccacactcacacttggatatctgggt

SEQ ID NO: 2726 - DNA, 1170 bp, Homo sapiens
ttcacaagttttagaccatattaaaggaacactggcagaaccctgtttgatttccctttcgtctgttcccctacattgccctcctggcccccttgaggaactagatgagcgattagaactggccagaggtccttggaggaacaacagcgaaacagaagcattagtagcattgtcctccccagtctaacacttgtcggacccctgatgagcagacttccctgtggggtgttcatatccccatgccccgctcagtgggcttcatgtctgagtcatatttgcctgctttcctttgaggtggtgggcgccaaggttgtgacaaatgcccggagtcctggagctcgctgttacggttttgtcacgatgtccacagcagaagaggccacaaaatgcattaaccacctgcacaagacggagctccacggaaagatgatctccgtggagaaagtgagtggccgttttcttcccaggatatagcccacattaggaaatgggggtaatacttgattctctttttcaggccaaaaatgaacctgtgggaaagaaaacctctgacaaaagagacagtgacgggaaaaaggagaagtcgagcaacagtgacaggtacccctccttcctggctaaattaaaggggcagggtgttttttgttgttgttgttttgtttttgagatggagtcgcgctctgtcgcccagactggagtgcagtggtgtgatctcggctcacctcaactccacctcctgggttcaagcaattctcctgcctcagcctcctgagtatctgggactaaggtgtgcaccaccacacccggctaatttttgtattttcagtagagatggggtttcaccatattggccaggctggtcttgaactcctgaccttgtgatccgcctgcctcggcctcccaaagtgctcggattacaggcgtgagccaccatgcctggccggggcagggtgttttaaacagaatctcactctgttgcccaggctggtgtgcagtggcaagatctcttttcattgaacctccacctccctggctcaaccaattctcatgcctcagcctcccgatttgcttggattatagccatgcccatttgtggttttagtagagatggggtttcaccatgttggccaggctggtctcgaactcccggtctcatgtgatccgcccgcc

SEQ ID NO: 2727 - DNA, 1273 bp, Homo sapiens
gacgtctatggtccctgtgcccaggtgtcttcctgggacccgctagttgtgggtacctgggggcctcaccaaagggagtggagtgggctaaatgtgccgtgggttccacgccgtgtgcgcaagttccctgtgtgaaagcacgtctgtcttccaggtggcgagagaagcatgtccggtcactccgggcctggccacatgatgaaccgaggaggaatgtcagggtaaggcatgctgggggcggcgccccttccccctgctttgcatattggcctaccttgctggaggcttaacaaccaagtccttccagctagtgcccctccccccaagggtgacgtgaggccaggcatggggtactgtggaggctgctgccactcaggaggggagggcattaggaaggggccctgcctgcaggcaacactcagggaagctgtgcaggctgggatgggccggggagcaggaggacttcgcagtcaaaccaatgtgaatttgttcctaggcgcggcagctttgccccaggcggggcctcccggggccaccccatcccacacggtggcatgcagggcgggtttggaggccagagccgggggagcaggcccagcgatgcccgcttcactcgccgctactgagtacttggaatcctgtgtcctgtctcgtggcaacaaggctatgttctgttaggagttaccttaaactgtgtaaaaatatttttttttaatctgctgccatattgtagctcaatacaatgtgaatttgtttttcgttttggggttttttttttttgtaataaatgtgtttccgttcacataccctttatttaaagtgtcatttctttatttctgcctctttaaatgaaacgaaattagacttttagttgtattgatatacactgattgttcctttttttaattattattattatttttttttttttttgagatggagtctcgctccgccacccaggcctgagagtgcagtggcgcgatcttggctcactgcagcctccacctccagggttcaagtgattcttctgcctcagcctcccgagtagctgggactacaggcgcctgccaccacacccggctaatttttatatttttagtagagacggggtttcgccatattcgtcaggctggtcttgaactcctgacctcatgatctgcccgccttggcctcccaaagtggtaggattacaggcgtgaaccaccacgccaggccgactctgtttatttttaaatatgtgtgaaacctctgggaaggcatccgggtgtggaag

SEQ ID NO: 2728 - DNA, 1180 bp, Homo sapiens
ggtggttcacgcctgtaatcctaccactttgggaggccaaggcgggcagatcatgaggtcaggagttcaagaccagcctgacgaatatggcgaaaccccgtctctactaaaaatataaaaattagccgggtgtggtggcaggcgcctgtagtcccagctactcgggaggctgaggcagaagaatcacttgaaccctggaggtggaggctgcagtgagccaagatcgcgccactgcactctcaggcctgggtggcggagcgagactccatctcaaaaaaaaaaaaaaataataataataattaaaaaaaggaacaatcagtgtatatcaatacaactaaaagtctaatttcgtttcatttaaagaggcagaaataaagaaatgacactttaaataaagggtatgtgaacggaaacacatttattacaaaaaaaaaaaaccccaaaacgaaaaacaaattcacattgtattgagctacaatatggcagcagattaaaaaaaaatatttttacacagtttaaggtaactcctaacagaacatagccttgttgccacgagacaggacacaggattccaagtactcagtagcggcgagtgaagcgggcatcgctgggcctgctcccccggctctggcctccaaacccgccctgcatgccaccgtgtgggatggggtggccccgggaggccccgcctggggcaaagctgccgcgcctaggaacaaattcacattggtttgactgcgaagtcctcctgctccccggcccatcccagcctgcacagcttccctgagtgttgcctgcaggcagggccccttcctaatgccctcccctcctgagtggcagcagcctccacagtaccccatgcctggcctcacgtcacccttggggggaggggcactagctggaaggacttggttgttaagcctccagcaaggtaggccaatatgcaaagcagggggaaggggcgccgcccccagcatgccttaccctgacattcctcctcggttcatcatgtggccaggcccggagtgaccggacatgcttctctcgccacctggaagacagacgtgctttcacacagggaacttgcgcacacggcgtggaacccacggcacatttagcccactccactccctttggtgaggcccccaggtacccacaactagcgggtcccaggaagaca

SEQ ID NO: 2729 - DNA, 1140 bp, Homo sapiens
gggcttcccgaggtcgccaatcccctccctcctgcttcccagcgagcccttggcgttcagttcgcggtgtcagcctccgcctccgagcctcagttgtcttctctgtgaggtgggaatgccggtgaatcctgccgctggcgtggatgagaagtgaatgcgtgctcggagctgcgagtgacagcgggcaggaggcgcccagggacacttggtttctccagggctggaaggcttctagaaggtcaagatcttacgtcttcactgcccctgctcactgtgggactttgagtgacccactctccccctctgggtttcagttcatcagttcaagtggcgtccagccgccctgccttgcacgttgtaaaacgagtgctgtatataataggggtctgggtcgacggtgctgcactacagagtgtcaccctgtggacggtgagccctcaggagggtctcactctccccgtgggccttggcccctgagggtggctgtcagtgtccgctgagcttctgctcctcccgtccctgcccgcaggttcctcatcaagggaagtgtggctgggggcgccgtctacctggtgtacgaccaggagctgctggggcccagcgacaagagccaggcagccctacagaaggctggggaggtggtcccccccgccatgtaccagttcagccagtacgtgtgtcagcagacaggcctgcagataccccaggtactacgggccgggaacgaggccagggtttggcgggtggtcagctctgggaggtccctccagccctgcacgatgttgtcctccatattgatgctgacctgattctccggcctgtcctcctccctccgcctctggggatgggctgctgagccttttcaccagttctttctgcccatctctttttcccagctcccagcccctccaaagatttactttcccatccgtgactcctggaatgcaggtaaggcacccagtttctttgcttggagggagacaccccagtctagcccctctccccacttcctggccattcctttctgtccatcctccttcctgcccgacacgtgtctcttagggatctaaaagggaaaggaggccgagcacagtggctcacgcctgtaatcccagcactttgggaggctgaggtgggcgg

SEQ ID NO: 2730 - DNA, 2218 bp, Homo sapiens
atacagtttggtattattattcccgctctacaagtgaagaaattctgagaggtgatgtcgtcgatgcagggtcggcccgaaataggcggagttgggattcgaactcatttcacaggcagagggaggagagcagccatagccacctccactggttccgactccagctcccgggctcgcaggagtaaacgcgcatgctcagggagctcggtcgcgcatgctcagcgcaacggcggggaagactccagccgccagggggagcgcgtgccgttcttgcctctctggcctgcgcctcctgagccgagtagatatcccggagttccgcgcggcgccagcccttccgccacggccgtctctggagagcagcaggtaagtggtttcccgcactgccggtatccgccgccatccggactcccgggtcctctgtgcaggttggaggatggttggttgtggcgagcgaggctgaaggagccgggacgcggggctctgggcctcgggaactgagccggtactcacctccgccccttctccccgtcgctgtccgcagccatggccctacgctaccctatggccgtgggcctcaacaagggccacaaagtgaccaagaacgtgagcaagcccaggcacagccgacgccgcggggtgagtgcgggtgccgcgcggaggttgtcgggggtttcttggagggcggagggcatggcttgggcaaaggctctcgacctgaaagaacgcgcgttcgggcgcagaactaaggggggcttgaatggaagagatggggtgggggagtgggacttcctgcctggtgctcgaaggcgggcacccatctgggtttttcccaaccgtgcaatccacgctggggcagagggagcaccttgagagcggcgcggggcagcgggtttggggttctgacgcaggagtaggagttcgctcatggagctggcccgaggttgcggtgtgtgaggttgagggatttcaggtgtgtcagtgtattgggcgcctttattaagcgggcagcgggtttggggttctgacgcaggagtaaggagttcgctcatggagctggcccgaggttgcggtgtgtgaggttgagggatttcaggtgtgtcagtgtattgggcgcctttattcagcaggcagcccagactccaggtgcgtcctgccagtgttgcggagactgggacttagggaggatgggagctgctccgggcgcggcgaaaagcgctaggcgttaataccttggttctcacagctacccacagaggggaggaagtagccagggaaatcgcggcagcgcgagagaagctgcttaactagaatgcagggatccccctaccctgacggccgcccctttcccccctagcgtctgaccaaacacaccaagttcgtgcgggacatgattcgggaggtgtgtggctttgccccgtacgagcggcgcgccatggagttactgaaggtctccaaggacaaacgggccctcaaatttatcaagaaaagggtaggtgggcgctgccggccgaggggcggggtgggatgggagtcagggccgggctgacggcggcctcgtccctggcaggtggggacgcacatccgcgccaagaggaagcgggaggagctgagcaacgtactggccgccatgaggaaagctgctgccaagaaagactgagcccctcccctgccctctccctgaaataaagaacagcttgacagaagccctggctctcctgctgtccgtgggtgggtgtgggtgtgtcgggggcccgcagtcccctgtctggtgcccgctctgagccacaccctctccgggtgctgcctggtcgtgaatcaaaagccgtggcccgcccacccttcccggggcagcaggtgaggaagccgccgtactgcaaatgactttaatcattaaatagcttctatgccacactctgattaagccgactgaggtccctgggatctgggtcactggaccgagctgctcgctcggtggctccactgccaggtccgggcgcgctccccacagcgctcagttctggcccagacagggcctgacatccgccgcctgcagtcccggggtggccgtcaccgttccacggccagcgcctctgcctgctcgtccgggaaggcgatgtcgaagatctcccggtagtgttccacgaagtgcacctccaggccctcggtgatgaaggctgccaggtcgtagaagtccttcttgttctcggctggcagg

SEQ ID NO: 2731 - DNA, 1210 bp, Homo sapiens
acagaatggaacattttattggctgggtacagtgtctcatgcctgtcatcccaacacttttggaggccaaggaaggaggatcacttgagccctggagttcaaaaccagcctgggcaatattgagacccctgtctccacaaaaaaaataaaatccctgggcatggtcgcacacaccagtggtctaacctgtgggaggatcgcttgagcccaggagattgaggctgcagtgagctgtgatcgcatcactgcactccagcctgggcaacagagtgagaccctgtatctaaaaattaaaataaaaaaattcaggccgggcacggtgggctcacgcctgtaatcccagcactttgggaggccgaggtgggcggatcacctgaggtcaggagtttgagaccagcctgaccaacatggagaaaccccgtgtctactaaaaatacaaaaaaaaattagccaggtgtggtggcttatgcctgtaatcccagctactcgggattactgaggcgggagaattgcttgaacctgggaggcagaggttgcggtgagccgagattgcactattgcattccagcctgggcaacaagagcaaaactctgtctcaaaaaaaaaaaaaaaaaattcagacagccaccagcggctacactgtcctgggcagctcagcattggggcattccctgtgagaatcttgcaacagggggaagacagcgaccaaacttacaaatgtgattagaactggcaagaccccttaggggcagcgaacttgttctttttttttttttttttttttttttttgagatggagcctctgtcgcccaggctggagtgcagtggcgtgatctcggctcaccgcaagctccacctcccgggttcacaccattctcctgcctcagcctccccagtagctgggactacaggtgcccgccaccacacccggctaattttttgtgtattttttagtagagacggggtttcaccgtgttagccaggatggtctggatctcctgacctcgtgatccgcccgccttagcatcccaaagtgctggggttacaggcgtgagccactgtgcccagctgaacttattcttaaagcaagtgccccggacctccagtgggcctgttctggtgccttctaccagggtcagctcagacagttcagcgtcaaagccaaagactagagaccaggtgattacggtttctttggagacagagtctc

SEQ ID NO: 2732 - DNA, 1190 bp, Homo sapiens
acgacctgccccatggacggggcatggagggtgctgaggactccgagtagaccaggggattccctcctgcagcagaaccagcgggtgtatgagggtggggtcagagggacgacaggtcagcgcgtggggaggggcgggggcgtgaagccagatcctaagcggctctccaagcccgaatccagccgcggtgtccctgtccgacggggcgggcgcactcctgtctcctaaaacctccaagtgtgcatctgaggaacgcacggtgccctccccagaatccccttagcctctaggagggcgagacccagacagccctttagccatgtggtctccaaggggccgttggggggcttccggatcctgcagagcccgggcggggggctgccgtcgcggtccagctgcgcacagaagtaaacatctgtcagtggcgcgttccctgctcgccgccgccgccgccggggacacggtgtcctccggtgagggccgggccctctcggctcctggagcagcccgttcagccaccagagggcgtgaaaccctttggtgttgggggtgggggtcccttaagggcaaagcctggatgtgaagtggcgggaggctgtgcctgcctttcctgctttttataaaaggtgtctcctgcacggggatagccccgaattgtcccaggaggtggtttgtggattaggagttattaggcccaagggggctgcagacagattagtggggaggggggtgtgctggagagagaaatggctctcccagggtgaatgccaccactgtcccctccccagaacgcatccgacctgcccacaggcctgtgattacctgcagggctcgtcattggtccagatttggggagtggggccaggggcttaaagcaggggggtgcaggaggccggacccctgactttcctccctcttgcctgtctcccctgccctttccctgttctctacatccttgtccctgttccatggccctctttgtctgtctctgagtgccccgggctgaggaagcctgggtggggtgtgaccagcctcagaggatgtcagtgaggggcaggatcccacccacactgccagcttctcccacccccagcttcttgccttggggccctttggacacccctccctcctcccttcatcctaagactcccgaggttcatagctccggcaccgactccacccccagggag

SEQ ID NO: 2733 - DNA, 1217 bp, Homo sapiens
gtgacctcctggtagtgacctcctgatagtgagctgtgattgcacaactgcactccagcctgggtgacagagtgagaccctgtttctgaaaaaaaaaaaaaagagagaagaggccaggcgcagtggctcacgcctgtaatcccagcactttgggaggccaaggcaggaggatcacttgagcccaggagtttgagaccagcctggccaacatggcaaaaccccgtctccactaaaaatacaaaaataagctaggcattatggctcacgcctgtcatcccagctacttgggaggctgaggcaggagaatctcttaaacccgggaggcggagattgcagtgagccgagatggcactgctgtactccagcctgggcgacagaatgagattctgtctcaaaaaaaaaaaagaagaaagaaagaaaaagaatcccaacctgtcttgttgttcaggacatctgcaaagggagctgaccctgggatgtttggtttccaggggcaactcgaagtaccattactatgggattcgtctgaagccggactcaccactgaaccggctgcaggaggacacgcagtacatggccatgcggcagcagcccatgcaccagaagcccaggtgggtgccgggccgagctgggaggagctggctctcccctggagcatggaggggtgggtgtttctccaacacgaaacaaactcatcataactccccagtctccagcatcctgggaaagccaaggtatccccctctgctgagactgaggtgagtctagcaggagacacaggaggctgggatgcaacctcctccagctaacttttcagactttttttaaaaccgtttaaaactgtttttaacagacttcattttttagagccattctaggttcacagcaaaattgagtagaaagtacagagagttgttctacacccccagccccgctccccaccgcctctcccaccattcacctcccccacacagcggtgcattgctcatgacccgtgaccctccgcggagccagcatcaccccccagagtccacagtcaacatcagggctcactcttggtgttgtacattcgacagtttggacaaacctataatgacatgtgtcccccatcacagtgtcacgcagagtcctttcacagtcctacacatcctccatgttctgcctacccagctttccctccccaccccagtctgcagcaacctctaatccttctgcca

SEQ ID NO: 2734 - DNA, 1141 bp, Homo sapiens
gccaacaatactccaccatggggcgcttcctttcttctctggaaactaagacattggactgaaggaactggcctgaggggggctgaccgggggcccgtgctgctgggagctctacgcacaagaggccgccggggtcacggacaggaacctcagcccagggtgctggcctttctccttcgcaggagtcccccaaaatccacacagcgactcgagcagccttccactcagccagaggagggtcgggctcccccgcctgctctcggtggtggcgtctggcccttcctgccgtttccaaggcctccggaagcaccaacccagttctcagttacctcctctggccggaaggcctcacgttgtcctccagagctgctctgggcccagggctggctccgtgaccacctgatggacgtgctgggcagcatgggctcccaaggcagcatccccagctgctctcccaccccaccccagctgcccggcggctgggcccacgagggctctggggacacttccataggaaaggggcctggcactttgtgattgccacgtgtttcctgttaagccgcctgcccccagtgcaaatctctgtgttttgctctctcctgaacaaaaatgtaaaccgacgccggaaagcaaatggtatcgaatacctttcttgcccataagggtttttacaaagaacgtgtctcactaggaactaggacactcatcggcccgagaccaactcctggataaaaggaataaggagaatcgtgtttgtaacgagttacaggattgtttctttcctggattttaaacttttgttaaattgtgaaattatggaggagttttatagaaaaaaaaagtgaaataaagtcagatgggaaagcagacgcatgcatctgcctggttcctcctgtccagtcagtgggcaggcttgcgaggtagcctggggccccctgccccgactacgtgtcccagtgcccccagatcagtgaccaaaacagagaaggagggttgggaccaagcctggtgggggtggggagtgtgagcaaggctggagacgatgctaccagcaattcaagagggcagagaattcggctcacatcctgcttctgatgctgtgctctctacttggaagcagacagcaaggtttgggttgaga

SEQ ID NO: 2735 - DNA, 1850 bp, Homo sapiens
agtgtgggctgcgggggcccctggtgctgccccaggagcccctacctctgttagggaacagggcaaccccacccttggccccctgcccctgaagccacctgccaccaccttacagattgtgaatctgatcgaggagactggccacttcaatgtcaccaacaccaccttcgacttcgacctcttctccctggacgagaccaccgtgcgcaaactgcagagctgcctggaggccgtggccacatgaccctgggccgcgtgccgggcccccaccgccggggtcctgggaggctgcagccaggcctcgcctgccctcctctcccgtctcgcctgcccgcagcactgccttagcgacagccctgtcctcgcccgcacagcccgctgcactttcctcggcggctccctgcccactctccccgctccatcgccaggagccctggggccgggctgggccacacgggagccgccccccgggctctctgggctcccctcagagagcggctggtgttgaaggcagctctgggcagagacagggccgggggcccctcgcccagccttgggaccagcccccactgctcggcgggctgtgcggcgtcgctgccccagcctttctgagcagcggatcgacggctggggggcatctccagcctcccgaatggttcagaacacaccctccgcccaccctggacctcagaaggccctgcctgtgtgtctgcgtcgtcctccgtgtagacctagcgccggctcctccccggctcgcgctgcgctggggtctgtgctgtatagttctctctattatatatgtgtgtgcactgtctggtcaagagcagtgtccatgtgcgtttctgtggcagcagtgcacgtggggtgggtggggggtgcgtacggtggggcttgtaggttaagatgtctctgcggtggtgtggggctggaggccgagccaggcacggcagctggccctctccaggcgcatggaggaattctccctttgccgttccaaggatgccgccgcctcctaccggggctcccgggggggtcagccaacactacaaagggcagcgagtcctcagggcgcccgggagccaccagtctgctctcgggctctactcagactagcgccaacagtctccgcggacagactcgcatcagccgccctggggctcggcctcctcccataggctcctcttcctctctttcattcaagtcttcaaactttgaaaaaaatatgagcttttgccaaataagacgggatagtttatggagttttctgaggcgcattgaactctggtcagcccctcgagcgtgggctcggccatcagcaggcccggtgggttggccgggctggccctcccaggctgcctttctctctggtcgcggcctggcccgccccggcctccaccgccgcaattcatgctggtgccgcgcccgcagccccactcctggtatgcctgagattctccaggggccaagccggtcctccttcccggcccactcttccagggccaggacgctcccgcggagccagcccatcgtggctgggggtcccaggggctggaggcctgcctggttagcctctgtttcccagacattgactcgaggcgcctccagtcctctcaaccccctgactttcaagtcctttcaagtccttgtgccctgaccaagttatgaggaaaagagggctgagggcctggaggtgggctcgcaccccctcgaacccacctagatgtctcctcctccccagcctatgagttcagacttggggggctccatctgtccctccctgaggtccctcatcttgtccctgctctgattctgtcagcagatcctgaacactccttggtggggacccatgc

SEQ ID NO: 2736 - DNA, 1200 bp, Homo sapiens
gctgggcgaaggaggctgagatgaggggcagggctgcgtccagtgcccgccagcaccccgcagtgccagcgcagcctctgacttgcccaggcccagctgtgaggtgttagggcgggcgggtgcgggcgaagtggccatgctctgcctgactcaccctgtgctcttcttgaatccctcagggaatgtcagttcaattctgaggggaatcttagcctgcagctgccggggaccagctgacacttcctagtagtttaaagggacagctccatgtaaaactctcacctactgccttacctttttgctttatggaagagtttctctagctgaggctgaatcaggtggattatgctttgtaggggtcaggggtggcggagcagggcgccccgcaatgccacgtgaccttgtctctccccttgccctccctgctcttggccttgcaggacgccaacaaggagagcagcaagacctccaagccacacaaggtgaccaaggagcaccgggagcggccccgcaaagactccgagagcaagagctcctccaaggagctggagcgtgagcaggccaaaagctccaaggacacctcgcggaagctgggcgagggccggctgcccaaggaggagaaggcgccaccgcccaaggctgccttcaaggaacccaagatggccctgaaagagaccaagctggaaagcacgtcccccaagggtgggcccccacccccacccccacccccaccccgggcttccagcaagcggccggccaccgccgactcgccaaagcccagcgccaagaagcagaagaagagcagctcgaaggggtcccggagtgctccaggcacctcgccccgcacctcctcctcctcctccttctcggacaagaagccggccaaggacaagagcagcaccagaggggagaaggtgaaggccgagagtgagccccgggaggccaaaaaggccctggaggtggaggagtccaactcagaggacgaggcctccttcaagtccgaggtgagtgagtgctgggggcagggcagccaggtgcaggcagtgtggtgggacccgcctcccttctggaacagcggaaggaggtgggatctgagccaggacctcaggtctcaccagctgctcctcccactggcttcttgtaacctggggcctccacgcctcactaggcttcggtttccctgtctgtcaggtgataaag

SEQ ID NO: 2737 - DNA, 2229 bp, Homo sapiens
caggggcagccctcacccacagcctctcacctgcctttgtccacccacagcgcaagtggccaccggagggggtccaggagctcccccaggctcccagccagactacagtgccgcctgggcggaatattacagacagcaggccgcttactacggacagaccccaggtcctggcggcccccagccgccgcccacgcagcagggacagcagcaggcaagtgggaattgccaccctcctcctcctcctttctccttccaacccccggccaccgtccatcctgccttagtgggtagcgccggaaaccccttcccctgcggggtgtgcccttgatgcctgcagcgggggccgtgtggccggaggtctccgggagtccccacgcaccgccagggaagcattcgctgggtccagaggttaaacgaagaggcctccctgcgccggctgcttgttcctgtgtgccgctgtcgtgatgctggggagcgctgagactcgcaggcgggacttctgaactgctggggagtcggggggcaggcagacagcgcggacggtgggcaccggcccggccgccaccacctcgctcacaatctggccacttgggaagaaaacgtctattttttccccttctctgcatcacttttttggtttttgttctttttattcttttattttttaaacccatgatcttttttcctgtgtccaagtgactgtgttgcaggcggcctggctctggcagggactggtggggacgcggggagcggcccaggcccctgccccgccgggctcagcctcccatgcgctcgcgcttgcctgtgtcccgggcttgtctgtgaagtgggcgtgaagatcgttgccaccttccaacctacctcacaggggtgttgtggggacaccatgatctctggattgttcatgtcgtcgtgctgcgccgggagccaccgccctccggagacagggcagctcccctacgaccctagcgcctccgccctccgcggcccctctcctctcttcctgctctgtccctccttctccatcagggagcagcgtgacttcagcgagtcccgcgagcacctggctagacagttaacaagcacgtccttccagcctgagccagcgcaggtttgggagggggcttcctggccccccccacggtgttccagcccctcctctcttccgccccctagtctcccacccttccctccccgtagtgaccaattcctatctcttccctctccgcaggctcaatgaatcgaatgaatgtgaacttcttcatctgtgaaaaatcttttttttttccattttgttctgtttgggggcttctgttttgtttggcgagagagcgatggctgccgtggggagtactggggagccctcgcggcaagcagggtgggggggacttgggggcatgccgggccctcactctctcgcctgttctgtgtctcacatgctttttctttcaaaattgggatccttccatgttgagccagccagagaagatagcgagatctaaatctctgccaaaaaaaaaaaaaaacttaaaaattaaaaacacaaagagcaaagcagaacttataaaattatatatatatatattaaaaagtctctattcttcaccccccagccttcctgaacctgcctctctgaggataaagcaattcattttctcccaccctcggccctcttgtttttaaaataaacttttaaaaaggaaaaaaaaaagtcactcttgctatttcttttttttagttagaggtggaacattccttggaccaggtgttgtattgcaggaccccttcccccagcagccaagccccctcttctctccctcccgccctggctcagctcccgcggccccgcccgtcccccctcccaggactggtctgttgtcttttcatctgttcaagaggagattgaaactgaaaacaaaatgagaacaacaaaaaaaattgtatggcagtttttactttttatcgctcgtttttaacttcacaaataaatgataacaaaacctccccgtctgcgggtgctgtctgtctccccccctttccttccctccctgtagttttgaagcggatgtttgttctttatagatgttgtttaaaaagcctgataatggtgattgaaatttacaaactttgtgtttttttttttttaagaaaaatataaaatagttttcttcaggctcaatgtgctttcctaaccgtgccccccccccttttttttttttgttaaataaa

SEQ ID NO: 2738 - DNA, 1263 bp, Homo sapiens
aactcctgggctcaagcaatcctcccatcttggcctcctgagtagctgggactacaggcacatgcccggccaatttttgtagagaggggatcttgctatgttgcccaggctggtcttgaactcctggccccaagggattctcccacttgggcctcccaaagtgctgggactacagatgtgaggcatcacatctagcctggagggatctttatgtggcagatacttgaataggatcctttagtgggatttggcagatcctttggtgggatttagtaggatattgggatcttctaaggaggctgctaggttagatgctttggtgacacctggtaggacccaacaggactcttctggggtctccaagcaagagtcattggcagactctagggtatcctaggattcatagaggagactcccctatttaggactgagtcacatctccctgtccccaccatggcatgacacccccaacacctgtatctttaggtcctggacattggcgagtgcctgacagtgccggacgagttctcaaagcaagagaagctgacgggcatgtggtggaaacagctggtggccggcgcagtggcaggtgccgtgtcacggacaggcacggcccctctggaccgcctcaaggtcttcatgcaggtgaggggctctggagagacctgccccctcccccaggcctgacacctgggaggggacctccaagctgttgtctccccattcaggtccatgcctcaaagaccaaccggctgaacatccttggggggcttcgaagcatggtccttgagggaggcatccgctccctgtggcgcggcaatggtattaatgtactcaagattgcccccgagtcagctatcaagttcatggcctatgaacaggtgagggcaggtacagggaggaatgtgcttgccatagggaagactgggctgtacataaagatttacgggattggcttgggggtgggtggtgaacacaggtccccaggatcaggcatctgctcctctgcatgaatgcctgcagcaagccagttctttggaagccaggagaacagtggagtgcaaggaaggttcaacccccatggtcctacccatccctgtgtctccccgcctcagatcaagagggccatcctggggcagcaggagacactgcatgtgcaggagcgcttcgtggctggctccctggctggtgccacagcccaaaccatcatttaccctatggaggtgagaaggagggaccccagcggaggccccatggcagggt

SEQ ID NO: 2739 - DNA, 1219 bp, Homo sapiens
gaggaggaggcggaggaggaggtggcctaggctgctcccatcgcttcccacctgtcccctcgaggcttctgacctttgatccgctaggccccccatctctgaaccctagagccccgctttccctccaaggctgactccccgctgaccctaacaatacctttggagctcgctttacctctggctacttcatctccgaccctggctcccctttgagccctaatttatctttaacccccttgagctcttccaaccttgacattcccaggaggagccccgcttcaccccttctgactctggaaaccgcacctttaactttgcagaccttccttcacccctgacttctgcttcacctttgacctctgccccccatgaatcccattttacctctagacctataagttctggtttatgtttgacccctccctctgagctgcacttcaccgctgaccttgcctcacctttaaccccccacctgagccccagctcctacctctgaccccaacttctctttgatctctgaatcccctctgactccaacttctctttcaccctctatgagtcccattttacttctacacctgcaagtcctggtttatattggacccctccctccgagctgcagttcacctttgaccttgcctcacctttcaccccccaccccccacagcgtcagctcctacctctgaccccagcttctctctgattcccacaggccccatgcatcctccctgcctcactcccctcagcccctgccgaccttagcttatctgggagagaaacaaggcctggtgcctgtgaggaagagaggtcacccctaccctccctccccgcttccctgcctcaccctcaataaataaattaattgttgtcatggatgtttctgccgaatccctctttcctctcttacagcaagtgcgggcttttctctacaggatggaggagggtaccgatgacatctcatctctggatggggggcgtgctggggagggatcagacgggccaggctaggccacccactaaccctgaggttttgactaagccatttgccttctctcagcctcggtcttcccacctgtaaaatgggatcgtatgttttcccccaggatccccccacaactgttataggaatggggtcccaatccagaccccaagagagggttcttggatctcaagaaagaattcagggcaagtccataaagtaaaagcacgtttattaaga

SEQ ID NO: 2740 - DNA, 1170 bp, Homo sapiens
gcgtgaatccaccgtttcttctctttgcaaaaagaaccaccacagctgctcaaagaacacagtgaactcatcactttggttcatcaaaaaatcatcgcccatgcgttattcctgagtgcattttcttacaactttttgactgcttccttttcttcttctcttaagagttgtgggcttaagaatgggatagagtcataatggcaacctccaagccctctcaattcttgattaagaacacaggtagacatgaatcccaattgtctattgctatcttatttatatgattcgggaaaatacagcatgtaaaaatattgctgaggagcctcagtgattgggtacaagaagcaagagtacagaaattatttttgccaaatttattttgtaaatatgagggtctgtacctaaatttaaaaaaaaaacacgtagaactaggtattttgttctcttcttagtaaatttgtagtggttgtatactacactagctgcaattttcacatttttctaattcagaaaggtttttcttatattaggggaaaaagtatttattttaatatataaaatcactctgaaaatcactctcataaaaaatggagcgcatgtaaatttttatcaaagaaaaataaacaggtgaatgggggatagtgattttcttttttcagcacagtctacctcagtgtattgttaagatgtgattcaatcatggacatctttgagatttcagaattctacctggaaccggtctgaatcagggaacgtgtgtatcagctgattcgaatgccagggaccagtaagaattttgagggagggagttgggatggagaaggtatggcctttatgcgagcatagatccttttcttcctggctggtaatattcttctctgaatttaatcttcctttaaaaaaaaatcctccatctattgtcactatgttccccaaacataaactaagttccaggctgtcatgatgtatctgatatatggggtaacccagcaaggtgtaccttcctttggtgagagatggctgccggggcaaagacgggctttgattcagagcaagcattcccacctgttccatggaatccccctgaagtgagcacaaaggtgccctgggctccctgatggtttatgcccactcctttcaggctggtgatgcaccttacacacaaacacc

SEQ ID NO: 2741 - DNA, 1217 bp, Homo sapiens
tcacagaactcatttcatgagtgttttcgagggggtttgggtgagggcttgggtggaaggtggctgcagacccccaagggatcctccaaggatgctgtgtagataagtaagaagtagtgtttccatgctctgtgtacgtgccggacgagtgggaggtgtctcgagagaagatcaccctccttcgagagctggggcagggctccttcggcatggtgtatgagggcaatgccagggacatcatcaagggtgaggcagagacccgcgtggcggtgaagacggtcaacgagtcagccagtctccgagagcggattgagttcctcaatgaggcctcggtcatgaagggcttcacctgccatcacgtggtgagtccagtgggggtgggacatgggctggctttcctgacccttccctttctctgcctcctcctcctgcacagagcgacagaggacacagggtgtaacctcctacccacccctcactccactaagcttcccatcctagaggtgtgaggagggatcattcccttctcaaatcccatcctctcccacttcgcctggaaccagactctatcactgtctcatcactttctggaatgtttcattgctttccagaatctttcatcactttctggaatcttccatcattttctggaatcttccaccactttccggaatcttccatcattttccacaatcttccattgctttttagactcttccatttcttgctttttcctggcacctttgtaacccaggaccacatagaggtccacctgataccacctgccctcgttcctactctcctttgaaggcagcaccaactcttcctgcctttctgctcctttgttcctctttgagtcctatgtgctttcatccttgccacacatatttatggggcatttaaagccctgctcttgtccctgtgatacagtggatacctgcccctgtagagcttccaaaacagcaggcggagacagactccaaaacctttatttttattttatttcatatatatatatatatatatatatatatatatatatatatatatatatattttttttttttttttttttttttttttttttttttttttttttttttcctgaaacggagtctcgctttgttgtgcaggctggagtgcagtggcacaatctcagctcactgcaagctccacctcctggattcacactattctcctgcctcagcctcccgagt

SEQ ID NO: 2742 - DNA, 2067 bp, Homo sapiens
gtggggtgggctgagccggagcccgggccgccgccgccgccgccggggagaggccgaacgcgcagccggcgcgggtccctgagagagcgcggccgccgggcggtcggtccccgtccgggtcgaagccagggtgaggggcgcgccggggcgggggcggtgggggagggggtcccaggccgccgagaacaaagggagcgggggcaggggccgcggggaccgtccccacgccgcgcgcccgggccgcggccgcgctttcgcacctgttgtgtgcggcccaggccgggcgcggctccgtttcccggctctcagcgcccccacctgcgcgcacggccagagttgggtccccgcgtggtggtggcggcgatccggcgggccgggcatgggcgtagcccggggaccgaggcgcgggcgggggatggggtcgggcacgttaagggaggcggcggcggcggcggcaggagggggcgaagcggaggaggcgcgggagggagggcgcagcctcatccccggcgcccggggcgggtcccctcctccgcagggcgcgcggcgatgtgagccatgagcgcgacgtggacgctgtcgccggagcccctgccgccgtcgacggggcccccggtgggcgcgggcctggacgcggagcagcgcacggtgttcgccttcgtgctctgcctgctcgtggtgctggtgctgttgatggtgcgctgcgtgcgcatcctgctcgacccctacagccgcatgcccgcctcgtcctggaccgaccacaaggaggcgctcgagcgcgggcagttcgactacgcgttggtgtgaggggcgcggcgccccctagccggccctgcgccggggtctcagagggccggcccggcggggggcgccgcggggccaggactgcgctcaggatcccgccccggagcccccagcccgggggagagggggagggagttgggagaagcccagcccctccccctcgagacccctcccatgtcccttcctggcctggccggagccccacctcgtgcctttatccgccctgtcccttcctctctgcgcatctcacccgcccggctggcccccacccccgactctgaatcccgggcgggaggaggacccccgcaccgccccctccccagcgtgtaagtggctctgctattgtgcgtccctggaagtggggacccccttgtccctcctccctcccctgttgtctggccgtcgtcaaccccaccttgactgagtgttgagcccgtccttgggctctggtccctgcggggcaggctctcccgggcccacggggcggacgctgcataccaatttgccctgcaccgcctgtcccggagacggagcccgaaggcctgccatggcggctgtgtcgaggatgcgtggcgcctgccgtggcgggacagcgtgggcaggctcatttctgcccccaacccgggccccaggacaggtcagcgcgccctgccccggtgcccaccgctgccccccatccgccctcctgccacttgcccctgacccccctgccgtgcctcccgcagccctcccatgccgttccactcctccctgcctctgagccgaacatgataataaaagctattattgagcgcttactgcatgccaagtagcgtgctgagttggcacctcctgtttatagcctgtctcctcttcgggatcgtgagaatgagccaggccctgttagcatccctattctacaggccaggagaccgagggccaggcagctccagtgactgacttgcccacagtcacatggctagagtctggtagggctggaagtggaacccaggtctggcttttgcatgtttttaaagcttcccagggctgcaaagacaccaagatcacaagcacctttcaccggctttgggggggggggctgatgtgtaacccccagctgcctcccctccacacacaattctgttgatctggggaggcgccgggggtggtgagagagactcagccctgtggggaactgggaggcgcaccctctgccagccctggagggaggctccgacgaccgaccgtacctgcagcctaagcctcctccccctgcccaccacc

SEQ ID NO: 2743 - DNA, 1149 bp, Homo sapiens
tccaagaggtcttgggcttgtccaaggggagggtctcgagggaggcctggtcctggcctgagaggcaaggcccacggggagggaccggtgctgggcctggtgctggagccttctcctagcagggcctaggcgcaggggtttcacctccaggggagcagccgggctgtcctctgaggcacatcccccctctcggcccctctgcagctggccatgggcaagatgatggagcaggggccggtgctgatcatcaccttccaggcacagctggtgatggtggtcaggaaccccaaaggcgaggtggtggagggtgacccggtgagtgagggagtgggatggggcaggcacatgacaccgcctgtccccaagatctgtgtgtggccacctggcagagaccccagctcagagccctgaagctctgggactgggtggggatgtggagaaacctctgggccagagtttggggttgagggaggtcggagaccagcagacctgtctgtttttaccaaggctgagtggttcctgagtctaggcaattgtgctggcctctgctcccagcccctggggaagttgccggtggctcctgccccacagagcctggcccccccccagagctgcctgggtcacctcaaccctctcaacagtgcccttcccaccccaccctgcaggacaaggtgctgcggatgctgtacgtgtgggcgctctgccgagaccaggacgagctcaacccctacgcggcctggcggctcctggacatctcggcctccagcaccgagcagattctctgagtgtggtgccggagccaggtagccccggcctgggtcatcaggcacagaggcaccgcaacaccacctgcggcaactccagacctctgggaacaagactgcgggctctgcccccagctctgccaggacggctgcaagaccagctggcccgggaggggacaacgggctgttgcgggtgcgcggcagctggagacactcccccgcagggccaacccctgccctgttgctctgccctgcaggggtcccggcgcctggtcacctggggtgcacacaggtcacacagtgccaagaggccccagggcccagggactccccccacagcagggtgggacccgggacccgcggctcagtggcccgctagccacgt

SEQ ID NO: 2744 - DNA, 1096 bp, Homo sapiens
agcttgcaagcttgtggaaggatttagcttaacaactgtcactcctgaaaagcaatctctgttccatcaaggttctagttgctggccctgtgtcctcaaagttcattacatcttatcaaggcctgtttgcaaaggggagatcccttttcttaaaaaaggctcaacccaaaagaaaccatttcttaaaaaattttacatagatcagttgtatttctatttagcaaaaatgagtgctctgcttttatttgggaatttcgatgaaaaagcgttcagagtagataatgttcatttatcaaaaatctggtttgggaaataccaaagaggctttgattgaattcccttttgacccgtgtgtaacttcctctggtagttagaccccaggcagctccgaatttgtgaacctgcttcctgatgaattctcccttgttcccccttggctctgccattatttcgttttcagtgtaatttgccaagccgcagttttctgtgctggctgtgcctctagtcgcagctctgtgactgattccctcccgggtgctgagtcccctccccggccaccatcctgcgtgaatatcctgaaattcatgggcttcctcgggggcccgcccgcaggtggtgctgggtgggttccgccaccttctcctggaaggtgagccttttcctggccaagggcagctgccttaacctctgagagtctgcgcttggccttagtcctggagacccagcctccagggactgaaccgtgctgctgttgggagccaagaccggccctttggagccggcagcccaggggtccctgctggatcagagaaatagaagcacccgaagacggttagtggcaattccttgacccggtttgcttccaaatgaaggccatttgtccaccaggcattgaaaagacatgacttacccagtccggcatcggacttgaaaaatcgaaattgacatcactcagctgttacatttcacatccgattcagcccccttttatttccatgtgcttttcgcagccttcctgtgttggatgaaagagaataagaattcagctgacaggaggcctctatcctgtccctccaccccaccctccacctcaatc

SEQ ID NO: 2745 - DNA, 1293 bp, Homo sapiens
ctgggtagcaaaaaaatcaccttttagttttagtttttaatctaaagatgttagacagatgctgagtgtgcgttttctcaaccgcttcaacattgtaagcgatgtatgctttggttgacaggaagttccttttccaggcaggtcccgttgccacctcctgctcactcagtcccgggctctgccgagtggtcctgggaatggcggcgggcccgtccagcgtgggccaccactggggccgggggccacgggctgcatgctgggcgggccctccagagaaggacacaaacgtgtttcgtaagcccaggcaccaatgggaatggaccaaagagtttcagggaaactccagtatattccagagtcagatctaagctccaggcacgcctgaagatgtgttgctactctgacatcccgagtttctgtccacacattgcatgcacagcgccccacacattggatactgttgttcacgataatttctcccgttttccagagcatttaacatagcttggaggcgtaaaatggctctgtattttaataacacagaaacatttgagcattgtatttctcgcatcccttctcgtgagcgcttagacctttttctattttagtcggattttgttttggaattttgcttttgtatgaacactcagcagaaaagtacttacttcttgccagttatctattaaccaaaacctttgatttgtagttttaaagattaaccctcaaagttctcttcataactgccttgacattttgggttgttctgttctgttaattttcttttgcttttttgtgttttttgtttgtttttacttttgcatttaagaccattaaatttgattttgttttgctcgaattttgttttgttttttattttaccttttctttctttttggctagggaaggtgcaggtggcccagcattcagggaggagtcgtaagatcttaagaaaccaatccttgcctcaagcaaaagcatttctgaatctgtgacgcaagaatgtgcagttacaggctggtggcttttaaaccaggagcccggaggaagggtgaaagagaaagcctgtgaaataggcagggccagatcacccaaaactcctcaggactgggatctggcgtttataaataactagtttacagagagaatcacaaacaggataacttagtaccagcagtttttaaccttgacgtgagactaaaacgtgaccgtaggctgttttttagttattgctctcatgagatgatggctgtatttatctgtttatttatacctatttatgtatttatttattga

SEQ ID NO: 2746 - DNA, 1181 bp, Homo sapiens
atcctctggcccctccctgctgtccctctgtggccggctcgttccagccctcccagtgagctctgcacggccgggccggggcccaggaaggacaggagccagtgctaccccgtcctgcccggggaaaagctagaagccccggtttgctgcacccatgaaactcgggtccccacagcgtcttggcggggtggggagggcggcaggatggacggggctggccagaggcgaggaggacgggcggacggcgccgccttctccccttttccttggccgactctagggagcgattgcctccctccctccgtgaccgggtggcccagccagcccgtcgtccccacccagaaccgtgctctgggccaaagcccgaagaaccaggcagcgggggccggggcaggcggaccccccgggctctcagcgcccacccgctcctccgcacacagcagctcgcacaggcctcccacctctgcctgttgattgatgcagggagaagcccgtccccccctctcccctctcccctcccctctcctgcacgcaacgcgccctctcggccctccctgtccccctcctctgtctcgtctccccatctggtctggaacctgtttgcaagtgaagcaatatctccgtgttttgtatatacaaccgctcttgtagcctttggtttttgttaatgtagagaaacacagattctttatacactttgtaagatttacgccaaaccccagctctcgatctcttcttctccctgtggcccctgcgctgttgccccgtccccgtcaccccgcccgttactgaaatgtataatctgacttcctgtacagaaacctgccgctgcgcctctgtcttctttcttttccgccaggcgccagctcctaggctgaggcccctctcgctgcacgttccccaatgcaggccagaccccccgtctccccagcccaccccacaggaagcgagaggaccccagcacctgccaagggcagcgtggaagtcagccagcgcagttggggtgggccctggtcaagctgcccctgtggcagggagggatggaaggctgccgcttgtccttgactttaaactcctgggtcctaggacctcaggcctgcgggcgtcccctgatggggatgggagccaagagcagtggccagggttcatcactttgtctcctgccagggcctcccctcccc

SEQ ID NO: 2747 - DNA, 1099 bp, Homo sapiens
ctgcgccttcttttttgaacttcctgaagcgtaaaggcgtgcattgaatccgccaggaaggcttttcatggggcaggggcaggctctgttagcagaagaatggcagtgtggctgagggggccgtagtcattggttctcgccattgtattctgagcctttgtgctctaggcttcagggcctctcctttttgactctgtccaccaaaatctaacaaaatcgggactgagtgtcgtctcttcttccctccctgtcctaggccacgtgctgtacgccgacatcaagatggagaatgggaagtccaaggggtgtggcgtggttaagttcgagtcgccagaggtggccgagagagcctgccggatgatgaatggcatgaagctgagtggccgagagattgacgttcgaattgatagaaacgcttaagcagttgccttttttaaacatcgatacgagacctctgaatttgtattttttcttgttaaccattttaatttgttggctggatgtataaagatgtttaaaaaattcagttgctttttggggtaatttgaattacttttttaatgactggggttccatttgactgtttgcattgagattgcaatgtgcgcaattttttttgtagttgtggcatcttgttgacatcgaatatgactttgataataaataccggttcctgaaaacggcctgcttgtgtgtgctgtgtgggcaaccacgcgaggtgtggggagctggggtcactcgagcttccagtccaagcagcagggatctcatcccctctcttgcttgtctgaggccccaggggtgggtgcctgcccacagatggggggagactcttccctggaaactgccttcctgtgggctgtaatcccccggcttacaatggagcgtttggctgtttagagccttctgaggccaggcgcggtggttcatggctgtagtcccagctactcaggaggctgaggcaggagaatcactcgaacccaggaggcggaggttgcagtgagtgagatcgcgccactgcactccagcctgggcaacagagcaagactccgtctcaaaaaaaaaaaaaaaaaagccccccgaaagccatcctgtctcc

SEQ ID NO: 2748 - DNA, 1177 bp, Homo sapiens
taaaaatacccccccccctcgcaaaaaattagccaagtgtggtggcaggtgcctgtaatcccagctacttgggaggctcaggcaggagaatcgctttaacccaggaggcggaggttgcagtgagcctagactgcgtcattgcactccatcctgggcaacaagagcaaaactccgtctcaaaaacaaacaaacaaacaaaaaaacccagggaactcatctcagtgatggtattctttgcagtcatacctgtcctatgaaggagaataccaacagagcttttcaaggattacgacactcccgccactactctcttaataacctttgtgaagagagtgtcttctgctctgtcaacaaagggcgggggagtgggctatacagatgacacatagtaaatccagtgcaacactcctgtctctctaggattccctccttcacattatgccagggaagctctggcatatgagcctcattaattataacaatttcagccctgagaacataagaaataactttatttcaggggtgtcctaaagaagctctctgattcttttgtttttggatggaatcttgctctgttgcccagcctggagtgcagtggcatgatctcggctcactgcagcctctgcttcctgagtaaaagcgattctcctgcctcagcctcctgagtggttgggactacaggcacgtgccaccacgccctgctaatttttgtattgcttgaactagggtgggcggcggcagaggttgtagtgagcgaagattgtgccactacactccagcctgggggacagagcaaaaatctctcaaaaagaaaaaaaagagagagagagagagatgtaatactacccatgatataagaaaagctacaaaagacacaatattcgagcttttgacgatatcgtaaaaaaaaaaaaaaaaaaaaagatctcggccaggcgtggtggctcacacctgcaatcccagcactttgggaggctgaggtgggcggatcacctgaggtcgggagttcaagacaagcctggccaatgtggtgaaaccctgtctctataaaaatacaaaaaaattagccagacctgatggtgggtgcctgtaaccccagctgctcacgaggctgaggcaggagaatcacttgaacctgggaggtggaggttgcagtgagttgagacagtgccattgc

SEQ ID NO: 2749 - DNA, 1175 bp, Homo sapiens
gaagtgacgtcagtgtgccaccgccatctttaccggctgtggctcagcatggtcagtgccgtttaacctttattgtggtggagtccaccccgctgtggtgagttctacctgcttgggggtccgggacataccagcggggcggcaaaggaaggattgggcgtggtcgcccaggagcctctcagatccgcctagtttcactcgcttttctaggggctgtcagtcctcctggtgcggcctctggccagttccgagaggccgcacagtccgtctggctgcgtcgggaagtgtgtttgttccgcctccgccgggtgttttcttgagtactttcatccgctgtgctcctctcttgaaaagcttggaaagcaacctttgggagtttttttctttccgaaaggaaaaggatttctgcccttctggtgaggttggctctggccccgcattctcccgcgtctggaacctatctcttccggcatgttcctggtgagcaacggcggaaaaatggtttcaagagggctgtgacttccatttatttgctaaaaaatgtctcatctgagaatctggcgttgtcttgatgtcctttactttttttttttttttgatttggagtcttactctgtcgcccacgctggagtgcagtggcacgatgttggctcactgcaactttcacctcccgggttcaagtgattgttagatatgagttttaaatttctttttaaaaaatcaatatgtcagtatgtttaattctttgccttctacttttaaacttctccgtaaagcaacctttttcgatcacctgctccaccctgactcattctgattacctgctccacccagacttatttcgattacttactccaccctgactcattttccaccctgactcattccaatttcctgctctgttataaccattttccccaacaaaccactcaccctgtcactctctttaaattagccaattggaattagtttagcctgtggggtctaaccctagccatcggggaaggacaaagcggcaggggccactttcctcaagaataagaaccccttcccctcccttgtcctggtgtgtgctcaccattgctccatctgtgagggcacacccttctgtagaagtaaattgccttgctgagaaaagaaaatgttatatttgagtgctttttttttgtggcatg

SEQ ID NO: 2750 - DNA, 1176 bp, Homo sapiens
gccgggtagagaggggggcctcggcgggtttgtggccagggaaggggcgtggagcgagagtcagaggtcaggcgccggcgcccagctcgtttgaagtcattgtttgttgcagggagactcggtcacatggtggggacgccagagggtcccgggagtaggggtaagctcctgatcctgagcccgaagcctcttgcagcggcaactaggagcaagggcggagggtgggggtgggggacgagttctgcagtcatcccttctgaccccctgggttcattcagggctgggcttggtgagcatttggctcacctcttccctctggccatcgcgttcccccgggatacggactccagtcagtaggcgaagcttgatcctagagtagactctacgctgcccaacagctgctgttaccgcatggtgccggacagttccaggctcttggtgtcctgaagaaagatttggaccagacacacagagatggcaaagctgcaagtttattaagcacagtattccactctcggagtggggagagcggactgacctctgcgagataagatcagccccagcttggtatagtttgggtctttttttttttttttttctgagacgtagtctcgctctgttgcacaggctggagtgcaatggcgcggtgccggctcaccgcaacctccgccttccgggttcaagcgattctcctgcctcagcctcccgagtaagtagctgggattacaggcgcccgccaccacgcccggctaatttttgtacttttagtagagatggggtttcaccttattggccaggctttttttctcttcccaaggctgcctaatatctagccagtgtctacctttttgaatgataggtgtgttgcttactttggcccctgtgtgcttgagagccgcctccattcatgatatgccgtccatatgcatgagcgctaatgagctggttatccttatcatgttaaggatactttttgtctttaatgcgcgtgcttatgcctaaagagctgctccttactggtttggtcctgatttccccggccgtgggatttttactgttttttttttaattttatttatttatttatttatttatttatggagtctcgctctgtcgcccaggctggagtgcagtggcgtgatctgggctcacggcaagctccgcctcccgggttca

SEQ ID NO: 2751 - DNA, 1156 bp, Homo sapiens
tcgcctactgactggagtccgtatcccgggggaacgcgatggccagagggaagaggtgagccaaatgctcaccaagcccagccctgaatgaacccagggggtcagaagggatgactgcagaactcgtcccccacccccaccctccgcccttgctcctagttgccgctgcaagaggcttcgggctcaggatcaggagcttacccctactcccgggaccctctggcgtccccaccatgtgaccgagtctccctgcaacaaacaatgacttcaaacgagctgggcgccggcgcctgacctctgactctcgctccacgccccttccctggccacaaacccgccgaggcccccctctctacccggcgcgcctaccacaggcgcgacacctgtcaagccttgggacaccgaaaccgtacctgggaacagcaaacacaccacagactgcagacccggaagaacttgtcccagtgttgaccacaccccctggctaggggcagggcttccggcctcgaactttaacttccgcttccggttcctagcgttaactgcgaccggggttcagcgctcgggtgaggagctggtggcgtcggcaggttcgaggcgattcgaggtgagggggtcaagcggagaggctcggagtcggagaaagctgtcgcgacccagccacccagggtctggggtcggtgggaggtgaggccagggagttttgtggcagggctttcaggcggcgagaaggggcggaggcgcggctccccggggttcgcggccctgggacaggggacttggggcctgggagtattcgagtccggggggttgggggcagaacggaaggctcagtaacctggaattttagggcctgggactgggagacttgtaggctggggcttctgggcctgggagacgcctgaagctctgactttgctgcctcccacccaccccccgctttgtgtagctccagctaggatgatcgaggttgtttgcaacgaccgtctggggaagaaggtccgcgttaaatgcaagtatccactggcagccgagaggcagtggtacccgcaggggtgcttggcgtgaggcaggcaactcaatctgtgttgtcggatggttttagttaaacccgggagagggggcggatggggtcctggcagatggtattctgccc

SEQ ID NO: 2752 - DNA, 1099 bp, Homo sapiens
gatggtaaatattttaggttttgtgggccatgcagtctctatcagctctgctttgtaactggatagcactcataactaatatgtaagcaagcacatggtcatggctgtgtgccaagaaaactttactatttacaaaatctgggaggatttggcctgcaggccatcatttgcagagccctgtctaaagctgtccagtttggctgccactcccaccctgtgcgggaggatcacttgagcccaggagtttgagaccagcttgggcaacatagcaaaaccccgtctctaaaaaaataaaaaaattagctggacatggtggtgcacgcctgtagtgtcagctacttagaagactgaggtgggaggatcctttgagcccaggaggcagaggttgtaatgagccgagatcacactaccgcactccagcctgggtgacagagcaagaccctgtctcaaaaataaataagataatatcaaaaattggtttctcaattgcactggtcatactttagctggtggctgccatctttgacagcgggaatataaaacatttacattcttggccgggcgcggtggctcacgtctgtaattccagcactttgggaggccaaggtgggtggatcacgaagtcaggagatcgagaccatcctggctaacacggtgaaaccctgtctttactgaaaatccaaaaaaattagtctggcatggtggcgggcacctgtagtcccagctactcgggagataggcaggagaatggcatgaacccgggaggtggagcttgcagtgagctgagatcgtgccactgcactccagcctcggcaacagagcgagactccgtctcaaaaaaacaaaaacaaaaacaaaaaaaaacacttttccattcttgcagtaagttgtgtctgatgcctttctcagagtccccaaacctgggctgtccctactccaaacaacccatctctcaaccatgcccagacagcctgggttgctatgcagctctgccacgtcctggctatgtgctcttgagcaagttacttaacatctctgggcttcaatctttttctccttcttcttttgagacagggtcttgctctgtcacccaggctgg

SEQ ID NO: 2753 - DNA, 1198 bp, Homo sapiens
tccttgagcccaggaaattaaggctgtagtgaatcgggatcgtgccacttcactccagtctgggcgaccggaggagaccgtgttagaaaaaaaaagactagaatctggaggcagcaaagcagggttggaaactgacttctccccagtatctgatgcaagttacttaacctctctgggcctgagttcgctcatttgtcaatgggaagatgcgctgtgagcaagagacagagttagaactcaaatctgcgtccgactgactctaaaggctaagatccttttgctcctctgggcttgttgaaagggtcagatgcaagacagaccataacaggatctgcaccgtcagcttatagttgtcacaacaagggataagctatgttttctttttttctttttgtcatttccaggttcgtaagaagaactcgctgaaggactgcgtggcagtggctgggcccctcggggtcacacactttctgatcctgagcaaaacagagaccaatgtctactttgtgagtagacgccctcacccttcatctcccccagacccccccttcccctatctctcatgatgaacacatatgcctctgagctgctgtgatttctggcttcaaagtaaacgctctgaagaagagatggggcaaaggtgcctactccgggcacctctgctagacccctccagagtcactgatcttttcttctcctgcagaagctgatgcgcctcccaggaggccccaccttgaccttccaggtcaagaaggtgagaggggtggaggtggtacaaagccatgtggggtgggagctggacttggggttgtccgcagccatgtgtggttggtggtcaccccctcctctctcctgtcctacagtactcgctggtgcgtgatgtggtctcctcactgcgccggcaccgcatgcacgagcagcagtttgcccacccacccctcctggtactcaacagctttggcccccatggtatgcatgtgaagctcatggccaccatgttccagaacctgttcccctccatcaacgtgcacaaggtgggtctggcctggcgaggtggcaggtatgggggggtgcagcggatagaggtgccacaggccctcagatggattgctcactcctcccagcgctgagactgggagctcctgggtctgctgagtcctgaggtcaaatcccactcctgtgtctgatgatgctgggc

SEQ ID NO: 2754 - DNA, 1198 bp, Homo sapiens; identical to SEQ ID NO: 2753

SEQ ID NO: 2755 - DNA, 1198 bp, Homo sapiens; identical to SEQ ID NO: 2753

SEQ ID NO: 2756 - DNA, 1219 bp, Homo sapiens
ttcagtctccttaggagcccagggaggcaggaagcttttgtggttcccgttttataagggaggaagctgaggctcaggttgtctagctcaagggcccggaggtctaggtggacccctgcacatccctgagtattgcgccctggtgggagctggtccgccagactgcgcaggccccacgctgtgtagctgtcacctggacccggaggctgacagctgccctgcctcctggagctcaggcctggcgtgtactcaggaaacaactgtcgccaggactgttcagggagtgcttgaggaggatgaagatggggtttgaggcccagacactctgggggtggctgttgtaggtctagggcaccccactgtggaacccagcctgcccctgccctcaactgtcccccatccctccctgagcccagaactggaagaagttcgggaactcagagtttgacccccccggacccaatgtggccaccaccactgtcagtgacgatgtctctatgacgttcatcaccagcaaagaggtaagcggggcaatcaggtggggctggcatcctggggtggggcaaagggggtgccttagccgcctctgagctccccccaacccgcccctgccaggacctgaactgccaggaggaggaggaccctatgaacaaactcaagggccagaagatcgtgtcctgccgcatctgcaagggcgaccactggaccacccgctgcccctacaaggatacgctggggcccatgcagaaggagctggccgagcagctgggcctgtctactggcgagaaggagaagctgccgggaggtgtgggggtgggagggtcctgctgtcagtgcacgggttctgtccccactgctgccttcgtgctgtcatctcccgcacgacagtgcagcgggtttgatggtgccagactctcctcggggcgtctgtgccttcctaattggctgtacctcctatggttgggagacgggcgtctcccatatatgtgcgacttggcagctgtgactttgctggtggccctgtgactgtcctgatgagctgctgtctgtcggccccagggtgctgaccaccccacatcgtgtgtgcgcactgtgtgtatagtgtctccgttgcatgcctgtggctgtaccgtccgaattctttggtgggatttgctggtggcgagtgtgagagtgcagacgtgcacttgtcgcctgccacgcgagggggacctgggcg

SEQ ID NO: 2757 - DNA, 1188 bp, Homo sapiens
gcctcaggtatggtggggtgggccaggcttcctctggggcctgactgccctctgggggtacatgtgggggcagttgctggccaccgttttgggctctgggactcaggcgggtcacctacccacgttcgtggccccatctttctcaaggggctgctgtgaggattgagtgagttgcacgtgtcaagtgcttagagcaggcgtgctgcacacagcaggcctttggtcaggttggctgctgggctggccctggggccgtttccctcactcctgctcggtgaatttggctcagcaggcacctgcctcagctgctcacttgagcctctgggtctagaaccctctggggaccgtttgaggagtgttcagtctccgtgaacgttcccttagcactctgccacttattgggtcagctgttaacatcagtacgttaatgtttcctgatggtccatgtctgttactcgcctgtcaagtggcgtgacaccgggcgtgttccccagagtgacttttccttttatttcccttcagctaaaataaaggaggaggaagctgctaaggactagttctgccctcccgtcacccctgtttctggcaccaggaatccccaacatgcactgatgttgtgtttttaacatgtcaatctgtccgttcacatgtgtggtacatggtgtttgtggccttggctgacatgaagctgttgtgtgaggttcgcttatcaactaatgatttagtgatcaaattgtgcagtactttgtgcattctggattttaaaagttttttattatgcattatatcaaatctaccactgtatgagtggaaattaagactttatgtagtttttatatgttgtaatatttcttcaaataaatctctcctataaaccaccctgggtgggtattcgtgatttgcacgggacttctggctgaggtcagacaggaacaagctcttccatgctgaaggcgacccacgtggagtttgaagctagcacgtttgaagctagacactccgtgtgtctgtctgtgtttgttcagaactgagtcacgtgagttgatccccatgacatgcaaatggaacttgctagtgtagcttccaggaaagccttttaaaggaagtcttggctggccttccccgtggctggtaggccttctttggtctgaagtgggttgtgatgcctggcagtggagcagccatcct

SEQ ID NO: 2758 - DNA, 1091 bp, Homo sapiens
aataggcatttcagtgtcagccagatcaaatgttagtattaataaaatggattgttttaagtttctattgtagcaaagtcaaactactcttattggtggctaattggtcatggccccactgagggagaaattaagtgactatcaaattgccttcttactagtctgcgttagagaggggacagtgcgtttctctcccaaacgattgcagttctctccttttcaggcctataatgcaaagagcaaaagctttgaagatcctcccaaccatgcccgtagccctggaaacaaagggaagggcaagggaaaaggtacgtcattgtatgagtttcttttcaagttattcttctgtaacttggaggctgcctgtgaatccctcagtgtaaaaccacctctggtgttactgactctgggacagcgaggccgcctgagttaacaaggcgcttgagagcaaggtggacttggactctgaggatcgggtttagcctctggcctctctcccccagggaagggcaagcccaagtcccaagcctgtgagccgagcgagccagagatagagatcaagctgcccaagctgcggaccctggatgtgttttctggctgcggggggttgtcggagggattccaccaagcaggtgagcgcccgtaggctccatctctgaatacctggtgagcccagaccgggcaggtgctacctgaaacgacttccaaccccggtcaccttcctgactcaagaatctccttccgaggccaggcacggtggcgcacgcctgtaatcccagcactttgggaggccgaggtgggtggatcatgaggtcaggagtttgagaccatcctggccaacatggtgaaaccccgtctctaataagaatacaaaaattagctgggcgtggtggtgtgtgcctgtagtcccagctactcaggaggctgaggtgggagaatcgcttgaacctgggaggcagagcttgcagtgagccaagatcacaccactgcactccagcctgggtgacagagcgagactccatctcaaaaaaaaaaaaaaatcttctggagagttgaaagcatggcttcgtgcttgatctgccaggcatctc

SEQ ID NO: 2759 - DNA, 1151 bp, Homo sapiens
gctgcagtgagtcatgatcgcaccactgcacccaaacctggggagagagctagactcttgtctcaaaaaaaaaaaaaaaaaaaaaaaaaaagctccaaagtcacctctgtcaaagccacagtctgttccttccacagccacaagatggcgacatgagcctaagtcaagtcctgtccctcaacccacgcccctcgctggcttccccacctctctcaggatgaaagcccaagtcatcagggtggcacgtcaggccctgcacgatgtgccccgtcacctccctgccctcccgtcatttgccctgggtctcccccaccagaatgggagccaggagtcccagccaggcacaggaccgagcctggctctcggtcagcaggtgatgagctgggagcagctccttggccagaggcttacaggcaacaagcggccaggcagggtctggccccgggctgctgggctcacaaagtcacactagaccacagtgacgatctctgtaagcacaaagggactccgatgtgggtggggtgaggagagaggcagccccggcctgaccggccccccgccccgcccccaccccgcccccaggcctaaatgtgcacagcatgctcaagcaccagacgctggtcctgacgctgcccaccgtcgccttcctggaggacaagctgctctggcaggactcacgttacagacccctctaccccttcagcctgccctacagcgacttcccccgacccctaccccacgctacccagggcccagcggccaccccgtaccactgttgatgtgaagcacctcttctgagccaggccgagcccctggccgacttgggagcctcaggcccacgcccacccttcgaggaaggtgtcacctggaccccttcattccacggaggaagctgaggccacagggagcggccatcgccattgggaaggggcgactccacggaaagcccagacgggcttctgcatccattccctctttttgtttttaaaataaattgtatttttgaatcaaggaggataaagataacttctcagtgtcatttttgataattgcattgagaacgatgagctccttcccaggttctgggcactgttggggatccgccgtctcaagaggctcacggtctggtttaggggaaccccagggctgtt

SEQ ID NO: 2760 - DNA, 1197 bp, Homo sapiens
tacttgggaggctgaggcaggagaatcacttgaacctgggaggcagaggttgcattgagccgagatcataccattgcactccagcctgggcaaagagagcgaaactccacctcaaaaaaaaaaaaaaaaaaaaattagccaggtgtggtggtgcgcacatgtagtcccagctactcgggaggctggggtgggaggatcgcttgagccgggaggttgaggcagtaagctatgactgagccatggcactccaggctgggcaacagagtgagaccctgtctcaaaaaaaaaaaaaaaaaatcctggccgggtgcagtggcttacgcctgtaatcccagcactttgggaagctgaggcgggcagatcatgaggtcaggagatcaagaccatcctggctaacatggtgaaaccccagctctactaaaaaaatataaaaaaattagccaggcgtggtggcaggcacctgtagtcccagctacttgggaggctgaggcaggagaatggcgtgaacccgggaggcagagcttgcagtgagccgagatcgtgccactgcactccagcctgggcaacagaacaagactccatctcaaaaaaaaaaaaaacaaaatcctaatgcctgattccttcccccaccacactgactgctgagtcagccggtccatcctccaagagcagtggagaggtggggacacattagcccagcacagtgatagggtcacagcaagggctcacagactgcggggagcctgcctggcctttcccctctcagctacctggcagccaagtccctgctccttaatggttctgcatctcagcctgctagggagtccctgggaaatggggcctcccagatgtccgtttgtaaaccctacacactggggaacagctagctgaggacattgaggacatgacacagtgcctggtacacacagtggagctgcaggcccaggagggagacgtgaggcacgtggtggaagagaggtctactcctctacgccattcgcatagcagccccttcctgactctgccactcacctgcgcccccttcacttcccacccctaggggcctgtgaagcctccctggcctgctccacctgccatgtgtatgtgagtgaagaccacctggatctcctgcctcctcccgaggagaggtgagtgggtcagccctgtctagctggcagcttcaccctggagcattca

SEQ ID NO: 2761 - DNA, 1153 bp, Homo sapiens
ggccccatctgacagatgagaaaaccgaggctcaaataaaatggagcaattggccctaggtcttatagctagaaagtagcagaagcaagatttgaacctgaaactgttcgctttccctcagggctggggggcagtggcaggggggcggggtgggtgcttcctctggcccccagggagtgacctgttccacctctccatttctcccaggcaatcggctcttccccgctggggtccggagaagggctcctgggcctcagccccgggcctaatggtcacagccacctgctgaaggtacgggcagggggtggggacatgcagggctgggaagccccggccccccagcggcccctgacccgccccgccctgccctctgtctccagaccccactgggcggccagaaacgcagctttgcccacctgctgccctcgcccgagcccagcccagaaggcagctatgtgggccagcactcccagggcctcggcggccactacgcggactcctacctgaagcggaagaggattttctaagtggctggcaccagagataactcaagggcctgcaccaaatcgcttttgggttttctgatgttttgttttgtgttttttttaaaccattttctctctttcggtaatagaaaaatctctgaaagactttactgaccaatcagccggagccccaggagcccaaggggtgtgggggagtctggaggcctcattatgtctctggcttgctccccacgctgaaaccctgcagccttaagagagaggggccccggcctgctctccctccctccccccatctcctcctccgctgtgcccgtctctccggagccctcctgcctcattgctcctgtaattttggcctttcgagtgccttggaggtttccctgacctcccgtgaagatacagagactgtctcctttttttttaactttgacaactgacttctgtttccttttctaagttttatttttcaaaccaccccggacagcccccagctctgattccttcaaggcccggcctgtccgggccaccattccacaccttgcggtttgaaacagctgtttttcccacatttgctgcaggcatggctgtctcctgcccctgcctgcccatctggcctataccccagccgtggggcccggggtccctgc

SEQ ID NO: 2762 - DNA, 1181 bp, Homo sapiens
accagcagctccctcaagtgagaatggggttctggatgggtccatcccacctgagaactgggtctagtgtgcgcgggtcttggccttccctcccgaccttggaggggctctgctgggctcaaggtaggcggtccccggcccgccctctatcgtcccccaccggggccgcccctctccgcggcaggcgagaagtcgctgcagctggtcatggagtacgtgcccctgggcagcctccgagactacctgccccggcacagcatcgggctggcccagctgctgctcttcgcccagcagatctgcgaggttggtcggccccgcccctgcttctggagcttgccccttcctcttcagcttgggctggcctgagcgatccggtgcagtctgctctcacgctccgcccctgctcgtttgcccaggctgtcttgtccttgcactgacctccgaactgtttggcttgcttggccacaccccctcctcccaagggaccacgcacagccggctcggcccctcccaactcgccctcctgcccagctttgctcgtctagccccgtccctgctttctggctcagcctccttttgcttggtgccacgtgccatccggccctctccagcggccgggtagccaccggcctgacctgactgtcccccagccctcctggctgctcaggtcctgccgccgcccccggccgaaccccgccccactgaaactcacgagccctgccccgtccccagggcatggcctatctgcacgcgcagcactacatccaccgagacctagccgcgcgcaacgtgctgctggacaacgacaggctggtcaagatcggggactttggcctagccaaggccgtgcccgaaggccacgagtactaccgcgtgcgcgaggatggggacagccccgtgttctggtgaccaggcggggtgcagtctgagggggtgctggggtcacttggaacaggcagggtggagtagacggatgctgggtatcatgatagggcatgatcccagtgaagcgcggcggggcctagcggtgcgggggtggggcctatggaggcaaggggcggtgtatagagtgcggcttggcctggtgggcggggttaacccggcctagccaatgagcggcctagccaatgagcatatcaccccgctcaggctgcgctcttaagggtgggtcccaactgagc

SEQ ID NO: 2763 - DNA, 1312 bp, Homo sapiens
catctctactaaaagtaaaattagccaggcatggtgacaggcgtcggtaaccccagctacttgggaggctgaggcaggagaatcacttgaacctgggaggtggaggttgcagtgaaccgagattgcaccactgcactccagcctgggtgacagagtgagactccgtctcaaataggtaaaatatcaataggcaggaagccagcttggggatgtgcaagggacaacggggacaacggggaccaccggctggcggccccacctcatctgcctgccttctcctcacaggacgcaaagtaccacatgcagcgctgcattgactctggcctctgggtccccaactctaaggccagcgaggccaaggagggagaggaggcaggtcctggggacccattactggaagctgttcccaagacgggcgatgagaaggatgtcagtgtgtgacctgccccagctaccaccgccacctgcttccaggcccctatgtgccccttttcagaaaacagatagatgccatctcgcccgctcctgacttcctctacttgcgctgctcggcccagcctggggggcccgcccagccctccctggcctctccactgtctccactctccagcgcccattcaagtctctgctttgagtcaaggggcttcactgcctgcagccccccatcagcattatgccaaaggcccgggggtccggggaagggcagaggtcaccaggctggtctaccaggtagttggggagggtccccagccaaggggccggctctcgtcactgggctctgttttcactgttcgtctgctgtctgtgtcttctatttggcaaacagcaatgatcttccaataaaagatttcagatgctctctgggctgctgggagggccgttcaggcagcccatctcttgtaggtgggagggaaacttggtgggatattgggggctgagctgtgcttctctggtcctttgcccaccagccatcgtgggtcctcgcctcacacatgctgttccacaacttggaacagtcttcttccagaggcctcaaaagcccccaaccttcagtctcacccacccactcccttgtccctacttggacctccagaatgcagggtggcccaagctgatcaccaccagagggcagtagtgatctgcaaaccaagtcacattccctagggttttgtggatctggcgcacctgcccgcaccccacacctttccagcttcctacaaccttttggagcagcatcctggatggactatatctccccaccctatggccagcgctgcccccaaacagatttttttttttttttttttttgag

SEQ ID NO: 2764 - DNA, 1192 bp, Homo sapiens
ctgtcagtgttctacagtcttgtttcatccttctctactttcctttttttttttttttggagacggagtcttgctctgtcgcccaggctggagtgcagtggcacgatctcggctcactcactgcaagctctgcctcccgggatcatgccattctcctgcctcagcctccctatagctgggactacaggcacccaccaccatgcctggctaattttttgtatttttagtagagacgaggtttcaccgtgttagccaggatggtctcgatctcctgacttcgtgatccgcccgccttggcctcccaaagtgctgggattacaggcgtgagccaccacgcccggcctcatccttctctactttctgctccctggtatatttcagagcaaataccaggtatataattttagccataaatttgtcttaaatatgtgtggaacagttaaagttggttctttccagcacaaccacagtattattcccctaactgaagtaactataattccttcataaggattcacttcatgaacaagattcccagtgtcgttgcgactatccagggaaaccatagccaagggaacaggcttggcagaatcagtggcgaaagaaggccctgtggagcttgactctggctcggtgaagagacatgggtgatggaggagaggatgccctttgcacacacatcactcacgcctggccctcattgcagcctgggaaggcagatttttttcaacagtaggatctagtaccaattgttaggtctatgggatatgtgctgcatgcttcaagtaggttgacttgtttcattttcctagtcctgccgagagtagaggggcctcttccgtgttgctaatgcaagaaggaagctagtggctgggcaagtggggtttcaggtccaagtctgtgcagaagctttccttgggcgatcgatcgagtggcttgccccatggtgtgagtctcaggcatgttgagccactgagcccagggactggctttctgcccttttcatcccatgccccctcacactccttccctcctgcatccctaccctgacatgaagcctttgacctcaccatgtcctgttgctgggctttgcaggggcatcatttgactcctaggggttttttgttttgttttgttttaaatgagacagagttttgctcttgtcacccaggctggagtgcaatggtgtgat

SEQ ID NO: 2765 - DNA, 1096 bp, Homo sapiens
ggtcctattgaagttcacaataagtggaaaacaattttttcagagaatgtatttttgtgcagaattgcacagaattctagagacagcgttgttcggcatcaaggcaaaagcccacctttgctttttatggaaagcattactttatttaaagagacagacaatgacgcattttaatctacctttgtcttaatttacagcaggttttgtatgaatttttaaccttttaacaaactcccaaatctggttgatgcctttgacagtgatgaaaacgatttcaccacatctgaatccagagaaaccggctttttttcttattgcgagcatgttaaaacgttgggaacatgtggggaattgtatattgcgctgaattaacttctcccgcctcttgtaatgctctggtgggttcttgtttgggaatgcgatattttgtggctggtttagctagagagtgaactctcaaaggtatcaaaactgtgcttccattattagtgcaagaaacagacaggctttaaggggtagatgacgtgaaattttgcaagtcttaattacagctgcagatgcatgggattctggatttttttgttgctttttagtttaatgggactttaaaagtaattgaggagaaagaaccgtgatgttccctgtttctccagtaaaggactggcttttgcttgggcagaggtggtgctgctgggtgtgcagctgccacagactccaaaggcgtagaagtttgtgccaacacacggagtcattctggctctctgctgaggcccctgttttctggcaggtgccctccttggaaactggttttggctctgatcagcggttctttttgcagcaaagcctgcatctgtgttgacttgcaagattttgcgtttattcaggcaaaaactggtcaaaatggttactacatgatttgttcccagaggtttgaaacattcagtgaaactttttaaaactttgattgcatgatgtattttttttttagaaagttattgtttgagaataatgtctttttataccaggaaaatagttatcctgaatgacgttgaaaactccccctcccctttatttttttttaatcaatacatgtgaa

SEQ ID NO: 2766 - DNA, 1066 bp, Homo sapiens
tggagctgcagcctgctcgccatctggaggctcagtggagtggggagttggggttctcataccagcagatttccctagagcgtgattctcccatctgaggcaatcttgcctcccaggggaaattttgcaatgtttggaggatgttgtcacagctagtagcgggtgctctgggatctggtggatagatgccaaggatgctgtcaagcatactgtactgcccagaacagtggcccatagcagggacctgccctatcaaaatatcaggtgtatggaggtggagtcccaacgctagagcagcccttctcagctccaccctgcccggggagggaggaggagctctggtttcagagcagtgccgggattgcctttccccaggatctgtgtcggccatccaggaagaactgtactggccaagcctgggaccacacgtctgcagagatcctgctctgctggcctgagccccaggccttggcctcctgtgcttgggtaaccatggccactgggaaaagcaaggaccgtgtttgactttcttggagaggtgaaagaggtgaaagaacaagttgtgtgctagaaaacttttgaggaattcttatttgtgttagagcagaggaggtcccagataccaagtggcgcctcccaggaaaggctgggagaagaggtggcctggagtaccccgagatcccagcagcgcacacagtggagggatgaggatggatgggtcctaacccctgattttgatgggatgtgttcatgtcctatctcctctcctggacacattaaggggttgggacaagaagagactcctgtgagatcagcagacctcgtgtttaaggagagaatgcctgcctgcaacactcatggagagggacacttcctggccccacctgctaaatacctccaaactctgggcaggcgcctgcattctcaacacaggacttcccttaacagtttccggatcagtgaccaccaccacgttcaggtttctgaatgcagacccaccacgagggatggattccacccgcccgccctgctgcagatacatgcggcacagcaggcacgtgcctgg

SEQ ID NO: 2767 - DNA, 1206 bp, Homo sapiens
gggcgggccagggcagcccctcactgccattgcctgctccacagggtcctccggcgcccagggcagtggtggtggcagcacgagtgcccactatgcagtcaacagccagttcaccatgggcggccccgccatctccatggcgtcgcccatgtccatcccgaccaacaccatgcactacgggagctaggggcccgccccgcggactgacagcaccaggaaaccaaatgatgtccctgcccgccgcccccgccgggcggctttcccccttgtactggagaagctcgaacacccggtcacagctctctttgctatgggaactgggacacttttttacacgatgttgccgccgtccccaccctaacccccacctcccggccctgagcgtgtgtcgctgccatattttacacaaaatcatgttgtgggagccctcgtcccccctcctgcccgctctaccctgacctgggcttgtcatctgctggaacaggcgccatggggcctgccagccctgcctgccaggtcccttagcacctgtccccctgcctgtctccagtgggaaggtagcctggccaggcggggcctccccttcgacgaccaggcctcggtcacaacggacgtgacatgctgctttttttaattttatttttttatgaaaagaaccagtgtcaatccgcagaccctctgtgaagccaggccggccgggccgagccagcagcccctctccctagactcagaggcgccgcggggaggggtggccccgccgaggcttcaggggccccctccccaccaaagggttcacctcacacttgaatgtacaacccaccccactgtcgggaaggcctccgtcctcggcccctgcctcttgctgctgtcctgtccccgagcccctgcaggtccccccccgcccccccactcaagagttagagcaggtggctgcaggccttgggcccggagggaaggccactgccggccacttggggcagacacagacacctcaaggatctgtcacggaaggcgtcctttttccttgtagctaacgttaggcctgagtagctcccctccatccttgtagacgctccagtccctactactgtgacggcatttccatccctcccctgcccgggaagggaccttgcagggacctctccctccaaaaaaagaaaaaaagaaaaagaaagaaaaaataaatgaggaaacgtgttgcagcac

SEQ ID NO: 2768 - DNA, 1208 bp, Homo sapiens
aggggggagatggagttttgttcttgtcgcccaggctggagtgcaatggtgcgatcttggctcactccaacctccgcctcccgggttcaagcgatttcaattttcctgcctcagcctcctgagtagctgggattacaggcgtgcaccaccacgcttggctaattttttttttttttttttgagacggagtctcgctctgtcacccaggcttgagtgcagtggcacagtctcagctcactgcaacctccgcctcctgggttcaagcgattctcctgtcccagcccccacaccgagtagctgggattacgggcgcctgccaccatgccggctaatttttgtatttttagtagagatgagttttaaccatgttggccaggctggtctcaaactcctgacctcaagttatccactcgtcttggcctcccaaagtgttggaattacaggcatgagccaccaagcctggtcctaatttttttattattagtagagatggggtttcaccatgttggtcaggctggtctcgaacccctgacctcaggtgatccacctgcctcggcctcccaaagtgttgggattacaggcatgagccaccacgtccggccctgaatacttttttttttttttaatataacacttccactttctatgtgacattgtgtcatgtttggctatttctgtcactctgctgtccactcctccaggtaggaattgtgttgttctctgccagatgcctggtgtttggaaccagcttggtgcattcagcgctgttcgtatttgggggtagtcatcagtaagtcctctgctgtggcggtggggaaggcctgtcacgagtgacactgggcaggtatggattctgcatctccctgcccactcttggcctttgcatgcctctgttgtggggactcctcttgccgtctccacacagtgtcactcctcacgctcagtgttgcgtatatagctgataacacagcagacccggtggtggcgcaggacatccatccagtgggcctcggccagccgaaaagaaagaataggggccgggcacagtggctcacgcctgtaatcccagcactttgggaggccaaagtggacggatcatcggctcaggagtttgagactagcctggccaacatagtgaaaccccatctctacaaaaaatacgaaaattagctgggcatggcggtgtgcgcctgtagttccagctactt

SEQ ID NO: 2769 - DNA, 1170 bp, Homo sapiens
cggttatgccccaccacacccagctaagttgtttttttttttgagatggagttttgctcttttgcccaggctagagtaaagtggtgcaatcttggctcattgcagcctccgccccgcgagttcaatcaattgtcctgcctcagcctcctgagtagctgggattataggcatccaccaccacgcccatttaattttatttttatttatttatttatttattttagacggagtctcgttctgtcacacaggctggagtgcaatggcacaatctctgctcactgcaagctccgcctcctgggttcacgccattctcctgcctcagcctcccgagtagctgggactacaggcacctgctaccacgcccggctaattttttgtgtttttagtagagatgggatttcaccgtgttagccaggatggtttcaatctcctgacctcgtgaacatcggcctcccaaaatgctgggattacaggcttgatccaccatggccagccagtttttgtatttttagtagagacggggtttcaccatgttggccaggctggtcttgaactcctgatctcaagtgatccacccgccttggcctcccaaagtgccaggattacaggcataagccaccacgcctggcctaattttttaaaatttattttctatagagacgggggttccatatgtttttcaggctagtctccaattcctgggctcaggcatcctcctgcctcagcctcccaaagtgttaggattataggcatgagcccccgcacctggccttcacctgtgttttttcctaaactctttgagagtcaaatgcagacgtgacagcgccttacctccatgtaattcattatctacttcataaagacaaggttgtttctgcacactgtaccgaggtgacggacacaggaggtgaacattggtacagcactgttatccaatctataggccttcgtatgaggtttggccagtttttccagttatcttcacagcagcagagaatcctgggtcacatttagtggaggtccctttagtcagctttagtcttaaagagctccttgtgtgtgtgtttgtttttttgcagagatggggtctcatgttgcccaggctggtcttgaactcctgggctcaagtgatcctcccacctcggccttccaaaggctgtgattataggc

SEQ ID NO: 2770 - DNA, 1085 bp, Homo sapiens
gccgtgggaggtcagggtttctttcacctggttccacccaggctgaatgagagtcccttggggctcccggtggcagagccctccctgagaatcacccgctataagccccatgtggtcagcctggcccctgcagcgctcctggcatgagcttggcgtggggtgggtctgtggacactccagtttgtgttactcgtggagaagcagcatgcccgctgccgggggtctttctggtgaggcacagggagcagagtgctctgggtactgcggttccatgtcccaggaattacatggagggaaccagatcctcacagtttcctaaggaagagggtgccctgcctggctcccagaaagcataaagcaggctgaaaagccacgtgccaagggcaagatcaccccaggggaccccgtccaccctgtccccacatccgcaccttctagtgagacctctgtcgccctcctttggaggtaacgcttgcttctcctgtcttgggggcttccaggtggacctgaatgaggaggaaaccattctcatcatccggcgtctccacaaagtgctgcggcccttcttgctccgacgactcaagaaggaagtcgaggcccagttgcccgaaaaggtgatggagttttgaggggagccaccagtgaagcagcctcacgtgggggctttctccagggctgggcgtgctcagggcctctccccacagtcccaggcctgccctggtcaatccagcttgggggtggcgatgacgccactgggtctgtaaagccctgtgctgctgttgtagggattgaaaagcactcataggctcacatagctcacaataggttagagcacaaaatcccacttcctgtcagggggccaggtgcctgtgcgggctctcctggccacatcaggaggggccgtgggcttggggttgccccccggccccccatcatggctctgggttttcaaggcctgctgcagccacacccctgggcccagttcccacagcaagacccatggactcggggtccccggctgcagttgtccctcttggctctttgtttcctggctggctgtagagaggcccccagaagatggctgg

SEQ ID NO: 2771 - DNA, 1197 bp, Homo sapiens
ttatgctcctagcctcaagtgatcctcctccctcagcctcccaaagtgctgggattacaggtgggcgccactgtgcctgttcccgttgggaggtcttttccaccctctttttctgggtgcctcctctggctcagccgcaccctgcaggatgacacaaggggatggggaggcactcttggttccatcgacgggtcccctctgaccccctgacctcgctccccggacccccaggctccatcgcctacctcttcttcaccaaccggcacgaggtcaggaagatgacgctggaccggagcgagtacaccagcctcatccccaacctgaggaacgtggtcgctctggacacggaggtggccagcaatagaatctactggtctgacctgtcccagagaatgatctgcaggtgagcgtcgcccctgcctgcagccttggcccgcaggtgagatgagggctcctggcgctgatgcccttctctcctcctgcctcagcacccagcttgacagagcccacggcgtctcttcctatgacaccgtcatcagcagagacatccaggcccccgacgggctggctgtggactggatccacagcaacatctactggaccgactctgtcctgggcactgtctctgttgcggataccaagggcgtgaagaggaaaacgttattcagggagaacggctccaagccaagggccatcgtggtggatcctgttcatgggtgcgtatccacgacgctgagggctgcagagggaatggagggagcaggaaggagcttcaggaactggttagtgggctgggcatggtggctcaaagcacctgtaatcccagcactttgggaggccaaggtgggtggatcatcaagaccagcctgaccaacatggtgaaacctcgtctctactaaaaatacaaaaattagccgggtgtggtggtgggcacctgtaatcccagctgctcgggaggctgaggcaggagaatcacttgaacctgggagatggaggttgcagtgagccaagacagccccactgcactccagcctgggtgacagagtgagactccgtctcaaaaaaaaaaaaaaaaactaaacaaaaaactggttagtggctagacaacaggatggtatcttccaagcccatggctgactcagcagctcctgggtcaagacactgtgacctgtgtcccctggcaggaagcatcgcccc

SEQ ID NO: 2772 - DNA, 1128 bp, Homo sapiens
gggaggatcacttgaggccaggagtttgagaccagcctgggtatcagtgagaccccacgtctataataaatatagtaaagtatagcaggccaagtgtggtacctcacgcctgtaatcccagcactttgggaggccgaggtgggcagaagacctgaggccaggcgtggtggcatatgcctgtagtcccagctactcaggaggctgaggcatgagaatcacttaaccactggaggtggaggttgcaatgagccgagatcgcaccactgtactccagcctggcctacagaatgaaactttgtctcaaaaaaaaaaagtaaaggcagtatccttttccccgtggggttgtgtgaggggctgtgtgtcccgggctttccttacatctgtgcctcagtccatcatggccccagtgtggcccagcccatccacctggacagcacccagctctccaggaaattcatcagcgactacctctggagtctggtggacaccgagtggtagccaggagcctcgtggctgcgtcttgcacccagcgggcatctgccgtggtcagatccatttcaaatgaaatgtggggacatagatctttttttttttttttttgagacagagtttcactcttgttgtccagtctggagtgcaatggcacaatctcagctcacagcaacctctgcctcctgggttcaagcgattctcctgcctcagcctccaaagtagctgggattacaggcatgcgccaccacacccagctaattttttgtatttggtagagatggagtttcaccatggtggtcaggctggtcttgaactcctgacctcaggtgatccacccgcccgccttggcctcccaaagtgctaggattccaggcgtgagccatcgtgcccagctagacgtcttccttttttttttttttttgagacggagtctcactctgtcgcccaggctggagtgcagtggtgcgatctcagctcactgcaagctccgcctcctcccgggttcacgccattctcctgcctcagcctcctgagtagctgggactacaggcacctgccaccatgcgcagctaattttttgtatttttagtagagacggggtttcaccatgttagacaggatggtctccatctcctg

SEQ ID NO: 2773 - DNA, 1391 bp, Homo sapiens
ccggttcctaacggtgggatcggtgtcctcgggatgagatttggcgtttcctcggggctttggtgggatcggtgtcctcaggatgagatttagggtttcctcggggctttcgggatcttcacctaatatccggtattattttatgagaggagtggtcttggctgtcagaactggatccctggggtgatatttgggaattagtggagtgatctctgaagacctagggctatgatctggagctgctgtggctgaaatttggggcctctgaagtggcatggagattgaggtccagagagcctgagatcttgagggctgacatttggagagatggggtcgagggttgtctttgggccttgactgctttgggcctttctcactctcattcccgggatgctttgccagaatctctgctggattggccgtaaccctgtccccgagcgggctcacagggtctgaaggccacgcatgaggcaaaggtaaagttctgagccacccggtgcctccttcccaggactgcaagatggaggaaggcgggaacctaggaggcctgattaagatggtccatctactggtcttgtcaggtgcctggggcatgcaaatgtgggtgaccttcgtctcaggtagggaccctcagcttggatgtcatgggtacctggggtggggatggaaataagaggggaaccgggaagtgccctaacacccctgtggtccccataccctgcaggcttcctgcttttccgaagccttccccgacataccttcggactagtgcagagcaaactcttccccttctacttccacatctccatgggctgtgccttcatcaacctctgcatcttggcttcacagcatgcttgggctcagctcacattctgggaggccagccaggtacgtgggtttgagtgccactgccctctggagacttgttcccaggacctcagtcagcgcctatggctacaccttttccagggggggaaaaaaaaaggctaggcatggtggctcacgcctgtaatcccaacactttgggaggccgaggtgggcggatcacgaggtcaggagttcaagaccagcctgaccaacatggtgaaaccccgtctctactaaaaatacaaaaaaattagccaggcgtggtggtgtgcacctgtaattccagctactcaggaggctgaggcaggagaattgcttgaaccgaggaggcagaggttgcagtgagccgagatcatgccattgcactccagccagggcgacaaagcaagactccatctcaaaaaaaaaaaaaaaaaggaaaggaaaggagaggagaggaaaggagaggggagggaagaggaagggaggggaggggagccccttcttcctggtagatacaaagctgggctctggatacccttgag

SEQ ID NO: 2774 - DNA, 1173 bp, Homo sapiens
aggtcctgggcggacagccccaaagaatgaaagggagcacccccgtcttcttcccagggggacacggttaatcatgagaactgtggttgtcttttccatggggctcttcacctgatgagctccttgtggctgtggccggtagggcccagggggccactagccccttccgtctgtctctttgtctcaggaacccgaggtctgcaggccgcattcgacaccggcacggctcaccccatccagtgagtgttgggggagtggggggctaaacagggggacttccaggtgggcagccactgccccagaggtctcacctaggcctttatgctgcctcccgagttttctgatcccctgatatctggcttctgaccaccagagtcgcagaactgcgcccgccgtggccacctgatccccagctgtgtctcctccagggccccagccatgtgttcgtcgccccgtgtgccccgtcctcgattgaggtctgagccgacgcccttgcccctgcccctacccctgccagcgcccacccccagccagggcccctcgccttcctcccctggacctggggggccaggcgggggtggtggacgtggccggaagctgctgctgcccacgcccctgctgcgggacctgtacaccctgagtggactctatccctcccccttccaccgggacaacttcagcccttacctgtttgccagccgtgaccacctgctgtgaggcccgaccacccacccagaatctgcccagtccccacttcttccctgccacgcgtgtgtgtgcgtgtgccacgtgagtgccaaagtcccctgccccccaagccagccagacccagacattagaagatggctagaaggacatttaggagacatctgcctctctggccctctgagatatcccgatgggcacaaatggaaggtgcgcacttgcccctactattgcccttttaagggccaaagcttgaccccattggccattgcctggctaatgagaacccctggttctcagaattttaaccaaaaggagttggctccaaccaatgggagccttcccctcacttcttagaatcctcctgcaagagggcaactccagccagtgttcagcgactgaacagccaataggagcccttggtttccagaatttctagagtgggtgggcatgattccagtcaatggg

SEQ ID NO: 2775 - DNA, 1237 bp, Homo sapiens
tgggattgcgggtgtgagccagtgcgcctggctgtggatttcgtttttgttttcgtttaagatcatgctgccgggcgctgtggctcacgcctgtaatcccagcactttgggaggccgaggcgggtggatcacctgaggtcaggagttcgagaccagcgtggccaacacggtgaaaccccgtctctactaaaaaaaaatacaaaaattagccgggcgtgatggcacgcgcctgtaatcccagctactcggggggctgaggcaggagaatcgcttgaaccctggagacggagcttgcagtgagccgacatcgtgtcactgcactccagcctggcgacagagcgagactccatctcaaaaaaaaaaaaaaagatcatgctaccagactgctataaagtgctgaacaaatatgaataattttactttagtggattttgatggtggcaccctggaggggaaactttggaaactgggatcctgaattgtgccctctagcctccaaatgtatctccagacatttgtgtctttgaaaaacctgtttgtggctggtcccaaggtagtgacttatctcaattgattgttcacagttacagatcgaactccttgttctactctttccccccttctcactactgcacttgacttgtctttaagaaaggaagaaggggtctggcacagtggctcacacatgtaatcccagcactttgggaggccaaggcaggcgaatcacttgaggtcaagagttcgagaccagtcgggccaacatggcgaaaccctgtctctactaaaaatacaaaaatcagctgagcatggtggcaagtgcctgtaatcccagctcgggaggctaaggctagagaatcacctcaacctagaaggtggaggttgcagtgagccaggtccacgccacggcactctagcctgggtgacagagactttgtctcaaaaaaaaaaaaaaaagaaaagaaaagaaggccgggggcagtggctcacgcctgtaatcccagcactttgggaggccaaggcgggtagatcacgaggtcaggagatcgagaccatcctggctaacatggtgaaaccccgtctctactaaaaaatagaaaaaattagccaggcgtggtggcgggcgcctgtagtcccagctacccaggaggctgaggcaggagaatggcgtgaaccggcgaggcggagcttgcagtaagccgagatcatgccactgcactccagcctgggcgacagagcg

SEQ ID NO: 2776 - DNA, 1206 bp, Homo sapiens
taagagctagccctcagaactatcctctctaaggtttcacagtcctgcccaagatggccgtctcggctctggcaccgcccccactcctgcctctcccaacatggcgaccctgagtctccgttcccggtgcggaacgtacgaccggaagtgacggggtccagaaatttccgctttctttctgcagcaggaaccgcggctgctggacaagaggggtgcggtggatactgacctttgctccggcctcgtgtaggtgtgaacgagcgggtgggagggcacctcagtttcttacagggggcaaccggagggtgcatgtgtgggtgtggacggcggaggctgttaatccctttggtctgttggcgggaattgggtcacaattgggcacagggagcggaggttttgagatcttgagatcctcgccattgatttgagcaaagtgagactggccaggattggggagatcgctgcccctcgcccccatatcggaaacaaagtgaggcctcattgcctggaagcgatggaggaatccaattggctggaagtagccctctcccactgaccgggatccgctttcttcctgcagcgtgaagacacagcgcatctccccgctgtaggcttcctcccacagaacccgtttcgggcctcagagcgtctggtgagatgctgttgccgctgctgctgctgctacccatgtgctgggccgtggaggtcaagaggccccggggcgtctccctcaccagtgagtcctcctgttcaccctcccgccaggctggaggtgggaggggccaacattgggccttagggataggcatttacagccttttgactcagtttcccggtagtgctccgctggtggggatgggaggacagaggtggtatttggtggagaaggcgcttacctgccctgggctgagcttcctgtaccccgcagatcatcacttctacgatgagtccaagcctttcacctgcctggacggttcggccaccatcccatttgatcaggtcaacgatgactattgcgactgcaaagatggctctgacgagccaggtgagccttttctctgttcatccatcagatgtttattgaacactgctcagtgccaggccctgtctgtgtgaccaagatactacctctgctggctcccctttgagtgggcagaaacaagctcagaagtcagtggtcagtgttatggccccgggcagctggag

SEQ ID NO: 2777 - DNA, 1603 bp, Homo sapiens
aggtgtgcaccaccatgcctggctaatttttagtagagatggggtttcaccatgttggcctggatggtctcgaactcctgacctcagatgatccacctgccttggcctcccaaagtgctgggattacaggcatgagccaccacacccggccatctcctgcctttttttttttggatggagtttcactcttgttgccgaggctggaatgtggaatgcaatggcgcgatctcggctcactgcaacctccacctcctgggtgcaagcaattctcctgcctcagcctcctgagtaattgggactacaggcgccgccaccacgcctggctaatttttttgtatttttagtagagatggggtttccctgtgttaaccaggttggtctcgatctcctgacctcgtgatccgccctcctcagcctcccaaagtgctgggattacaggcttgagctaccatgtctggccatcccctgctttttaaaaaaagatttttttacttttgaaactaaataggccaggcgtcgtggctcacatctgtaatcccagcactttgggaggctgaggtgggcggatcacttgaggtcaggaggttgagaccagcctgaccaacatggtgtaaaaccccatctctactaaaaatacaaaaaaattagctgggtgtggtggtaggtgcctgtagttccagctgctcaagaggctgaagcacaagaatcacttgaacccaggaggtagaggttggagtgagccaagatcatgctactgcactctccagcctgggctacagagtgagactctcaaaaaaaaaaaataataataataagagaaaatagacaaggtctccaggctggtcaactcctggcctcaaatgatcctcccacctcagcctcccaagcagccgggactacaggcaaacatcaccatgtccagctgtccccagctttctaatctggtctttctcttgccccagaacctcaagaaggcatgaagccagcccctgcagtgccgtccacccgcccctctgggcctgcctgtggctctgttgccctcctctgtggcggcaggacctttgtggggcttcgtgccctgctctggggcccaggcggggctggtccacattcccaggccccaacagccttcaaagatgggtaaaggagcttgccctccctgggccccccaccttggtgactcgccccaccacccccagccctgtccctgccacccctcctagtggggactagtgaatgacttgacctgtgacctcaatacaataaatgtgatcccccacccaaacttgtctgtgtctgcctcgctttgctggggtgtggaccggggtgtgggcaggggttgagcgcaggggacgcagctttctgcagatcccacccgggcctcccccaccatctggggatcactcctgaagataccaggtggatggaccctggaccatttctgtcttgagcatccatccgggcccgtgtcccaccttccctgggtctcatctgtgctctgtggaggccaagggttccctcccggggccaaagcccctgctgcagacagacccaggcccagagaaggacgggggcctgggcgctactacacaggctgctcctg

SEQ ID NO: 2778 - DNA, 1151 bp, Homo sapiens
ccacgagaaatcctgtgatgtgaaaatgtgagtggggaacagggcaagggatccagcctccccactgcctcttccccgctgttctccatcctgccccttgcctcccttggtgaaggcgtcatcacccacaggcccaggacgcattgctcaccagtcccttctcttggtctgtttcagggaccgtgcccgcaacaccggagtcatctcttgtaccgtgtgcctagaggaattccagacgcccataacgtgtatccttggaaacctgggctttttccagagggtggggagggggctggagtccggaccctgctcatctggcccactgtgtgccctggtgcagggccaaagccgtccagaggaacaggtgccacctagtgatttctgtggggtgagaagatgcagggcagggttccaatgccaatgatcgcccttgacctaagtggcccagatctgtcagaacccgtggatgtgtacagtgattggatagacgcctgcgaggcggccaatcagtagcgacacagaggacccgccccctgagcagccccgcgtactgtggatccagctgttcggttctggtccagagacattccaggggtccagggtgtgggtcctgggctgtcacagccgtgtgtgtgtgtgtgtgtgtgtgtgtgtgtgtgtgtgtgtgtgtgtgtgtagtgggtgtgcgtgtgggtgtgggtgtgagtgagtgtgggtgtgtgtggctgcacgtgtcactggggtggccgtgagtgtgtgctcacaggtacgcggtggtgtcgggttcctgggcctgaggggcctgaactgatctcacttggctccgaaagcctttgctgtgttccctgcagcccctggccccccagccttggggctctggctccccccggcggaattgggggactgtttcctgacatcctggacaagggaagcccactagaggctggaacaggacctctccagcctcctcaccagcaccgtgcccatctcaactggacttcccgctctccttctccaccttctagtgcccgtggccggggattcaaagccgccgttccccaggtccctgggctgggccctgacagggagccgcccccctccccatggtaaccaggaagcccgtttcatgttcagttgcttttgtagaggaa

SEQ ID NO: 2779 - DNA, 1204 bp, Homo sapiens
ccccacattatgcgggggccacgggagggatatggggggatcccgcctcggatatggggtttgttagaaacaagtgcccggtgccgcaaagaaaaccagcatctaggcagaaaattcctcagcaaagcaaatttatttctacacaagggtgcagcttgcgccagtcacaagagcacagcgagcggggtagggcaggggtttttctccttaacgcagtttctagcacttctgtgtcctttcctcattggctagggttggacctcacaatctaaactaactcgataggctaaggtttaaaattaaatagggtctggccaggcgcggtgggtcacgcctgtaaccccagcactttgggaggccgaggcaggcggatcgcgaggtcaggagatcgagaccatccctggctaacacggtgaaaccccgtctccactaaaaatacaaaaaaattaactgggtatggtggcgggcgcctgtagttccagctactcgggaggctgaggcaggagaatggcgtgaacccgggaggtggagcttgcagtgagccgagatcgcaccactgtactccagcctgggcaacagagcgagacaactgggcaactccgtcacacacacacacacacacacacacacacacacacacacacaaattaaatagggtctatgagacgggaaggaacagggactgtccgttactaggcgggaaggcgtatctggacttgtctgggcgcggcaaaagcgggaaggttgtttacagaacaggtagctaggagacaaggaagtcggtctcaagaaacaaagaacagcttactaaagcttttagaaaagtaatttatcatctctgacaggttcgtgtgggaggagtagcggtctttggggtccccagtgcccacttttttctgttaaaaattaaactgaggtacgttaacaattaaagagtttagggccgggcgcggtggctcacgcctgtaatcccagcactttgggaggccgaggcgggcggatcaggaagtcaggagttcaagaccagcctggccaacatggtgaaaccccatctctactaaaaatacaaaaattagctgggcatggtggcgcgtgcctgtaatcccagctacttgagaggctgaggcagaagaattgcttgaacccaggaggcggcggttgcagtcagccaagacggcgtcactccagcctggcaacagagcca

SEQ ID NO: 2780 - DNA, 1140 bp, Homo sapiens
ttgtagagatggggtttcaccatgttggccaggctggtctcgaagtcctgacctcaggtgatctgcctgactcagcctcccaaagcgctgggattacaggcgtgagccaccatacctggcctgttattagttttttaagttagacactgagattattgattacagatcattctttggtggtatatgtgttcaatcgtctacatttcagccaggcactccttttgctgcattctacgtgttttgataagttctatttttatttaattcaaaataatttttaatatcttgagacttttctcatccatgcattatttagaagttcaggatttaatatccaaatatttgtgggttttcaagctatctttctgttatcaattctggatctgagaacatgttttgtattctctagtcttttaaatttgctaggaagtattttatttaccagaatgtgagatatcttggtgaatattccatgtgaacttgagaagaatgtatattctgctgttactgaatgaattattctggatttcaattaagtccagttgttttgatggtgctgttcaatttaattatgtccttcctgatttctgcctgctggatctctaaattaatgctgggggttattgaaatatacagctgtaccagtgaattcatgtatttcttcctgcagttgtattagttttcccctcatatattttgccactctgtggttatgtacatacacagtaaggattgccttgtcttcttggtgaattaacccctttgtcagtatgtaatgcccttctatcactgataatttcatgctatgaagtcagctttttctgaaattaataaggctgtgccagcttttaaaaaattagtgttggccgggcatggtggttcatgcttgtaatcccagcacttagggaggccaaggcgggcacatcacgaggtcgggagtttgccaccagcctaaccaacgtggtgaaaccctatctctactaaaaatataaaaattgaccaggcatggtgtctcacgcttgtaatctcagcactttgggaggcaggcggatcgcctgaggtcaggagtttgagaccagcctggccaacatggtgaaaccctgtctctactaaaaatacaaaaattagccaggcgtggtg

SEQ ID NO: 2781 - DNA, 2218 bp, Homo sapiens
gattactggggagtgcgctgcatccggaagtcgctgtgccctggttgaggggggttagggaggagtgagtgggactcaaatccagatgccttccccgtccgtccgtccgtccgtccatccgtccacttgccctcctggcaggtgggtggggccaccatgctcatcctacaaacggggaggtgggggggacttctggtgggcaagggcccctgggctctaatagggtcatctctggcagcccacttgggccagctacgtgggagggaggaattacacagctgaccgaatccggcttcggatgaggtgagggaggagcaggtcaggaggggggccctcgtagggacgcgtacactcacacggacacacatggccacacgcatgtgcgggtgccataaccggcgaggctgggccagccgctccaccatttccccgactgcatggagacagtagaattagtgaacccctgagttaacccgtaaggccttccgtgtaacctgcatctagagtttaagaagcttctgctgttttgccggaattggcggtgactggggagggctgggtgggtggggggcctcaggcgggatctcggggcggggggaggaggatggtgaccttgggagtcgccctgtcagcacgcacatgcttgggacccactccacacactccctgccagctttgttgcagcctcagctggtggtgtctccgtccttatcctagcctagctcgcagggtgagaaccactggagtggctggggctggccagaggtcaccgtttctccttcctgtgtgctccagtggcttttgaagacactgggttgggacctttttcctgaagagagctgggtgtagccagagctactggcacctaccccgagcatctctctctgtaagcagcttcaggggcagtccgtttctctgtgcttctgaaacccccttctcacgtttcaggccccagttttaactcaaggcctggggcaggggcgtttaattgatgatgacagaggacacaggtttttgccagcaaaaaggaaaaccaaggcttggtggaagggaaaggtggtgtgtcccctgttccctattccatctccctgggacttcctgctcatcatagtacccagtgagcccagagatcctactagactgggtcagcaattctagagaaccttccggaatagtctgggaacatggtcaaggtggaaggggctcccctagagagggtgggggtgtagttacttcccagttggccagaaaactgggccttgcagacccccttagcattttttccctttttttccttccctgctttctacttctttggggagccccttgtgttttggagtctgactggagtctcgcatcctggggcctgctccatccatccctcctgggcgccagaccctccatccaagccctgtgtctttccatagtcagggtcaggccctgcatctattccaaggggcactcagtacacattccataaattagctgggtgtccctgcacgcccaccccatgaaactcgagcaggtctctggaagccatttgttaaaaaaaaaaaaaaaagttttaaaaataccttttaattttctggtaattccagttctttgaagcatcctctgctgggtcttggggtgtgtggatggattggctgtctgatgggattggtaacccctcgctactcaagatggggggatacaaacaccttcagggaaggggagcctggttcttctcgttttcctttttttttttttttttaaaaaaaaactatttaattttttaatttatttttggttgttttttgcacaatgaagtttcagcttctcaaccttctcccctacccagggctgtggacccagactggccttgagccacagtccctctttccctcctcaccctcttccccctgcgggctcccgggtctgtccatttgttactgtgctgtgctggggattggcgccgaggtggcgtgagattccacttgtgtagaactttgttgagtaaagatcagtttcttgtgaactccttagtctgtggcttcctgtgtccttggctttggtagtgaagaaatgtcgggggcaccggggatacttgagagtgggaagatagacgaatgtgaaagatggaagattaaatttgtaacatatatgaaatgtgcagctcattctctgggacttcagctcactaagggtgagccattagtgtcacagcccaggttcaaga

SEQ ID NO: 2782 - DNA, 1208 bp, Homo sapiens
ctacaggcgtgtcccactatgcctggctaattttattgtatttttagtaaagacagggttttgccatgttggccaggctggtctcaaactcctgacctcaagtgatctgcctgcctcggcctgccaaagtgctggagattacaggcatgaaccactgcgcctggccctaacactgtgccactttatatcaaggacttgcacatccgtggatttttatatctgcagggacctggaaagaatcccccacggacactgagggatgaccgttggggcactgccatctcccatttgcagatgtgggctggaggctagggaggttaaggaacagctaggagctctagaactggaaagtggcagaggctggacatgcaccagggactgtgccccctgagctgtcctggttagaaggaggggagcctagccacactgatcttacttgaatccccaggactcgatgcctgaggtccggcagagctcctttgccctcctgggagacctcaccaaagcctgcttcatccatgtcaagccctgtatcggtacgacactcgccttgtccctaacccatgaccccagccccggcctcaagtgatggagagcaatacccggggatgactgtgaccacattgggatgtattcgtactgtctgatggggcctgctggactaggtcctgcagcttaccctggctggccctccttctcagcacccctgtttctccccaccagccgagttcatgcccattctgggcaccaacctgaacccagagttcatctccgtctgcaacaacgccacctgggccattggtgaaatctgcatgcagatgggtgagtgccctgcaagtggcaacacgcgccccccattagcctgttctcaacctgggggcgggagcctagctctgactgacagcttccttcaaggcaagtctcttgggggtcgtcaggggtggagccaagcagaaaggtcatttgtgattggcttctctaaagaggagggataggagggctgttctgattggaccgttttgtgtagttggctaaaagactcattcggattggttgggtgactttggctttttttttcctttgacttgggcagcgtgttgtcaccttagcgactccagagaagcctctgttgtttggagggtgtgggtctgtccctggttggccagggattctgggtggggattagccggagaaggtcttttgtttcc

SEQ ID NO: 2783 - DNA, 1170 bp, Homo sapiens
ggcttgccgcccacagggttagaccctgcttcttaagaaaaaaaaaaaaaaacctttctctggaggcaggagtggtatcatttatatcctaatcatagcggcagagactagattccgataattccccagagggaaatggatcaatttgcacctagcagtaccatcatgctctgcagggtctgctctgtggctgattggggggctggtcactctgttggcacctgtttgcctcctccccaagctgtgcctccccccaacttttgccacggcccctgcatccccataaacagtccctctctgtgcaggttgatccccatcttggtgaatgggatgaagtactcggaaattgacatcatcctgctcaaggtcaggcagggcccacccagcatgggtgggcatgggcgtgggtgtcgcggctgtggtccccaaagtacttaacagtctgcctgtcccccagggggatgtggaggaggatgaggctgtccccgacagtgagcaggacatcaagccacgcttccacaagtcacgcacggtcacactgccccacgaggctgagcggcctgatggctccgaggacgcggaggatgacgatgatgatgatgctctgtccgactggaatttgagtgtgtgcccctgcctgggggtggtggtggggtggcaagccctggactccctcttgggaggtgactagaagctgaggcagaagctgattagaagctgatcgtggccgggcgcagtggcttacgcctgtaatcccagcactttggaaggctgaggcgggcggatcacgaggtcaggagatcaacaccatcctggctaacacagtgaaaccccgtctctactaaaaatacaaaaaattagtcgggcgtggtgtcgggcgcctgtagtcccagctactcgggaggctgaggcaggaaaacggcatgaacccaggaggcggagcttgcagtgagccgagatagcgccactgcactccggcctgggcggaaaaagtgagactccgtctcaaaaaaacaaaacaaaaaaaaagaagctgatcgtgaagattctgagcatgatctctgatcctgggagtgcagtcaaggagggtcggccacctgcctgaggggccgccctgagcctccccattgttcccccttccccagggaagtgctcagcggctgcactgga

SEQ ID NO: 2784 - DNA, 1242 bp, Homo sapiens
cctgcccagcctcaggcagcgtcctttcccggccgccccaggcattctcatcaccaccatcgcttccaagggtgagctgcagatgtggcccgagctgctgccccagctctgcaacctgcttaactcggaggattacaacacttgtgaggtaggcaagaagccatggatggccagagcgagtactggggggctgggaccaccacccaccacccacgtttgtctctctgcccctctgcactcagggagcctttggagccctgcagaagatctgtgaagactcatcagagcttctggacagtgacgccctcaacaggcccctcaacatcatgatccccaagttcctgcagttcttcaagcactgcagtcccaagatccggtgggtgcagctccctgggggcttccagggagcctggagtgggcagggtcagggtgacccacgtgtctgctccccgccaggtcccacgccatcgcctgcgtgaaccagttcatcatggaccgggcccaggcgctgatggacaatattgacaccttcatcgaggtgggccgctgggctgggggtgggcagggcgaggactgagggcccctacaactgaccctgttcctccctgcagcacctatttgccctggctgtggatgatgaccccgaggtgcggaagaatgtgtgccgtgccctggtgatgcttctggaagtgcggattgacaggctcatcccccacatgcacagcatcatccaggtgtgcatggtcaaggccagcccaggcgggcaggcagggggccggtggcaggggtcagggagccacccccagccaggccaggcctcagcttctcccccctaccacagtacatgctgcagaggacccaggaccatgatgagaacgttgcccttgaggcctgtgagttctggctgacgctggccgagcagcccatctgcaaggaagtcctggcctcccatctggtccagtgagtgctgctgctgcccactgtcctaccccagcttcgaccccttgctatgcctctgccttcccttctggtcacctgctgtgcttctctcagtccacatccttgtcagtttacattcagtatatatttatgtgtaagtggtaagaatgccactttttgaagacttcaaaattaggtaactgataggtggaaagaaatgaaaaatcaatggccacatgtggtggctgacacctgtaatcctagcactttgggaggccgaggcgggcagatcacaaggtcaga

SEQ ID NO: 2785 - DNA, 1229 bp, Homo sapiens
agacggaggatgaggtgagccagcttggtgcagggggtccacccacattgcctttcccttccagcttttgcgcccagccttctccctccctgtctggtatccaggccttttatgagtgtgcctggcagggtaggagggctgtcaatgggtccccagataacttgactttataatcttcagctcaaacccagagtcttctgggtgacactgggaatgggtcacctgtctcagggcagtcctgaccctggttcctggcacccccgtcctaacccgtatcccctttccacaggtattaacaagtaaaggtgacgcgtgggccaagtacatggcagaagtgaaaaagtacaaagctcaccagtgcggtgacgatgataaaactcggcccctggtgaaatgacgcccctcccccacctgcccatggcctgggactctctgcgatgtacataactatttaatgcagcggcagcggcgacagccttccctgagaggacttaaaagcagaaggaaaccgagatgcttcccgcagccgtggacgattctccaggactctttttttaccttgagcacttgcctcgtgagacttcatagaacagtggtttactgtcccccccttctcacctcctcattctctctggctctttctgtcttcctcttctcaccctcctccctccccttagccatcacttctgggaagtaaagaacttgacttagtgccggagctgtgtgcttggtttgtcttctttgcgctgtcggacctaagccttccccctgttgctggcattgtacctgtcaaagcctgggcctgacccagtaaggagcgggatatggaagggttaggaaggacaggggcacatcccctcctgtaggcctggactttccccaagacctatctcccctcactgctgcatctctaccgtgccaccttaggctcactttctcttcacagttccattttggcttggccaaagctgttgcattgtgcattcagcagacacttaggagcatctattatgtgccagggctctgcaaggctctgggacaacagctgggagcacgcagaccacaccctccctgcccttacagaaggagacagacacaaacaaaaaggggaagcccttttgcagctagggaggaggcgggtatgtcttttaggtgacatttgattagagtcctgagggaggtgaggcagagtcccaggcagagggaacagccaggttggagacagcttg

SEQ ID NO: 2786 - DNA, 1199 bp, Homo sapiens
cagtaagtgttgaatgaatcagtgagtgaatacagggagatacagcatggtcacataggaggatttcaggtagtgataaatgtcaggatggaaataaagcagagtgacttggtaggtagcatggggatcctcatcagacgggagatcaaggaagtcctctaggaggagatggcagtggcgtccccttccttcccctggccacaggactctgaagacctactgggtgagcaaaggcagtgcctttagtaccagcatctccaagcaagagacagagctgagcccagagatgatctccaggtagcaggcaaccccagggtcagggcaggtgggagctggggcagggggcaggggcgggcagcccttaccaggcccttgcatcctcccccagtggctcttggcgggaccggcccttcaagccctacaacttcttggcccacggtgtcctccccgacagcggccaccttcacccgctgctcaaggtccgctcccagttccgacagatcttcctggagatggggtgagcacagggctgggggcggtgcctggtgcttctgctgggtacaggcagggcagtcaggctgtgtctcccaccaggttcaccgagatgccgactgataacttcattgagagctccttctggaactttgacgccctcttccagccccagcagcacccagcccgtgaccagcacgacaccttcttccttcgaggtgggtcagcccctagggcctccctgagacatgagagacaccaggccacggcggagcctttacaggatgggcatcccatttgatcaaattaggtctagaactgggcatggtggtgtgcacctgtagtccggctatttgggaggccaaggcaggaggattgcatgagcccaggagttcaaatccagctcaggcaacatagggaagaatctacctctaaaaaaattaattgagttaaattaaagtccatccttgttggatgtgtcaagctctgttctcattatgccacctgcagtcttttttttttttttttttttttttgagacagggtctcactctgtcgcccaagctggagtgtgcagtggcatgatcttggctcgctgcaaactttgcctcccaggttcaagcgattctcctgcctcagcctcccgagtagctgggattacaggtgcataccaccatgcccagctaatttttgtatttttagtagag

SEQ ID NO: 2787 - DNA, 1137 bp, Homo sapiens
aagttgtatagctgggatgtgaacctagctttaagggctgtgctttcaacctgggacccagcgctgcagaaagggggtgcctggctctgagcctcacccctgcctggacaccctccccacatttccctctaggtcatcgaggctgaacttcggtccaccaagcactgggagcttactgcggagggcgaggagattgcccgggagggcagccatgaggcccgtgtgtttcgaagcattcccccagagggcctggcccagagcgagcttatggtaggagctgcggggtgaatggggagtgagtgatgggatgaaggtggccctcgtgccccactcactgcagcctctcttttccagcgactgcccagtggcaaagtgggcttcagcaaggccatgtccaacaagtggattcgggtggacaagagtgcggctgacgggccccgggtgttccgagtggtgcgttcctgcgggctggtcagggggcaggtggacgggcacatgggcccctggccctcatacccctcacactccttatcctggcaggtggacagcatggaggatgaggtgcagcggcggctccagctggtccgggggggacaggctgagaagctgggggagaaggagaggagcgagctgaggaagaggaagctgttggctgaagtgtgagtgggtgccccctgcaggctcaggcccccaccacctgcgaagcatggtggaggcatggtgggagggagacatcttgcccacaccaagcacaggtgtggccagtttcctcccagctcgcttaatgccatagttgtcaagcctacgtgccttggggtctttgcccatgaggacccttctgctgagaactgttttccctctgatcttcaagataggctcctcatcaagtctctctcctgtgtccccttaaagaggccaccctgacagccctcctctccccttgagttccatgaagcccatcgcccctagtcttcatctttggtgcttgttcatttctttcactgtccttagtgtggtccaaagtttaatgaacacacaccagacaggcctctggaacctagatgggctaggggccgtcctctcacaggacaaatgtcccctttgagcagacacagagtggcagagagaagagactag

SEQ ID NO: 2788 - DNA, 1186 bp, Homo sapiens
tgtgtgctctgcctgcaggcagcagagaaacaaatgaaggacaaacaggacgaggagcagaggcttaaggaggaggaagaagacaagaaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctccctcctgtgtctccttctggggaaagacagacttaaggaaacccagcagtggtctttttggggggggggggggtttccagtatatctcctttttcagctattgctagagaggttgctgagtgttccacaagattccagggacccttatttaccccataaccctcaaaaccaacgggggaatggctgttgctgctgtaaatactccacatactaacttactgaatccttgaacctaactggtaagttttggttctgcttatttatttatttttaagatagactctcgctctgttgtccaggctggcgtacagtggctcaatctggttcaccctgccccttaaactggcctttttcatgcttctattcctttggggtcctgtggctcagccca

SEQ ID NO: 2789 - DNA, 1193 bp, Homo sapiens
tgcgtccacgggcgtctgtgcagacggacactgtgccggggcgagctgacaggagttcacggctgcgatagaacatggagatgtcatgggcgcgacagagcctggcggggataccagcagcgtgtgtgtgtggacggcaacgttgtctgtgcgcgtgtgtgtgagtgagtgagggagagagagagagaataggtgtgtgtagaggctcccggtgcctctgtctggctgctgaggctgagatgggagcaagtggctggcgaagctggtggtggcttcaaaccacactttcgtagaacaatcgcaagagaaaattgttggggggagggaggaggaggagaaggcggttttccttgtgcccccccttctaacgctgcttttctccttctctctttccccctcatcccgtcttcccctcctcccgtcctccctcgccccgcatgctcccggcttgccgcctgcaggatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccgagatcaagcagaagtgggcatcccggctgctggccaagctgcgcaaggacatccggcccgagttccgcgaggacttcgtgctgaccatcacgggcaagaagcccccctgctgcgtgctctccaaccccgaccagaagggcaagatccggcggattgactgcctgcgccaggctgacaaggtgtggcggctggacctggtcatggtgattttgtttaaggggatccccctggaaagtactgatggggagcggctctacaagtcgcctcagtgctcgaaccccggcctgtgcgtccagccacatcacattggagtcacaatcaaagaactggatctttatctggcttactttgtccacactccgggtaggtcgttctcaaccatttttccctctcattttattttccttgctggcatttgttctgtttattgttcctctaatttccaagcgataactcgccatgggcctaactggtgtatgcccgtcctgcggggcctgcaacacggttctatgggcccttttcctttttcctgtcttctgtctcccccgacctgttctattctt

SEQ ID NO: 2790 - DNA, 1318 bp, Homo sapiens
agggctcctggtggggtgggtggatagtggaggggaggctgacacccaccccccacccccaggccctgagaatcgtcctgcacagcctggacctccgcgccaactgctaccagcgcttcgtggtgccgctgctcagcatcagcgctgacttctacgtgcgtgtttttgtccgtgtcttcaccggccaggccaaggtcaaggcctcagccaggtcagcccgggggcagagagcggtggtggattgagagaggagacaggaccttgccctgggggatctggggcttcttaagggacagagccagtctaagggaggagttggggtgtcgtggtcacgctgggaactcgtggccactggtaccccccacagcaagcaggcgctggtgttccagtgtgtgggctgcggggccttccaccttcagcgtctcggcaaagcgtcaggagtccccagcggccggtgagcagggaggaaggagaagaaggggagtcccagggttttcctccctccccaccaaccacccctctctgtttagggccaagttctctgcagcctgtggtccccctgtgacccccgagtgtgaacactgtgggcaacgacaccaggtagggctaggccaggggaggcaaaggagcaagagggtcttgaaggtcatagtccctgctcacctgtccccggtgcgcccccagcttggtggccccatgtgggcagagcccatccatgacctggattttgtgggccgtgtcctggaggctgtgagcgctaaccccggccgcttccacacctcggagcggatccgaggggtcctgagcgtcatcactgaggtgagagccgggctgtgacggggaagggggctccacctgtgcccgtccatctccactcatgcccatcctgtcccccatcgcaggagctcccggacgtgcctctgtactacaccctggaccagctgagcagcaccatccactgcaacacaccaagcctcctgcagttgcggtaagagcccctggggtcgggaggagcctgtcccagaccacagggtggcctggggcaagtccagggattctcatgcatagaacttgcgagggggtggggagaacccggtgcactgtctcattcctgtaatcccagtaccttgggaggctgaggcaggaagatcacttgaggccaacctgggcaacgtagtaagaccctatctctaacaaataaataaataaatatatatgtacacacacatacatatacacacacatacatacgtatgtatacacacacacacacacacacacacccattagcctggcatggtgatacatgcctatagtc

SEQ ID NO: 2791 - DNA, 1159 bp, Homo sapiens
gggaggagaggagagcggcgcggccggaggggggcggggaggggccgggcctgcaggtaccgcctgggcgctggaggaggtgggtgggtcaagttacaggcctgggggcggctgaggagaagcccaggaagtggggcacggcgggtgtgggcggagttacttcgtgtgggggcggataggagatcccagagatgttttccgggggtcacatgaggtcaggactcagatgtggggagggggaggctagatgtgggggcgatcaggtaaggtgagggactgctgtaggagttttgggagtcgagagagcagagccttttgggctaggctaggggggatgtgggggcaggtcaggaaaagctggtgtgaccagaaggtatatactaagatgcgccccccaccgcccccaactcaagtgttaaggggttccgtctttctcacacctcatccctgaagcctctagagtcctgaccctaccccttgggcaagcctctgccaactgttcaaaggcactggccagtgggtgtttgtgtgggcagctggagacagtctggaacacctagcttaggcatcttgtttatcacaaggtggcccttgcccacccccaccttatatatctacagggaggcagcccagcagacgttacctgggtattttaggatcctgcattctttctctaccttttgtggccagaagctggtggttcaagcctagtggatgggacctcacagcaaccatcgtatatattagtaccatggcctcccaggcaccaactccttgagcctgagttctgtgtgccatctccctgggggtgaagaattagagggaatgagcatgtaaaactctgttgatggtggtttggaggctcccgacggggtgaaggcagggcacagagaagagttaaggggatcaaatcaggcactcacaccctggcccagggatctacctctgggacactcgtcctgggccaggccctgtgccgagctcgctggtcggatgagctcattgatggctcaccaccaccagttcaacttaggccttctctggggtccagacgaggaagctgaggctcggggtggtgtggcttgtctcagatcacatgagcagacagtggctgaactgggattgtctgaccctcagcccaaacccatagtcactcaag

SEQ ID NO: 2792 - DNA, 1098 bp, Homo sapiens
tcaccaggcccaccaggggagggggctggcctgggggtcttgggaaggcccctccccaggccctaggccacctcgcggaagccttcagcctccgcccctcactgcagccccttgggacttgaggggggccccaggggttctcaggacccctcccaccacctcccagtgcttccacgtctccaaaagcgccttcctgtcaccctcgtctatccctgcgcctgggggctggggtaggcgaggccgtggggactacccattttatagctggggaaacaggctccgagaaattgcacaaccgacctcaggtggccggcagtggcgtgcctggtgccctttctcctcttccgcctctgttgctccctttggtcctctggggcctcagagaggcaggtcctaaaggagggggggtctcctgggggcagaccgagggtctcggaggatagaatgagaggtttccagggctggcagagtgtgtgcgtgtgtgtgtgcagaagttttgctttcaaacaaatgaagatacaagaggcagtaggacctgggttggaacccaggggagcagactggggggctgttgcccctccctccatctccccacacccaccccaccccacagcagggctcctggcccccacccccctgtacataatttttaaaacctttttttagcgaatgaaatattgaagtataagattccttttatttttcaaaccaatggggctgtgtctattgtccccctcggtccccaggggtggggggccttggaaggcagggcggtgttggggggctggggggcaggctgaatgtgtgtgtgtgggtgtgtatgtgtggagtgtgtgtgtgtgtttccatggtaggactccagtcccagctgctgcctaggctcctgtgggtcctgtgggtccccctcccctgttcaccttccccaacagggctatagtttaagggtgtcccaggccttggctggttggctgggcccagctcctgggggctgggcagggcagggcagggccgggtccacttccattgttagcagttgtttgcagaattttctcttttaccattcctctctttttgttctcgcccagagtgggtggtttt

SEQ ID NO: 2793 - DNA, 1181 bp, Homo sapiens
acgctggactggtcccgagcaagaaagcccgtctggaagaaaaggaagaagaggagggagcgtcatccgaagtcgccgatcgcctgcagccccctccggcgcaagcggagggcgcctttcccaacctggcccgcgtcctgcagaggcgcttctccggcctcctgaactgcagccccgcggcccctccgacggcgccgcccgcgtgcgaggcaaagcccgcttgccgcccggcggacagcatgctcaacgtgctcgtgcgggccgtggtggccttctgaggaccccgagcggcgctgccggagcccagagcgcgcgtcgaaccgtcggcccgagggcgcagacctgaggcgaggccacccccctccatcctgggggaagcgcccgcgaaaaccgtggagagaagccgccgcccgggctgctgagaggcccggagagggactctgtccccggggagccatcgccttcagtgtgcagggacggcaccgaggagtctgagccgggggcgcgggcgccttccgcagagacctgcgcccacaggtgctgtcttagtggactgggacgtgaacctttcgctctccttctggactgggagaagggaggcttgggtgttgtgttttttgttttgtttgtttgtttgtttttaaagatctcctcagggtcggacttcattttgtactgtgggctgtgctggccctttcaaggtttttcaagagttggttttgcgtttccaacctcggagaattccaggcactccccttccccctccgctgacatacttgtataagcggtcatcgttgcgtcatggggcaggcgtggggagcttcctgtcgccttgcgtgggtgtggggcctgggaggaggtcctggggcgtgcacccgccctgggcagtggggaggagagtggcctgagttacttcacccccgcgtgctgctggttaatgtcccgcgtctctgcaccttcgggtgggagcggggactgatctactttcacattctcaagtttttctcatctgcattagaggtgcccagtaggttcccaggttccagcgtgcccctccctcagacacacggacacaatcagccgagaagttcctggtctgaatcacgagaatgtggaggggtggggggtgtcagtggaaaggcataaggctgagctgagaccagttgctggtgaaactgggc

SEQ ID NO: 2794 - DNA, 1124 bp, Homo sapiens
aggctgcccagattcaaatcctgactccgccacttttcccactgtatgatcttgggcaagtcacttcacctctctgtgccttggtttcctcatttataaaatgtggataacaggccgggcgcagtggctcacacctgtaatcccagcactttgggaggccgaggcaggtggatcacaagatcaggagattgagaccatcctggctaacatggtgaaaccccatctctactaaaaatacaaaaaattagccgggtgtggtggtgggcacctgcagtcccagctacttgggaggctgaggcaggagaatggcgtgaaactgggaggcagagcttgcagtgagccgagatagcgccactgcactccagcctgggcaacagagcgagactccgtctcaaaaataaatataattaattaattatttaattaaaaaaataaaaaataaatgtggataatactagtacctccctcttaaggtcagggctggagctagggtgacatctccagggcagaattttaagaggacaccaaaaaagctcagcaaccaagataaaaaatattttaaagcaatattttgttttgggttttttttttttgagatcaagtatcactcgttacccaggctggaatgtagaggcgagatctcagctcactgaaacctgtgcctccccggttcaagcgattctcctgccacagcctcctgagtagctgggattacaggcatgcgccaccatgcccagctaatttttctatttttagtagagacatgatttcaccatgttggccaggctggtctcgaactcctgactcaaatgatccccctgcctcagcctcccaaagtgctgggactacaggcatgagccactgtgcctgaccttacagcagtattttttaaaaatcaaaattaatgcaaaaatccatgatgaggccaggcttggtggctcatgcctgtaattccagcactttgggaggatcccttgagcccaggtgtttgagaccagtttgggtaacataggaagagcttgtctctacaaacaaaaatttaaaaacaatgagctgggcatggaactcacacctctagccccagctactcaggctgaagtgggaggatggcttgagcccaggag

SEQ ID NO: 2795 - DNA, 1210 bp, Homo sapiens
agcctcccaagtagctaggactacagaggcccgggatgtaatcccaacttttttttttttttttttgagatggagttttgctctttttacccaggctggagtgcagtggtgtgatctcagctccctgcaacctccacctcccgggttcgagccattctcctgcctcagcctcctgaatagctgggattacaggcacccacaatcatgcctggctttttttttttttttttggtattttcagtagagacagggcttcaccctgttggccaggctgttcttaaactcctgacctcaggtgatccgcctgcctcagccttccagagtgctgggattacaggcgtgagtcatcacgcctgaccctctaatcccaacttctaacttaccagcggtgtgaccctgtgcaagccgtgttatgtctctgtgcctcagtttgcttgtctgtaaggtgcaaaggctgcgagttgcaacttccgagggtcgaggtgaggggttagcagatcatcaggtggcacacagtgggcactgcggaagtgtgtgttgctgccactgttggcaggaatattgagcctgccccgtgcctcctcaggggccctgtgggtttgcgtcgtcctgagcccccactgcaaaccagaggaaagggcaggctggctccagctactcagcaggtgggacaagctcgacgtctgcccactggaagagggcaactactccttcgacggccccagcctgcagcccaccatggcccccgccccaggtaggagagaggggtctttaccatgccccccaaaaaccatcaccactaactgtggccccacttaccatcatggtcctcttcccaggagagagagggagtggggcagagcaaagcagaccccagtccttggctgttcttccaggactaatcccaacttgtctagccaggaaagagcgagtgccaagggcaggagcaatggcagcccaagtgggcaagtgaagtaaaatgcttaaaacacctgcagtcctgggctggtctggcttggccttctgctagctatgggaccaaagagaggatgagagaggaaaaaaggaggaatcaaacagaaggggaaagtgagatattgaggagagagaaacaagtgaagagaggcagagatggatggagagagggagaggcagacagaggagcagataggaaggaagacagagagagattgaggagagagggaaaaaa

SEQ ID NO: 2796 - DNA, 1399 bp, Homo sapiens
gtggaccgtgatggatgtcgtcgaatattttactgaggctggattcccggagcaggcgacagctttccaagagcaggtgagtttccagcccaggactacacactgacagacacagagggcctccctgggatgtgccctgatcccggctctctctgttcctgtcccacccaggaaattgatggcaaatctttgctgctcatgcagcgcacagatgtgctcaccggcctgtccatccgcctcgggccagccctgaaaatctacgagcaccacatcaaggtgcttcagcaaggccactttgaggatgatgaccccgatggcttcttaggctgagcgcccagcctcacccctgccccagcccattccggcccccatctcacccaagatcccccagagtccaggagctggacggggacaccctcagccctcataacagattccaaggagagggcaccctcttgtccttatctttgccccttgtgtctgtctcacacacatctgctcctcagcacgtcggtgtggggaggggattgctccttaaaccccaggtggctgaccctccccacccagtccaggacattttaggaaaaaaaaaatgaaatgtggggggcttctcatctccccaagatcctcttccgttcagccagatgtttcctgtataaatgtttggatctgcctgtttattttggtgggtggtctttcctccctcccctaccacccatgccccccttctcagtctgcccctggcctccagcccctaggggactagctgggttggggttcctcgggccttttctctcctccctcttttctttctgttgattgtcgctccagctggctgtattgctttttaatattgcaccgaaggttttttaaataaaattttaaaaaaagaaaaagggaaaaaaaagccacggagtccattttatgaatggggtggggagagggcactaaagagcctcctaagagagcctcaggttaggacagaattgtttggggagggagaaaaacagaaacaatgaattatagctgcctcacagccatgtataacaataattgctccaggaaggtgggaatatttgcttttttttcttctgtaatctcaccgtgtccgtgtccagaacagagctaggcacacagcaggtgctcaatttttgtttttcgtttagacaggtttcattctttcacccaggctggagtgcagtggtgctatcatagctcattgtagcctcaaactcctgggctgaagtgatcctcccacctcagcctcctgagtagctgggactacaggtgcactctgccatgccgggctaacttttaaaaatttttgtccgggcacagtggctcatgcctgtaatcccagcactttgggaggccgaggtgggtggatcatgaggtcagg

SEQ ID NO: 2797 - DNA, 1196 bp, Homo sapiens
ggggcggcggcagcaggagggtccccgcagcaccctgcgagcgcggcagccccggcccgcgggcggcgagttcccggtaagtgcggtcccgagagcggagcgcgctggagaggcgtggagaggggggctgggcgccggggacgtctgggtcccgcgcccaatggctggagggcggccgagcgccgcccgcccgccctgcccgccccctctccactccccccggcactcccctccccctcccccgcccgccgctttcccccgcccccgccccgggccaactccgcggcgcctccttaaaaagcgcgcgggagttgtaagggggggccggagcgagccggagtgagcgagagcgcagggtaaagggggcgggcggggggcccgggctccaccttaaaagcgggcgcgtgggggtgggagggaggaaggcgggcggcggggaggagggagggagggaaggaaggggggccggagtgtcccgggcgcagggcgcgcgtgcggcggcggcggcggcggggaggggccggccgcgccgcgctcccctcctccccctcgcatccccggccccgcgcgcgcccagcagaagcgggtctgtgtgtgcgtgcgtgcgagtgagtgagtgtgtgcatatttttttctctcttttctttctctctcactgttttttcctctctctctctctccctctctctctcttttttttttttttttttttgcaaagaaacagcagcgccgccgccgctccgccgaggcgctgcgccccccggggggggaggcggaggaggcgggcagcggcggagggaggggagccggggaggggggcgccgcgctgggagggaggcagcgcgcacggtgcagccgggccgggcgggaggcatggcggggcccccggccctacccccgccggagacggcggcggccgccaccacggcggccgccgcctcgtcgtccgccgcttccccgcactaccaagagtggatcctggacaccatcgactcgctgcgctcgcgcaaggcgcggccggacctggagcgcatctgccggatggtgcggcggcggcacggcccggagccggagcgcacgcgcgccgagctcgagaaactgatccagcagcgcgccgtgctccgggtcagctacaaggggagcatctcgtaccgcaacgcggcgcgcgtccagccgccccggcgcggagccacccc

SEQ ID NO: 2798 - DNA, 1153 bp, Homo sapiens
ccagagcttgagagacaggaagcagggggctgggggcgggggcttggatttctgcccaagacggggaggctgcaagttgggttgcaatgagtccctcacttgggaggacactcattacctccttgctcatggtgaggatgcgagtaggggagatgagtgggcagggtcaggacaggggcatggggaagaggcttccagagggtccaaggcctgcctgggatctccccgtgagctgtcccaggaggttccagtggggaagagttggcagtctctttgcccagaggtgcccagatagctgggtctggctgctgggtgtaagggtggggggtgtggtgtgagctgcagaccccggagggggccctacagatagggctggctcgagggacgtgctggacctcagcctctcagagctactcagccaccagcaggaggagaggggagcggcctggaggccctatccccacctcagtctccctgtcctcccccaggctggtggtccaggccgtggtgcctgccaggtgatgtggggcaaagccccccgcacaggccactgagagctccggacacgcacccggctgccaccatggcccgcctagccgcagtgctctggaatctgtgtgtcaccgccgtcctggtcacctcggccacccaaggtaggtgctgctggggccggggaggggccgcggctcccaaacccttctggggggggcagataaaatgttgaaaaccctcctgatcactcagtaaagaattacagccccctgccccgccccagacctcagctggagcaggccagtggaagactcaggggtaacacacaccccagtgccaccaagaggcccctggaccatcctcttacctccaacaagtcggctgggccaggttggtaggggccatcccgctgtggcccctgggaccaggacaggccttcttggtgagccgatgctcctctctctgtctctctctcgctctctctctctctctctctctctgtgattacatcttcgaggctctcactgggaagaaggcttaattaaagcatgcccgctgacgtttatttaaaaacaactaattacccggctcggccctatgccggccctaggatcctgcacacgccactattagtgccccaagcctgcccgcccaccctcac

SEQ ID NO: 2799 - DNA, 1100 bp, Homo sapiens
ccaagatcgcaccactgcactccagcctgactctgtctcaaaaaaaaaaaaaaaaaaaaaaaagaacccctcttgttgtggagaagcagaatgctattgccttccacacatggttgtcaggtgctctctacacagtgcctaacccctctaaacattcggtacaggcactgagattgtgcctggtcttcccagcatccttttgataatcaggaacccaactgagaaagactgaaacaagtaaagaaatttattggtctggatctgaaaagtccaggagtgtgctaccttcaggcatggctgtatccaggtgctgagatgacgtttctcagttctgcttccctctgtatgggctttggttgccatctgggagtctggagtaagtggcggccatggtctctgacttctatcccccacccctccccagcctgatgtgtgagaagcggatattggcggcagtgaccagtgcgggacaccccttcctggtgaacctcttcggctgtttccagacaccggagcacgtgtgcttcgtgatggagtactcggccggtggggacctgatgctgcacatccacagcgacgtgttctctgagccccgtgccatgtgagcctggaccccagcccgggcccctgcctcccctacagcatctgacacttagtccccccgagaggctggcagcctgcttctcacccctccaccctcaggccttgcttccctcagcctcccagagctttggggagactggggggcttttgaggatgtggaagccaggcttatgtgaccctccctccttgcagggtggccccacccctctcagcagcctctctctctctgcagcttttattccgcctgcgtggtgctgggcctacagtttcttcacgaacacaagatcgtctacaggtgtgtgcgtgtgtgcatgcatgtgcacactgcccgttgtggggacaggacccagacccccgctcatccctctttccacccctccaacccccaacagggacctgaagttggacaatttgctcctggacaccgagggctacgtcaagatcgcagactttggcctctgcaaggagggtgaggggctggcctctggattagacaa

SEQ ID NO: 2800 - DNA, 1126 bp, Homo sapiens
ccgcctcccaggttcatgcagttctcctgcctcagcctcccgagtacctgggattacaggcgtgcaccactccaccacaccaggctaatttttgtatttttagtagagacggggtttcgccatgttggccaggctggtcctgaactcctggcctcaagtgatcctcccgcctcggcctcccgaagtgctgggattacaggcctgagccaccacgccgggcctccacttttcctaatccggcttctccaccaggctctcgcaggtgatccctcctgagccccagtccccccaccccacttgtcctctgtatgctcactcctctccgtggtccccgagccccaggactggtccccactgcagcacgccccctcctcagcctccaggctgaccctcccctccgcttccctcccctgcagactctgggctgggaagccctgttggcccggcgcctgccaccgccctttgtgcccacgctgtccggccgcaccgacgtcagcaacttcgacgaggagttcaccggggaggcccccacactgagcccgccccgcgacgcgcggcccctcacagccgcggagcaggcagccttcctggacttcgacttcgtggccgggggctgctagccccctcccctgcccctgcccctgcccctgcccgagagctcttagtttttaaaaaggcctttgggatttgccggatccttgcatcctccgtgtcttcttgtgtgcagtcattgggggtgggggcgtgcttggaggtgtggacgtttgcggggcaggtggctgggtggtcgtgggagtctcgactgatgggggtgtcatctgaagaggatcaaggggcggcgtggactcggggctgttcttatggtggggagcgtgggtgagccgagatgggagggggcgtcgggattgtgttggggggcgcccaggggcgtggggcaaaatggtttggggatagggttttggggctgtattggaagagctcaaagccgcagtgagcagaatggtttcggaagtccgttagggcagcggcaaggtcaggaaacgccccacacaccctctgtctctgctcccagcggagccccagccccggccgcccgcacggtgcgcttgctcctgcggctctggcg

SEQ ID NO: 2801 - DNA, 1151 bp, Homo sapiens
agacagcctggattctagtccacttctgccacttcccagctcccagggaccttccttgggcacatgggccgcagtttgcccatcagtaaaatggggatgagctgaacaccgataccaccttctcagggttgtcctgaggtctaaatacgaatatatgtaaagtggtgacaatggcagtccgtccaattactatgtatattcacattgttatgatgtcgctgtcacccctccctggcccccagccctctgcctttgaagagaaggccattgagaaggtggatgacctgctggagagttacatgggtatcagggacacggagctgggtgagtgagggctgcctgggggagggggcatctaggtctgctgggggccgaatccaccctgagccccttggtccctggtgtcatttgtgcctccgttctgacccctcccccaatagcggccaccatggtggagctgggaaaggacaaaaggaacccggatgagctggccgaggccctggacgaacggctgggtgactttgccttccctgacgagttcgtctttgacgtctggggcgccattggggacgccaaggtcggccgctactaggactgcccccggaccctgcgatgatgacccgggcgcaacctggtgggggcccccagcagggacactgacgtcaggacccgagcctccagcctgagcctagctcagcagcccaaggacgatggtgaggggaggtggggccaggccccctgccccgctccaatcggtaccatcccctccctggttcccagtctggccggggtccccggcccccctgtgccctgttccccacctacctcagctgggtcaggcacagggaggggagggatcagccaaattgggcggccacccccgcctccaccactttccaccatcagctgccaaactggtccctctgtctccctggggccttgggttctgtttgggggtcatgaccttcctagtttcctgacgcagggaatacaggggagagggttgtccttccccccagcaaatgcaataatgccctcacccctcctgagaggagccccctccctgtggagcctgttacctccgcatttgacacgagtctgctgtgaaccccgcaacctcctccccacctcccatctctccttccaggccc

SEQ ID NO: 2802 - DNA, 1247 bp, Homo sapiens
ggcctggcatgcggcgaaaagttcctggagaaggcctccccctccccaaaacacccgagaaacgtggggacctcattattgagtttgaagtgatcttccccgaaaggattccccagacatcaagaaccgtacttgagcaggttcttccaatatagctatctgagctccccaaggactgaccagggacctttccagagctcaaggatttctggacctttctaccagttgtggaccatgagagggtgggagggcccagggagggctttcgtactgctgaatgttttccagagcatatattacaatctttcaaagtcgcacactagacttcagtggtttttcgagctatagggcatcaggtggtgggaacagcaggaaaaggcattccagtctgccccactgggtctggcagccctcccgggatgggcccacatccacctccagtccctggccaggggtgagaggcagaccagcagatggacttgatccctctgtgtctttttgcttctggctggtagataatgtcaacctgcagtcttgattcccagaccctgtacactcctccttttctgttgtgtgatcagtttgtgctttattctgtatttgtctcccatgtcttgctcttctcctggagaattctgtcttctctttggccatctcaaattgagaacctaaactattcctgcagaactgcctggttggcgtccacaagcaatacctctcgttccagcaggaccaagggagccagcctccagtgagtgactccagcaagtgcagccacctctcccttgatggtctgggagcctggcctcagcaaggggccttcctgacctctggctccagtgaagctgaatgtcctcactttgtgggtcacactctttacatttctgtaaggcaatcttggcacacgtggggcttaccagtggcccaggtaattttttgtttcatggactatggactctttcaaagggatctgatccttttgaattttgcacagccctagatacaatcccttttgataaaagggtctttgcttctgattacaggagcactgtggaacgtctgtaaatatgtttttataattccatgtatagttggtgtacactcaaaacctgtccccggcagccagtgctctctgtatagggccataatggaattctgaagaaatcttggggagggaaggggagttggaacaaatgtctgttccctggaggccagtccagtgctcagacctttagactcattgtaag

SEQ ID NO: 2803 - DNA, 1461 bp, Homo sapiens
ttttcaaatttagcaaactcccttctgtcatgaattatcattaaaagcttccatatcagcagtaatgcaaggccaataagaacaattccagcaaccacaccagctacaattggaatgatgtctggaccagtgggacactctggattctccacaacatgaaccatgacctcgttgttcccattcactgaatacgtaaaatagaaccaacagtcgtcaacatccttctccttacaatgggacacaggatcaggttggaccggctggggtaatttgtcccgactttctaccttggtaatgttaaaataggaacattcctgtgtgcatgtgtctttcttttctcctttattgaaggctctgcactgaacacattctttatgctcagcacagacaccaaggcaggtctgacacatctcacacgtttgcccttgaaacttcggatctgtacacttacagacaccacactcgcagatgccccggccattgcagatctgtccgttgctggcttcacaagtactagtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttttgctaaaaagtccttgatttagcactatttacatacaggccatactttacaaagtatttgctgaatggggaccttttgagttgaatttattttattatttttattttgtttaatgtctggtgctttctgtcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttc

SEQ ID NO: 2804 - DNA, 1124 bp, Homo sapiens
cacccttacctgaccccatcccccgaatcccctgagcactgggccagcccctcacctccctccctctcagactggtccgaatccacgcctagcccagccactgccactggggccatggccaccaccactggggcactgcctgcccagccacttcccttgtctgttcccagctcccttgctcaggcccagacccagctggggccccagccggaagttacccccaagaggcaagtgttggcctgagacgctcgtcagttcttagatcttgggggcctaaagagacccccgtcctgcctcctttctttctctgtctcttccttccttttagtctttttcatcctcttctctttccaccaaccctcctgcatccttgccttgcagcgtgaccgagataggtcatcagcccagggcttcagtcttcctttatttataatgggtgggggctaccacccaccctctcagtcttgtgaagagtctgggacctccttcttccccacttctctcttccctcattcctttctctctccttctggcctctcatttccttacactctgacatgaatgaattattattatttttatttttctttttttttttacattttgtatagaaacaaattcatttaaacaaacttattattattattttttacaaaatatatatatggagatgctccctccccctgtgaaccccccagtgcccccgtggggctgagtctgtgggcccattcggccaagctggattctgtgtacctagtacacaggcatgactgggatcccgtgtaccgagtacacgacccaggtatgtaccaagtaggcacccttgggcgcacccactggggccaggggtcgggggagtgttgggagcctcctccccaccccacctccctcacttcactgcattccagatgggacatgttccatagccttgctggggaagggcccactgccaactccctctgccccagccccacccttggccatctccctttgggaactagggggctgctggtgggaaatgggagccagggcagatgtatgcattcctttgtgtccctgtaaatgtgggactacaagaagaggagctgcctgagtggtactttctcttcctggtaatcctctgg

SEQ ID NO: 2805 - DNA, 1192 bp, Homo sapiens
tgcagaatatctccccgaggtgttttctgaatctgtaggctctgagaacatgtaggattcactcctgtggcataatttacagaagtgtttcccttgtggactgctggttctgaaaagctgacatccccgcaatcatgggcctcctgagctctgcttacaccacgctgaccggtgtttcctctttggccagggtgaggaccctttcaccagtgaaactgttgatccagaaatggaaggagatgacaatttaggaggtgaggataagaaagagacacctgaggaggtggccgcggacgtcttagcagaggtgattacagcagcagtgagggccgtagatggggaaggagcgcccgctccagagagcagcggggagccggctgaggacgaaggccccacggacacagcggaggccggtagtgatcctcaagccgaacagctgctggaagagcaggtgccctgtggaacggcacatgagaagggcgtccccaaggccagaagtgaggctgcagaggctggaaatggcgccgagacaatggcagcagaggcagaaagtgcccaaaccagagttgctcctgccccagctgccgcggatgctgaagtggaacaaactgatgcagagtctaaagacgctgttcccacagaatgatgctcatttccctgttccagggaaggcgttgggatgatggatgcgttggtctttctcccttggtttgtaagcagtacaagggcgtgtgctcccagaatatgctgtaatctaattttggtgaagagacccagcgtttcctcctgagcagtgcctctcacggcttgtctcatgcagtcgtgtggcttcttgcccaggtttcaaagctgaagtacattgtccttagcggctgtaacatgtctcttgacagtagtgcacttggaataataaaggttgggtgattatatcttgatgatacattacttgttcaatacagccactgatggaatgcttccttttttatttttttccttaatttttttttttatttggttgggaacagctgaatactaggaatatatcttgctctatagaggatttttttttgtatgtttcaagcttcagcctttaacctatacctttgtagtgcaccatatggtgtgtgactttcacaggacttcgcagcacctggttcacatgtggcactgaccgcgtcacatccacgcactc

SEQ ID NO: 2806 - DNA, 1202 bp, Homo sapiens
catctttgcatttatctcttaagattgcctagcttttccagtttgttagtcttggttgcacagtctctggagccttctattcttggaggctggcgttttgagattcgcttctctgcatagggctgatctcaggatgactcggcagagcctggctggtttattctcttccttaatctttgccatttttaagagctcacatttggttccctttgcagttggctgctgaacagttcaagaaaaccagtctccatgtggctaagagtgttttgaacaacagacatatagtgaagatgctggaaaaatacctcaaggtttgtgcttgcaagtaccacagacaggaaaagctttcaaaagggaagatgaaccccaggagcagggagttgaatccagagtgcagcatttagcatttctgagtcttttgacagttgagggacactggaatgcatcaagctcaggaacatgacaactgggatttctaatgagtcagtgcttgcctggggactctggggatgtggcgctgcttgattaatcagtgcgtaatggatttttaccatgaaaaatcctgattgtttagccttaaaattctgagcaaatgatggttaggtgattttttaagaaaaacccaaggctagccctactcgggaagctgggatgggaggattgcttgagcccaggaatttgaggctacagtgagtgatggtgttaccactgcacttcagcctgggtaacatagcaagactggtcttgaaaataaaggaaagcggggaaccgggaattatggctcatgcctgtaatgccaatagtttgggaggctgaggcaggaggatccctgagctcaggagttagaggagttaacgattgcgccactacactccagcccaggtgacagagtgagaccccatttcaaaaaaaaaaaaagaatccaaggtacatgagaattttccaggagagaagctaaaaagagatttcattgatagagccaactgacagtgaggttgaaggtgaggggtagtgaagaaccagagccttcatgatgggagcagcatatcgaagtcccaaagtgggtgctcatggagagaaggctggttggaagagctcccagttcttccttgtgaaacccattttgctcagtgttcatcccaggactttagcatttggggcaggtggctaagtcccagcccacaacctgacttcaggacctt

SEQ ID NO: 2807 - DNA, 1180 bp, Homo sapiens
acctactccttaacaggaggccctcatcagaatgaccagggcccatctagcttcagtggctagggtcttctctctctgtgacagaagatacccttgtatctgtgtttgtctctgtctctgtctgcctcccctctgcctgcccccaccatctgtctgtctctgtctccctcactgcaggctacgagggctatggctatggctatggctatggccaggataacaccaccaactatgggtatggtatggccacttcacactcttgggaaatgcctagctctgacacaaatgcaaacactagtgcctcgggtagcgccagtgccgattccgttttatccagaattaaccagcgcttagatatggtgccgcatttggagacagacatgatgcaaggaggcgtgtacggctcaggtggagaaaggtgagtggacacctgcctaggggttgagactctgcaggggcggctcctgcctgctgcccactgcgttttcctctctgagtgcccctctgtgtctgcttcctccccgctgcttggtgctgctgtggctcccagcagggtccgttgcacttcccgtctctgacttgtgtctcctctcacccaccctcaacccctgccgcactgcctggtggtcagcctttcccagcttgcggtgagaggaacaagcccagactgggcagacttcactgtgccctcaaaaacagagtgttcagccacccctccctccaaggacagccatttggaattctctcgagactttgcctcctgcgtggtgtcagggcaggacagatggagtttggtgtgaagggtgggacgagcgtttggggctgatcactgcgagctgggccacccccacgtaagggtcggggcaggtgtgggcatttcctggttactctcctgtgccttacaaacatgtacctgatggaagcactcctgtgaggaactgctgctgtcctcattttgcaggtggggatacagaagtgcaggcaggtcataccctgaaggcacgcagcaagtacttggtggggctgggcctcgcctaccagatctgccctactccaaagcatcatgctgtgggcatttgttattaactgaactggacttggcccaggagtgcttatgcccagtgcgaggctttggtgaggagcgtgggtgtatctctaacatgggatagagtggagcacc

SEQ ID NO: 2808 - DNA, 1202 bp, Homo sapiens
gacagatcacttgaggtcaggagttcgagaccagcccagccaacatggcgaaaccatgtctctactaaaaatacaaaaattatggtgacgcctgcctgtagtcccagctactcgggaggctgaggcaggaggatcgcttgaacccaggaagtggagactgcagtgagccgatatcgcaccacagcgctccagcctggtcgacagagtgagactccatctcaagaaaaaataaaaataaagttgttctctgaagagcaaatgtctcattccagtaatgacccactcagcaggaatatggtggagttcagtccaattcaggtcagccatatccaaaagaccacaagtcattactaagttgagcaaaagagtttttatctattagcagaaagggcctctctggcagcagagattaaaaactggcccaacttcatttccatacttcagggaacagcaaattgaggatttacttatctaggacttgaattccttctttgggaccaagttaataaaagaccaagaaactcctgattaaactggataatgaaggattctgtagacagggctgcacgtatcggctttgtttgacttctcttttctcagttaacatctcagagctagaacattccacattccccagcagcgtgtgggggctgactaaagtttacaattccaactaaaaatcaccctgcttctggcttatctgaatcccttacccaccccaccccaccaccctactcctatttattcagcaccacactacccaggaaatacactagcaaattgtgcaatggaataaaatccacactttagattcttgcaactgtatcatatgtaatagtatcactttttctacattttggtcaaataaatttttacataaactacaatttgcgtgaattttagaatgtgtgggggtacacagagcattttggttcaacaaatgttaaagggatggaaagggaaaataaccagagccaagaatgtagacaaggttatctatttgctttatactgtgacttcatgatacaaggatattacagtctcattgcaggcgagagcactcagcctcggtcactcgaaaactcctggccttccttatcccctacgctgcctaagccaggctgtgaagaatgagtaggattttaagagataaaagcagggaaaatcatctctgttgcctgagttaggaagatctgcctagc

SEQ ID NO: 2809 - DNA, 1151 bp, Homo sapiens
ccagctccggacccagtgaggggctgtcgcagccaacaccccggcctcggggctcctggtggcagcaccaggggacacacctgccaaacccaccagatggaggggccctccctggtctctggccaccctcccagcctctgcccagggacccctgccttccccaggccatctgctctgccgtcgacactcgtctcagaagcccctttcccagaagaggctggtcttcaagaagtctcgtttctttgcccctgaagtcagtttcaggggaaggatgtgaaatttttccgtgtagaggttacagccttttatgctgttgagctcccaggtaccaaaaagcttggccaacgcttgccagccagccagctgcaggtggcatctgccacgaaggaagcgccagcctcgccaggccagcaggggcgtcgttttgttgccattttgttgaacgttatgggtttatgggtgttcctggaacttgtctttgtgcattcgttgctgtttgtgttaccctcactgtccccatgtcccacccacgtcctacggcactcaggaagcacttggtgaggacgagccctcacccttcttgtcttccttcccggcagcgcccgcagcgggccatttacacgtcgaggctggcacctggcgcgctcgggggccactgtagcgtctgcctgctccctggactcgcaggcctcgcctgtggcgccttcccagggccagcctgggtcacgagatgctgtcactcagccagatcagtattgacccaccaggggaggtggggtttggtgagagacgccagcctcagactttttcccactgagggtccagagagcggggccacgtgtcacccacgtctgcgcttggtcacccgtcctccccaccctgtgtgtgtttatgtcatagttacattaaattccattcattgaatactccacagccttcctctgatgcagcgtggtcccaactcctcctgcgtgaccacagggcttgcctggttttgtcgccgaccttccctgtggccccacgaggtgtcaccagctccctctgcttccccagctgaaacacaggaaaagcagctgcgggaagaggcagctgcagtgctggaccatgggccaccactcctgggccacacagaggaggccacagaggcagag

SEQ ID NO: 2810 - DNA, 1174 bp, Homo sapiens
cctgggcgagtgggtgtccgttgccagatggatcctaaacaccctttatttcatagacgggggctgggggtattgaagtgagcccctgtcaggcctggagttactggggagcttgcagaaagctcaggtttccctgtccaggttggtggcctctttgtatcacagtcaagtcaccatgaagcaacagcacgtcgtgggcagcacggtctttgtggctggcaggaggtggccagggactcagtccctggggcggccaactcagttctgccttacaggagacagagcctccacgcagttcccaaatgcatccatgctgttccatgcagtttcacactgttccatcttccacaggaaggtctgcaaagacctgaattccttgcaccctggggtctccatttgaaggcctgaagcaccaaaggtagggctgactctgtggtatgtccctcttctttcaataaatatttttagagcagtggtggagaacggagccctgtcccaggtttgaaataaaacccaaacctggccgggcacagtggctcacacctgtaatcccagcactttgggaggacgaggtgggcggatgacttgaggctgggagttcgagactagcctggccaacatggtgaagccttatctttactaaaaatacaaaaattagccaggcatggtggctcgcacctgtaatcccagctattcaggaggctgaggcaggagaattgcttgaacccgggaggtggaggttacagtgagctgagattgcaccactgcactccagcctgggtgacagagccagactccatctcagagacagacaaacaacaaaacaagacaaaacacaaacctctcactgaggccctcaaggctctgtggtctggccccggccaccctgtgaccccatctcctcctgcacaccagcctccccaacacaccagcctccccacagttccatgatcacaccaggcatggtcctgcctcagggtcttggcactgtctgttccctctgctgcaaatgctgttcccttcagccactcctttatctcctgctggtctcagcttaaatgtcacctcctcagagagaacctccttgaccttctcggctaaaatgaccctccgggtcccacctaccatgtcatgacctatttttctccatcacaaagatttcactcaatgttat

SEQ ID NO: 2811 - DNA, 1127 bp, Homo sapiens
acaaaatggtgacattgttaataaaagccagaaacaaaacctgctttatctagagtttcttgaatagcccttcatttattttctggtggaaaaatattaaacgctgatttaaaaaaaacagaactcttcacacatgactcaggtactctgtcttgggtagggaagagttaggtaagtggggtgaacggcagcttgaagaaatgactgttctctttctgaaattcataattctatttcctgtgaccccaacccgcaaagggctcgttttttcgaaaagcataaaaaaaaaaaaaacacccaaggtttcaaggtatcatttggcttagcatttctggtagttccagaacaattgttaacttcagttttaaaatagcgccagccattttatcaccctcatctcctggtgggaaagcaaattccacccaggcctggatgcagccctgttgttttctgttttttttttttttttccctaagtttttggtttttacatatttggagatgagtctcgctctgttgcccaggctagaatgcagtggtgcagtcacagcttcactgcagccttgacctcctgggctcaagcaatcgtcccacctcagcctcccacgtagctgggacctcaggcgcgcaccaccacatctggctaattttaaaatgttctgatagagacaaggtctcactttactacccagtctggtctttgaactctgggctcaaatgatccttctgcctcaggctcccaaagtgttgggattacaggcatgagcccctgtgcccggcctgttttctgtttaaaatcacttttcccactgcaaataccccagtttttttccagaggaaatgatcagatagtgtacttcagccactctgaagggatgggttgagtgaagacaggacccttaattgtttttgtttgtccccttgggtcgtatcattgtctaaaatcatccataaccagctctcctctggggactcaagatgacgtctctccatgttcacggcattcgggggctcagccgatcagctggtggtttctgggttcactggatcttgactatttgtgctaacttagaagagggcacagctgcttcctctggtttgaatgattccacttccctgagcaaatgc

SEQ ID NO: 2812 - DNA, 1261 bp, Homo sapiens
ggtggtcgatcgtgtggcgccggaggacgttccccgcggccggagccatggagatgccgctgccccccgatggtgagacccaaaccggccgagagaccgtttctctctccccggaacctcctattggccggccccgcctcccggagtccccgggtctgggagggggcggggctcggcctcgcggcttcgcctgcggcctctcccgtgggtccccgcattcccggcgagcgtgtggcccctatcgggacccgtacaagggcggcctcttcggggcccacccccttggggtccccggcaaggcggacgggggctggggcgccgagtcccccggctttgggcggtcctcgctgacgccccgcgtggccttttctccgtcctccagaccaggagcttcgaaatgtcatcgacaagctcgcccagttcgtggctcgcaatgggcccgagtttgagaagatgactatggagaagcagaaggacaaccccaaattctcgtttcttttcggaggcgaattctacagttactacaagtgcaagctggcgctggagcagcagcagcgtgagtcccctccggcactcaggccgtcccatcgagcgcttcctttctcggattccagtccgggctctgccacaaacctctttctttcgggtcgtttattctttgaagtggagcagctcggtccacacgatccctgttccgctgttcccacggccctgcacagagcggctgctgggtgccactgtaatggagaacaacgaggttttcgatcctcccccctgggctctggatcagggattttgctgttgttttgcagactgatgacggagattagcaggagtagcgtgattgttttagtgttttctagggaggaagtgatagaggccggatgggagtccatgggacaggcactgtccagccccctttgccgtctccctgtgggtccagcaaggttttgtgcatttcagatgcctgcagcagaaatcaaaaagaattatccctctgagttttagttattggcaagtgtttatcaatgttcgttcatttaggcaacaggattccagtcctgctctaaagaagtttaaagttaggaagcagagctggcctttgaataatggatagtcaccaggtggtgcggctgctcagggcaggtatcacatctgtcacgttcagtacccaaccccgtctctagattgtttaaatgaataactaggagtttgccaggtagatggacattgagaggtggttgtccgctgtttgatcgaa

SEQ ID NO: 2813 - DNA, 1171 bp, Homo sapiens
ggcggcggcggcccgggaccgagacccggccccggctcccctctccgccaccccgcgcgcccccaaccccccggcgccgcggggaacatgcggctccggctcccggaggccggcgagtgagtgacccccgtcccccgcctcagcccgcccgcccgctggcccggccgcaaccccccgcctcgcccaggcaatgacagcggctccggcgtctccgcagcagatcagggaccggctgctgcaggccatcgacccccagagcaacgtaagtacccgccgcgcgagctgggacggaggccgcatgggcccgggaccctccccctctcctgtacccctcgcccaccgggcttcgggggacccgtctggcgcccacctcccctcgagggccgctgccatccctgcctctcgcttctcgggcccgggccgggggcaggtcgggcagcccggcagcgctcggtacgtgaggccgaggcttccgtgcggcctgggcggaggaagcagacgggggagctgaggctagagtttttcctccctttctgctccagctctacgaccctcactgctctggacgaagcttctctgcctcgccctccctccgggacccgagacccccgggaagccctcccggagcgggaaggggagggagaagggctgtgaagcaactggtgtccggggtatgactcggggaacctatgtctcccatgtcttggcctcctgggtgatcagggaagtccttcttccccctcctctcggctggcagcaccttcctggcttcggagagaacccccagtctgttttgcccctggccgggtacctagggtacgtggagagtctgtctcccttctgtgactagacacgcctttgccaaaaccctcttggggtcgctgccgacgatagatgatctcggggagggtgggatccttcctgttgcctttctgggcctcagtacccattgcgtctctgaccaagccagagctccattttttaggtagtgaattaaagaggacttttctctcccgtttacccaagagctctgtttcagtaggctctttccctcacctgggggtctcagcctggtggtttttgacccagactgtcggggttaactccagagtgtcgcttcctcgggtgcccctttgctgaggctactgtttgcggagggaccgccccctcc

SEQ ID NO: 2814 - DNA, 1178 bp, Homo sapiens
gacggggtttcaccatgttagccaggctggtcttgaactcctgacctcaagtgatttgtccaccttggactcccaaagtgctgggattacaggtgtgagccaccatgcccggcccagagtagcaatttcaaagtactcccaggtacaagctggcccgtctcaccaagcctcagtctcctcttgacaatgagactcctgataataaaagccatcacttggctgggacactgatgaggatttattaagtcctaaatgtgaactagtgtcatcatcattgccacctctctgggcatgaaggaaaggactcccactcggctctctattttctctgtgcaacctcaggcatgcgtacagcctctctgaaccttggttcctcctctgaaacttacaaactgcacagtgttgggtgggcgctctggattaggataggctgaccagagcatatgggagtgaagcctgcccttggcatgctggtgatgatgggggacactcctgtgcctcccaggagcagtcgaactgtcccggcgccaccccatcgcgtcctggctgtgcgccatgctgcattgcttcgggagctacatcctggctgatctgctccttggggagccactgatcgattacttcagcaacaactccagcatcctgctggcctcagctgtctggtaagccatgctgggcatgggagagcagagccgggtgggggaaacaacaacctgggcaccagggaggagagaggttggaggaattagaatgcaccagcaacagccctcatgatggccctgaatatgctgccctccatgcccatctctggtctaggcacagcacgttggggagggtggtctgatataaccacagctccctacccccatccttcacagtctgcccatcccctggcactcactgttctctccccaaaaggtacttgattttcttctgccccctggacctcttctacaagtgtgtctgcttcctgcctgtgaaactcatcttcgtggccatgaaggaggtggtgcgagtccgcaagatcgcggtgggcatccatcacgcccatcaccactaccaccacgggtggttcgtcatgattgcaactgggtgggtcaaaggtaaataggatgatgacaatgaaaaatcatcccagtggagaacttttggttcagtggtactaccaggcaccccag

SEQ ID NO: 2815 - DNA, 1261 bp, Homo sapiens
tttttgggcgagcctagtcgggtggggaactccagcatcgggtcaggtgctatctgcccaggagtgggactccacatgccccttaaacttcctcccaccattctgaccatgcctggctctgacctcccttctagctccaggacacgcgcgccccgagcctgggaggcatgctgaagccaggcggccggcaggatgagtgtgaaagaggcaggcagctcgggccgccgggagcaggcggcctaccacctgcacatctacccccagctgtccaccaccgagagccaggcctcgtgccgcgtgactgccaccaaggacagcaccacctcggacgtcatcaaggacgccattgccagcctgcggctggacggcaccaaatgttatgtgctggtggaggtcaaagagtcgggaggcgaggaatgggtgctggacgccaacgactcgcctgtgcaccgggtgctgctatggccccggcgggcacaggacgagcaccctcaggaggatggctactacttcctgctgcaggagcgcaacgcagatggaaccatcaagtacgtgcatatgcagctggtggcgcaggccacagccacccggcgcctagtggagcgtggcctcctgccacggcagcaggcggactttgatgacctgtgtaacctccccgagctaaccgagggcaacctcctgaagaacctcaagcaccgcttcctgcaacaaaagatctacacgtacgcggggagcatcctggtggccatcaacccctttaagttcctgcccatctacaaccccaagtacgtgaagatgtatgagaaccagcagctgggcaagctggagccacacgtcttcgcgctggccgacgtggcctactacaccatgctcaggaagcgcgtgaaccagtgcatcgtgatctcgggtgagagcggctccggcaagacccagagcaccaacttcctcatccactgcctcaccgccctcagccagaagggctacgccagcggcgtcgagaggaccatcctgggtgctggccctgtgctggaggtgagcggggaagctggtcggtctgtgggagggggcatttgtttggaaaatgcgggtttcaggccaagctcggtggcccacatctataatcccaatgctttggaaggctgagggaggaggattgcttgagcccaggagttcaagatcagcctgggcaacatagcaagatcttttctctacaaaaaaaaaaaaataattagccaggcaggcatagtagtgctcacctgta

SEQ ID NO: 2816 - DNA, 1163 bp, Homo sapiens
actttgggaggccgaggcgggcggatcacctgagatcaggagctcaagaccagcctggacaacatggtgaaaccccatctctactaaaaatacaaaaattagccgagagtggtggcacatgcctgtaatcccagctacttgggaggccgaggcagaatagcttgaacctgggaggcaaatgttgcagtgagcccagattgcgccactgcactccagcctgggcgacagggtaagatccggctcaaaaaaaaaaaaaaaaaaaaaaaaaaaaatagggcctcactccgttgcccaggctggtctcaaactcctgcactcactaaaagaaaagaaaagcaacaacaaactagtaggctcaaacgatcttctctcctcagcctcccaaagcactgtgcttaaaggcgtgagctgggccctcggcctgggggttggaaattgaagcctctattttatgtatttatttattttctgagacagagttttgctctgttgcccaggctggagtgcagtggtgtgatcatggctcactgcatcctcgaacttccgggctcaagagattctaccaactcagcctcccaagtagctgggaccacaggtgcaagccacccacgcccggctagttttttgtatttttttgtagggactgggtttatccaagttgcccaggctggtctcgaaccccagagctcaagcaaccctcctgcctgggcctcccgaagtgctgggattacaggtgtgagccaccgtgcccggcctaagcctctcataaggccgtgctccctgccagaggccacccttgaagaagattccctgagacttaatgacctggggcaccccggactttcttaatcgtagctccacccactcgagccgggtgccttcgcgtttcccgtttttaaatgagatagtggcacacccggtggcatcctcccacccgggctcttatcggcggtcccagaccctgcttgagcgcctccgggtgtcaagggcccctgaggacactaaagctctcgaaccccgatgtggacccccgtgcggcgcggggcagcctggctgggaaccctgctcggccctggagaggggccccccgagccgaggggaggagcggcgcatgcccacaagccccccgcgggaagtaggaaatcgaccgaccaggcggtgcg

SEQ ID NO: 2817 - DNA, 1196 bp, Homo sapiens
tctgggctccggaatcgcccgcagccggtactgcgggacccactgcggatatggctgtcttggctggatccctgttgggccccacgagtaggtcggcagcgttgctgggtggcaggtaagtcctcagggggacccttccccaaatcagggaataagggcggcttcggaggctggcgccactcttcactgcccgcgtgacctgccagtgccttgcgcattttgcagccaggctctgtctccgggagccgaggctcagagaggttgagcgccaaggtcacccagcgccccgtctgacctttctcgccgtccctctacccacgcaggtggctccagccccgggcctggctggggttcccagacgcctggggcctccccaccccgcagcaggcccggggcaaggctcgcgggaatgagtatcagccgagcaacatcaaacgcaagaacaagcacggctgggtccggcgcctgagcacgccggccggcgtgcaggtcatccttcgccgaatgctcaagggccgcaagtcgctgagccattgaggatcgcgacgcagtcggcgggaccctcatggaagcatcgccctcgcctcggaccttgcctggcgctatttttgcagggagctggggagcaggaacgcctcggacctgagtgctctccatattgtggggttgaagtctggatgggagcttgccaagtccctttttaggctttttaattaggaagcatttcgaacctgcgcaacagaccaaagaacagtacaaagaacatccgtgtacccagtaccctgactaccgactacctacaacccgtccctgccccatcctgagttcttttgaagctgatctcaggcatcggattatttcttctgtaaatatttcagaatgtatctctccaagatgagagctcattaaaagacaattacaaagcttatcacatccaaaagaattatcaataattttgaaatattattaaacgtgtaataaatgttcaaagttccacttgccttatatgtgtcataactcttttttttttttgagacagtttcccttttgttgcccaggttggagtgcaatggggggatctcggctcattaaaacctccgccttgcgggttcaagcgattctcctgcctcaccctcccgagtagctgggattacaggcatgcgccaccacgcccggctaattttgtatttttagta

SEQ ID NO: 2818 - DNA, 1602 bp, Homo sapiens
cgggagcagcaggcactgagccgtgaggccaagaactcggacgtgctccagtccccactggacagtgctgcccgggatgaactctgaggggtagcagccagaaagccaaagcagccatcggtggcccaggctccacgtgcttactgaggacatcaggtccacctctggaccccttggcaggccacagagggctctcgtgtggggtggtgtccagccagctcttgctaagcaatcacgtgcacacaggcagcattaatggagtgcctactgcatgccagcaacagggcttggccctggggaattgggaggaaccaagccctcttcatctgttcatgtgcccagcatttattaagcacctgctgtatgcaaggttcccatgttacggcagtgaatgaggcataattgttccctccatcagcgattgattcagtcatcaagcagttactgatcagattaagaatcaggcactagtgatacacattcatttttaaaattcattcaaggatttattgagtgcctactgtgtgttgggtgccattccaggctctgggatttttttttttttttttttaagagtagagtctgtctctgtcacccaggctggagtgcagtggtgtgacggctcactgcagcctgcgcctcccagcgtccagcaattcttgtttctcggcctcccaagtagctgggactataggtgcgtgccatcacatctggctagtttttgtatttttagtagagacggggtttcaccatgttggccaggctggtctcgaactcctgacctcaagtgatctgcccgccttggccacccaaagtgctagggttacaggcatgagccactgtgcccagcccaggctctgggaatattgagataaataagatgcttctatccatttattcaagcacatattggtcacctactgtgtgcctggcactcatgtcacaaagataagttcctgattcggtacacttactgagcacctgctgtgtgcagggagctgagctatgggatgggaatgggagtaaacaaggtactttttacttttttctttttttcctcactgctagacggtgtgggaacttctcactcattggcttctttcccacacacctgaagagcactgactgtgtgccgggcactagtgatacaaaagagtgtgacagttgttcagtctgcattttcgatcatgggctacatgccgagtgctggggcacagagatgaacaagatcggttccttcacttcttcatgccacaagtgtttattgagcacctgtgtgccaggcctcacagactcccagttgggttgaagaatggttgactgagtttgattcttcctgtaccctcggtcgtctgagctgtgtgcagacaacatccccccaccacccaagagggagggtagctcttccgccaccaggggcaagcacaggtcctggtggccccacgccacatgttagcccccctggagggggcgccagttggagacgggggctgggtgtccctggcccactcccggtcccctgtgctttacctccttgcccttgtgtctcaggtgtggtccctgcctgcttgatgaagttgctctgttcaagcctttggtggg

SEQ ID NO: 2819 - DNA, 1202 bp, Homo sapiens
actacaggcatgcaccaccacacctatctaagttaaaaaaaattttttttgtagagaaggagtctcattatattgcccagggtggtctcgaacccctgggttccagtgatcctcctgcctcggcctcccaaagtgctgggattacaggcatgagtcaccatgcccagcctactactgttgttaataaaatatattacgtaagaaaaaatcttctatgaattttcaaaacatccctcagagtgttgtgtcatccccccattatggaaagccactgctaaggtgtttgagatggggaaactgaggcccagaggagcagtgcctctctcaagggtgtctgaaagcttcttcatctttttttttttttgcgatggagtcttgctttgtcacccaagctggagtgcagtggcacgatctcagctcaccgcaacctccacctcctaggttcaagcgattttcatgcctcaacttccccagtagctgggaattacaggcatgcaccaccacacctggctaatttttgtatttttagtagagacagggtttcaccaagttggccaggctggtcttgaactcctaacctcaggtgatccgtccgcctcggcctcccagagtgctgggattacaggcgtgaaccactgcgcccgggcagtttctccatctttacctcattctcctccccagggccaccatcgaggagacctactcgaaggcgatggcgaaactctccaagctggccagcaacgggacccccatggggtgagtggggtaggggtcaccaacatggggacattgggagcctcctccttggtggacatctcttcacactcggtgcatgtagaatagagtgtcatccacctcgattatggggctatttggatagagggatgtatatcattcattcacacactagctcattcattcattccacaaatattttttgagtgccttctgtgtgccaagcaccagcagcaacccagacagataaaaccccagccaccttcatgcaatgtacatctgggctgtgtgagaagagagatgttaaatacaaacaaaaacattttttttctgaggtgaaaagtgctgggaagggggccaggtgcggtggctcatgcctgtactcccagcactttgggaggctgaagtgggcggatcaccggaggtcaggagttcaagaccagcctgggcaacatggtgaaactcct

SEQ ID NO: 2820 - DNA, 1227 bp, Homo sapiens
tccctgtggcctctccttggcaggtgtttgagaagtcccccctgcgggtgaagaacttcgggatctggctgcgctatgactcccggagcggcacccacaacatgtaccgggaataccgggacctgaccaccgcaggcgctgtcacccagtgctgtaagctgcctgtcccgcctccagctttttagaccctccttgactccctcacactgaggcagggcaagtgccagaggttcccagtgcaggagagtctcaggactggtggcggggcacaggaagacaaaaggatgccccaggccccagatggcgcttttctgagagccctgccaggctcggttgtaaatcacatcacatctggaaactccctttttgggtctgcaccttgtttagactgggatccacatcaccactgttttctgggacccactgagaaccgaattgaacccctgcctagtgttgggagctggcaccttttccctggctcacctgccagggtctgtgagacccccacacctccctgattgcacctaaacccaagaatcactgtttcttatagcggtggtttaaacagaggtgcaaacagcaagcggatcttgtcgcctttggggggctgtggccgtgcccctcaaagtgaatttggaggttccacaactctagtggccagtgactgcagggacccaggccttgggctatctcgcttccccaccaccaccttcccgtgagccccgagccctcaggcagttgctgtgaccaacaggatgtgtcaggtcattgggcaggcactcaggaggtttgctgaatgcccagagcccaggcaacaccgtcaccctggccccgctcctttccacagaccgagacatgggtgcccggcaccgcgcccgagcccactccattcagatcatgaaggtggaggagatcgcggccagcaagtgccgccggccggctgtcaagcagttccacgtgagtgccctgggggactcccctggagggaagtgcctgctctgacgcaggagcccagtggggggcggctacaccttggtggccccacaggatggggtgttaagaggcttccaaccccctcaacatgcctcccttcctcacaggactccaagatcaagttcccgctgccccaccgggtcctgcgccgtcagcacaagccacgcttcaccaccaagaggcccaacaccttcttctaggtgcagggccctcgtccgggtgtgccccaaataa

SEQ ID NO: 2821 - DNA, 1227 bp, Homo sapiens; identical to SEQ ID NO: 2820

SEQ ID NO: 2822 - DNA, 1157 bp, Homo sapiens
cacacctgtcatgccagcactttcaaaggtgggaggattgcttgaggccagcaattcaagaccagcctgggcaacatagcaagaccttatgtctacaaaaaaaaccttagctgggtgtggtggtgtgcacctgtagttccagctacttgggaggctgagcaggaggatcgctagggcccaggagttggaggcagagctctgcccatctcaggcggagccaaggtctagggcagaaggggaggccaggcaccccagccccccagctctgagcacactcctaacctgcccacagtctgctcatcacctcgcttggccacatcaagctcacggacttcggcctgtccaagatcggcctcatgagcatggccaccaacctctatgagggccacatcgagaaggacgcccgagagttcatcgacaagcaggtgggcgggcaggtgggtgggcagccccgggatgcctcctcctctctcctgggacctctcttgggctgggggctggcctcagtttccccgttctccctggcccaggtgtgtgggacgccggagtacatagcccccgaggtgatcttccgccagggctatgggaagccagtggactggtgggccatgggcgtcgtcctctatgagtttctggtgggctgcgtgcctttctttggagatacccccgaggaactcttcggtcaggtggtcagcggtgcgtttcctccacgggcctgggtttgagctgcagccccaccagagctctgggcagcggtcctccacccgcatgtcagggagagaagcaggaagaggggagggagttggatgccaggtggggaggcggtggggtgctgagtgaggcgggtggctggattaattatagggtcacagaggcttcactgaagtgacttgtgaggctgggcacagtggcaaacacctgtaattccagcactttgggaggctgaggcgggaggatcatataaggtcaggagtttaagaccagcctggacaacatggtgaaaccccatctctactaaaaatacaaaaattagccgagcatggtggcgggcacctgtaatcccagctacttgggaggctgaggcaagagaatcacttgaacccaggaggcagaggttgcagtgagctgagattgtgccactgcactccagcctgggt

SEQ ID NO: 2823 - DNA, 1292 bp, Homo sapiens
cggagctggcgtccacggcgagcctgctgcgcgagcaggtggcgcagctcaagcagaaagtcctcagccacgtcaacagcggctgccagctgctgccccagcaccaggtgcccgcgtactgagtccgcgcgcggggcgcatgcgcggccaccctccccaaggggcgggctcgcgggggggtgtcgtgggcgccccggacttggagagggtgcggccctggggaccccccctccccgagtgtgcccaggaactcagagagggcgcggcccccggggattccccccccccgagggtgcccaggactcgacaagctggaccccctgctcccgggggggcgagcgcatgacccccccgccctcgcgctgcctctttcccccgcgcggccgccccgtgttgcacaaacccgcgcgtctcggctgcccctttgtacaccgcgccgcggaagggggctccgagggggcgcagcctcaaaccctgcctttcctttacttttacttttttttttttttctttggaagagagaagaacagagtgttcgattctgccctatttatgtttctactcgggaacaaacgttggttgtgtgtgtgtgtgttttcttgtgttggttttttaaagaaatgggaagaagaaaaaaaaattctccgcccctttcctcgatctcgctccccccttcggttctttcgaccggtcccccctcccttttttgttctgttttgttttgttttgctacgagtccacattcctgtttgtaatccttggttcgcccggttttctgttttcagtaaagtctcgttacgccagctcggctctccgcctccttcttcccccgccggggcctggcgggctgggcggggcctggttcgcttcccccctacacccccgcctttctctcctccctctgtccctagctcctccccttgttggagggagcagagagcgggtgtctgagagcggcccgcacatctggcgcgcagcgagcgccccctagacgcgccttggcgcggggccggctgatgtccaggttggggaggggtcttggggtctttgatctgcgtttggaactagctaatgcccccttgccttttgggaaggagagatttcgaggtggaaagggcacagccccagcccaaagcaggaaggaagagacagaaacttagtaaactttttaaccttttggtccttggtttgcctgtccgtataaaatggggagaacagtcgaaaaacttgccccataaagttgtgacgattaagagagtttatgtttacagagcagtgcttggcttacagtg

SEQ ID NO: 2824 - DNA, 1157 bp, Homo sapiens
gggcctgagctatgctgcctgcagcgctggcctctggcccctggcacccagcacatgggccacagggccagctcctcttgctggccttggctctcctgctgtttgaagctccagctttgatttcctcaagcgttcgtccagctagaaagttctctgaaacggctccctaaacggggcttacagagctggggtccccaagggagacagagagggagggatcaatgttgggtcccggcctgaccaacctgctgcgtccaggcctggcctgtggtgagggtggcgtgaaggggcgccaggcacacagagggtgtggggacaggcgtgccctgcgtgcagcctgctcaggattactggaggtgccgctgtagcgtccactcagtccctggggccctcatctcccgggaaccccctgtcacctccccagtggccacatgctcccacctcaggggcttcatggaaaatgtcatttgtcctcatggtctatctctggcctcaggcctgctggggagtcccctccccttccccatccctggggctggatacacagaaatccctctttctgttttcctcctggcaggtagatgaggggctgtgggtggttgtggcgcataggaggccccccccccgccagggagcccccagcctggcctactgccctggtctctgctccacgcctctcctacctcctcctcctcctccaggaaacccttctggctttgtcctttaggaagcctgccccaacccccaatgtgacttagtgtcctctgtcgcctagtcccccccccccgcatccctgggggctgggtctagtcccataatgaggatgccctggagttcctgccttcctcagatgctctgccccacggaggagatccaagcaccctcagtcaccacctcacacatgaggaagctgaggctggagacttaggtgacctggcctagagtttcagggcgccgggatcctgtcgaaggtcccacccacctggctctgctgcagcgccctctctctgtcctctaggtgtgtttggtggccggggccgaggtgggatcccgggcacaggcagaggccagccagagaagaagcctggcagacaggcgggcaaacagtgagcgcccacccagaccggctgctgcgccccctcctgccagggtggcga

SEQ ID NO: 2825 - DNA, 1134 bp, Homo sapiens
cccatggtggcgcccaacgacctcgtgttcgatggtgggcggagccctgggccggggtggggcgggatgggagatggggtctggaggggcccaggatccgggcagggccgagtgtgagggtccccccaggctgggacatctcgtcgctgaacctggccgaggcgatgcggcgcgcgaaggtgctggactgggggctgcaggagcaactgtggccgcacatggaggccctgcggccccggccttctgtttacatccccgaattcatcgcggccaaccagagcgcgcgcgcggacaacctcatcccaggctcgcgtgcgcagcaggtgctgtcccatcccgcatcccttgcttcctgccacctgttcttcgccacttggttccctctttttgccccaccccgcgaatccaggcctcacttgacacccggggaactgagtagcccaggcctctgtgagtccgagagtatgtacaaccaacttccctacaccctctccatcctccccacaccctcaccatccaacccacagctggagcagatccgcagggacatccgagacttccggtctagcgcggggctggacaaagtcatagtgctgtggacggcgaacacggagcgcttctgtgaggtgattccaggcctcaacgacacagccgagaacctgctgcgcaccattgaggtgggcgaacgcccgggtggagcgggtcaggcagggccagtcacagacacagctctgtgctgactgcccgccttgcccacagctcggtctggaggtgtcgccctccacgctcttcgccgtggccagcatcctggagggctgtgccttcctcaatgggtctccgcagaacaccctggtgcccggagctcttgagctcgcgtggcagcaccgggtttttgtgggcggagatgacttcaagtcaggccagaccaaagtcaagtccgtgcttgtggacttcctcattggctccggcctcaaggtgcgtgggcctagggagctgccgagtgcaggaagggggcctgggccgcgagcacctggcttgtggggccgcagggcctgcagctgctggggcttcccttgtacccacagaccatgtccatcgtgagttacaaccacctgggcaacaacgatggggaga

SEQ ID NO: 2826 - DNA, 1225 bp, Homo sapiens
gtgctgtggtggggacactgtgtcacaggggctctgctaaccaaaggtcccatgagcacctcatttcatggctgggtaaaccgaggcccaaacatctcagggcaaggatttcagcctgagggctgtttgtcctctctgagctttggttttctttctttttgaggagggtggggagactgggttcttgccattttgcccagacgctgggctgaacttgtgattctcccacattggcctctcaaatagatggaaactcggcaagtctcagttttcttaaaaaaaaaaaacaaaaaaacaaaaaaaccagaccaaccattgttcactgagctggtctctagcaccagcactgtcaccctgaagtctgtcccatcctgcccagtgtcctgcacgtggggttccccactctggtggcagagtggccattggaagtttggtttgtgccccagtgttgggccagccccctctggacagctagtgggcagagctgagggtaggagtgggggctcaggggagcgggtgcctgtttgagctgccaggtgacaggctgcatgtccctggaccctggcagggaacgggctgttgaggaagaagacgctggtcccagggccgccaggttcgagccgcccggtcaagggccaggtggtcaccgtacatctgcagacgtcgctggagaatggcacacgggtgcaggaggagccggagctggtgttcactctgggtgactgtgacgtcatccaggtgcgggctggggcgggacagggcaggggcgaggggcgtgccttgctgggtctgagtctgcctgacagctggctatccccacacaccccaggccctggatctcagtgtcccactcatggacgtgggggagacggccatggtcactgctgactccaagtactgctacggcccccaaggcaggtgagagtcagccacccttaggtctctgcaggtctcaggagggggatgggtggagtgggtgtacccctcggctcaccccatctacttgcccattttatagacaagaaactgaggctgggtgaggtggctcacacctgaaatcccagcactttgggaggttgaggtaggaggattgcttgagacctggagttccagaccagcctaagcaatatagaccgcatctctatacaaaaaaatttaaaaattagctgggtgtgggccgggcgtggtggcttacgcctgtaatcccagcactttgggaggccaa

SEQ ID NO: 2827 - DNA, 1146 bp, Homo sapiens
ccctggtaaaagattcaatttcccccagtggccttagaggctctaaaaatggcttccctaaggcctcggaggctgtcctctccacaaaaatcccagcacccttcgctcagcttataatcaggcaaagccacagggcctgaagccccaggttcaaatcctcctttggcctttggctttctctgtgaccttgggcaaatgcctttgcccctctggcctgtttcctgttctgcaaaatgttgaggggaatcttccctacttcctggagtatttgtaaacattaaataataattagctctaataatggctaacactatttgagcctgatgccaagggcttgatgcatgggttaatttctcccaacaagctggggttgttgttacacccactgtatagatgaggaaactgaggcctggagcccttgagttacacagaaagtgatcggcagtgtggggaatcagtacagtggagactttgaggggctgtgtaggattctgacccacatctctgccccccacttccagggccaattcctgtccccccagcagcatggcatcgtgtgctgaaccctctgagccctctgccccactgcccgccggggtcccaccgctcgaggacttcgaggtactggatggggttgaggatgcagagggtgaggaggaagaggaggaggaagaggaggaagaggatgacctgagtgagctgccaccgctggaggacatgggacaacccccggcggaggaggctgagcagcctggggccctggcccgagagttccttgctgccatggagcccgagcccgccccagccccggccccagaagagtggctggacattctgggtaaggagcaaaggtggatcagggtgcccttggccctggccctctcgtcccctgagcctcatttccccatctgtgctgtgagggttggaagtcacgtggtcaccaccgtgatcaccagccagaggcaactactggagatgcttcacattgatgtactctatccactgactcacacacatgcacaatgtgctgtgtccccgtttcccagatctgctaacagtggctcagagaggctgagtcacctgcccagagccacacagccagcacgccaggcgctggcagctcctaaccccatcaatgcatctttt

SEQ ID NO: 2828 - DNA, 1323 bp, Homo sapiens
aggcatccttcctggaggaagaggatgaagaccccatcccacccagcaccacgaccaccattgccacctcagaacagagcacgggctcatgtgacaccagccccgacaccgtctcgccctccctgagccccggcttcgaggacctgtcccatgtccagcctggctccccagccatcaacggccgcagccagacagatgacgaggagatgacgggcgaatagccctgctgcccggtgccttgagggggtctcagggcagcagcatacaaggtggcagcgggtaaccctgccttgttctgtcatccagggctcctttgctgccccgttctgtcacccagggctcctagggggacaaggctctctcccgaggggtgtggaattcctgggggggtctttaattctggctccttccttcctcagaacatctctattctgcaagacccctctgccatgccagggcacgcccattccagctggagtcgtggggctgggcacaggggaatttttccagagctgagcctgacgtctgctctgaagaatgcttagaaggttcccagacaccagagccagatgtcccccaccaccggtcaggacctccttgaggtgcacaagcacggtctcctctgagttcaccccagcccacccccgcacccactaattctgcttttcctgccccttgctccgtaaaagtatcaaatactttctccttggtatctcaaggaggtttctgagataggtagaagtcttgagacggaggctggccatccattcagccctgagcgtgctgagttctgtgtttctctgaatagaggtgtggaacctgaggggccagcaggcctctctgaaggcctccatggagcaaacggagccacctcgggaaagagtttaatggaatatttttgtacccgatgtttacagatgctgttgggaagttatcaataaaaagacaccattactaaaaagggaaaagtacacctagctgtggcttcttcagtccttaagccaagcaacccaaaaggagggcaagtgctggatgtggggctgggggccctgctggagggaggtgcagacaatcaggcactacagggctagaaagagatgtggcccttttttggaaccccccctggtgggagctataacaacccaagttcccgtcaccagctaggtcttccctcacgctgctgtcactgctcacaatactagtgttcccatcctcatttcataattccttctccagatctcagccttcctccagataggggagccacactagatccattccccatcagacacactcccagggttacctcatcttctgagtact

SEQ ID NO: 2829 - DNA, 1164 bp, Homo sapiens
caggcctttttgagcccaagccctcagggacaggatcaggcgctgtcctggaagcctggtcccaccccacaccccgagccccaggacagacccagcttcagaccagctctacgacagccaggacattacctattgcctgcctgcctccctcgcctcgggcaaaccaagccgcaagcttgcggtccttgtttccaaaacctgaagccgttgatttttagggccaagatagcatttttgccacacgtgctggccttcccttccttgggtcacctttttacctcttctctggcgtttgagtgggacgtccaacctcacaagcctcctcgccccagggtgagcgtgtctgtctctgttgtctgcccactgaccaccaggagcaactggtgggtttgtggccggcccctctctgggattgaggccagagactcaggcgttgggatcttcctggaacaaaggggatctctctagaacaaagctcagatggggagctccaagggagagggccagggctttgggtctgtggagacattcacctggacgccttatagggcacatgccttacgctatagctctgagaatggctgtggggcagtggcttcctggggacactagccagagctcccagccccctggatgctgccaggcctccagcagccacaaggtcacactgcagctggggttcccgaggcctcgtccacggccaccccctcctcgcctccacaccccagccagacctcatcccaccatctcttggggaggggctccgagtgtctcctttctagcgtctccaccacccataaggtcccctagccccctgctcctgtcaagggacagcccctgtcaccctgcctctgagagccctgctggcctcagatagcaggagtagggccccgggtcctgcaggctggcagccctgggcaggggctctccctgtgcctgtcctgtgctctctcagctggtggctggctctgtgcgcccatcctgtccatgtacgtggcctgcgtcgtgtcctttgtctcctgtcaggagtcaccaagtgcactttctgtcctgaatgtaacgtctgggcacttcccgccttggccctggtgacaggttctcctctggggcctgttgggtgggggttcctcatccctgtggcccccaacttccctgtgatggaga

SEQ ID NO: 2830 - DNA, 1204 bp, Homo sapiens
cacagatgagagctactcagggccatgtttgcaagttggggagttgtcctttctaaagcaaaggtgaatcccagctactcgggaggctgaggcaagaagatcacttgaacccgggaggttgcggcaagctgagaatgcactattgcaccccagcctgggcaaaaagagcaaaactctgtctccaaaaaaataaaataaaataggccaggtgcggtggctcacgcctgtaatcttagcactttgggaggccgaggtgggtggatcacgaggtcaggagttcgagaccagcctggccaacatagtgaaacactgtcttactaaaaatacaaaaaaattagccaggcgtggtggagggtgcctgtaatcccagctactcgggaggctgaggcaggagaattgcttgaacccgggaagcggaggttgcaatgagtggagatcgcacaattgcactccagcctgagcaacagtgtaagactctgtctcaaaaaataataataaactaaaataagtaaataaaataaaattgtaaaataaagcaaatgcaagtcaggtgctgccttcacccaagccaggtgatgaactgagcagtgtggggctgccccctgggagggtgcacacacagctccggcccccactacttgctgctgcctcgtcagggaggggcatggtgtccatgagatgctgtcagttctgaagccaggaaagatgtggttgctggggtcggactgggcctggaccttctatcctgaccctgtggtgctgggcaggtcacttccactccctagacctcacatggtggataatgagaatggtgacgtcctcgtggggctgccatgagggtcacggaccttgtccaccatcagtgcagtttcggccctagtcaacgtcacagaaaacagcaagcagagatcttgggctgaggcccgtcagggctaatggctggcattacttagactgggttccctggcagccaagccaaaaagggaaatcgggcagtaactaactgctgtgtaaggccagactggcagacctgcctctccccagcgacccgtcctccacacagtggtcctgcttggggtcaagcccagacactctgggctgatccctcccaagcccaagcccttgttcagcatctccaggacccctgagctgtgtagctgtcaggatctacctttattcgccccatgtcctgacgcccagcaca

SEQ ID NO: 2831 - DNA, 1158 bp, Homo sapiens
ggcttacacctgtaatcccgggactttggaaggccaaggcagggggatcacttgagcccgggagttcaagactgcagtgagccatgatggagccactgcactccagcctgggtgacagagcaagatcctgtcttgaaacaaaaaagttatacatatttattcacgtgcataagcacaggagccatataaaacattatgaaaactcaaagaagggccaggtggttgaagctgaaatacctctttgtaggggagagggcagatgggaggctgtaggtaactttagaggggaagcagatgattttaggagagatgaatggaggcaggcatcatcttgtgaatgatcctcattgagaattgaatgggactagagaacagccagtggtctgggctctaggtgtggtgtttaatgttccatctcttcttgtgtgataggagttttcaactctggttaatgacatttcagggaagggatccaaggcccttgtgttcttctttggcaagtccagtttctaggtagatagggaacttgaagaaaacagcttcctcctgtgctttgggagggaccttgaggctgctactttagtcccacctgtcaaagtgctataattcggggtatcgctttctttctttctttctttttttttttttttttttttgagacggagtctccctttgtcgccaaggctggagtgcaatggcatgatctcaactcactgcaacctctgcctcccaggttcaagggattctcctgcctcagcctccagagtagctgggattacaggggcgtgccaccacacctggctaatttttgtatttttagtagagatggggattcaccatgttggtcaggctggtctcaaactcctgacatcgtgatccacgcaccttggcctcccaaagtgctgggactacaggcgtgagccaccgcgcccagccttagggtatccgtttctgaccccctacatcttgctgcatgttgagttctcagcacctctccaggttgttttgtccctttctagggtgagaacactgaggccccaggagctccagaggcccaggccttccttatgggagcacttgctctctcctccctccctccctcctgacctgaggccctgctctctcccttctccctttcctctcccagcccctggctcc

SEQ ID NO: 2832 - DNA, 1443 bp, Homo sapiens
caaccttctctttactgttctcatcatgatgactgggtcataagatttcacacctgggccgcaggctccttggttaatgttctcttgtggttcacatcacactttccttgatgcagtcaaaagctcaccgagcactcatcctggctgggccatttaaaaggtgtcaattctgcctgccagggtgctatggctccaaggtgactggtttgtgtttccaggccatcaagagctgggagctccctcacggctgctgctgatggaaatcaaggaggaactcagttcaaactcccgattgccctgtggtcactcttagcagggcagctgtcttgggcctagctctgggtcctcagtagagccaggcagagcctctgagacaggagaggacagtgaggagttggccacttagaaagggtttgtgtttgaaggaacaatttgggacctggtggtgttttcataaatgtcccgttatgcttgttttgttatctaggtttttgtctgatgaaaatagtctggagtataaatattacaagctgaagttggcagaaatgcagcggatgagcgagaacttgcgaggagccgaccagaagccgacctcagcagactgtgcagtgagggccatgctgtactcccgggctgtccgcaacctcaagaagaaactccttccgtggcagcggcgggggctcctccgtgctcaagggctccggggctggaaggcgaggagagcgaccaccgggacccagaccctcctatcctcaggcaccaggctgaaacaccacggccggcaggctccaggcctctcacaggcaaaaccatccctgccagacagaaatgatgctgccaaggactgcccgccagacccagttggaccttctcctcaggaccccagcttagaagcctcaggcccatcccccaagccagcaggagtggacatctctgaagcacctcagacctcttctccctgcccatctgctgacagtgggtgctcactcctgtccccctcctctgggccccagtccctactctcccatctccagggtctctttagaattgggggggcctgcaatctaggcaaggcagtggataaaagctctagggacctggccaggacaagtgtacatgttggcgctttctctcttgctttcttgagagagctgcatgcgagtcctgcagctccctcctcctcttctgagagcggagctggtatgaggtgctgccccatgccttcgtgctccccgacagggtcctgctgctggggccgtgggcggtgcattgcctgaacttgggatcccatgtcctgctatatcctggcctcccttgatagtcttcgggactgccttgttctcattgcgcctcctcatccccagggtctccacagttcctgttcttggggttcgctgacctgcactgcttcctccgaatcgactaacttcaccccttctgttt

SEQ ID NO: 2833 - DNA, 1235 bp, Homo sapiens
tatcgaggtataggatgtacttttttttgagacggaatcttgctctgttgcccaggctggtgtgcagtggtgcaatctcggctcactgcaacctctgcctcctgggttcaaatgattctcctgcctcagcctcccgagtggctgggatcacaggtgcccgccaccatgcccggttaatttttgtatttttagcagagatgggatttcaccatgctggccaggctggtcttaaactcctgacctcaggtcatccacctgcctcggcctcccaaagtgttgggattacaggcatgcgccactgcacccagcgaattgtatttaatatagtgtatatcttatactatatatggtacataaatgatacaaatatattgcatatgtttacattatacaacttgacgattttatatgcatgcagattgtgaaatactcacctcaatcaacagttacctttttcttttttgtggtgagaacacttagaatctaccctcttagcaaatttcaagtataccatacaatattgttaattatagggagttccgagtttttagttgatagtacgatgttagaatcttttttttttctttttgagtcaggggcttgctctgttgcccaggttggagtgcagtggcgcaatcttggcctcccaggctcaagcgatcctgctacctcagcctcctgagtagttgggactacaggcatgtgccaccacactcagctaatttttatttttattttggtagagacagacttttgccatgttgtccaggctggtcttgaactcctgggctcaagcaatcctcctgcctcagcttcccaaagtgttgggattataggcattgacccactgcgcccagccagaatcttttttcttttattctgattcctaataagataatcattattatttgctacatccgtaatagtttcagaataacattactagtatcattatattaaagaaccacctttcttagataaaatgtagtaaactctgtgttctctcctacactttgtttttttttcccaagacagggtctcactctgtggcccaggctggagtgtagtagtgtgatcatggctcactgcagccttgacctcccaggctcaagtgatcctcccacctcggcctctcagagtgccgggattacaggctaagccatcacacccggcctcttctgtatttgcagaagttctagggaagtagggatatcaccctttcctgtgataacagg

SEQ ID NO: 2834 - DNA, 1219 bp, Homo sapiens
caggatgtgggagaaagatctcgaatctgccccagactgccctgacttaacttctgggccagtgtgaccttgggcagttctcaagcatttcttcatctgtcatgtggcggggtaggtgctcctgagctatttcgaggacggcctgcagtgctggccctgtcattcctgctccagccttgctctcagtctgcccatggctcccctttgccttctacataaaaccaaacctgtctgtggtcccagcaacttgggctaaggcgggaagatcacttgagcccaggagtcaaggctgcagtgagttaggatggcaccactgcactccagcctgggtgacggatcaagagcttgtctcaaaaacaaacaaacaaacaaaaaaatgcacttcatgccctgcagacccagtatggcccaggccttgcccatttcccagtctttccactgtactcactccctattcccccaccccagggcctttgcacaagcccccatgtgacaagccatgccctctgcctagaagtgcccttcccttggccttccccgtggccggctcctcctagcacatgaggtttcagctcacgttgccttctccaggagagacccccatctcatcacctcatgtgctctggctctgacactgggccccatctgaggtcacctcatttgtgaactctcctgtttgtcttgcccccaccatcggctggctccctgcagggaggcccctgtccccacttgctgtgccttcagcttcccgtcagtgtttttgagtgttcacctgaataaactgacaagcactcgaggtccctgccaggtggccccagcgtcctcccctgggcctgggccaagctgcaggcttcttcaggaaggggtggttctgccttatctgtccctcccaccttagcccaaggaagtgggtgtcttcagtagatgcagctagcatgtttggacagcctcaggttgggtgggggcccctcaccaaagatctcacatttccctggggttatggcctggctttccatcccccctcggccacttcaggcatatcacctcccgtctgtgagcctcggccttctcatctgaactcaggctagatctggcacactggagggccacagcccctagaaaggcgcgcttcaggggatgtccagaacataactccccccagcccccatccccgtcgccttcccttttctgtcacccaggctggagtgcagtggcgcca

SEQ ID NO: 2835 - DNA, 2166 bp, Homo sapiens
ctgacgggaccggcctgggcagagagagggacgtggaactggagggtctctgcctgggaccatccccgaggaggggcgctggagatggccctgaaggaagggcactgatggccggaattattgaaagtggggcgtcgtcccaggcggaggtgcaggacgccgtaggagatgaaggcacaggctcccgggaatgaggagggaggctgcattgattttatcagggttcttgagttcgagaatcgtaaatccagtgaagggaaaagaaggagctgatggaagactccagaaaattcttgcagatgtctgcagagccctgaccctgagacaggaggctgggtggagggcagggccatcagaacatccctggacagacctctgggagccttaggtggagagatgcacccctccaccaccttttcccttggggggttttggggggtggtggggtcattgatgaagagcccaaaggtccaggaagacctctgagactccagtggttgggtgcagggagggctgaggagagagctgagctgtggggaggtggagggatggtctctagctatgcctgcagggtgcagaaccaagttgggggctgactgtgagactgggaagggcctgaaccacctggaagggtatgggatgatgggtgagtgctagggtctcccaggagagcctggaggaggctactggttgagctcagcagagaggtctgggctggaggtgtcaccgtgctgaggttttgatgggctggctgattgggtggttaaaaccctggcaggtcacaggagagaggtcggagagagaggagaaaaacagactggggggtgggagggcagggtcctaggggaagggtggggcttcaacagccctgacccactggcttgcaggggcccatgggctggcactcatggtccctaagtgccagccagccagtctgcactagggtcccggggagggcgagcaatgaggacttagagatgagaaagatgccgccaccaacctcattactgaaaaaagatttctggtctcagtttacaagtcacaggtacagagaaaatgtcctattagtctgttattttatgtatttttattttattattattattattttgttttgagacagagtcccactctgttgcccaggctggagtgcagtggcacaatctcggctcactgcaacctctgcctcccaggttcaagcaattctgctgcctcagcctcccaagtagctgggattacaggcgcccaccaccatgtctggctaatttttgtatttttagtagagacaaggtttcatcatgttggccaggctcgtctcaaactcctgacctcaagtgatcagcccgcctcagcctcccaacatgctgggattacaggcacgagccaccgcacctggcctcagcagtcattttgaattaccgtgctaggcccggtacccatcacattagggtttttccgactaaatttagcttatttatgcctgattaaaggattattttcataattaattttactattaaataaactttatttcattttgatgataattccagaacactagtagacagctctcctgagcacataattttacataattatgtaattactggcagcaaatgggtatttactgcattcaagcaggaaaacccagcttcaccacagactgattcttctaaaacgtttaaaaataagtatatgaaaatgtgttctgaattaagaactgggtgagaaaattcctaattaaaaaaaaaaaaagccttagctgggtgtgttggcacatgactgtagtcctaactactcggtaggttgaggtgggaggatcacttgagcccaggagtttgagaccagcctggacaacatagcaagaccccatctctaaaaataaaaataaaaataggccggacacagtggctcacgcctgtaatcccaaccgtttgggaggccaaggcaggaggattgcttgagcctaggagttcaagaccagcctggcaacatggagaaaccctgtctctacaaaatagacaaaaattagttgggtatggtggcgagtgcctgtaatcccagctactagggaggctgatgtgggagaatcacttgagcctgggaggttgaggctgcagtgagcaccccagcatgccactgcactccagcctgggtgacagagca

SEQ ID NO: 2836 - DNA, 1211 bp, Homo sapiens
tgtctcaaagatgcatttgagaagcccttgggatcaagacaagtccctctgccctgtctcgtgtctggtgtctccccacaatctgagattttttggtgtgaatgtctcacttttcccaggccctggggaagggtctgagggtccctgccctttccctttgtagcagggtgaacaatgacagtgtgatgggtgcctgataaagacagggtgaggattggagtgactcagttcaaaggaagggcatcgggccaccagaaccagcagtcactgccaggaggcctggcagggcaggaggtcatggtggagaccgtgactatgacatgaccatatagtgaccctggccaacgtgggcacacaaggccagaactgctcctgcccagaatcagggacagggcctcgggcccagctgacactgcaccccccaactctcctttgcagctttctgtatgagcccaatagccaagggtacaagtactaccgacagaagctggaggagttccggaaagccaaggccagctccacaggcagcttcacagcacctgatcccggcctgaagcgcaagtcccctcctgaggccctgtcagggtccttacccccagccaccacctgccccgcctcgtccacgcctgcgcccactatcatccctgctccagctgcccccgggaagccagcctccgcagccaccgtgaagaggaagcggaagagccggtgggggcctgaagaggataaggtagagctcccacctgctgaactggtgcagagggacgtggatgcctctccctcgcctctgtcaggtgggcagaccctctccccctccctgtgttggaagggtctgacttctttcactgagcataatgtcttcaaggttcatccacagtgtagcttgtatcagaatttcattccttctgtggccatatcttccactgtgtgtacataccacatttggcttacccactcatctgtgaatgaactcttatattcacagaggttgtttacactgcttggctgttgtgaataatactgctgtgactatctgaatcgttttcagttctcttgtcggtatacctaggtgtggaattgctgggcctattgcaattctgccttttttttcttttttcttttttctttttttttttgagacagagtctcgctctgttgcccaggctggagtgcagtggtgcgatttcagctcaccataagctctgcctcct

SEQ ID NO: 2837 - DNA, 1208 bp, Homo sapiens
gagggaggggtgcagatttgctttcttgaggggttttcaccttctccctgaggcacgagggcagattgggaggtaactggagagggagagcagtcgtccccaagtgtcttgaggtgggtgggtctggagctttctttgtagaattctgttcactgcactggagaagtgatcgttcagccgatccacaccccgccctccccacagacaccggggccgaagttcccagagaagagcttccgcgtgacgaccccgcgggggtgacattctaacccgcgtttcagaggcaaccctgagttgcttgaggtcgcccagctcagctggcgcgaggtcagcagtgagcgcgtcgtgagtcagccttgggtgcggcccgcccggctttgccgccggtgagttggccacgacccttcggcctgcggagggcgctgggactcggcggggagggagccagccggagcccgcgtgggaaaccagcgcgcccaacgaggtgtcgcgtgggagcgcgccggagaggggcggtgcttccggggcggtaccgtccggccccgccccctcaactcaggggcccgccttctacgcctggaaccccgcccacgagctcctcccttctcgtcaggccccgcccctcggtcgccacgccccgcccagccgggcgcgggcgggcggcgtcgcctttaagagctccccggtgttttgggggccgcgggccgggcgcgctgacctggtgcgcatgtcccgggcggtgacgccggcgccgggctccatgtgtgcggccgaggggcgcattatctggccggcggcgcgggcgggcgggcggaccggcgcagcgagcgccgcgggcccgggcggccccacaggcggaacgagcgcgcgcggcccggcgtccccggcccctccgccgcccggccccgcgggcgaccccggaccagcagcccccgtaacctgcgcgctgccctagggcccggccgacccgcggcccggtaagttctggaccaaacttggcggggggcgggggctggggacgcacggctgagactggagcggcgcgggccgcgcagggtcggggcctcggggggctctgaaggacccctgcatgagcgtggaaaagtgagagcgagcgagttctactccttgtattctgggagcgtcttcttgcgctgccctggaaagttccttgccccgaggcggcccgggcacgtgggggccgggcg

SEQ ID NO: 2838 - DNA, 1222 bp, Homo sapiens
caacatggtgaaatcccatctgttccaaaaatacaaaaaattagctgggtgtgttggcacccacctgtggtcccagctactcaggaggctgaggtaggaagatcgcttgaacctgggaggcggaggttgcagtgagctgagatggagacattgcccccagcctgggtgacagagtgagaccctgtctcaaaaaaaaaaaaaaatttattggagacgaagtctccctttgttgcccaggctcatcttgaattcctaggctgtagtgatcctccctccttggcctcccaaagagttgggattacaggtgtgagccactgtgcccccccccacccccttaggtttctgtttttgaaacctacttttctctgtagtccattctgctataaggcttattttggaaaagcagatttgttccaacacaattgatgtgttagaggaccgtcgaggtgtaacacaaatgttgcgatggttgcgtgtggttttgttcaggagaaacactaggctagggattggaaaactatggcccacaaggtggtggcctgttttggtaaatagagtttaattcgcagacacgcccattcaggtatgtacagttgggcctccatatccttgtgttttgtgtctttgagttctaccaaccgtggattgaaaatatttggggtaagccaggcatggtggtatgtgcttgtaattctagctacttgggaggctgaggcaggaggatctcttgagcccaggagcttgagaccagcctgggcaatacagtgggaccccatctcttaaaaaaatttttttgggggctgggcacggtgactcacacctgtaatcctagcactttgggaagccgaggcaggtggattgcctgagttcaggagttcgagaccagcctgggcaacacagtgaaaccccgtctctactaaaatacaaaaagttagccaggcgtggtggcatgtgcctgtagtcccacttactcgggaggccgaggcaggagaattgcttgaaccccagaggcagaggttgcagtgagctgagattgtgccgcgccactccactccagcctgggtgacagagcaagactctgggtcttaaaaaaaaaattttttttgaaggaaaataatggaaaaaacaatacaacataaaataatacaaataaaactatagtataacagctgtttatgtagcatttacattttatggagtattataagtaatctagaggtga

SEQ ID NO: 2839 - DNA, 1155 bp, Homo sapiens
tctgcctacctcggcctcacaaagtgctgggattacaggcatgtgccactgtgcccatccataattttctttaacttctctgctacttaaaaaaaaaaaaaaaaaaaaactagtatgtactttcataaaagcagcaaaactgcttgctttaaaaaaagtgtgggggggtccggtccatgtaaatctgggtcttggtatcgttggcagacctcttcagctcggatgcccggcagtgtcatacccccgcccctggtccgaggtgggcagcaggcgtcctcgaagctggggccacaggcgagctcacaggtcgtcatgcccccactcgtcaggggggctcaggtaagcagggctgtgcacatgggggagacctggcagcctcagcagtcgtctaccttgaaagtagggcccttcccagtccttgggggcaaggtgccctgtgccttccggtcccgctccattgttgatctcagtcagatttcttgttctccccaccctaccccaacagcaaatccacagcattaggcaacattccagcacagggccaccgcccctcctcctggccccccgggcgtcggtgcccagtgtgcagattcagggacagaggatcatccagcagggcctcatccgcgtcgccaatgttcccaacaccagcctgctcgtcaacatcccacaggtgagggctgcgccacactgtgccagggagagtgtgtgtcccacctgtgactgctccccttggacccaggttctggggcacagtagtgtttccctgggctgtgtggcatgacctgccttgctctttcagagccaggcaggggcttggacttgagctcctgggggccacagggctgtctgggtcgtgggcagaagttttgtgggcagacttgctatccagcacaggtgggcagctgacgagaggggcgatgcacggacctgagctgaaggtggggtctgcttaccagccccatggctgaggaaacagcatgtggcacacagcaggtttagggggatagtcgaggcccaggagaggccggtgatgggcccggagatgccttggggggcaccggagcccatgccgccctcccggcagtggcttcttccgattgcctcctcagcaaatgttctcatgtcaccaggtgcgcctattcttagccgcac

SEQ ID NO: 2840 - DNA, 1088 bp, Homo sapiens
accaggatagctattgattaatgttaagggtgttctacccacagcaaagcacaccctcttaaaccaggcactgcctgggtcctggtcccgagagccctaccaggatcaggttcctgcaagccgtcagaatgtgggagcccccagcccaactgattgtaactgtcccctgttacctgtgacatgaacctccaacagcacctggaaacggttccctctgtcagctgctctgtagacagggctggggagatctcagagttcacacctcgcctgttgtaggggaggttgggggtagggtttggaatggccaagtgcccttggaacctcccacagctatggccgtcctgacctcatcccaggaactctacggtgaccaggaaccacccctctgacgaggtctgtagcggcccttctcagagtggaacagcccacagtgctagttgtgcctggtcttacctgtactccacggacctcggtgaagcaaaagcttcagggcagagggaatgaggcaacccagtggcagccccgctgggccccgtggctcctgctctcctattggacgtagaggcaggggagagacttctctatacaaatattctcatcacagaagggatgatccttgctgctctgccgtagggtttttgatgctgagctatgctgcacatgacgttaacctaaagaacttggactgagcttttaaaaaaggacagcaaacaattttataatccttaaagtgtaatagacggttacactagtgcagggtattggggaggctctttgggtgtggaggctgtcacttgtatttattgtgactctaaatctttgatagtaaaacaaatgtaaaaagaaatgtttgccaccagatgggaatagaagttccaataagcaggctggaatgggtggctatacgttgtatcacgaggaagttttagactctgaaggataataaatggatgatgtgtcaactggacttttcttttgtcccttctgccctggcttctctgtattgtttcgtcctagcttcccaggcaggttggagggagatggaggatgacccttagttaatgagagaagcaaagggcggggtgcat

SEQ ID NO: 2841 - DNA, 1099 bp, Homo sapiens
cctccccaccccagggccttggcttttgctattcttgcccctgcattacctgccacgatgtgccaggcctcctcctccaggaagccctcgctgactcccatcccatagcagtcctccttctcctgcactctgcctacctggccttatcatgctgcaaaattggccagagggcagacatctcccactcagagagttgaaggaaagagtctcaggattcatcccctcaaaacatccaccatctgtaggtctggctctatgtctttgttcatgtcctgtggctctggagacaccaagggggaaagacccagtttcccaacttgcttcctgcatgatcctgggcaagccactcggcttctctgaatcattagttgtttttccaacttttctaggcctggctctttttatttatgtttgtgttttttattattatcttagagacaaggtcttgttctgtcgcccaggctagagtgcagtggcgtgatcatagctcactgcagcctccacctcccagattgaagtgatcctcctgcctcagcctcctgggtcaccgggattacaggtgtccaccaccacgcccagcctagtctgaccaattgtgtaggtcacccgaatattcagttttgctccgagaggtggagacggaccccagtcattcagtgaagtggatggcagagcttcacctccagctaagtagccacattttctggcaacaaataaccttttttttttttttttttttttttttttttggagacggagcctcactctgtcacccgggctggagtgcagtggcacgatctcggctcactgcaacctctgccacccgggttcaagcgattctccaggttcaagccttagcctcctgagtagctcgtactgcaggcacccaccaccatgcctggctaattttttgtatttttagtagaaacagggtttcaccatgttgggcaggctggtctggaactcctgacctcaagtgatccacccgcctcatcctcctgaagtgctgggattacggatgtgaggcaccgcgcccggcctggccacaaataatctaattatgtcactgcccctgaaaatcggtcaccaaagggtctca

SEQ ID NO: 2842 - DNA, 1177 bp, Homo sapiens
tttgtatttttaatagagatagggtttcaccatgctggccaggctggtctcaaactcctgacctcaagtgatccacctgcctcgacctcccaaagtgctgggattacaggcgtgagccaccacggctggcctttatattgattttgtgcaaatcaaattcacatgaaatatgattgtactgcattttcataaggcgacttatctacagtcagagtggcagatctcgtttggtttgatttctcagtatggaagatctttactcttggggacaagatgatgactattcttttctcacaccctcctctgtcacctccctttcagaaagcatgctctgaattgccatcggatgaagcctgctctgttcagcgtgctctgtgagatcaaggaaaagacaggtaggctgtttagaagacactttctggccgagcgtggtggctcatgcctgtaatcccagcacattgggaggcggaggcgggcagatcacctgaggctggattccagaccagcctgaccaacatggagaaaccctgtctctattaaaaatacaaaaattagccaggcgtggtgacgcatgccggtaatcccagctactcggggggctaaggtaggagaatcgcttgaacctgggaggtggaggttgcggtgagccaagatcgcgccattgcactccagcctgggcaacaagagtgtgcggtgagccaagatcacgccattgcactccagcctgggcaacaagagtgaaattctgtctcaaaaaaaaaaaaaaaaaaaaaggcacttcctgtgtgtgactagagctgcggcagcacacctctgatcttgtctcagcccttatgtgcatggtgggccgttttgctcatcccttctgtctcgcagaagacggctaggatgttttctttctgccttatcattgccctggtttccagtatgcacactgatttattttgtagtttataactgagaaatactgttgcaaatcagtaacaagcagctgcattctaggtcgaagacctaagaggtgcttagcattcagtcatatagaaaaaggaaaaatgacagacttagggaaattgaataagaacagttttgtcggctgggcacagtggctcatacctgtagtcccagtactttgggaggccgaggcaggtggatcacgaggtcaggtgttcaagaccag

SEQ ID NO: 2843 - DNA, 1311 bp, Homo sapiens
gagagggttcttggatttcgctcaagaaagaattcagggtgagtctacagagtaaagtaaaagcaagtttattaggaaacagaaggaataaaagaatggcttactctataggcagagcagccctgagggctgctggttgcccatttttatggttatttcttgattatatgctaaacaaggggtggattatttttgcctcccaattagacaatataaagtcattttctgatgtttccatgatgtctccatggcattttgtaaactgtcatggcactggtgggagtgtagcagtgaggaccaccaaaggtcactctcatcccatcttggttttggtgagttttatccaccttctttactgcaacctgttttatcacccagatctttataacctgtatcttgtgctgaactcttgtctcatcctgtgacttagaatgcctaaccatctgggagtgcagccccataggtctcagcctcattttacccagcccctattcgaaatggatttgccctgattcaatacacctctgacatttctccttttttttttatctgagacggagtctcactctgttgcccaggctggagtgcaacggcatcatctcggctcactgcaacctccacctaccaggttcaagtatttctcctgcctcagcctccccagtagctgggattacaggcgcctaccaccatgcctggctaatttttgtacttttttttttttttttttcagtccaatcagtttactctgctttctccatctcctcctcccattagtcagccattggaactgggaaacctcctactttccccctctttgtactctttccacaattcatcttgtctttctgcagccatatcttcttaatacagactgaagtttctgtcattgagaacagagtgatccataaacctggtcatcacactttttatgagatagtaatgtgggccccagatccatggcatggtttcctctggatgcactcctggatctaatttttgtatttttagtagagacggggtttcaccatgttgaccaggatggtctccgtctcttgacctcatgatccacctgcctcggcctcccaaagtgctgggattacaggcatgagccatcatgcctggccgtaatctctgacttttttttttttttcttgagacggagtctcactgtgttgccccggctggagttcagtggcacgatctcagctcactgcaacctccgcctcccaggttcaagttattctcctgtctcagccttctgagtagctgggattataggcgcacgccaccacgcctggccagtttttgtat

SEQ ID NO: 2844 - DNA, 1193 bp, Homo sapiens
catgttggcaaggatggtctcgatcccctgacctcgtgatccacccacctcagcctcccaaagtgctgggcttacagacatgagccacggtacctggcttattttagcttttaatatgttttaaaatttggaagtataatacctctttgttctttttcctgggcgtttggctggttatagttccaaatcaaatttttaaattttagacaagttttctttctttttttttttgagacggaatttcgctcttgttgcccaggctggagtacaatggcgcaatcttggcttaccgcaacctccgcctcccgggttcaagcaattctcctgcctcagcctccggagtagctgggattacaggcatgtgccaccacgcctggctaattttgtatgtttagtagagatggggtttctccatgtaggtcaggctggtcttgaactcctgacctcaggtgatccgcccaccttggcctcccaaaatgctgggattgcaggtgtaagccaccacacccagccatagacaagatttctataatgaaactgtacttttgggatttttaaagagcttatattgaatttgtttcccactgtagtttgtactgacatcttaacaaaattaattttattgaccattgaacaaaaatacgttgaagagtgtcttttatttttattttatttgttttagagacagggttttcttacgttgtccatgctagttttgaacctctgagctcaagcaatcttcctgcccagccttcctaaatgctagtattggaggcatgagccaccgtactcaacccatgtgttttatttttagatattcttggatttgccagttttactttttaatttctagttttattcagttttggtcagaaaacaaagtgtatgattttggtcttcttatttattgtcgttttgagacaggatcatatttatcacccatgctggagtacattgacataaatttgactcactgcaacctcagcctccttgactcaagcgatctttccacctcagcctcctatgtagctgagactacagacatgcactaccatgcctcgctaatttttttggttatttgtagtaatgggtctcactagacagggtctcactgtgttactcaggctggtgtcaatcttctgatcccaagtgatcctcccaccttcatcttccaaattattgggattgtaggt

SEQ ID NO: 2845 - DNA, 1218 bp, Homo sapiens
attttctttacacgccaaaggagaggattacacagcaggtgtgcaacagattgggaatcctggcgatcatcttagaattttgtctacccacctgaatagactgttaaaatagtcttatagtttctttttttatctaagtaaacaaaagatatcatttgcaaataataattaactaccttcccattttattacaaatattaacatactttttctggcttatttttttcaagtatcattttatacatttacacacatatacaacaatgaaaattattcaattattcaatgtgttaatttttattaaaaatgattgttaggctgggtgcagtggctcacgcctgtaatgccagcactttgggcactttgggaggccaaggcgggtggatcacctgaggtcaggagttcgggaccagcctggccaaaacggcgaaacctcgtctctactaaaaaatactaaaattagccagggaaggtggcaggcacctgtagtcccagctacttgggatgatgaggcaggagaatcgcttgaacccaggaggcggaggttgcagtgagttgagattgcggtcggcgtcccccaacttcttagagggacaagtggcgtttagttggtggagcgatttgtctggttaattccgataataaatgtcaaatataacaaaaaatgcacaggtattaacatactgaatagggaaatgctgtaagattttactctaagagctaaaacaagtcaaggatgtgcactttcttcagtcttactaaacatagtactaaatgtccaagacatagaaaataaagaataaaatcaaaggcatccagattggaaaaaaaggagttaaattatcattgtatgataatcttttatctcaggctgggtgctgtggctcacacctgtaattccagcactttgggaggccgaggcaggtgcatcacctaaggtcaggagttcgagaccaacctggacaacatggtgaaacccatctctactgaaaatgcaaaaattagctgggtgtggtggcgcatgcgtgtaatcccagctacacaggaggctgaggcaggagaattgcttgaatgcggcacgcagaggttgcagtgagccgagatcgcaccattgcactctagcctacgtgacaagagtgaaactccatctcaaaaaataataaataataaaaaataatcttttatccctatacataatcctaagaaaagcctaagact

SEQ ID NO: 2846 - DNA, 1827 bp, Homo sapiens
gtgcagtggggcgatcttggctcactgcaacctctgcctcctgggttcaagcaattcttttgcctcagcctcccgagtagctgggattacaggcacgtgccaacacgtttggctaatttttgtattttttttttcagtaaggacagggttcaccattgttggtctggttgatctcgaactccttaccttgtgatctgcctgccttggcctcccaaagtgctgggattacaggtgtgaaccaccgtgcctgggaagaatttttatatttcaaattatatctactgaatgatttattgaaagatatttgcattgcttttacctatttgcttacagtaacaatgctgcagcttttccgcgctacctgcagaggggtccatacggcgttgttctggattcccgtcgtaacttaaagggaaactttcacaatgtccggagcccttgatgtcctgcaaatgaaggaggaggatgtccttaagttccttgcagcaggaacccacttaggtggcaccaatcttgacttccagatggaacactacatctataaaaggaaaagtgatggcatctatatcataaatctcaagaggacctgggagaagcttctgctggcagctcgtgctattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttctgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctccctctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttctaaaaaaaaaaaaaaaaaaaatgctgcaataattatgagtctataaatgactacttatatgaccatatatgtgaaagtttatatatgtgctgcattctattttattagtctactttttcacctttatactcatatcaaattgtttaatttggtagctttgtaatgtgttttgaatcaggcactttaatgcctgcagcattctttctttctttttttttttttaatattgttgggtagtttgtttttcttttgagtctctgtatacttttgaggttggtgtttctatttcttcaaaaatgcaatgagaaatttgaaaaatattgcattaaatctgtagattgcattgagcaggatggactctgcaatattaagtatttcaacctttgtgtaagagcacactcaagagtgtgttgtttagtttctatatatttgtaaatttttcagttttt

SEQ ID NO: 2847 - DNA, 1607 bp, Homo sapiens
ctaatccaaccatctagtagctggttccctctgaagttttcctaaggataacgggcgctctcgcaaaaaccccatgccacgcagttatttggtaaagcgaatgattaggggtcttggagtcaaaatgatctcaaccaattctcaaactttaaatgggttagaagcccagctcgatggcatggggccaggtatgaaatgcgagtgcctagcgggcaacttttggtaagcagaactgctgctgtgggatgaaccaaatgccatgttagggtgcctgatgctgatgcccattagaccccagaaaatgtgttggttgatatagacagcaggacggtgggcatggaagtcagaatccactaaggagtgtttaacaacaaagaatcaactcgccctgaaaaatggatggtactgaaacattgggcccatacccggccattgccagcagttgagagtggatgggagtggtgagggtggtcgctcccgctggagccccgaggatgctatgctgctatgagtgggaggaccgctgcaatgagccttgaagccttgggcatgagcctgggtggagctgtcccaggtgcagatcttggtggtagtagcaaatattcaaatgagaactttgaaggccgaagtggagaagggttccagttgaagatgggtcactcggtccccagagataggagagtgccattccgaagggatggatgatgacttccattgccctcagccaatggaaacggagtcaagttcagatttctgaatccggagtggcagagatgggcaccatgaggcattcagggaggtaatggaagtgatcctggagaagctggtgggagcccaggggagagttctttttgtgaagagcagggcaccctgtagtggattcacccttagagagaggtctgtgccttggaaagaatcatagatcaggaggcacctggtgagctctcacaggcccttgaaaatctgggggagagggtgtaaatctcacaccaggctgtaaccatatccacagcaggtctccaaggtaaacagcctctggcatgttagaacaatgtaggtaagggaaatcagcaagctggatcagtaagttcagggtaagaatttgctctaagggctttgccagtctggctggggcttgaaatggggctgggtgcaggcagtggctggatgaggtgctgtactccacccctcaacgctagcggcacccctctgcagacatcctccacccaccttgccataccttcctcttccctatccctgcccaccttgctattgccacttcctagcagccttcttagaactgatgcagaccaggggaatctgactttttaaaacaaagcatggtgaaggcctatggtgggtgttgacacaacgtgaattctacccagtgctctgaatgtcaaaatgaagaaattcaatgaagcacgagtaaatggcaggagtaaatatgtctctcttaagtgtagccaaatgcctcatcatctaattagtgactcatatgaatggatggacaagattcccactgttcctacctgctatccagtgaaaccacagccaaaggaatgggcttgacagaatcagcagggaacaaagactctgttgagact

SEQ ID NO: 2848 - DNA, 1053 bp, Homo sapiens
tattattgatactatatttatattgcatatggccaatatctttcttgcaaagataaaaaaattatcttctatattctacttatgtctgaataacctcaatatatagaagcagcataggaactgttttttgttaatttatttcaaaacatttttttgtttttgaacttagaattctagttttaaaaatactttattcaagatcttagtatttacccatggaaactaactggaaatttaaataatgtaaaattctagtatgtttgtttgatcttgttaattttcttccttgctagtaagcctgatactgtgattgcaaatggagaagatacgacatcttctgaagaggaaaaggaagatcgtaacacaaatgtgaatgcgatgcatcaagtaacagactctcatactccttgtcataaggatgttgcaagttcagaaccattcagtggtcaagtgaatagtcagttgaactgttcagtgaatggttccagttcttaccacagtgatgatgatgatgatgatgatgatgacgacgacgacgacaacattgacgacgatgatggtgataacgaccatgaggctttaggggttggagataattctataccaacaatatatttttcacatactgttgagcctaagagggtttgtatacttttaactttactaattttgcatataatttgaacattaagcattatgatattttttagaagagcaatattaacaatcattatcattgtggatagtgccagacaggaaaatcatcttttgcctcttgttctgaccaatttaagaagaaaaagggaaaaaaaatttagttagctggtattggtccattgttctctgaaacaatgcattgtttggggtctggaaggggatcagatttgagtggcaactactgtaacttcacctgtccttcattcagagagttttcttaagaatcctggagttaattatattgtggacattttggtgtgcttaggatgttgaaagtgactgcattagttaaatttttaattatgccaggttgttttctatggacataaaatgaat

SEQ ID NO: 2849 - DNA, 1199 bp, Homo sapiens
actaaccaaagacaaaccaccccacaaattagtgggctgtgcctgtgttgacacatctattctcgccctaatgatatgtttatttaactgatgactgctgtcctcattaggggctcattgttgagcccggaatagtgattatttttgctgatattccttttctgcaaagatgatttttttaaaaaatcactcttttggtgtgctatgaatccttaatgaggatagttaaatttaaaagaaacccccaaaccacccttcaggttgaaaatagaagtgtctgcaaaagcaagctgctaatttgctgattattgattgacatgattggtgacagacccaaaactttcaataaaatgaaagctcccatcactggagcatggtagcaaaaagaaacagaagcagtttcgccaatgggaaatgagtgcttggggttctagaacattctctttcctgcatgtagaaagagtcatgattctggaagtttgaatgttggtaatggcctccaaattggacccaaagctatgcgattcttggggatggatggagaaagatgtttgtaaaagcttattagctgaatactcagagtcaattaatgaacttaccaacccctgaaactcatctttctcctttagaattctaatcgaattcctgtgtggcaggtgagtattaacctcctgcttctcagacaaggagagtaagaccccaagaaacagaatcttggctaagattggggctagggttggtattaggacgtctggttaagacaaacgttttctccacccatcgctgggagcccacattttccctccatgacacaatttgaagactggttctacaaatactggcccgttcccctttacttgaatatatccaaatacataaggactgtgatcatgctgtgaggagtatgacacggtgggttgatcatggagatgttattcatgatgaaaattctatggcctcagctcaatgcccagcctttacagcagtttccaaccattttggcaccggggatctgtttcatggaaaacaattttttcatggatggagtggatggatggtttcaggatgaaactgttccacctcagatcgtcaagcattagattctcataaggagcacacaacctagatcccttgcatgcgcagttcacaagggggtctgggctcctgtgagaatctaatggccctgctgatctggcagg

SEQ ID NO: 2850 - DNA, 1222 bp, Homo sapiens
tttcaacctcctgcctcaccactgcttccttcctgagctctttccccacacctcaaaaagagtacaaagtgattccatctgcagaggtaaattctttgtttaaaaaagtactgtttttcttatcttttctggttctcctaggtatcagaacaaggtttaatagaaatccttaaaaaagtaagccaacaaacagaaaagacaacaacagtgaaagtaagtgtccccagatgcttgtggcaaatgaaaagatggatactttaaagattaatgttgagtatacatctaccacacatatttttcagcccagagacattttccttttgtcaaacacgtgaaagtttggggagaaaggctgaatctgttgggggagggttctaatttttataggctcttgactccattcccacccttttagttcacgctaagttgctttaaagacacaaatgtcttgctaaaattggtagaaatcttttctcggaaaatctgagttatgctttattagaaatgttctgacactcatttaattttcctcccagttcaacagaagaaaagtaatggactctgatgaagatgacgattattgaactacaagtgctcacagactagaacttaacggaacaagtctaggacagaagttaagatctgattatttactttgtttattgtctatatgccttttaaaaaaataaacttgttatgcaaaataaaacatttgggtaagttgttttagtatcatagccaagtggccagatctgtgttttgaatttttccccttcctaccaaaagctttttttatttttatttttgttattatactttaagttttagggtacatgtgcacaatgtgcaggttagttacatatgtatacatgtgccatgctggtgcgctgcacccactaacttgtcatctagcattaggtatatctcccaatgctatccctcccccctccccccaccccacaagagtccccagagtgtgatgttccccttcctgtgtccatgtgttctcattgttcagttcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgtgggacatttgggttggttccaa

SEQ ID NO: 2851 - DNA, 1149 bp, Homo sapiens
ggttgggccaaattccgctccccctacagcttgaaggggacataaccgatagcccgggaagggggcgtttgtgatcctttggagatttctttgcttatttccttctgggcagcggacattagaggaggattatcattaataggaaggggagctatagggaggctaggatatggaggtaagctgagaggtcctcctgtgggatgtaaattgcaagctttgcatacttgggtattctccttcaatgaaaagaaaacttagacataaggtatttcactccatttgccttccctcttacagaaaaggtcaggctgcaggatagtactgtagtttatacttccctcaggtggccatttttccccatcagagagagaaattggggccaggctgtagtatagaaaaaaatgagccacctctttttcagggtttgtgggtcaaattggtcccagtggcttaggatgcatttcaagggtgagcctgttgatgcctgagtgtttcccatctgaaagacaaaaccgcctgtggttttggtttgtttgtttctccccctgcccaagaacctgcaacggtccctggaccctgctgatcggaatagttgtgctcaccaatgcagcagcagaaacacctcttgcccaagaacctgcaacagtccccggaccctgctgattggagtagttgtgctcaccaacgcagcagcagaaacaacccctgcccaagaacccgcaacagtccctggaccctgctgatcagaatggttgtgctcactgacacagcagcagaaacactagttctcctagaccacaaggaggaatgaggaaggtcagatttcgtggcccttaccaacacattctcgaaaacctgcgccctttcctgtcctcctagacctcaaagaggactgagaaaaatcagatttagtggcccttactgatgcattcttggaaaactgttggagtcctaagcattctcctgttagtattgggaccttacccatgtcctataaagatgttatgcccccaaaatgaagtggagggccataccctgagggagggaagggatctccagagttggaagagtgaagccttttatccccagttatatgaataggaaggatacaatttctgaggctcccgatatcctagtttcaggaatagc

SEQ ID NO: 2852 - DNA, 1180 bp, Homo sapiens
agtgttgggattacaggtgtgagccactgcatctggcttgagtttttatttaaagccccaaacattaatgagtccctgctgtgtgctgatacccacaactgacagcttatggccacacggtctgtaggatagacaagcccataaataattctgtacacaatggtaaaacaagaactgctgttgatgtgtgtaccagaagggcagtgacgtcagcctggagagttggcctgggcctggcagggagtaaggaaagaattctgggtgcagaagacagcaaataccaaggcctaaaaaagaatgaattatttgctgtttgggaaatggaagcccacgctgagtgctgaagcacagggactctgcgcaggaagaggaggggaagcaagaaatgaatttgggtccttgtgatggcagtggctgctgccatcacgctgtgtggctagggctgcacacttcatggagccggtggaagccccgtccctcatgagttgggactggagccgcaaaccgctgctgcagacccaggccttctgctctatggagcaggcaggagccccaccctcttgggcagggctacagccacccaaactgcagctgtggatccgagcctctctgctcctgggggagccgggaacaggcagaatttgcccttccagatgcagctgcagccgcgcaggcaggagccagggacaagtgggagccctgcctcttccaagttggcggggtgggagctcccaggtgcagctgtggctgcccccccaggcacaggacgagggcatctctgtagcctgcaccatcggccatcccaggaaggacagcccccttcaccctccatccctgcaggctcaggggtgtctgcttccactgcctggcctctctccactccagcaactgctctgatcttggaggggagtcggagccaagacctgcagccatgaatggcagcaggaggaagggggtggggtccccagtaaggccccaccctcaggccagggagggcctgaattctgggggctgggctgccagtccctctgaccagagtggaaactcgtggagccttttctgggcctgccaatggcccaatcagcacacacttcttccccgctgaggtccataaaaaccctgggctcagccagagcagcgcagagaatagccagaggatgaagatggtagagacgagggg

SEQ ID NO: 2853 - DNA, 1192 bp, Homo sapiens
ggatgaagccaagcagctggcgctggccggcctcttcccttaccagccgccgccgccgccgccgccctcgcacccgcacccgcacccgccgcccgcgcacctggccgccccgcacctgcagttccagatcgcgcactgcggccagaccaccatgcacctgcagcccggtcaccccacgccgccgcccacgcccgtgcccagcccgcaccccgcgcccgcgctcggtgccgccggcctgccgggccctggcagcgcgctcaaggggctgggcgccgcgcaccccgacctccgcgcgagtggcggcagcggcgcgggcaaggccaagaagtcggtggacaagaacagcaacgagtaccgggtgcggcgcgagcgcaacaacatcgcggtgcgcaagagccgcgacaaggccaagcagcgcaacgtggagacgcagcagaaggtgctggagctgaccagtgacaatgaccgcctgcgcaagcgggtggaacagctgagccgcgaactggacacgctgcggggcatcttccgccagctgccagagagctccttggtcaaggccatgggcaactgcgcgtgaggcgcgcggctgtgggaccgccctgggccagcctccggcggggacccagggagtggtttggggtcgccggatctcgaggcttgcccgagccgtgcgagccaggactaggagattccggtgcctcctgaaagcctggcctgctccgcgtgtcccctcccttcctctgcgccggacttggtgcgtctaagatgagggggccaggcggtggcttctccctgcgaggaggggagaattcttggggctgagctgggagcccggcaactctagtatttaggataaccttgtgccttggaaatgcaaactcaccgctccaatgcctactgagtagggggagcaaatcgtgccttgtcattttatttggaggtttcctgcctccttcccgaggctacagcagacccccatgagagaaggaggggagcaggcccgtggcaggaggagggctcagggagctgagatcccgacaagcccgccagccccagccgctcctccacgcctgtccttagaaaggggtggaaacatagggacttggggcttggaacctaaggttgttcccctagttctacatgaaggtggagggtctctagttccacgcctctcccacctccctccgcacac

SEQ ID NO: 2854 - DNA, 1278 bp, Homo sapiens
agggctgagtgattctgtaaccacctgagaccttcacgtttgctgccgttgggggctcaggctgcactccccgggtcacctgacctgctgcccaggggcttccagtcctgtctgtgtggactggcacctgggctgctggagaagtctcctcccgttcggaccagcctcagggctgcacgttacctcaggaatgggccccaccatgaaggggcccatctgtcagcagcgtcttctaggtccccagctcagggagccatccccagctccagttttctcatgcgaatatgcacagttttaattcacgttgttacactagcctgccgatgagacccagacacaggcagacctggcgctcttgacccctgattccagtgaggactggccctgaggagtccttgcagacctgctgcctcccccacgacaggcccaaagatggaccccccctggccttgtgacagctccccaagtgttctccggtggagaaactgcagaggactggtgggcggggctccccagccatcaccatcctgtgtacaatggctgtagacttgtatatggctcctttaatattgtaaagatgctgatgtacaattgtcgtgcatttgtgtgaacacattgcgttcccagtccatgccataaatgatgctctcaagcaaaagactggaggctctgtcctgtgcagaagcagcagccagactcccgcattcgatgttgtgcagggaggtttgggggcggaacggattcctcccttggatccttcagttcccatcgaggaataacccgcagcagtggtggaggaaggtcagtggctgggtcctgagcttggtgttatttattgcatttgggtgcctgtcccctcagggcagcacagattctgaattctgattcacagtccctagccagatgggaactgggaaagagacagaaggcgtctgggtgcttttgaaccctgtctcaaatgtttgggattttctctctcactattctttggttggggatgatgtcctctttagacccccacgtaatggtatgagaaggtggcaggcagtggctcagccagccagggggcaccaagtcatgcagccagcgtgagacctgcagttcacctaagcacagaacgagatctcagtatgcctccatgtaaacagattcacataggcctccaatttcaatgagaccttttgcattttttctcaaagcccttatgttctaacccatgagaaccattttacctgccctctaagggccaccagcttcgacctgcctcaggggacagca

SEQ ID NO: 2855 - DNA, 1145 bp, Homo sapiens
tttcgtggaaatgagtgagacaggtttttctatgaaagtaaaagtgggggagtatatttaaagataatttaaaataaacttgagcaaagtaaaaagaaaataatacaccaataatttggaacatgagctaaatttttttttcttttttagaaagacaacaaagttgctgcatagtctacaaacaagtctctgaaaataggtgaatttctagctcttcatggtcctgaacattgatttcagtctttgcaaagaatgaagaagtgaattcgctgtacatttgtcaccagcactgggtttttgttttttgtttgtttttccgcttaatttcaaagataaaatgcagttacttttgggggtggaaggctcatcttaaaacatgagcattaaatatatttggaatagcagaaggttaagtaatttcttatgtatagttaaactaaagcagtacttcagtgggacttaacaagtattttttcatcactgaaaggttttttttttttatcactaaattgtatttggcaattgcaagttgcctgcagatagggccgtgatactgtgttttgagccacagaaggttgtgtgtgtgtgtgtgtgtgtgtgtgtgtgtgtgtgtgtatgtgtgtgtctttttcctcctttcttttggggaatcctgtaatatgaggtagcttatttcgtcaattaattagggtgctggatggtagagaattttgtcagtcaactatgtacacacagtaaatactgtttcttaggcaaaggtaacttttttatatagttgtaaaattccattatattccattgccaaagaaacattaagaactttgtatagctgtataaaaagcaactaattttttaaagaataaacattttaaagtcagcaaacatactgtgtccttgcagaagttgatgtgctgagcagcagccttatgggtgggtctttttttcttagttttccaggcttaacatttttgattttgttttttaatgtttggaacataaatgaagatttgatacattatttcattatctaaaaaggattaattattcatgctcattgtaagaacttcattttgtagcaaatggcatatcacaggatctgtccagataatcgatattttcagtatacaaatgtaaataatcacaga

SEQ ID NO: 2856 - DNA, 1120 bp, Homo sapiens
ctggctgatttttgtatttttagtagagacaggatgtcaccatgttggccaggctggtctcgaattcatgacctcaagttatccacctgccatggcctcccagagttccgggattacaggcgtgagccatggcgcccggcctctgaaagcatttattgcttgtttctgacatgtattgttgccattctctgcctttgctcactgttcctcttttctctcactgttcatgccctgagcatctctggcaggccttcggggcctgtcctaggcatatatgggtcccctcctctcctcctgactgtctgcagcacataagtccttggggagctcctactcctctaagcatacagtgggttcttggaacaaggttatggtgctaacagagacctcagggcctgcctgtctagtggatagagggccgagctatggcaccatgcccagctgggagcatggctgcctggggttggggggggcagtctttatatcctgaccgtaatccccagggtcgagccgtgctgcacgtggctctgcggaaccggtcaaacacacccatcctggtagacggcaaggatgtgatgccagaggtcaacaaggttctggacaagatgaagtctttctgccaggtaagtggctactgggccggactcacccttggccgtgtgtgtgagttatttgggaatctgggagccctaaggggcagctcttccctcttcttgtaggcaggactcaggttctcactgcagcttaagggaggggttgcctgtgtgatcgctgaccctggagtctctgctgaggcctgaatttctcctggctctgctctgaaggaatctgctgctggcagaagtggggccagtttctttcctgaattgtagacacctatggactcatggtgacaaaccacagaggcttcaaatgaaaagtggggcccctgagagacaggacagtcaggaaaggaaggagctttttcttttttctttttttttttttgagatggagtctcactctctcgcccagagtggactgcagtcgtgctatctcagctcactgcaacttccgcctcctggattcaagctattctcctacctcagcctcccgagtagctggaattacaattatgcgc

SEQ ID NO: 2857 - DNA, 2112 bp, Homo sapiens
gagctgggaaagcagctggctaagaaaatagagcctgagcttgatggcagtgctcaagtgacctctcacgacgcttctaccaatgggctcatcaacttcatcaagcagcagcgcgaggccagagtccaataaactcgtgctcatctgcagcctcctctgtgactcccctttctcttctcgtccctcctccccggagccggcactgcatgttcctggacaccacccagagcaccctctggttgtgggcttggaccacgagcccttagcagggaaggctggtctcccccagcctaacccccagcccctccatgtctatgctccctctgtgttagaattggctgaagtgtttttgtgcagctgacttttctgacccatgttcacgttgttcacatcccatgtagaaaaataaagatgccacggaggaggttgtaggctcagcctctgattttttttttcctgtgatggtgctttatgtagcagagggcaggagcgctcagcaggacgcaggctgtgcctctgcggacacttaacactaagtggtgagcgggtctagagtggagcaaggtgccctgagaagacaatagtggggtgggggcacaatcagtcaggacggcaacttggcctgtgtcaccaaatcccaagactgttttccactcctcacctctgtgactgcagaaattggatactctgttcactcgatggttctaaaaactgcattgagattatgtttgtttcgggtgaattcctggacaagaccgaggatgactgccatctcctggcaagacgctcaggtagttcttttgctttaaaaggcagatattgaaaactggaattttttttttttgagtctcgctctgtcacccagactggagtgcagtggtgcaatctcggctcactgcaacctccgcctcccgggttcaagctattctcctgcctcagcctcccgagtagctgggattacacggcgcacaccaccatacccagctaatttttgtatttttagtagtgaaggggttttaccatgttgggcaggctggtcttgaactcctgacctcaggtgatctgcccgcctcagcctcccacagtgctgggattacaggtatgagccaccacgcccggcccattttttttttttttttgacaacttttttttttttttgagacagggtcttgttccattgcccagactggagtgcagtggcatgatcacagctcactgcagccagtaatcctcttgcctcagcctcccaagtagttgagactacaggttgtaccactatgccctgctagttttttcattttttgtagagagacgggtcttttttttttttgagacggagtctcgctctgtcgcccaagctggagtgcagtagcacggtctcagctcattgcaagctccgcctcccaggttcacgccattctcctgcctcagactcctgtgtagctgggagtacaggcacctgccaccatgcccggctaattttttatatatttttttagcagagacagtgtctcactgtgttagtcaggatggtctcgatctcctgacctcgtgatccgcccgcctcagcctcccaaagtgctgggattacaggcgtgagccaccgcgcccagcaaggcgggtcttgctgtgtttcccagactagactggtcttgaattccagggctcaagagatctcccacctcagcctcccacagtgctgggattacaggcgtgagccgccacacccagcctattcaaaatttttttttcttagagacagggtctttgttgcccaggctggactgcagtgatacaatcatagctgactgaagcctcaaattcccaggctaaggtgatcttctcacctcagccttccaagtagctgggtccgcagatgcatgccagtacacccagctcatttaaaaaaaaatttttttcttttttgagagtcttgctttgttgcccaggctggagtgcagtggtgtgatctcggctcactgcaagctccacctcccggcttcacgccattctcctgcctcagcctcccgagtagctgggactacaggtgcccgccaccacacccggctaattttttgtatttttagtagagacggggtttcaccgtgtta

SEQ ID NO: 2858 - DNA, 1169 bp, Homo sapiens
aactcctggcttcaagcagtcctcccacctcagcctcccagaatgctgagattatgggcatgagccagtgctcctggcgtgaaattactctcttaacctgactcatcttttttccctagccttaaactactttaatagttccaagttgatattccacattctgccttcatttctatcatgtattatctgctagttatattagaatagtggtgagtttaggaacaccttgaaacagtgttttgtgtaaggtacagcaatagaagagaaatatggcacgttggatttttaagattatgtgtttctgtgggtacttctcctggagtaaatttgtgatataaattctatttgatattttgctaagtgaatgtctcttaaatgtctgtaattaacagttgtattattctggccatagctataagaaaattgtacaaaaaatgaagccagtaagatagttttgagtctgtgtcatcctaattaaagataactaattttttttttcccaaaaactcatactgtttgttttacttccagctgcccgaaaccatgttaatagaatgtgcctggcagctgatgttcctcttattgaaagtggaacagctgggtatcttggacaagtaactactatcaaaaaggtaaagaaaagttttatttttttaacttcccaaatatttatttgagaccttggagcaggaggaaataaactttgtatttatataaaatgaacaggtgaacatccaaaatgtaaggacttttatgcttatataaaacttaaaatgcggggccaggtgcagtggctcatacctgtaatcccagcacttcgggaggccgaggtgggcggatcacctgaggtcaggagtttgagaccagcctggcaagcatggtgaaaccccatctctactaaaaatacaaaaattagctggacatggtggccggcgcctgtaatcccagctacttgggaggctgagccaggcgaatcacttgaacctgagaggcagaggttgcagtaagctgagattgcaccactgccctccagcctgggctacagatcaagcctctgtctcaaaaaacaaacttaaaatgctataaacgtgctcaaaagactatgggcaaggaaatctttcagctctgccattttgtttcatttgacttttgtattaaaatccttagag

SEQ ID NO: 2859 - DNA, 1189 bp, Homo sapiens
ggggagggcacattttaaagatatcgcagttcagaagttctgttgtgaagcactttagtttaaaaatctgtatactttgtgtgcatgtccccatgagcttggaggcattgctgactggcatccctaggctcagtgattgtctgtagttgtacatttatttacaactacataatgtacatttatttgtatgattgtgcttcagactgatctttggagctaaatttagggaagcttttggagaggtgacttaggaaggcaggggcagtcggcagttcagggctcctttactctgcattcctcagagcacttctgcatttcgctgttttcaatgtagagattctgttagaacttccttttacaaatgtttttccttttgaaaattgttatgctgctggtatatgacatgtatctttaaatcagatttcatagtgtaatatagatcagcaatgacgttttcttgtatcttatcaattagggattatggggttcatgggatctgtctttcttttgtaagctttttaaagatgacatcaggtatctgttgacaatggacaaactatggcggaaaaggaaacctccagttccgttggactgggctgaagtacaaagtcaaggtaaagaatacattttagtcttggaacacctaagctggaaatatcctcgcgtaaagtctttgtatagccctgttgttgcttgaaaatgatatgtcttcatatattcaaacagtgcaaaaaaatatgaagaacaaaagtcactgaagtcccacacttcagaaatagccactaataacattttcaggagtgttctggtggtccgccctatgtacacagatgcaggcattcgttatacactgcgtaaatggaatcatactattgataaactctcacttgcttttgtcagtcagtatagttaactagtctcttattaacatgtagtgtttttgtattttccctgaaataaagttttgaaattgctatatatttatgtatatcttttttttttttttttttttttttgagaccgtgtctcgctctgttgccaaggctggagcgcagtggcacgatctcagctcaccgcaacctgggttcaagcgattctcccgcctcagcctcccgagtagctgggataacaggtgtgagccactgcgcctagcctatttatgtacacctttgtacccttgtgattatct

SEQ ID NO: 2860 - DNA, 1101 bp, Homo sapiens
gatcgtggtgcccacgaggtcaggagttcgagaccagcctggccaacatggtgaaaccccgtctctactaaaattgcaaaaattagctgggcgtggtagcacgcacctgtaatcccagctccttgggaagctgaggtaggagaatcgcttgaacccaggagggagaggttgcagtgagctgagatcacaccactgcactccagcctgagcgacagagccagactccatctccaaaaaacaaacaaaaaaagatataaaaaaaatgggaacattctctggccagagtattgtggggacttgggaagcaggaagtttgagtcctgggcgcaggccctggaggggctgtagcaggggattccccgcttgctgaggccaggtctggtgcgggagatcgtggctgcctccttgtggaagccaggggaactgcggaggccgagggctggtggggaatctggcgggccgggctctggctggggtgagatggaggccaaccccaggtcccgcctccccagacgctgagtccccgcgagctctggcacctggtgcatcagtgctacggctcagagctgggcctcaccagtgaggatgaggactatgtctcccccttgcagctgaacggtctggggtgagttggaggtcaaaggaggttgaagggttcgggggagaacaggacggtcggcgtgcagagttcctggagtgctggggggcctgagatggttgtatgacgtctggaggattcaggagggtgtatggggtctcaaggacacagcagtcccgcttcctcccctttcccacaggacccccaaggaagtgggagatgtgatcgccctgagcgacatcacctcctcgggggcagctgaccgcagccaggagccaagcccagtgggttcgcgccgtggccatgtcacgcccaacctttcccgagccagcagcgacgcagaccatggggtgagcggtgggttggaagaggggtgggatactgataggaagagagaggagggctgggggtgcagtgggagaagaacagcctgacagatttggaggggaatggatagggggacaggggaggcctggatggaggaacaggacagggaggggaag

SEQ ID NO: 2861 - DNA, 1336 bp, Homo sapiens
ggggctcgggagtcatccctggggtggaggccggtgggcggtgcctgccctaaggctcctggtcccctcgccccccagagtaaaggagggatcctgtccaaggcctgcgattacatccgggagttgcgccagaccaaccagcgcatgcaggagaccttcaaagaggccgagcggctgcagatggacaacgagctcctgaggcagcaggtgggtgcggggcctggagcgggtcagggcccaggagccccagatgcaaggcgctggccctcagctcccttgacctccgtcgtgtccgccagatcgaggagctgaagaatgagaacgccctgcttcgagcccagctgcagcagcacaacctggagatggtgggcgagggcacccggcagtgacgcccgccaccaccacgcagccgccgccgcccacgccggcctctgctgcccccttccccagcccttagcacagagagggacacatgcccctcccccagctgcgtttttttatagtagatttttaacaaaaaacggggagaaataatgcatttctgtggatacagtgcccaccgccctcctccacttggaaacggtatcctccctgcccatccgtctgtctgtcgcccttctcccggccctcactaagccccggcacttctagtggtctcacctggaggcaagagggaggggacagaggccctgccacgtcccgctgcctcctgctctctggaggtactgagacagggtgctgatgggaaggaggggagcctttggggggccacccggggcctggacctatgcagggaggccacgtcccaccccacctcttgtttctgggtccctgctcccctttgggggtgtgtgtgtgtgttttaattttctttatggaaaaattgacaaaaaaaaaatagagagagaggtatttaactgcaataaactggccccatgtggcccccgccttgtctgcttgtgtgtttgtccatctcaggagtggggagggggcctggggtctgcagagctccacgaggcatggttctgctgttgtgcacatggctgtgcatggtccctgccagctgcaccacccattacccagtggttggttggatggatggaggaattaaggaatgaatgtcccctttgaggccctagacgtgcatgagggtgtggggagctggggtcaaggacatgtcccatgttggaggagaggcaggggtctccgtgtcaacagttcctgaaaacacaaccagcccctggccctgccctgctgggccaaagccctcccctctgcaccagccaatagtggggcctggccttgagcccctcacccccagggagggcagatggcc

SEQ ID NO: 2862 - DNA, 1271 bp, Homo sapiens
aactgttacatgaacatatgataatcttccgaatgaaggtacatgtgtgacatccatttgccataacacattaggacacagacctctgggattaactcctgcctcttgagtgggcaggtgtaggacttgacactgggtgcaatgtggtacagtatcttttgcctgtttccatgtgacatcaaatttgttttttaatcctgctgcatttacatgagttaaagcatgaagttcttgtgcttttatgaatgcagatgataccagtaagtcagcttgttaatttgctttagtcaaaggccctagtaaattagtgtgtgctcgaatatgagtaacataaaatgggaaatttctttttcttacagtttgttgtaataaattgaatagctggtttaactgatcatccatgctatatttgattagagctgtctcaacatcccttgtagcctgtactacatatgcagaatctgatacaatattgataggttgatcaaaatcttgtaacactgtaatgactgcaaccaactctgctctttgagtcaattgatattgagttttgattactcgctcatcagaccccagaaaaggtgttggttgatatagacagcaggacggtggccatggaagtcagaatccactaaggagtgtgtaacaactcacctgccgaatcaactagccctgaaaatggatggcactggagcatcaggcccatacccggccatcgccagcagtcaatggaatgtgagtgccttagaggtcttggggccgaaacgatctcaacctattctcaaactttaaatgggcaagaagcccagctagctcagtcggtagagcataagactcttaatctcagggttgtggattcgtgccccatgctgggtgccagatgaagaggtgagttgcccctaaaaaggataccctattccttctctttcttaatttcttttagtctcaattgggactttaatgccattttcattttttcctagtccctttcctggtatatatcccatctcagtcatgattttttgatttgcggggctgtataatggagcaggcatagtgatttccgcaccccgttgttgtaataaatctcgaccccacagattaagaggaatcgaagtagtcattggctgaacagtactttcttgattatctgaccctaaacaatgtaaaatcttagtactttgatacacttctgaggctgtgcctacgccgataagtcctataacagcctttgtttaggccaattttttggccactgattgaaagcaatg

SEQ ID NO: 2863 - DNA, 1099 bp, Homo sapiens
tctcccacagctgtggccccccagagggcccctatcctgcgtccagccttcgtcccccacgtgctacagagagcaggtgaggggccagggtcatcatccctgccacataactccccccaggccctggaactccccactaacaccctgacagattccgctctctcctctgcagcagccggcccccgccctatggccctacggccccctcaccaggccctcgtgggcccccctctgcctgggccccctggaccacccatgatgctgccaccaatggctcgggctccagggcccccgctgggctccatggctgcactgaggccccctctggtgagtgtgaacagggaactaacggtcagatgtgcggtggacggggagaccatccatcctggcccaatgggctatgtctgagttggcctctctcctgactttctgtttctctaccttctcactctgcctttgtctctgtctctttctgcatctttctgtggcaaaatctgttctctccttttgtgaagggagtacagagagaaacatgctattggaatatttctcttttgattgttactgatgttcttgtctgtggctgtctctctctgcctgtgtttctccttctctgtgtttgtctggctggagactctctgcttgggtgtctcttggctgctctctggcccccaggccctttctttgttggatggaatggagatgacagtaaagtctgagcctgtgagccggcccccctcatgctctcctcttacccacaggaagagccagcagcaccccgagagctgggcctaggcctggggttgggcctgaaagagaaggaagaggcagtggtggcggcggcggctgggctggaggaggctagcgcggctgtggccgtgggggcaggaggtgccccagctggccctgcagtcattgggcccagcctgccgctggccctggccatgccattgcccgagcctgagcccctgcccctcccgttggaggtcgtccgcggcctcctgcccccgctgcgcattcctgaactcctgtccctgcgtcctcggccccggccccctcggccagagccacccccaggcctcatggctcttgaggtaag

SEQ ID NO: 2864 - DNA, 1122 bp, Homo sapiens
cctccatcattgtttatactgagcatcgcctgtggtcagtggtgggattgcactgtgtattgtttggcaccttttttgcacttgactatgtatcttgaagatccatccattcatgccagaacataaatcagcctcgttttttttcacagctgcctgctattccatctcccctgtttggacaaacagcatagtgttgacttgaggttttcaaagcagggcccacccttggagctctgtacagtgacacatctccccatcgacagctctgcagtgggcctggggttttcctgcccattactctcctcccagcatgtcagcttgttcagaacagtgatttctgtcttttggggtcactgctgattccccggcctctagaatagaggttggcacacagcaggtacctgtggatattggttgaacaaacaggtgggcaaagtgaggaagataagaagtccatccgttcagtttccccactgcggagggaataacactgtctttccacaggtcacagactgggatgagcaacgggctgaaggcacgtttcccgggaagatctgaactggctgcatctccctttcctctgtcctccatccttctcccaggatggtgaagggggacctggtacccagtgatccccaccccaggatcctaaatcatgacttacctgctaataaaaactcattggaaaagtgagactatgcgtgtgaacgggccaggcagtggcaagaagctgggctggaatcagtgccctgaccagggaggggcttgaatgagtattttctctgttttgtttttatttatttaatttaatttaattttttttttttttatgatggagtctcgttcttcacgcaggctggagtgcaatggcacgatctctgctcactgcaacctccacctccagtgttcaagcgattctcctgcctcagcctcccgactagctgggactacaggcacaccccaccacacctggctaatttttgtatttttagtagagatggggttttaccatgtcggccaggctggtctcaaactcctgacctcagatgatccacctgcctcggcctcccaaagtgctgggattacaggcatgagccaccatgcctagcgttttttaactta

SEQ ID NO: 2865 - DNA, 1221 bp, Homo sapiens
gagaccgagtctcactttgtccaggctggagtgcagtggcgtgatctcggctcactgcagcctttgcctcccgggttcaagagattctcctgcctcagtctctcgagtagctgggactacaggtgcccatcaccacgcctggctaatttttgtatttttagtagagacagggtttcaccacattggctaggctggtcttgaactcctgacctcgtgatctgcccgtctcggcctcccaaagtgctgggattacaggcatcagccaccacacccagctccctgtccctatctttcctcactgtccagcccctgaccctgtttattccctgccagctgagccctggagggcagatggaggaggtggccggggctgtcaagcagatctccgacagaggccctgtccggtctgaagatgagtcggtggaagctaagagagagcggccctcagtatgcatcgggaggagggccctgaagaagactggcgggaggagtggggctgcgggagcgcaagctgcccacacacactccgatttctcccccagggtcccgagtcccctgtgcaaggtccccgcatcaaacatgtctgccgtcatgctgctgtggccctgggtcaggcccgggccatggtgcctgaagatgtccctcgcctcagtgccctccctctccgggatcggcaggacctcgccacagagggtaggtggggagactggacagccatgtcaggtttggggatgaccccacacttgggtgacatgcaccaagagcctaggagagagggagccaagtcaggtgctcaggggttaggtggcaagtgggctggagtgctaggtcctagagcaacttcatttgggggcaccaggaacctggcgctgtgagaaagcgagagccaggttgtgggaaagcagggaagtgaggtagaagcctggtggctttgtggctccatcccctcctccctgcctgctgcaatagatacatcatcggcgtccgagactgagagtgtcccgtcacggtcccggcggggaaaggtggaggcagcaggccctgggggagaatcagagcccacaggttctggagggaccctggcccacacaccccggcgctcactgccctcccatcacggcaagaagatgcgcatggctcgatgtggacactgtcggggctgcctacgtgtgcaggactgtgggtcctgtgtcaactgcctagacaagcccaagtttgggg

SEQ ID NO: 2866 - DNA, 1156 bp, Homo sapiens
gacctttgggagagttgtggctcagataccatgagcactgcactcagcctgcctgtgtagagagcatttctaaactgcccagtttggattgtgggagtcttggtgtcacacccagccctgagttcaaataccagctctaagctgggcatgatggctcacgcctgtaaccccagcactttgggacgctgaggcgggtggatcacttgagctcaggagttcgagaccagcctgggcaacatagcaaaaccctatctctacaaaaaattagccgggtgtggtcatgtacacctctagtcccagctactcaggagggggaagatggcttgaacctggtaggtagaggttgcagggagcacagatcatgccagtgcattccagccttggtgacagagcaagaccccgtctcaaaaaaaaaacaaaacactaaaaaaacatatcccagctctgccatttattttcttgtcaccttgagcaggttatttcccctgagcctcagtttgctcccctgtaaaagacaccaccgtttacatttaccttaaaaatggtgtgatgaggccgggcgcagtggctcacgcctgtgatcccagcactttgggaggcctaggtggatggatcatctgaggtcaggagttcaagaccagcctggtcaacatggagaaactgtgtctctactaaaaatacaaaaattagctgtgcgtggtggcaggcgcctgtagtcccagctacttgggaggctgaggcatgagaatgacctgaacctgggaggtagaagttgcagtgagctgagatcgcgtcactgcaccctagcctgggtgacagagcaagactctctcaaaaaaaaaaaaaaaagaaaattgtatggtgagaaatgaatgagatgatatacatacattctttagcacatgggtggtactcaaggaagtcccttttgtcactccctttgatttaccccagttcttccccacagcccccttcctcaggtcttgaggcctccagaacaggccctggtttgctgggatgccccagacctgggcccagggtgtggatgtggcaagtccagcacccctgcactaagcggataggggtgtgttttccaggagcatctggagaatggggtccaggctgtggtgtgggtggcttcagggtcagccacggc

SEQ ID NO: 2867 - DNA, 1198 bp, Homo sapiens
gggaaccccattgtccgggaacccagagctcacagccacgatcttagacccgagcccacagagccagaggtgacactggaatcctgccgctgggaatacctaaattctcaagcccacatttgggatttcctaaaccccgccctggggccctttaggccgtggatgtttgctccgcgcccatgacctgccaaggacctctacattcaggctgggctctggatctcacattctagcgcccagacatgtcgggaacgccttacgccaacttggggtccccaccaagagaacccccaccagatctgcaccctccccttcacgcgtgcacccagtccaggctccctcaagccccacgggtgccttttagacctgaggaggttgcaaacctgatcccccatacctgccccacccatccgcggacaacccgccctcgcaaactcagacccccacccggaggcttcagattcctcccaggtccagctgccggaaatgcgtgtttgaagggagggtgtgggctcaggggcgaagcacccactggtccccttttttccccccagcagtgagtcgcagccatgttcctggttaactcgttcttgaagggcggcggcggcggcggcgggggaggcgggggcctgggtgggggcctgggaaatgtgcttggaggcctgatcagcggggccgggggcggcggcggcggcggcggcggcggcggcggtggtggaggcggcggtggcggtggaacggccatgcgcatcctaggcggagtcatcagcgccatcaggtaaggcggagactatcagaggggcggggcctgggaatgggaggagcctcagtgaggcgtggtctgggaggggcgtggtctaaaaatagaataggattaacctggaggctaacctgggtacatgaattaggccggggaggcctggtttgagagttctgctgtaagggggtggaccccagtgaggcggatatcagtcattgggggcggtgcttgatatgggagtagtctgattgtgtgggaccaggacaatgtggtcctgaggggactgatgtggagttttggcgggtggggcttatgggtctgggctcagcctgcattggctaacctggagatgaacgttaaaggtgcggagccaatgcgtctgagtgacattttacggaaggggcttgacttatgagtgtggtcagaggttttaggtgg

SEQ ID NO: 2868 - DNA, 1196 bp, Homo sapiens
tgcaggagtgagccaccacacctggcttgatttttctttgtttttctcttgcagtttatatgttcagaaaggccatgtcatttgtcctgtatatgatcaggcctggatctgaccgatcatatccctgttgcagtgtttaacttattcttctatctctgtgtttcctataaatgaatcattggatttgcagagtaggtgaatttcaggtttgagatgtacacacacacacacatacacacacacacacacacacacacacacacacacactgtttcttttttggcaggcagggctagccgtcctcctaggtgttgctgtgtatccgttagggatgtaaagctgggggcccctttctgtattggtgttagtggccgtggatgaccattgctcagagccattatttcatttggggtgtacaaaaattgtgctgttgtaattctgtccacctcttcatttattagtgggactattcctctagagagaacctgcccctcatctattattcagttatcctgagggtactggctcttttgaacttttgtttgccttagaaatgactattgaacaattgggctggtggtttctaatctgttgtgtgttttttttttttttttttcctgcagagattcaaatcttccttgtttttatgttcattcatttgacatttgccggtctccaccactgctcataccctgtcctgagcttgccaataaacagatgaaccagtccagtcatctcattgtgtgggcacggctgctccaggccttacctttgaccgggtggggccttgcgggtgtttgtcgaagtaatgagactgtggacattcccatctttctctctctttcccctgtcgtgcattgtcagaccttatagtctttggtgagttcctgctctacgccaaggaattagtcctttatgcttggggcaagaggtttttgagtatttggatttcttctgatctgaaactccattcctagacaaaagaacaataaagggctctactccattgcagaggcaagccctggtaacctggccaggggcgagccctgaccccagccactgttgtctgggtcataaattcttgagagcagtagcacgcttgaaatcatttagatgctttgggatcagttattcattatattgcacgatatctaagggcctctttgctgctagagattacaacacattcctcctgg

SEQ ID NO: 2869 - DNA, 1227 bp, Homo sapiens
gcctgactgcctgctgccactcactctgccagcttgggagttgctcaggcttgtcctccagggaggtggcattctcttctttgcatcagagactggcttaggtaggaaagccactctgttacctaggaaagaggcaacactatccagcaggtaaaacttgcccacccagttgctgggagaggcccattgccttgggctggcgaaggagataggaatgggattctctatgggaatgaaggaagagaaggagaaacgccgtgcataattggtaattggctcatcttgaagcctcacgttgggcagtcactccttagacccctgccgttgacctgcagaaaatgggagatgggtacaaacttgaggggacctgggtttggggagcctccaaagacgggaaccaaccaaacttgtctctcctttgcagatggtccatacccttacactctgaagttgtgtttctccactgctcagcacgcctcctaattaggtgcctaggaagagtcccatctgagcaggaagacatttctctttcctttatgccattttttgtttttgttatttgcaaaagatcttgtattccttttttttttttttttttttttttttaaatgctaggtttgtagaggcttacttaaccttaatggaaacgctggaaatctgcagggggagggagaggggaactgttatctcccaagattaaccttcacttttaaaaaattattgtacatgtgatttttttttttcctgttcatacatttgtgctgcccatgtactcttggcacatttcaataaaattgtttggaaaataaacacagcacttgctgggattccaggatgtctgcttttctccctctctgtcctgaagacacaggcaggcctgagcacagtcacaggccctctggaggcatacagagacccaagaggagcagggtgggctgcagactgagaatggtgctagcaattgagtctttgaggaaaatccatcaggcttagtggcattcttactgggccctgcccgagcaagctctatcaggcccagtgggtcatcacacctataattccagcaatctggggaggccaaggtggggcacatactttgagctcaggagttgaagaccagcctgggcagcatggtgaaacgtcactacaaaaaggtgggtttggtggaacacctgtagtcccagctactcgggaggctgaggcaggtgggtcagttgagcctaggag

SEQ ID NO: 2870 - DNA, 1099 bp, Homo sapiens
tcagccagttaaagggcaaggaatttggggcacatgcaaaggggatgtcctcattcaaactgtagcagatagctgttagagcccttgctgccagtgtatctccttttccagctactcttttcccatgtttccttggtcgagtggaccagtgggaagagaggggggtccctggaagaacgtaagatttgggacttgtgtggccctccctccgttataccttcctcagaagctacagcaagagccagtgggcaagtgatcacccactcaggaccactgttctgctgacccagaatccttctgggctgattggcttcaattgctgcccctagtctttcctgtgcatccttcacggatgacctccaactgttttatctgactgggtctacaacagtacagaggccagtggggcgtcatcttgtacagcaagaaaataattcttgtttttgcttcctttctcaggagaactacgatgacccgcacaaaacccctgcctccccagttgtccacatcaggggcctgattgacggtgtggtggaagcagaccttgtggaggccttgcaggagtttggacccatcaggtactgggctcagaggccaggtgttgggcttccaaagttgactcctgggtgtccttgtgtgtccacgatttctggttggaaatagtgattttgttgccatcctggtctagattctgtggccgctctgcttttgggttggccattgtactttgtgtcagattacagcaagttccatgaccctttttccttccttcgtttttcctctgccttgtagtttctagtcagtgttctctttttcagacagagcaaggtctcgctttgtggcccaggctggagtgtagtggtgcagtctcacccaggctcaggcagtccttctgcctcggcctgctgagtagctgggactataggcatgcgccaccatgcccggctaatttttacatatatatattttttgtttgtttgtttgttttgagacagtctcttgctctgtcgcccaggctggagtgcagtgacaatctcagctcactgcaagctttgtctcgtgggttcacgccattctcctgcctcagcctcccgagtag

SEQ ID NO: 2871 - DNA, 1558 bp, Homo sapiens
cacgtggccgggagatccggaaggagcttgttcacctgtaccccagggaggcccagcttgaggagcagttctacctgcaggcgctgaagctgcccaaccagacccacccagacgtggtgagcaccgtgctgggtggcagggaggccaggggcccacctagtgccacctttccgtgactcctgctgtctccctgcagcccgtcggggatgagagccaggctcgagtgctccacatggtcggagacaagccaggtgggccacaccccaggcctgggagctgacaagccctgcggtgtgggggttctggggtctcggggtgggggcccctggggtctgggaacatgtctggagcctggagaactcctggcggtacaggaggtggctccagcttcctgccttggccgagctcgagctgtctctgagaggcggtccttgggttttcattctctcccccttcaccattgggcagtctcaccctgtgttgtgtgattgtatcgtatgtgtgtgagtgtgtgtcgtgtatgtatgtgttgtgtgactgtgtgtcatgtgtgtctgtatctgtgtgtctgtatctgtatgtgtgtgtctgtatctgtgtatctgtgtgtgtctgtatctgtgtatctgtgtgtgtctgtatctgtgtgtgtgtgtctgtgtttgtgtgtgtctgtatctgtgtctgtgtctgtgtgtgtgtgtctatgtgtgtgtctatctctgtgtgtgtatatctgtgtttgtgtgtgtgtgtgtctgtgtgtgtctatgtatctgtgtgtatgtatctgtgtgtctttctctgtgtctgtgtgtatgtgtctgtctctgtgtgtctgtgtgtgtatctgcatatctccgtgtatctctgtgtgtatgtctgtatctgtgtctgtgtatctgtgtctttgtgtgtatctgtgtgtgcgtgtctgtctttgtgtgtctgtatccgtgtatctgtgtgtctgtctctgcgtgtctgtgtatgtgtctgtctctgtgtgtctgtatatgtgtgtgtgtcttcgtacctctgtgtgtatctctgtgtgtgtatgtatgtgtgtgagtgtgtgtgtgtctctgtctctctctctgacccccctgctttggtccctgtctccggggctttttctccccaactctgtgcctcctctctgattctcctcctcccttcctcgtggtgtttccttctcctctggcctctctcctctgtttctaactctgccttccccaccccgcgccctcttatttccctctctgcctcctctcatttcctctccctgtctctgtttttatctccctcccttcctgtctgtcttttcttccctttccctccctttccgtgtcttcttctcccttctctcctcctgcccctcctttattttctctcaccgtccctcctctctgctgtctctggaagcttctatctgggccccatccctctctccccgctgccttacaccggtgcttttcacccacatccagttttctccttccaacctcggggccacctggaaattggcgagaaactcgacatcatccgtcagaag

SEQ ID NO: 2872 - DNA, 1191 bp, Homo sapiens
tcttgtgcttccttccagatatgtctgcatgtaccaggaaatacttacatgcatatacagacatgtattttccttcatacagatagcataatgggccaggcacggtggctcatgcctataatcccagcactttgggaggctgaggcgggtggatcacctggagtcaggagttcgagaccagcctgaccaacatggtaaaaccccgtctctactaaaagtacaaaaattagccgggcatggtggcttgcgcctgtaatcccagctacttgggaggctgaggccggagaatcacttgaacccgggaggcagaagttgcagtgagccgagattgtgccattgcactccagcctgggcgacagagagtctgtctcaaaaaataaaaataaaaaaaatgttgaatgttggcataacgggcacatccctctgccccttactttttcctacttaacaatgtatcttggtggttgttccctgctggtacataaaaagcaattttgatcctgttagcggctgtgtaatattccattgaacagaggaaccatgaatgataggaacagccactgtcactggacatttagggggcttggagtcgtttggtgttttttattttattttgttttttattttattttgagacaaggtctcactcgctctgtcgcccagcctggagtgtagtggcacaatctcagctcactgcaacctccgcctcctgggctcaagtgattctcccacctcagcctctcaagtagctaggattacaggtatgtgccaccacgcctggctaatttttttattttattttattttattttttatttatttatttttttgagatggagtctcgctctgtcgcccaggctggagtgcagtggcgtgatctcggctcactgcaagctctgcctcccgggttcacgccattctcctgcctcagcctcccaagtagctggggctacaggtgcccgccaccacgcccagctaatttttttgtatttttaggagagactgggtttcaccgtgttagccaggatggtctcgatctcctgacctcgtgatccacccgcctcggcctcccgaagtcctgggattacaggcgtgagccaccgtgcccggccaatttttttcttttttgtagagatggggtttcaccatgttgcccaggctgttctggaactcttgagctcaagcgatcct

SEQ ID NO: 2873 - DNA, 1223 bp, Homo sapiens
ccgccagggcgtgcctggctttcaccagcaccgagtggatgctggagagtaccgtgtgagcggcgggcgggcgccgggacgcctgggtgccgcagaccaaacgcccagccgcacggacgctggggcgggactgggagaaagcgcagcgccaagacattggaccagagtggagacgcgcccttgtccccgggagggggcggggcagcctcgggctgcggctcgaggccacgcccccgtgcccagggcggggttcggggaccggctgccggcctcccttcccctatggactcctcgacccccctcctacccctcccctcgcgcgctcgcggacctcgctggagccggtgccttacacagcgaagcgcggggaggggcagggccccctgacactgcagcactgagacacgagccccctcccccagcccgtcacccggggccggggcgaggggcccatttcttgtatctggctggactagatcctattctgtcccgcggcggcctccaaagcctcccaccccaccccacgcacattcctggtccggtcgggtctggcttggggtccccctttctctgtttccctcgtttgtctctatcccgccctcttgtcgtctctctgtagtgcctgtctttccctatttgcctctcctttctctctgtcctgtcgtctcttgtccctcggccctccctggttttgtctagtctccctgtctctcctgatttcttctctttactcattctcccgggcaggtcccactggaaggaccagactctcccaaataaatccccacacgaacaaaatccaaaaccaaatccccctccctaccggagccgggaccctccgccgcagcagaattaaacttttttctgtgtctgaggccctgctgacctgtgtgtgtgtctgtatgtgtgtccgcgtgtagtgtgtgtgtgtgtgtgtgtgtgtgtgtgtgtgtgtgtgtgttgggggagggtgacctagattgcagcataaggactctaagtgagactgaaggaagatgggaagatgactaactggggccggaggagactggcagacaggcttttatcctctgagagacttagaggtggggaataatcacaaaaataaaatgatcataatagctaacgcttagtgaatacttacttactatgtgccaagcacttaagtcatttaattctcacaacaccaggacatatcggtattattatcctgttttccagat

SEQ ID NO: 2874 - DNA, 1179 bp, Homo sapiens
agccaccaagcccgacgcagtgcagcctgacagcctcccctacccacagtacctggcggtcatcaaagcccagatttcctgtgccaaggacattcacaccgccctgctggactgtgccaacaaggtcacgggcaagacacccgcaccacctgctggccctgggggcactctgtgaagtgggggacagggagtggggcaggcagtggttggtgggtggtgtgcaaagggaatgaagagcgtcctgggcctaaacacagcagcctcctctcttcctgcctgagcaccgcagcgggagccagcagggggcagcagaggccaacagggagctcgcaggccgggcccctgcgtccctgccccttcttcctgctccccctcctagcctagggtagactttgaactgtgtgtgttgatgacttctctgttccacaggccctcccccattcttgcctgggtgtggagccctggctgtcccctctccctcagtccttcctgactgtctccagctgggaggtggtctctgtgtgccactcctctgtgtctctattacagttgtgtctctctcatcctgtctctttttcccttgtttctctgttcctgttaatgtgtttctccccatggtcctatttctctcactctgacctctctctcttagtcccctttagctgtcttctatccccagctcctaactgggactctgtgtctatgcagggggccagcacccctgggttatctggggctaagggaagggacttcatttccaggggccacagccaagcccagagtcccccagcggctcgcatgtcagcccagaccccagggtccttggcctaggagaggagcagtggaggggcccaggctctgagctccacaggtctgagcagggagcaactcaggcccccacccaagcctgcgtcagcggaacttgagtgaggggcgttgtgcaatttgtggcaaggctggcccagctggatgcctgggtcccagtatttttagccccaaaggagaagtgaaaaggccccagccggggtgaatcatcagtcctggggaagaacccaggcgcctgagccccagctccgggaagcaggcactggggagggggcttcaaggagggagtgccccctcagactccctgcttccctggaagcttcaggaagctcagcctcagccttcaggcctgag

SEQ ID NO: 2875 - DNA, 1142 bp, Homo sapiens
cggtgcagaaattccggacgcccgggtccgagcctctggacccctcgggctcccggctgggtgtcacggggctcgtgtgacggcggcggcgccacatctggggcgggagagtccgatcccagctgtgaggcggggggcggtcgcccggggcttcccctcccccgctgtcgccggggctcacatcctgttcccgcctgcgggggggggaggggctgccttccggccgacccgccagcgaagggttaagaccccaccccttgttttgaatattcatgaggaggcgtgtccttctggtaggcgacacccctacattccaaacgcctcgcggacttttcccttttacagcaagggccgcgaggcgtgagaatccggaactggcaatgcactgtctcctattggtcaatgcaaaatgtttaatttgcatatataacacaaggcggggccctccggtgaggtcacgtggctatgaaccactgaagaagaccccggcgcaggggtgcggccggagctccagtggcgcaatcggttagcgcgcggtacttatatgacagtgcgagcggagcaatgccgaggttgtgagttcgatcctcacctggagcactttttttccccatcagtttttataaacttacacatctaataaaccaaccaaaacatctacatcacttagatgaatgaacgtttctatcttttgaattattgggctcaaaagactcctagggctttggcgacggtcctttgggtgttctgtattgtagggaggtgccgtttccgtcccagccaccaggtgggggtatcgtctcttattagatgctctgggcatggaattgtgtgcaaacagtttgacttctgtagagatgtgggtcctcggcaaactgtatatgactctgcctcctctgtatttctctgtctttttaatgcctcctttacagatgaacatagctatctgtcttggagttttcgacctctgttgaaaaggaaaactatgtttttgagtcgacttgttttttcaataaatattgaacattcactatgcctggcttcctttagctgtgtgtaatacagcagtgaacaagtagtccctgcccctgaggacgcgacattctagtggggaggcagattgctgtcaacataagaattaa

SEQ ID NO: 2876 - DNA, 1209 bp, Homo sapiens
gacccccatccactagtacttgaaggccagtggtggcagaagccacagaaacaagaagcccagtgagatggctaagctgcccagcatgtaacttaaatccctgttcattccccattcctttagctgctggagccagttctgcttctcggcaaggagcgatttgctggtgtagacatccgtgtccgtgtaaagggtggtggtcacgtggcccagatttatggtgagtcccaggaactgggcgcatggaggaggtggctctgggagggaggccttcacagcgctcctgtaccctttaattgtgtgtctttctcacagctatccgtcagtccatctccaaagccctggtggcctattaccagaaatgtgagtgagcatgggtccttcccatgaggtagatgggtgtgtggggatcaagtcaaggactctgtgtgattatctaaatcctcgtccctgctcttcttgccagatgtggatgaggcttccaagaaggagatcaaagacatcctcatccagtatgaccggaccctgctggtagctgaccctcgtcgctgcgagtccaaaaagtttggaggccctggtgcccgcgctcgctaccagaaatcctaccgataagcccatcgtgactcaaaactcacttgtataataaacagtttttgagggattttaaagtttcaagaactgtgtgtggccttatgtgttggtattggatgtttaaccagacagaaatcagtaaacatcctggacctattgccagtctggattttgaccctccccagaagtggtcgcgctgggcttggtgtgggtgagtggaagcagaaggcagggggtctctgtctctacacctccagtagagtccagtgtgcaggcaaagctgagatggcagtcgtttggggccattagtggctgcagaccttggcggatatatggctcatccttgtggatgtctatttttttcaagcccagcctcccaaatagcttggattacaggtacccaccaccacgccatgctaattttgtatttttagtatcgatgggtttcactgtgttggtcaggctggtctcaaactcctgacctcaagtgatccgccttcccgggcctcccaaagtgctgggattacaggcgagagccaccacccccagctgaatttttgtttttgtagagacaggtctcactatgttgcccaggcgtggtctcctgacctcaggcaa

SEQ ID NO: 2877 - DNA, 1200 bp, Homo sapiens
aggaaccgtactaccagccaccctacacgctcgttttggagctcaccggcgtcctcttgcatcctgagtggtcggtgtgtcccgggaaacccagtgggttggggatagacctgggcagtggggttgtgatgaggtggactttcagccctggctgtgctatgtgatcttggggaggagatgtcacctgtcattgcctcgctttcttcagctgggagaaggcagtcatgctaacacccactctgtagggtagtgtaggtgtgcccaggcacgctataagtgccacaaaggagccagacccgcagtcacagcctatgaacttcttgacctccaagagccacagagacagagggagagaactctgttctgggaatcccccaggctggatctttgtcctcttggggactctgaggacctctgggtcttggtgtttcactgtcctcactgtcttcccagctggccactggctggaggtttaagaagcgcccaggcatcgagaccttgttccagcagcttgcccctttatatgaaattgtcatctttacgtcagagactggcatggtgaggctctggggcaggggagggaatattggtgtggtgggaggcgtagagatctggaggaccagggctcagcctgaccttttctcgctcccttcccacccccagactgcgtttccactcattgatagtgtggacccccatggcttcatctcctaccgcctattccgggacgccacaagatacatggatggacaccatgtaaaggtgccgtgggttcatgggtgggcctctgggatttggcggagttggcaccacctgagggaaggagggcccagctctgaccctagcctcacctggcttatggttctgcccagattcgattcctgctggcaggcacatgcctgcctctagccttggccagacatctgcacccttctttgttccctggaatctgggtgtgggagtggggggaaatggggtctctctaaagaagacagttgggggttagtggtaaggtcgtacgatttagaagctggttttatcttgctgtgtctgtaacttagtgtttctgggaaggtttgcttatagttgtacatatgagactggttggggtttgtttgacccgggctctgttactgtggccagtgctgtattcaggagtccggatctgcgaatgggcctctgtgggtctggctccaagtg

SEQ ID NO: 2878 - DNA, 1099 bp, Homo sapiens
ctctattcaggaaggcagaggcctcatgacctgaatcatctctcgaaggtcccacctctcaactcttgcatttaagggttacgtttccaacacatgaactttgggggacacactagaaccatagcactgagttttacttgaattaataatgaaaacatctggtttaaagagcacacaagagaaaaacagcccaaagccctgttgtagacattagtcctttctcctctttaggccaactgcattgactccacagcctcagccgaggccgtgtttgcctccgaagtgaaaaagatgcaacaggagaacatgaagccgcaggagcagttgacccttgagccatatgaaagagaccatgccgtggtcgtgggagtgtacaggtgagcaggggcccagcaatacaccaagacagacatctctgtcccttgcaccccgagtgccatgatcctggggaccctccttcatcacctatcttcctctcacaggccaccccccaaggtgaagaactgaagttcagcgctgtcaggattgcgagagatgtgtgttgatactgttgcacgtgtgtttttctattaaaagactcatccgtctcccatgtctgctgctcattcctccccttgacctgctgacacagggagcacgcacccttggtcaattttgcggggttgggtaaattctcactcggtcacagagcgcatgctccgtttctagctgcctttgcgcagcggcagcctggatttcggttcttgggtgggattggtagctcgctgcgcatgcgtgcaggtaagcggccatctcgcgcaggcggagtgtcagtgtgggtcacgtgaggggagcggagagggagggatgggggcggagtccagggcgtgggggggccggtttgttgtggtcgccattttgctggttgcattactgggtaatcggggccctggcttgccgcgtccgccggataccctcagccagtgggcaggtctgagctcgggctccccgagcagtttgagtccccttgcccgctccttcaggtaacggcgcggggacgggtggggcggcaagcggtcgcagggaggtgggcaggacgggatccgccctgctcccgtcg

SEQ ID NO: 2879 - DNA, 1099 bp, Homo sapiens; identical to SEQ ID NO: 2878

SEQ ID NO: 2880 - DNA, 1317 bp, Homo sapiens
gggaacggggactgcctgccgccctcgccctcgtcccccaccggcggaccccggcgggcattcgagagccgcgcggccaggccctcttagccctctgccgtttggggggcacgggtgaacctgccgccccactcccaccccgccccgccccgcccgtacagccaaatcggaagggacgagcctgccctttgaaagggttttttttcttgctcctgcggagggcgccccagccatggccctcaggagctccctagaccccgcagggactgccctccatcccggccgccggggcccgccctctgcatcccgcgggcagcctgtgtgaagcggcctcccgcagcccccggcccctcccccatggaggaggaggagggggcggtggccaaggagtggggcacgacccccgcggggcccgtctggaccgcggtgttcgactacgaggcggcgggcgacgaggagctgaccctgcggaggggcgatcgcgtccaggtgctttcccaagactgtgcggtgtccggcgacgagggctggtggaccgggcagctccccagcggccgcgtgggcgtcttccccagcaactacgtggcccccggcgcccccgctgcacccgcgggcctccagctgccccaggagatccccttccacgagctgcagctagaggagatcatcggtgtggggggctttggcaaggtctatcgggccctgtggcgtggcgaggaggtggcagtcaaggccgcccggctggaccctgagaaggacccggcagtgacagcggagcaggtgtgccaggaagcccggctctttggagccctgcagcaccccaacataattgcccttaggggcgcctgcctcaaccccccacacctctgcctagtgatggagtatgcccggggtggtgcactgagcagggtgctggcaggtcgccgggtgccacctcacgtgctggtcaactgggctgtgcaggtggcccggggcatgaactacctacacaatgatgcccctgtgcccatcatccaccgggacctcaagtccatcaacagtaagtggtgtcctctccccaaaattccttccacagaacctctcaaggccaggcctaggtggtgggaaacagggtgagggacaccagatgacactgtgcctggagtgagaaggggcagcagtatgataccttcagggtgaaggtgaggtaggccttgcctgccttaagggagaaaaaggaggctcagaaaggttgaaggacttacctgcctcccaggctgcagagtcacaatcgctcagtaaacatgtatccatgaacacctgcgttccctgcatgaa

SEQ ID NO: 2881 - DNA, 1162 bp, Homo sapiens
gaaggtgggaggctcagaaggccctgccagctgtggggcgcatgggcaagggcacaggaaactcccagaggaggccgcccggggctcaggtttggggagtgggtccgtggctgagggcctccattgcggagggatgggcctttcctgtcctgtcctgtgggcagcccccgccagctggggccgtttccccagggagtctgggcaggtgtcccaggccctctcctgactggtcctccccatccacctctgccgcccacagatgacagcctgggcttactggagctggaccagcggacccacttcccccagttctcctactcggccagcatccgcgagtgagcagtctgcccacgcagaggacgcacgctcgctgccatcaccgctgggtggttttttccccctaactttttacttagcctttttggtttgtgtccccacccccacctcctcaccccctttccagttcttcttcaggcccctcccagacgcaccccagcggcccctgcagcccctgcctccagcctccagcctcacctttgtgcccagactcgcatttggaagactccacctcccgcccaggcctgggctgttgggcggttggagattcaggttttaatccacacaagccccagtgaggggtgaagcatggcgcctggggcctgcctgagtttctggcctgggtgtcgtgctggtgtctgcctccgcgctgctgcatctggacgaaggctgccttctggtgggacgcgacacccggcagacagtggtgctgccttccaggccccgtggcctaggctcggagtggccaggcacggggcggtccaatcccccacccgctgtccccctatgggggcagaaaagcaataatgtccaggggcaggcaggggcccttgggagctgcagggctgggggttagggctgctccctggtgaatggagtcagatcctaggatctgtaccatggggaaccaggagtggccgggctgggtgccgcctcctggtccggcctcctccccaccaaactgtcctcaccctatggatgaggcaggaggaacatttggggccaaacctgcctgcctcccagccccgtgccttactagggcttccttccagctggccttacctcccgctggaccctgggcctggcctggccccactgggggcta

SEQ ID NO: 2882 - DNA, 1214 bp, Homo sapiens
tatttcttctccctaaggtgcattttgctcagctgtaaacgggaaccttcctgctgagtggggcggtggggaggatgcacggagctgctgcgttggaaagcacaggcctcctgaggaggcggcgggatgaatttgggctgatgctactcctggtgattgccagacaggactgagggcacctgagagcacagaaggggctctgcagggcagtgggcacaggctcgttgttggtccttgggagagagtggtagggcctgttagctgatgggagggctccagacaggaatgtgaatcactcccaccactgtactcctgcccaaccagacgctgcatattagctctacaaacctgcacagcagcctgggaggtgggcagtgttagcactcccatctcgtagataggaaactgaggcccaggaagccacatagaatattggggtcattctcgtgagtagttcgcctctcagtgctgggcactgctgcagagcttaaggtgtctgctctcactcatcctcaccacagcctggcagctcgctgtcccgatcgtccccgttgtacaggggaggaaacgggcatagagaggttattggatttgctggaagtcagtaataggcatgatggttgaaccctgctctgtcggcgaagctgccttttgaagacagcctcatcttcttgccctgcctgctatgactggagttgtcactgttgtcatcatgatttcttttctgctttctcttctcctagacagagctggcacaaagtaggcctcagtaatccagaaatgactccattccatgcctgcttgggatgtggggtgtggctgcttctctccacccccaataccatgaccttggcccctcccaaggggggcccagggggaagagatgaggatgggaggcaccccctccccactgccctaggggcctgattgctgaacagcctcaggagccagcctttggctgttcttggtcatttgtgtgttccatctgtctccaaatattgattgaatcacttctatgtgccacgtgtagttctggatgcgatcggaggtggcagagaggttgcattggcctgtgagtgcttggtgtggctgaaggagggaacagagatctagctggactgggtgggagaggggcttgggaaggctgctgaggagcccctgtgatgtgagagcccgaggaagtgggctggacggggtgcagccaggtaaaggcc

SEQ ID NO: 2883 - DNA, 1624 bp, Homo sapiens
ggtgacccaggagccggtcacaggctcctgcctgggggcgtgggtagatttgactgagcggagcagggcgtttcacaggcctcccacttcccctccagtagcatcactgccttacagccagcaaaggcctgagggttgcctccctcctgtggttttcacaccgtgttctccagagcccgtggctgttacttttagggaaagaggaggggaggctcattgggctgatttctctgcccattcctccccaacccaaccagccggactaatactgaatagcaacgcagggcagcagtcacacctgatacagacagcacccgctgaccctgcgtccacgctgccgtgggcctgtaggcctgcgccattcccagtgctcctctggaattggaaagaccagggcttgtgactggcgcccagcacccaggtctctggttgggctcaggtgtggttgatattacgaaggcaaaataaatgagggccaggttgagagtgtgggcatgtttctccactatagctgggtgatcagggaggacctccctgaggaggtgacgtgtgggtagggactggagtgctgtgagggagccatgggaggatctgggtgaagacccattagacccaggaggaatcttctctgattcccgctttacaagtggtgagaactgaagcctggagagcctctgtagcttgtgctgagtcccccaaccaggaagtgttggggacaggctatgaatctgggcttccagagattcccccaccacagctcagtagcccctggtgagtgtgacttctgatcccacccatgggctcacccctaaggcttggtgcgggagcaggcgctctggcttttttttttttttttgaggtgtgttccagggtatcttcctagaaggagcagaacccctcagaacaaaccactagggtctccagaaggcccccgggatgggttgggatggaaaggagtgtctttcagacttgagctccaagcccctggaggacccagggtcacccctccccgggcctctcttcagcttcccagagctctcagcggaaggccctcaaccacaggcctccgggccgcacggtggggtggttccatggcaggctcttctggacagccagccaagcagcgagaggcccagctgggggagacagcctgggagcaggaccaggagggagggagtgagtgtgggaggggcgctgggtgggagctcagcctggcccccttggggcaggacccactgccaactcggcacccacagcagggcccaggtgctctgactgtgccgagcgagggacagcaagccgggtcggccaagaggagactgcatgtcagaggtcccagcaggagtttcttcagcccagccgtcctgctggagaagctcgttcgcagatgttgtttctaagggtgaggccagaaacccaagtcttcctcggtttgccactttgtgggccctttccgaatgggctggggcagttgccgctccccggttctcttctccagcctggcttcaagttcttcatggtctggtgggtttttggtgtacacttacccagctggggctgctgagtgacctggtcccgggggtagctgacgtgggtgagaaccctgctcttggcacccctctcg

SEQ ID NO: 2884 - DNA, 1419 bp, Homo sapiens
aacgccccccccacgatggtcgcgtccgggccccccgcggtgccgcgatgggctgtaccacccgtgcccggcggggggaccgcggccctcgagcccctccttcaggagctgagtgggggtggccgagcgggggcggtgggaccagcctcggggggccggggcggtggcggcgggccataccactgaggcggtggggggagcgctgcaagtttgcgggacggggagcgcaggccgcagcgtgcgcgggccgggggctggacctttcgggcgcggcgggcagatcgagcctggcgtgcgcgggctaagctatcgagggggcgcgccgcatcaagtgtagagggctgtacctttttggcgctgtggaagccgttgctgtgctgtatttacaggggtgggggcttctggggaggatgcttccccaactgtggctgggttatatcaccacggcgttgggggagccctgcttagaacgtaggggaacccaaatcagaggactgtgatgtttgtgatctttaagggactgggacggggcgggacaggccctagtgggttttaggggcgtattttgggaggactgtgatgccgattggtgaggaggggtttctgtttcctgtatttgacgtgtgtggcgttgggggtttacactgatctcagcctttattgaacttcttaacgactctggagggaacgtcatggttactggggtgctttggaccatggaggtgctgctctggattccattaccctctcagattatttaccaggcagtaacagttctttccttccataggggagggaggaaagctgtgttagaagtcactgaagttgtctgagccttaacattctgaagaggaagagggattgggcttggatttgaggagccgtgcccctgcacccgcttgttaaaacttgggaggaaggagtgtttgggggaacacctcttccccccagggaagctctctgggggcatcttgatcttgggattgtgaggacctcttcctctcatttggagacctcttggggctcagcaagacgcctgggctggagtaactagagcctccaatgggctgcttttcaacttcatccactcctaccttcccagagaagcagcaggagttcactcgtgggctgaacttggttggcagtggatgtgaagggtccaggaaccaacgcagaccactacatgctcctctgtcgctggccacgaagctgtttgtgtctcccagttaccagctcggtcacacatcatgtttacactccccaccaaggcagtaacagttggccttgcagtgaggccgggagctgttttcccagctgttcctctttgcataggccaaggggacttggagtgggggtgcccctggcccagcctggcccagggaggaaggctgctctgaagggcttgggacagtcagatcc

SEQ ID NO: 2885 - DNA, 1100 bp, Homo sapiens
ttggctaagttgttggacttgtcgaatcctgagggcaacatcataaaaggcagggtcttcctattctcatcccataaacggatgaggagatggtggtgcagcgagcccagggctcatgctgaatggcagaaccagacctgcagcagcccagcagagtgattctgtgtggatggtcgccctgagacaaggccacctctggacacatcccttcctctggtagcccacatcagtggatactaaagccagatgcaaactagcagtatctgtggcaagtggccaaggcctgggccagcctcagcccccctttctccagtgcccaagccccctgctgctgagatgagccaagagttgagctgcagccacctccacccctcctttgggcatctgacctgagttagtttggcaagtgctgcaactatagacccaactttgaaggcctgtcggggtcctgcagcagaggagacatttccctttgcaaaatcagggctaaatctctctctctctctctctttttttttttgtaatagactttatttttagaacagctttatttattcatttatagataggggcttgctctgtcacccagactggagtgcagtggtatgatcccagctcactgtagcctccacctaccaggctcaagtgatcctattgcctcagcctcctgagtacctggggctacgggcacctgccaccatgctcagctaattttttaatttaaatttttttttttttttgagatggagtgtcactctctcgcccaggctggagtgcagtggggtgatctcggctcactgtagcctgcgtctgccgggttcaagcaattctcctgcctcagcctcctgagtggctgggattacaggcatgcgccaccatgcctggctaattttttatttttagtagatatggggtttcaccgtgttaaccaggctggtctcgaattcctgacctcaggcgatttgctcacttcggcctcccaaagtgctgggattacaggcgtgagccaccatgcccggccagttgttttttttcttgtagagacgaggtctcactatattgccctagctggtctcagattcctgagctcaagcgatgta

SEQ ID NO: 2886 - DNA, 1215 bp, Homo sapiens
ggcactgtgagcgtgttcaaaagactgggccgcaggaccttctagcccacctgtgggcggggtgcaggcagcagagcctgcgggcatctgccctggccgccccaggctcctggcttcatcacgcctcccaccagctcctggatgacacagcttgtctccctcgggctctagagctaggcccgagcattcgggggatcaccccatttctcctagcctgggatggtcgtcgcagctggcctggcctgctccaggactccccttctctcatgtcctctgtgctttcttctctggctgtggccttggcagaacccacttttctacctctcccaagtgccagggggcttcttcctctcctacattccccttcttcccctgagcagggtctgctgcctcagaccccagctcatcagcctccctgtccccctcaactaagtgggtgtcacctggtgggcctcccttcccccactccccactgacctccctcactcctctgcgcctccccccactgctgtgacttctctctctccctgtcttcactttgttcatttctcttctgttttctgtccccgtggcaaggcccgactgtccgctgcgtcctgcccgaccctcctgtacctccggcctcccagcggccccctcgtcggcggtggcgtcgagcctgttgagactgttagccgccctctactcccaggctggagggacctctccagaccctgggctgcggctgaggcgcatccgttttcctgccctgggcatctgtctctgaaagtgtatggcgggtggtgggcaaggggcactgggaagggaggccagtgcctagagtgaagacagctgctgttttaatatatttttgtgactttcaaatcatttcccccactccttcagggtgagttgcaggactgtttcacactatgcgcagctgggctggggatggtggcagaggattgggctgtgtctctaaaggtcaggcttcctgcacacacatggtccatgtccctgctgcaagccctgagtcagggggagtaatggccacagtcaccattcagttaggccgccccctgcccccaataagccgtagtggttttgtcactctatcccctccccccatggatttcacctgcctgctggcacctttccaaatgatgggctccgtttgtgagaccatgagtttccactggtttggtcgcccacccctccctgctgcacagcgcccct

SEQ ID NO: 2887 - DNA, 1238 bp, Homo sapiens
tgccgtgaaaagaggtgccaccctctgtcaattaggagaggagggatgagagaggaaaggggtctccagtgtatttctccagccggggccttaaatccctcttgggagatatgggatggggtggatcggaaaataaatttttttaaatccctaccaaaatatcagctggctttttttaaaaaatcaaataccaaaatctaaatagactccaacagaaaattcaccatctcctctgaccttttcttcccatctcatgctgtgaactgtcttctgttgactttatcgctacctttcttcattctgttattcaaccatgatctctccgtttcattttataagcgttttattaatttcatttatgtatttatttttgactaggtaatgcatgtccatggtacacaaattcacaaggtttgtaaatgagaaaagacgtgaggttccttttgttctttacctgtggcctccctgccctacacggggactctagggtggaatgtagcaaagcccatccaccagccatgtactaccccccaacccggccaggctggagcgaccgtgtctggggagccgagccccgcttctcgctgcggtgagcccggactggggcacgcactgcgcagactccccgctgcagtgggcggagctcccacaggccccgccccctcctcccaccctcgttcagcctgtccagacagaagctggggcccaccggaggtagctgcagacgcctgagagcgaggccgaggcccctcaggggtaggtggggggaggctggctggggggatgggcagcggggtggcagggaggccccgatgatccctggctgagctgtgtggtgtgggggcacctgagggcggaggagccacctagaatataccccctgtcccagggctgagaaaagccaggcacaaagacctggggctccgctgacctcatccagcgctgcctttcttggggtgtctacaggttggaggagggagaagggggctgctagaggggagctgcgtgggtgctgatgggggcagggtgggcactgcagagtgaagagcaggcagcagagcgttggattttgagggatttcgaaatcctgctgaccagtgaccagcttcctctttttggggtggtgggcagtgtgccagtggcccccatgattatgaatagccccaagactaatcactcttctgtgatgtctgtccctggaaagcgtagaacaccccacacagtgcccacttttgttc

SEQ ID NO: 2888 - DNA, 1099 bp, Homo sapiens
gacaggcttctgggaggtcacagaaggtttaggcagttcagtggagtgggtatgcttacttgtggggacttgggggggtctttatcctccctacgggccttaatgtgtgcacctgataagctaggagtttgtcctggagccacagtggttcttttttttttttttttttttttcttttctttttttattgatcattcttgggtgtttctcgcagagggggatttggcagggtcacaggacaatagtggagggaaggtcagcagataaacaagtgaacagaggtctctggttttcctaggcagaggaccctgcggccttctgcgtgtttgtgtccctgggtacttgagattagggagtggtgatgactcttaacgagcatgctgccttcaagcatcgccacagtggttcttgactttgccaggaaccctcttaaactcatgagagctgctgacattcacagcgtggaccttggtggggttcatggcctcctggtgtcagtctgtggccccagaccaagcacggggatgtagataggcacacagttcacctggccgttctctgttgctgtctgtccctgtccacatccttccctgtgctcctgtcgtccatccctgtttgctggcccatgtttctagtccatccatcctgtctccaaggcaggagaagcagaagggggagggtggctgtgatgagtgagccctgggctgagggaaggaaaggggtgctgcccgctgggccgagtgcttggccctggactgcattgtgccctgggtccccactgtggcatctgcatcgaggacagtctcctgggggtggtactgggtggctgcctgttggcccaggtggagctcatccccatgtctcccacccttcactgtcccagtccctgccctccattccccctgtcctgtgtgtcacttcctccctacccatgtctgtctcttcctctgcctttatgtgtttgttcttagtccctttttctttttgctttagaacaatagttcttaatggtattttggagcctgggtctttttgagaatctgtcagaggccacagatcctctcttaagacaaatgctcatttgcttggagtttccggg

SEQ ID NO: 2889 - DNA, 1099 bp, Homo sapiens; identical to SEQ ID NO: 2888

SEQ ID NO: 2890 - DNA, 1168 bp, Homo sapiens
atggccgcctagtgtgtgtggatatggtagctggaattgcagaaaactaatgtccaaccaccctggtctccaggtacgccatcactgtctggtattttgatgccaaggagcgggcagcagccaaagacaagtatcagctaggtacctgcttccctcccttcagtccttcctattctgtgggccctcttgggcctgatgccaccccatccccctcatcagcctcttgttaaatcccaccactcatttttcttcatctctgcccaccttccttagcccactctcctggtaccccaacaggagccccatttcttcctggtcctctccccatctccccaggtttcccttggcttctttgtccttctgatgactcactgtctcctgtcccctctcacccccagcatcaggacagaaaggtgtccaagtacctgtatcacagccgcctacgcccacctagtggccagtcccagagccgcatggcagacagcttaaatgacttcaggagagccctgggcctgtgctggctgctccttccctgccaccgctgctgcttctgactttgcctctgtcctgcctggtgtggagggctctgtctgttgctgaggaccaaggaggagaagagacctttgctgccccatcatgggggctggggttgtcacctggacagggggcagccgtggaggccaccgttaccaactgaagctgggggcctgggtcctaccctgtctggtcatgaccccattaggtatggagagctgggaggaggcattgtcacttcccaccaggatgcaggacttggggttgaggtgagtcatggcctcttgctggcaatggggtgggaggagtacccccaagtcctctcactcctccagcctggaatgtgaagtgactccccaacccctttggccatggcaggcaccttttggactgggctgccactgcttgggcagagtaaaaggtgccaggaggagcatgggtgtggaagtcctgtcagccaagaaataaaagtttacctcagagctgcacacatctgactccatctgcaatttagggcctttattgaccgaggagggtatggaggtttgagggccagtgagcccaccatagtggagcctgacctcagcaggccactggctggagctggaagtctggggggacactgcccaggcca

SEQ ID NO: 2891 - DNA, 1168 bp, Homo sapiens; identical to SEQ ID NO: 2890

SEQ ID NO: 2892 - DNA, 1199 bp, Homo sapiens
acatattagtgtatctataggatgctgagttatagagcatgtgcatttatggggttttgttgtttttttcttttaatgtttttgtaaagatggggtcttgctatgttggccaggctggttcctaactcctggcctcaagccatcctcctgccttggcctcccaaagtgttgggattacaggtgtgagtcaccatccccagccatttacagttttgatagagacttctagattgccctctaaagacactgtaacagtttatctttctactagatgttacaagagtctcttaaactaaaacataaccgtattttgaaatgcctgtctctgtggccctgtactctactgatccctttggaggccctggcttcgattcggttcaacaggcttttcagagctgcttaaacgcttcttctccagcaagaaaagccattgctattttttaatgcctgatatgcttccctcctatattggctcataacctacggcctccagagaagcaaccctgagcccttttgtcctctttcctcagatcaatgaggaaatctccgtgaagcaccttccgtctacagagcctgacccccacgtggtccgtatcggctggtccctggactcctgcagcacccagctaggtaaggaggggtcagctatgcagtccagagaatagagtgactgtccctacccttggattttcaaggctcctaagcttccttttccagcgtcagacttagaatagaactaggctgaagtggaacaggtacaaggattaggtatatgccactgtctctgtcatgctgtattcaactgagaggactatggtcatgaaacaacttttctgtgaagaatcaattcttatccttcatcttttaggagagggtccaaaattctctttaggaatctattccctttctgtaaaaaggatcagtgtctcctgcccttaaaccaagctgctgataagttcccaagctccattaagttctgtctgtattttctgtccggagcctaacctagaggaaaaaggggagcagagaccagtgaggccagggctagttgggagaggggcaggggctgcctattgaaaggttttgaattttgcgggtccccaggcttcaatgaccttctggtcccaagtgactgattattctgaccaatgctgacacctcctgccttccgtttatgatcatacaaacgttccaattat

SEQ ID NO: 2893 - DNA, 1137 bp, Homo sapiens
ctggagcttgaatgccagctcggctactccctagctctgtgcctttgggcagctgactttattctctgaatctccatctcttggtttgtaaaacagggatctcaataccatctgcacccctaacgcaggacctggcacttagtagctggtgattattgttaaatactctacagaataggtagagtagctttcatgccaacagcagtgctgtaaggtaaatgctattattgcttccgtcattttctcttcacaaatacgtatgactggcaggtacatacctaagtcatattttctacctacacttcagttaatggtggagttcttaacatcagggaccttggaacctttgtatttgaacataaatattgtatgcagctgcaggtgtatcctttttatgaaaaagaagggaaaaaaaaacagttttttgtccctatctttcagcattctcaaaaggatgagtgacccaaaaatcattacagattcctgtctcagagtaatgagttccacatggttattgcctatgcaacgtcattgcctattgacatttgtcctgaaggctttcacaagtaacaaagggtgtctccttattttctatgtttggggatctgtgaatgagcctctgttcccttcagccttgcatttgtgctttcttaagaacctgtgagtgagcaaatatgtaaactaagtaacaccctgcccttgtagccttcctgaagtgccttccatacgtgtaggcctggatacttggtgaccatgagttcaaagggctcctgataagagtggaggtggggacagcgtttggctttgtcagaatggtagtttgcttgttagaaaggaatcgccagagaccgagttgccttcacataggaatgaggatcctacacaaaacagttgagcacaggatagtctaaaagccatccgtggttatccccccagctcatattgtgtacaatcagtgttctctccgctttgaagatttgtcttttaaacccttggcctcactttacctgatcctccttgtcggggcattcaagaatttttttagtctgtattgaccccagttggactcattgtcgtgaaagggagagcagtaataccattttaacactctgaggatacatacctcttttggatacc

SEQ ID NO: 2894 - DNA, 1278 bp, Homo sapiens
agtggccgccatactacgggaactacgactacgggagctactccgggaacacacagggtggcacaagtacacagtagccagtgtgacccagaggctcccggaggcccctgccggcttcctccaccagcgcctgcctcggcccctcctctgcccccgccagatcccgtggtgctggggatggggtcatcccagggctgcctccctccagcccactgcctcccctctgaggggcttccttcccctccatagggccaggcatttttttctggattcaaacaggcaacaatgaccttttattttctgtttgtccccacctccccagccttccacctcctgttcttcctaccttcttcctttttgactaaataatccccacctcccttgatcatacagtgaggctacagtgactgaggggagaatcccctcctgttcactctcccaaccctgctccagcccctcagcttcccagaccctcatgcagttggttgtaaattctcccaggagctgttttactgtctacttttcaggattaaaaaaaaaatcaaaacttaaaaaaaaaaaagtttaaaaagcaaaatggggagggggaggaagcagtgacttttttttggtaattatgcgcttttttttaatttttagaatttgtctttttactgtgggtgggctgttgatatttcatcaagataagcatttctttcctgagttcaggtgactgaggaagagccacaaaacaaaacacaacaaaaccaaaccacagaatcatctttaacccaactttttatacgatgccccagttccccataactttgcacacaagcttctgtgttcagttgaattgtaactgctttttgtatttggagagagtgactattgaacttgaaaccttttattccgggcgtcttggtagtttctggtgggattcagtgggtgagagggaagaaggggaggttggggggctccttcccttcagaacttgaagtttctcccactgcctcctctccagtggtctcccaggtgccagacccaaaagcttttcctacagtgataccctttatttttacttccccttgactcatatgttttaacatgattttaacaaactgcacttattaagaaatgtgtttgccctgttttgtttggtttcgttttgttttctttgaataaatgacatggcacctcctagcaggaaggaagcagggttgaaaccctgaagtgttactgcagttggccgttaattggggtgggggcctctttaaagggaaattatttactcattca

SEQ ID NO: 2895 - DNA, 1322 bp, Homo sapiens
tgggggaaacgggagttacaatgaaatgaaggaatcgttagattgggataagtttgcatgaggcaggtagaagtttagcctggaaaggtaggaggattcgtctagagagcaagggaaggctcagcttggtacagggaaggaggtaatttgagaagggctggtctgaggcaatgcaggaattaggccggggtagagaggtttctgttaatttgagagttagcctggtaaggaaatgaattagggacatggaaaggattggtctggaactgggaagaggttaatttcggggggaaggaatggaggaaaagaaggtcagcccgcgacaagggagggaataatctgggcaaagtagtgaagaggaccggtaaagctgaggggggtgggtgtccccctaaaacgagtcctacttcgcgttcctgggggaatcatttcctagagacaccgcaaccgcacccacccgccgcctgcgcgtgaccaagatctcacccttatcgggttccttcgccgccgtcgccgtcgccacggcctccatcctgattctctcggacttttcaaccgcccggcgggccccgcacactaacctccggcccacgcacgcaagagacactttcgcctgagaatgttccgggtccgggtgcaccgctgcgcccaggcaccgaagttccgggcctaaggcagacgttgcattgcgcatgcgtgcctctctcgggctccgccctccgcagccaggaaggaaaggggctccccggagagtgagagacccttaaacctctcctgtcagtcagtaggaaccagaatcattgttcgttttatcactgctgtgactccagctcccagcgtgcttaattttgggatggatggctaaaggactttcccccggagcctggagccgtcatacgctgagggttcgtgctctcgtttagacccccgcttgtccttttcctttcttaactccttcaggaattcaggaatattactaagccttgactcttttttttttttttttttttgagacagggtctcgctttgtcgcctagacgaatgcagtggcgcgatcacagttcaagtaacctcacattcctgtgctcaagtgatcctcctgcctcagcctttggagtacttgggactacaggcgcgcacaaccgcgcccggctaatttttaaaatttttttgtagagccaggggtcccactttgttgcccaggctagtccccaactcctggcctcaagcaatcctcccgcttcagcctctcaaaatgctgggattacgcgcgtgagccaccagcctggcttacttccgtcatcataccctgtctctggctg

SEQ ID NO: 2896 - DNA, 1189 bp, Homo sapiens
ctcaaaactgcctcctggagtccacggttcctgacctccgagcctcagctatgccctctgggtcaaccagaattagagccagacagggaaagtgagagctggatggaggcagacaagatgctcagagcgactattaaagaacgaaagcctctgctacggagcgcttctgtcctctgtcaggcccgagcgaagtgcctgacaccgggttggatcctcagatggccccatgaactagtgaagtgggtcaaaggaggcctggaaagatgttgcttcctcaaggccactcggccatcagaggcagaaatgaaacaggaacccaggcctagaatcacaaaggtcctagaaaccacttggctgtctggcctctcaggtgtcagggccatccagagtgagacagcattggagggacaagtgtgcatgcagatgtcctcagacgggaaggtttgagaagggtcagatggtaggcgggcctaacaagggctccgtgctagccactgtcccgcacacagacaggatcaggtcatcttgatatggagatcagtccccaaatcactgaattgtcccagcagtgctatgccctaggtactaccaatatcactcctctatttcccagaggaggaagcagcagctagactccaggaccttggggtcatatctctcagaaagccaagagtgcaggatgagagctgtctgtctcttacctgcctgtatttgtgccccatttttaaagagcagagggcctgggccacaggaaaggtatcagcccttggtgataggcacattttttaccagtctatcatttggtcattaaatttgtttacaatatactttgctatacgtaaatttgttgtgtaggtttttaaaaagcgatgagagacacagaaattgagtcagaattagggttagtcagatggtcaagacgtgagcatctagctgacagacagaggtggagccagtcccagggacagggattagatggggagacaggaagagaggtggagacagagtggggtagggatgacgggagacacaccccctggtcactgcctctgagacctgggggtggtgggccccagggcgggtgcctcccatccccctcccagttctcccggggtcggggtaggtggaaaggctgagtcagggagggcgggccccgctgggagacaacccctaggtgggcatccggccc

SEQ ID NO: 2897 - DNA, 1171 bp, Homo sapiens
catgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgagg

SEQ ID NO: 2898 - DNA, 1222 bp, Homo sapiens
gagctttcggaactctcgcgagaccctacgcccgacttgtgcgcccgggaaaccccgtcgttccctttcccctggctggcagcgcggaggccgcacggtaagcgggggctccgagctggaccgggcgcgaggtggcagggccggacgccgaagcctcagagcgcgtgcctgagggccccgaggcgcccggcgcgggcccgtcccgccccctagagccgcggccacgtgcgagcggcaggcccggacatgcccggtcagcgccgtccgggaaccgagcgtgggccccggggggcagcggcggggtgcgtggggcgtccggagtcccggggctggggagtggggtcgcgcaggatcctcacacgcaggggccgggctctgttagtgcgatccagagaggccgtgggcgtcggtgagctccttcagacccgcaggagccggagcccggcgttgaaggggccgtgggaagtaacggggggtaccacggtttaggatgcgctggagcgaaaggattggggtggggtccgtgctcttggcagtcgtctctgccaggcctgtgttcacatgcttgactttctccctcagatgcctggagttactgtaaaagacgtgaaccagcaggagttcgtcagagctctggcagccttcctcaaaaagtgagtttggggactgaggttcaaaacgggtggaggctgtcgccttggcctgcccatctgagccccagtgtttgccggtcctggcaggggaggcttgtttggggcctccgtggctcctttcagcgtgaggcctggcttgtgttccggttccagcctctctttgtactctgggcacagcatagttgtgttgaggggagggcatttgggatatggggtagtttgtggagatgactgaatcgtgcttttcccactgttttggtcttaggtccgggaagctgaaagtccccgaatgggtggataccgtcaagctggccaagcacaaagagcttgctccctacgatgagaactggttctacacgcgagctggtgaggaacttaggtctttggctggagagtggggagctgggtgacccctggcacaaaccatacttccctgtctcctctgagctctttcccgccccaagagggagagaaacccttggttgtgtcaccacttgctttgtgtgatgtgacattcgataacttggtactccaagtttttatgacattctaagagctttgtgagagga

SEQ ID NO: 2899 - DNA, 1176 bp, Homo sapiens
agggttcatgctcttccctggaaggtagaaaaggacagaccaccagggagcctccaccgcaaactgacctgtgctgcctacacactaactttcctgggcctggggcctgcacaggctgaatggtccttgagccttcactctgcatctgagcggtcttgggcccgctgagtggcagtggcaggaagtcggtggaagcagatccctgtgcagaagttgaattaccagggcggccacacacgggctgcacaacctttgcagtcgtgcacggcaagtgggatgtggcctccgcccatgattgggcacctggtcaggctgggagatccaaatagcacccagtgggcagctgtccgacccctggaggggcaagccaggaaagaaacttagggcccgctgtgaccagatgtccctcccagttgggaagactaaactggtttggccaatatctcccaggattcccctgtccaaattattcctgggatctgacccatttcctggaaaggggcgagcctgggttttgaagttcaaactagagtttaaatcacaactctgcccctaatcccacgtaaccctgtgcaccttatcctctgagccttcgtctcctcgtgtgtaagcctgctaactcctgagagactggacaagatgccgtggagagccttggctctgagtagctctgctgctggacagttcagttggcagtccccaaacgtaaggcgtaagagtttaagaagtatcggccaggcacagtggctcacacctgtaatctcaacactttgggaggccgagacgggctgatcacctgaggttgggagcttgagaacagcctgaccaacatggagaaaccctgtctctaaaaataccaaaattagttgggcatggtggcgcgcacctgtaatcccagctactcaggaggctgaggcagaagaatcgctcgaaccccggaggcggaggttgcagtgggttgagatcgagcaattgcaatccagcctgggcaacagagcgagactccatttcaaaaaaagaatcaataaaaatgttaaaagcaccgttgtttacactcagcaactctgtgaagtaagtgccgaaaagtgctttggaggtaggtaaagtaagccataggctgggtaacttgccagatatcccacagctggagccatcatatgaacccaagcaacccag

SEQ ID NO: 2900 - DNA, 1182 bp, Homo sapiens
aagctacgctttaagcggcgctggagtgaagactgtcgcctcgaagggggtgggggccccgctgggggctttgaggatgagggtgaggacaagaaggtgcgtggggaggggcctggggaggctggggggcccctcaccccaaggcgggtgagctctgacctccagcatgccacggcccagctctccctggagcaccgagactcctgagggctgtgggcaggggacctgtgtgccccgcaccccccatgcttcttttgctgccttaagccccctatgccctggaggtgagggcagctctcttgtctcttccctgcctcctcccttttccctccccacattttgtataaaactttaatttcttttttttaaaaatggtgggggtgggtgggtgcccagggctaggggctattccctgtctctgtgggtttctaagctctgggcaaagtggtggtagggggagggagggggaagttaagggggtcacctccattctggggaatttatatttgaattgaggctttggccttaacacccaggaacttttctattacaatcgcttaggaagtaaagccttgtctccctccctgttctctgcctcttgtacccctctgacccacccgctctgccccactcccagccctcctcagccccagccctgcctgccctgcccctccagggggccatgagtgcctaggtttctcataccccacaaggtcacagcaggggagggagggacaattttataatgaaccaaaaattccatgtgttggggggtggggggcggaggagggtgaggggtgccgcccatgggccacaaatctctacaagtgcctgctatccctctcccactccccaccccagcaccggtccaaccccttcatccccagctgctcctaggactggcccatgggcaggcgggtggggggatgggaagggggtgccctgaaaccaaactggaagccccctctgcctcccagctggggcctctggggtggggtggggggctgtggtcaagccttattctgtattggggactgagggtggggggagtagaggggccgctggagaatgtattcaaaacaataaaactttggacctttggatgcagtgatcaatgtcctaggtgctcggtgcagccccctgagggccacagcttttgcttgattctgaaggaggggcccc

SEQ ID NO: 2901 - DNA, 1332 bp, Homo sapiens
cacttattgaggttgtctggtgtgcctggcggtgttctggggcacatttttggagtgagcctatgggtatggcagttctgtgaggttagatggatagttgctatggatatgcacttctatgagagtggggacactagttacttcctctttgagatgagggaaccgaggctcaggccagcggttggctagccagcaccacatgaacctctctccaggcctccttactttcaggagggctgccccccagggaatgggcctgctgcaaccccagagggcaggaatcagcaggaatgagatgctggactggtggtgggtggtggtttttttttttcaccaagtggcccagaaattccagcctgcttctgcctagtacctagaaatatctatgggttgttgggccagtctaggtgctggtgacaggcttactgactgtcatagcgccactctctactttacagtgtcctctgagctcctgtccgttgcagcccagacactcctgagctcagacaccaaggctccggggagcagctcctgtggggcagaacggctacacacagttgggggacctggctcagcccggccccgagctttctcccacagcggggtacacagcctggacggcggagaagtagacagtcaggcgctacaggaactgacgcaggtctagggtgcaggccccctagtgggggtgggcagggaacctgtccagggcagcagccccgctgaaccctctctgccacctatcctgcagatggtgtctggccctgcatcgtactctggcccaaagccttctacccagtatggagctccaggaccctttgcagcccctggtgagggaggtgccttggcggccactgggcggcccccgctgctgcccacccgagcttctcgttctcagcgtgcggccagtgaggacatgacgagtgatgaggagcgcatggtcatctgtgaggaggaaggggatgatgatgtcattggtgagcattgcagggcccagaatcttgcccaggacccagcaggccaaggctcagagggtgggcagaacttggatccaggcccctaggcccctttgttttcttttccacttggtttatggttgcatgtggccagttcaggccctgccgagtaaatccagccctgccctcaggaagcccccagccctgcaggaaatctggaggacagggggcatgaccagatcttcaggtgcagtgttaggggctctgtcctgcaggctcataggctcctgcactgggcagtgggcactgggcatgtgggcacagccctgggctgaggagtagccttcctggacagcactccctgccggtttggagc

SEQ ID NO: 2902 - DNA, 2098 bp, Homo sapiens
tcagcctactgtggcagccacggcacctgcgcctcggtgagccggtccccagccctgtttcccctggggccctgatctgtgagcgcagcctccacgcccatctcctaggtctgaccttgctcctgcatgaaactccccccaccaccccaccctcctccgtgacacccacttccctctccttccagagcttgcccctcacctgttactccaaccccaccccaccttcacctgcagggcctcccctgctgaggatatcccactctcatctataccccactctcatctgtgaacaccaccctccttcctccagccaggcccaaatctgtcctcccatccagccactctgtgtggccttggacccctgccatgacttccagcctcgcaccactgaccttacgccgaagctgtgtacatccagctttcaatctggattgcgctttgagccctccccgccttgacctccccagatctgagctctttcagtccaggctgaatgtcaactacgctgtctgtattctcccagcctgccgtctttctgtcttttctcctttttctctgtgcatcttttcctttttctgttggtcttcttttttccgtctgtctgcttccttctgattgtttctctttgtctcttgtttctgtctgacagtttgcctttcccctcttcctgtctctctctgtctccctttctctctctctctttccttttccatcctctcccttcctgtctgtctctttctctctccctttgtgccctgtctgtctcattctgcctcttttcctctctgtgtctcctttgtctctctgtccttgtctctccctctcttatctctgcctttatgtctcctttcccgcagcccctgggaccatgccgctgtgagcctggcttcttgggacgtgcctgtgacctgcacctgtgggagaaccagggggctgggtggtggcacaacgtgagtgccagggaccctgccttctctgcccgtattggggcagctggcgccttcctgtccccaccagggctgctggcagttttcggaggtgagcagatggggcgagtatctgggatctggaggcccggcagcctatggccagggcatgagactatccacccctccacaggccaggacctcaacaatgccctgggtgacctcgtcctatacaacttctccgccaacacctgggagtcttgggacctgagtcctgccccggtatggacccctcctctgccctggaggagcctttccactcaatcagacccagccggggacccccggaatgatcccctatcacctagtgctcccacagttcctgcagcttgatataggaacctacttctccctgtttctgccttttctctccggttttcttttttcttcttcctcttcctttatctgcctttgtgcatcttatttttccatgtgtctcctgttgctcaatctgtctctgttttcgtctgtctgacttttgggcttctgtgttctctgtttctgtgtctccatctctctggatctgtttctctctgccatttgtccctttaactctgtctccttgccttttctctctcttattgtatttctctgtttctatgagtctgtctcttcttttctctctctgccggtctctgcctttctctttgtctctgtctttatctcgccttctctccatgtttctctggctctgcatctctctgtctaagcctggctctggctctcttgctgtgtctctacctctgtctcttttctcttcctcacaggctgcccgtcactcccatgtggccgtggcctgggccggctccctggtactgatgggtggtgagctggctgacggctcgctcaccaacgacgtgtgggccttcagtccactgggcaggggccactgggagctcctggcaccacctgcctccagctcctcggggcccccaggcctggcaggtcacgcggctgccctggtggatgatgtctggctatatgtgtctggaggccgcaccccgcacgacctcttctcctctggcctcttccgtttccgccttgacagcaccagcgggggctattgggagcaggtgattccggcaggcggacggccccctgctgccactggc

SEQ ID NO: 2903 - DNA, 1784 bp, Homo sapiens
gaggtaggggcaggtggattgcctgaacccagaagtttgggactagcctgggaaacatggcgagacatcatctctccaaaaaatacaaaaattagctggccatggtagcatgcacctgtagtcccagctatttgggaggctgaggtgggaggatcacttgaacctgggaagttgaggctgcagtgagccatgatcgcatcactgcacttcagcctgagtgatggaatgagaccctgtctcaagaaaaaaaaaaaaaaaaaagcccctgaggaggagggtccctgggggtctcacctctgaggttctcaggatctaaggagctctgaggccctcttcttaggagggggtggggtacagggtgggtttggaggtatcaggggtctgaggaaggaatgggaagggttctgaggcccctgcctatcactcacacctaccccaggaggaggtggggcgctgggtggctcatcaggagaaggagacgcggcggctgcagcgccctgggtctgctcgcctcttccctctgcctgggcgggaccacaagtatgcagtagagatccagggccagctcaatggctcggcaggccctgggcacagcgagctaactctgctgtgggatcggactggtgtgccaggaggcagcgtgagtacccaggacctacctccaaccctagccgcaggccccagcctcagatcacctgggctttctgaaccccaggccacaaactctgaaatccctagattctggcctcggactccttaactcttggcctctgaactctggacctcctcttgaaccctgtggcccctgacctctgcctatagaccctaacctgatcccatattttgacccccatcttctgactcctcacccttgaccctgctgaccctgacctctgccctccatactttgacctataataatctccagattcctccagaccttggacctctttactgatttcctaaatcctgacttcctatgtgcctgagttctcaacctgggctccaaacccttactttcagttagcgccagactctgacccctgccccagaccttgactgctgccttcctgtgaccccttccccaggagatctccttcttcttcctggagccctaccgctcgtcgtcctgcacctcctattcttcctgcctgggctgcttggcagaccagggctgtggctggtgcctgaccagtgccacctgccacctgcgccagggcggagcccattgcggggatgacggggctggtgggtccctgctggtgctggtgcctaccctctgcccactctgcgaggagcatcgggactgccacgcctgcacccaggtgcctgtggggccaccaggggaggtcacaaggtggagggagccacagcaggcaatgggcagtcaagggaacccctggtggggggtgtgggggaaacagcaagggcttttggccttgatctgcagagcctggtggggagggtgagatggagctgtagagagaggcacctggggagtcaggactctccctgttgtaggggccagagaatgcaactccatccttttccactagcggggagtttctcagcataggcactggagcccaggagtaggccttcaggcctgccacctccaagtgatgtcaggcagccctcgacaccctgcttcctcttgttccctgggagggtttgtttccttgtgagtggcaagggagccgttaagggtccaggctctaagtccctgctctgtctcaaacagagtgaggcttcctatttctctccccccaccccaccaccatcca

SEQ ID NO: 2904 - DNA, 1134 bp, Homo sapiens
tctcatgggacttaggttctggtgaagggagacaatcagtgcacatgcacacaccccacacgcatacacacatgaacacatgcacatgtgcacacacaagtaagatggcttcagagagggagaagcactgtgaggcctccagaggatgtggcagtgagggacgatggggtgaagtcagctgggcattcaaagaagctagactgagaacgcctgagaagaaccagctacgggaagagctttgggaagcaaaggcagaggccctggggtgggagcaggcttgttttattggaaggaccagaaaactggtaagtgtgacccagatcaagtgtgaggagatgaggctggggatagtcaggggctggatcacccagggccttgtgggccccacatagggttttgggttttattctcagggcaatgggaagctgttggatggtttgatgaaggggagtgacaggatccgatgtacctatttaagaatttaagagggtcgggtgcggtggctcatgcctataatcctagcactttgagaggccaaggtgggctgatcacaaggtcaagagttcgtgaccagcctggccaatatggtgaaaccccatgtctactaaaaatacaaaaattagctgggcatggtggcacacacttgtagtccgagctactcgggaggctgaggcagaagaatcgcttgaacccaggaggcggaggttgcagtgagctcagattgcgtcactgcactccaacctgggtgacagagcgagactccacctcaaaaaaaaaaaaaaaatttaagaggtcactcagttgtgctgtggagaatggaccggagggacaagaggggcagcagggatggtgggctggagtagggtgctggcaatgagggagtctggctcagatgtgggatgtgtatggaagaatataaatgatggtgtggatgtcagggtgagggaggagacaaaaccacgatgacccctagctttgtggcctgaactgtgggtggctgaggggatcgttaattgaatggggcagactgaggcttgtgaggaagatcagagtctggttcttgacatgagatgcccttcagacatctcttcactcaggtccaactagggatacagaaacactgaatatttcaac

SEQ ID NO: 2905 - DNA, 1181 bp, Homo sapiens
tgaattttcttctcggggctctcaggaaccaatctggaacaacagcattgctgcttagatgggagagttaatacatttgataggagggagtaggacagagctttaatcgccatcttctgtgccttgcatttccactgcaatggggtgggaaaaggggtcaacagagaacagtgtccatccagctatttgaatgccagtatttctgagttgtttttcctgacaactttgggcaaggtttgggcaagggtttgggcaagggtttggtggcaggtttggagggtgcatcagaatatcattactccaaagaatgaggagtaaggcttgggtgtctgcttttcagtggctactttcccttggggaagccattttgcctctctgctttcagtcttgcctgtgagtaaaataaggctgagaataggattcaggaagcttttggaaggccaggaaaaaataaaaaggcttttggacggtagctctgggttcttcaggaaaaggataaggggcagggcgcagcctgacatttggctggctttcccctagaccttggagaagtccagttcttgcctgagagtcaggaagaaagtgggcacaggtgctgcatgtggcaggctgtggagaggggaatgggtgaggtcagctgagataacatctgcattggtctcagaggggcccaagggagagagctggggtcatggtgatgccatcgctgttgttgttgctgaattactgacctttgcactcacattcttggccgccttcctggagccatctcctagaagcctggcctcggtccctgtggcctctggcgacccctgtcggaaggaaacaggtcacatccagacactggaaagggcacagaaatgatcctcccagcattgttctacctaggtcagcacagttccatttttccatttttacttcaagaatctaggttacttcaagagatgaatattttatttttatttatatttttgagatggggtcttgctgtgttgcctaggctggtcttgaactcttgggctccagtggtcctcctgccttggcctcccaaagtgctaggattataggcgtgagccactgtgcccagctgaggggtattttaatcgataagggattgaggtttaaaatctggcctatacataagcatattcaaaaatttaatgattaaaaaaatctggcct

SEQ ID NO: 2906 - DNA, 1169 bp, Homo sapiens
actcacgcctgtaatcccagcattttgggaggccaaggcaggtggatcactggaagtcaggagtttgagaccagcctgaccaacatggtgaaaccccgtctctagaaaaattagctgggcgtggtggcatgtgctgtaatcccagctattcgggagactgaggcaggagaactgcttgaacccaggaggcggaggttgcagtgagctgagatcgtgccagtgcaatccagcctgggggacccagcaagactccatctcaaaaaaatacgataaaataaaatggaaggatacacaattgttgactataaaaggatgggaaaagatatttcatgtaataagaaagccagcatataagaggcaggaggatcacttgaggccaggagtttgagaccagcccggacaacataaggagaccctgtctctacaaaaaaaaaaaaaaaaaaaagccagatgcctggctcacgcctgtaatcctagcactttgggaggcaccttgggactgttgaattaaaacaaaacacagcttaggctgctgtgggtattgacgacttgtgatttctgtgcagggcactgaatgtcaaagtgaaggaattcaatgaagcccggatcaagggcaggagcaaccgtgaccctcttaaaagagccaatgccccatgtaattagtgacgcgcgcgaatggatagacgctattcccaccgtccctacatagcatccagcgacaccacagccaagggacaggcttggcggaacctgcgggagagaagaaccctctgagcctgattgaaaggcggtgaagagacaggagagggggatcggtgggcggtcccgcctccatcttcagttcccgcatgggggcgaggcaggtacatgggccttgcgggctgtgggtgaaattccattattaattgttttttcactaacctggtgggggagtcgggcgcgagtttcgagagagactctggcttctggcgccaagccttagccaagctcaccaggggcagcgctagatggggagactgggacacacgtctgaacgcagatgtccgaagggagcgcaggaagacagaagcctcccgttgggcaggagggcaaaagctcctgggtcttggatttgcaacaggagttcagacggtgaaagcagggcctcaggatccttctgaccttttgag

SEQ ID NO: 2907 - DNA, 1219 bp, Homo sapiens
ccagggtgcattgcttgcctcagtttcctcttctgtatggcgaggatccctacccctacccctgcttctgaaagggacagcctgaggattagccactgtgggagctctggtcattgtggctgtggcaagatggatacatgaaagaatggagcctagaggcaacctagaggcgcataggtggggacagtgtggggacagccattgagagtggctggggagtaggacgtcagtgctgattccctgatgtgccttctacctcttttcttctctcccgccagggagctcgaggacaatatgagtgaccgggttcagtttgtgatcacagcacaggaatgggatcccagctttgaggaggtgagtaccaaagaggcagagaatgggagacccgggcacacctttgcatctcctccgtcctcccctcgatgacacattcccgtatggactccaccccaccctgcaggccctgatggacaacccctccctggcattcgttcgtccccgatggatctacagttgcaatgagaagcagaagttacttcctcaccagctctatggggtggtgccgcaagcctgaagtatgtgctatacacacacacacacacacacacacacacacacacacacgatgcatttaataaagatgagttggttctcatccaagagtctcccaaaactctaagaggctccctgggacctggggaagaatgctgggcacctccgtcagagatctggtagagaaggaactctttgtctcttctgcttggccccttatccctgtgttggcaagaggcagggaactgggaatctgaccctcagcactgcccctcaactttttctggccctctgagccacacctgtatcttggctgtccctttgtggctggaggcctgggtacccatgaggcttgtctctctcctgaagcctcagcgtccccaggccagggatagtgcctttcctccagggttttcagaagtagctgtataatgaatgtcaccactgtggttttacatcacctaatttaggaggtagaatgggaggaagggacattttaagcaacctacccaaaccctgcacccccttcaaggctccaccacatttaagtgggaattgaggtgattgtgagggaatcagggcagaggatgggatggtgctctaggcagaggccatagcatgggccaggaggtgggaagcagcctgaggcaggcagaagagcattgct

SEQ ID NO: 2908 - DNA, 1135 bp, Homo sapiens
cagaatacactctctcagagccggactccgaagaggaagaagatgaggaggaggaggaagaggagaccactgacgatcctgaatatgatcctggctacaaggtgaagcagcgccttggcgggggccgtggtggcccatcccgccgggccccccgtgcagcccagcccccggcccagccttgccagctctgtggccgctcaccccttggggaggccccaccgggaaccccaccctgccggctctgctgccctgctacagccccccaggaagcaccagcccctgaaggcagggccctcggggaggaagaggaggaaccacctcgggctggggagggccgaccagctgggcgggaggaggaggaggaagaggaggaggagggaacctaccactgtacggaatgtgaggattccttcgacaacctgggggagctgcacgggcacttcatgctgcatgcccggggtgaggtgtaggcagagcccccatacggggagcttggcagaaggggtggggtgggaggagggggctgaggaaattggggttgtgacagtggtcatgggggatggggtactgccggtctgtgttgtcttagaagtagatgtgtgatggccagaataaaagccaaaatctgtatctgtgtgtgttggttcagagtgtgtgtgtgtgtgtgtgtattcccgcccgtgtgtgtgtttgtgtgtgtgtgtgtgtgtgtgtattccccctgggctccttcttggggaaccttggggtcttttgggaaagataacatttactgcgtgcttgtattcgatgaggtttccatgtatttacttacagaccccataatgtaaaggctctaataatagaattttgtttctcactcacaaaatggtgctgggtgagtcatttggggacccaggccatcccttaagcctgttgtctcccccatggtccagactgggtggccatagcctgggtcctgctggcagaagaggacaggatgcctggtgaggtgcacgtgttgtcttacaagccctggcctgccaggggcacacactgcttccattgacacgcctttgctgagaaattagatatgtggccgcagctaactgcaaaaacaacctgggagaagcagtctagccaagcgcccagaaag

SEQ ID NO: 2909 - DNA, 1208 bp, Homo sapiens
cggtgaaaccctgtctctactaaaaatacaaaaaatcagctgggcgtggtggtgggtgcctgtagtcccagctactcggcaggctgaggcagaatggtgtgaacccaggaggcagaggttgcagtgagctgagatcgtgccactgcactccagcctgggcgatagagcgagactgtctcaagaaaaaaaaaaagaaaggcctcctctgaccaccctattaaaaatacattctctccatttactctctgtgcactgccttatattgtgtgtaagcactgattatcacctcatatatgtttttgtttagtgacgtttgtctcctcactggagtgtaatctccaggagtggaggaatgttatctatttgcttctgtctcctcagtgcttagaatagtcctagtatatggcagagacactataaatattagttgaataaatgagttaatggaaatctgtcttccatggaggtaactaataggtggtgaacaaatcagcataaataagggatattgcaaaatattttttgtcttctaatgaattcctaacctaattctaatttctctttgtgtgtgtgtgtgtgtgtgtgtgtgtttgcatgtgtttgcctgtctgtacaagttgacccatatcttggggaacctatagtgtcatagttgtaaccaaactgaataacatgctttgtttatgactttctttgagcatttgtagcagagcatattcattcggggagggaatattttacaataaggacttttatttctatttcttaggtattcccccatagaagggaataaaattcgatttccttatccattatatcaggaaagaaaaagtaaaactaaaaaccaggacatgagcattagcctttccctcaaaatgtttgcacagttgcatcccatttgcttcttccaaagtccacattcataaaaagaaatggatcttacattgttgcctctcaaacatttatatcgtgtaggcttatatgtatgtctttagaaggccttttatgtaatgacaccattactgcttgtgattattctgatatgatactttatctgtttttttttcctaaatatcacaagctattaaatttatttcacaattgactagtagaccactttgtcaatttggaaaacattcttgttaaagacaaacatatctacatccagaaactttctataccttgctttcaaagagacagcattcttt

SEQ ID NO: 2910 - DNA, 1210 bp, Homo sapiens
tctcctggccctgtccccctgagagagctttccagggctccaccctcccaagctcccaccctgtcctatccccttcccatgtcctctccctctcccacaccaccacccctggggaccccaggactgacttctacacgccagcatcggtccgcaatcaagtgccatccagcccacaaactgttttcaaaaaatgtcttatcacttgccagcttttgaaattgaggcagtatcacttaaaagccacaatttctggcttattttataaaactgggttacatggtcacccacagggcagccgtgggctggagctgagccacagctgcccccttcagtggggacctgcctgccctttgcctcagtcccctctgctgaggtcaaggcaccctttagctcctcatggtgtggcctagaaatgtcccctgtcctccagtctctgtagaggggccctgttgggtctctccagacatctgaggcctgcgggtaccctggcctcctgcccgggccaaatggtgcccctgccccacgtgctgcagatgtgaagttcgacgccgtgagcggtgactactatcccatcatctacttcaatgactactggaacctgcagaaggactactaccccatcaacgagagcctggccagcctgccgctccgcgtctccttctgcccactctcgctttggcgctggcagctctatgctgcccagagcaccaagtcgccctggaacttcctgggtgatgagttgtacgagcagtcagatgaggagcaggactcggtgaaggtgagtgcggccggtgtgggcgggacttcccggtgccttcctgggcgcaagaggccaagaggaagtgtgccaggcctgggctgtgggacctcccgcctggtgctcctctgcccacagtttcacaacctcccaggtcccttctccacagtgaaaggaagtgggcacccagccctccagccctagatgactgggggtcctctccccaggctgttctgttggaccctttgggtccagacctgtcccttcctccttctgtcccagaccttgtgtccctggccctggctccaactctgtgtctctgccatctcactgggtcctgaaatgtcagcctgtgtctgtggcgtgaggctcggctttgcctcctgggctgtcgtcactgttgggtctctgctcctggctcccagtgtcccttcacccactccccgcagcact

SEQ ID NO: 2911 - DNA, 1146 bp, Homo sapiens
gtttcacgctgccattttcttcttagccacctcctcacaccattttaaatggacaggtgtgtgtaggggcccatcctgggccagccagctgctctccctgcaactttggacaagttatcgcacctctgccccatgccgcagttttctcctctcttttttttttctgaaattttttttgtagagactggctttgttggcaaggctggtctcaaactcttggcctaaagcaatcctcctgtcttggcctcacatagtgctgggattgcaggcgtgagccatgtgcccagtctcctctctaaagtgggaggatactaatactcccgtgatggaagtgatcagggaattgaagctgtgtttatttgcattggaagtgctggggatgggcctggcgggtgtgagtgctgtcagcgcgaacttcctctctgatctgcccatgctgctctttcttttttcttattaatagattggtttcttttttatttgaatacatttggcctcatttctaagcaatagtatttgtaaaatcttagttttggtgtgctcattccttttttttttttttcttgagacagagtcactctgtctcccaggctggagtacagtggcacgatctcggctcactgcatccttcacttcccaggctcaactacttgagagtgcctcagcctcctgagtacgtggaactacaggaacccaccaccacgcccggctaatttttgtatttttagtagaagtgcatttctacggcgcttctgtaagcacttgggcggatgtgacctcctcggtctctgactctggtggtgactcctgcaaggccggacctggttccagaccctgtaggtgcccagctgaaggtgtggtctgattgctgtgtggggagtgaaggttgccagcctagaaactgggcctcaagctcactcagaggctcttggaacaaagaagaggcaccatcttggctgggcacggtggctcacgcctgtaatcccagcactttgggaggccgaggtgggcagatcatgcggtcaggagttcgagaccagcctgaccaacgtggtgaaaccccatctctactaaaaatgcaaaaattagccaggtgtggtggcgtgtgcctgtaattccagcaactcgggaggctgaggcaggaga

SEQ ID NO: 2912 - DNA, 1220 bp, Homo sapiens
cagcaccgagacagttcctgggactcagtagacgctcaataaacgtttgaatgaacgcggagctccatcggcctacgcaattccataaaagaacagcaggtgtcgcaccagccctatagccgcctgctcagagcctttggggccagggtgaatcagactctaacaggaacccactcaccactcctccgcagaaagagaattcggaattttccgagaaggcgcttctgaatgccgaatcatgaatctctcctcttaaaaagctgacttttcattttggaaaaagggggtcctgggccctttaacagcttgccaggtgctcaaacgctgcttcccagaatgcgtggcgctatgtaaatgagacggtttggggagcgaggatgattcatactatatgaagtgaaggcaacgttttacaaggacatctctcacgataaatgagtggggagaacttatagcccttgaagtcaaccatctcacacctttccaaaggacgcgaccataactctaaaaggtaagcttttgcgatccttatatagctgcgcgggaataaggttgtcctgcccggatgatcctcagtggtctggggtgcaggcttcaaacctgtagctgtctagcgacagagtggttcaattccacctttcgggcggtagtaactaagcgccttaaatcttacttatcgaaccggacttcttttgcttgttgcccgggaggcgctcctccagcctgcacctggagaggtcgctgcggccttccgcatcgcaaactcattctctgtcactccgatctctgattgtcgttacttatttccccctccggagtataaaaacccactccaaaagacggagaaaaagtcatctacccagttctgggatattggcagtttggaaattatcctagatctctccccttcaattgcttactcattcagtcgtttgctcactcatttatttaatcacgcatgccgtgattaatcagtcaaatacttgcccatttgttcatctgtcattcactcatcaaacaagcatttgctgaggacgcagcggtgggtgacagccctggccttggtctcctggtgcagtcagcccagtgggggagacaaacattaagccatcatgtaattacacacttaattaacaactacaaaggggataacggctgcaaagggaatagaaaagtgaggccctctcataaggagagctgagctggtcgggtgtcatggg

SEQ ID NO: 2913 - DNA, 1213 bp, Homo sapiens
ccaccaggatcttgatgcaacttggcatttggttacccctgctgataagagcagccgttacctgccactgggaccagcaggtgaagcgttgcaacatagccccctccatcatccttcacctcctatcccccactccaaaccaggacgacctgcaaggtcccagccagcaggacaccgtgggcactctggcaaatgaaaaaatggaacctggtcttgagctgaatcaatgtgttattgttacccccacccccggtttacctgatcagtgttaacctttactgggacactcatctgttacactggaacaccttcttctttttgtcaatcggcacagaccactgtaaggaaatgcagtgtgttgcagtggccttttctccccctcaccttctaaggtcagctctagctgagcatcagtgctctcttaaggaggaaaaaaacggtgcggctgggagcggtggctcacgcctgtaatcctagcaccttgggaggccgaggcgggcggatcacttgaggtcaggagttccagaccagcctggccaacatggtgaaactccgtctctactaaaaatacaaaaattagccgggtgtggtggggtgcgcttgtaatcccagctactcgggaggctgaggcaggagaattgcttgaacccatgaggtggaggttgcggtgagccaagatggcaccattgcaccctagcctgggcaacagagcaagacaccgtcttaaaaccaaaagttaaccgggcgtggtggtgggtgcctgtaatcctagctacttgggaggctgaggcaggagaattgcttgaacttgggaggtggaggccaagattgtaccactgtattccagcccgggtgacagagcaagactgtgtctcaaaaaaaaaaaaaaaatcctggctgggcacggtggctcacacctgcaatcccagcactttggaaggtcgaggtgggcgggtcatttgaagtcgggaggtcgggagatcgggagctcgagaccagcctgaccaatatgatgaaaccccgtctctactaaaaatacataaattagctgggcatggtggcatgcacctgtaatcccagctacttgggaggctgagacaggagaattgcttgaacccgggaggcagaggttgcagtgagccgagattgcgcaattgcatgccagcctgggtaacgagcaaaactccatcttaaaaaaacccacaaaaggtcc

SEQ ID NO: 2914 - DNA, 1186 bp, Homo sapiens
tggttgggtgatctggatcccgacctgagacatgcagagttgaaaatgtctggctgggcacggtggctcacgcctataatctcagcactttgggaggtcgaggcgggtggatcacaaggtcaagaaatcaagaccatcctggccaacatggtgaaaccccctgtttactaaaatacaaaaattagctgggcgtggaggtggtgcatgcctgtagtcccagctcctcaggaggctgaggcaggagaatcgcttgaacccaggaggcagaggttgcagtgagccgagatcacatcactgcgctccagcctgggcaacagatcaagactccgtctcaaaaaaaaaaaaaatgtctgttaggcatctagctgatgatactcagaaggctgaacaggaggacagatgtggtgggacaaggttggggagacactgaagccaaggccctgatcacccatcctcacagctccagcctctcaactccagcctctctcacttattggttccatgtttgtccatgcaggagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggtgagtgctgggtcctgggaggtgttctccgcaggcctggagaggccactccagctccagtctgaagagctcaaagacagctgtctcagaagcctggggtgtatggccaggcgtggtggctcatgcctgtaatcccagcactttgggaaggcaaggcgggtagatcacctgaggtcaggagttcaagaccagcttagctaaaatggcgaaaccccatctctactaaaaatataaaagccaggcgtggtggtgcacgcctgtattcacagctactcaggtggccgaggcacaagaatagcctgaacccaggaggcggaggttgtggtgagctgaaatcgcaccactgcattgcagcctgggcaacagagtgagattctgtctcaaaaaagaaaatgataattttcaatggccctgtgaggaaggtaacgtgattatcttccctcttaaaaaggagcaaactggcacagagaggtgcagtcctttgcctca

SEQ ID NO: 2915 - DNA, 5101 bp, Homo sapiens
gctgcatggcctggttcctaacaggccacggaccactactgttccatggcccggaggttgaggaccccgagatacaggacaattctgtggcaagcaggactgtcccctcgccaaagatgggacatcgaggctccttggagcaccctgtggccaccttgcagcagcctctgtttccccatgtttccatgacctggtgtccatctgtcttccccagtttgggagcttctctccgaggaggacctgggcctggtgtggcacctgctgtgtgagcggggccatgtccaacggccttcttggggactttgggtcggggagaagttctgcctgggttttactgccttctcccaaccccacactgtctcccctggcagcggttgatcgacaagaccaaggtgacatatctgaagtggctgcctgagtcggagagcctgttcctggcatcacacgccagtggccacctgtacctgtacaacgtcagccacccctgcgcctcggccccgccccagtacagcctgctgaagcagggcgagggcttctctgtctatgctgccaagagcaaggcaccccgcaacccgctggccaagtgggcggtgggtgaggggcccctcaacgagttcgccttctcgcccgatggccggcacctggcctgtgtgagccaggatggctgcctgcgcgtcttccacttcgactccatgctcctgcgtgggctcatgaagagctactttgggggcctgctgtgtgtgtgctggagccctgacggccgctacgtggtgacgggtggcgaagatgacctggtcaccgtgtggtccttcaccgagggccgcgtggtggctcgaggccatggccacaagtcctgggtcaacgctgtggcctttgacccctacaccacaagggcagaggaggcggcgacagcagccggtgctgatggggagcggagcggcgaagaggaggaggaggagcccgaggctgcgggcacaggctcggccgggggcgccccgctctctccactgcccaaggctggctccattacttaccgctttggctcggcgggccaggacacgcagttctgcctgtgggacctcactgaagacgtgctctacccgcacccccccctggcccgcacccgcaccctccctggcacacctggcaccacgccaccggccgccagcagctcgaggggtggcgagcctggcccaggccccctgcctcgctcgctgtcccgctccaacagtctcccgcacccagctggcgggggcaaggcgggcggcccgggtgtggcggcagagcctggcacaccattcagcattggccgcttcgccacgctcacactgcaggagcggcgggaccggggggcagagaaggagcacaagcgctaccacagcctgggcaacatcagccggggtggcagtggcggcagtggcagtggtggggagaagcccagcggccctgttccccgcagccgcctggaccccgccaaggtgctgggcactgcgctgtgcccgcgcatccacgaggtgcccctgctggagccccttgtgtgcaagaagatcgcccaggagcggctcacagtcctcctgttcctggaggactgcatcatcactgcctgccaggagggcctcatctgcacctgggcccggccgggcaaggcggtgagtggccccacaccagcctgccggggacctggcaggacctttcgtgggaagaggcaggcattggcagagagagggctttgttgctgtcacagcctctggctccgtggggtgaggggaagccagggaaatcttagtgtctcagtacaagacctctcagatccttagagtgagggggtctagccctaggcagcaggcagcagaaagaggggtgggtgtgagagccagctaggaattggggcatccaaggctggccgtctgaagggcagcagatgggccccacatggccaggtcttactgcctgtcactcgaaccagaatctatttctgttgaacatctgttttttaaatcgtgaaacttttttgagtacttcaggccaaaactaggggcgagctcaagcctgtgggcatggctgccagcctgggtctgggactcaggatctgagcctcctgctgaaggcacaggctgggaatcccaggcctgggttccagtcccactccctctgtgaccctggacaagtcactgccccctctgacctccaactcatcacctcttagaacagagcctgtaggatgggcagtgggtggatgtgcttgcctcctgggtgggctgtggcgttgggaaggtcatagtaggcgaatcaggcctggcatcttgtaagttcggagctcgtcttgggtgtctcagcttcttagggcttggactcagttgcccagggtcctggaggccgtggcttggttcctcagatcctcagttttggaatcgtagagtcctgagtccctagaacttgagagcacagtctgagtgactcagaggcaagagtggtgggatttggggagtctggttgagtcctaaaagagacccctctgtctccgtagttcacagacgaggagaccgaggcccagacaggggaaggaagttggcccaggtcacccagcaagtcagtggtagaggtaggactgtccctgagttctttccccagcacctcagggtccctcccaagttagaagggagctccagtttccccctcccctcccacccttacccttaccccatggtctcactcaggatccgccaaggactttgattattgcgtgaaagtgctgactgccaggacaggaagctagctaagatgcaagttcccagcctagagcagtggcctctggggggtctagggcggacccaagggcaaggccagggtggcagcagctttggggactctgggctggctccctccccttgacactggctgaagcccaggtggtctctaacccctcccatctctccctctcatcttccccagggcatctcctcccaaccaggcaactccccgagtggcacagtggtgtgaagccatggatatcgggcccccccaaccccatgcccccagcctcctagccataaccctccctgctgacctcacagatcaacgtattaacaagactaaccatgatggatggactgctccagtccccccacctgcacaaaatttgggggccccccagactggcccggacacgggcgatgtaatagcccttgtggcctcagccttgtcccccacccactgccaagtacaatgacctcttcctctgaaacatcagtgttaccctcatccctgtccccagcatgtgactggtcactcctggggagagactccccgcccctgccacaagagccccaggtctgcagtgtgcccctcagttgagtgggcagggccgggggtggtccagccctcgcccggcccccaccccagctgcccttgctattgtctgtgcttttgaagagtgttaaattatggaagcccctcaggttcctccctgtcccgcaggacctcttatttatactaaagttccctgttttctcagcgggtctgtccccttcggaggagatgatgtagaggacctgtgtgtgtactctgtggttctaggcagtccgctttccccagaggaggagtgcaggcctgctcccagcccagcgcctcccaccccttttcatagcaggaaaagccggagcccagggagggaacggacctgcgagtcacacaactggtgacccacaccagcggctggagcaggaccctcttggggagaagagcatcctgcccgcagccagggcccctcatcaaagtcctcggtgttttttaaattatcagaactgcccaggaccacgtttcccaggccctgcccagctgggactcctcggtccttgcctcctagtttctcaggcctggccctctcaaggcccaggcaccccaggccggttggaggccccgacttccactctggagaaccgtccaccctggaaagaagagctcagattcctcttggctctcggagccgcagggagtgtgtcttcccgcgccaccctccaccccccgaaatgtttctgtttctaatcccagcctgggcaggaatgtggctccccggccaggggccaaggagctattttggggtctcgtttgcccagggagggcttggctccaccactttcctcccccagcctttgggcagcaggtcacccctgttcaggctctgagggtgccccctcctggtcctgtcctcaccaccccttccccacctcctgggaaaaaaaaaaaaaaaaaaaaaaaaagctggtataaagcagagagcctgagggctaaatttaactgtccgagtcggaatccatctctgagtcacccaagaagctgccctggcctcccgtccccttcccaggcctcaacccctttctcccacccagccccaacccccagccctcaccccctagcccccagttctggagcttgtcgggagcaagggggtggttgctactgggtcactcagcctcaattggccctgtttcagcaatgggcaggttcttcttgaaattcatcacacctgtggcttcctctgtgctctacctttttattggggtgacagtgtgacagctgagattctccatgcattccccctactctagcactgaagggttctgaagggccctggaaggagggagcttggggggctggcttgtgaggggttaaggctgggaggcgggaggggggctggaccaaggggtggggagaaggggaggaggcctcggccggccgcagagagaagtggccagagaggcccaggggacagccagggacaggcagacatgcagccagggctccagggcctggacaggggctgccaggccctgtgacaggaggaccccgagcccccggcccggggaggggccatggtgctgcctgtccaacatgtcagccgaggtgcggctgaggcggctccagcagctggtgttggacccgggcttcctggggctggagcccctgctcgaccttctcctgggcgtccaccaggagctgggcgcctccgaactggcccaggacaagtacgtggccgacttcttgcagtggggtgagtgcctaccctcggggctcctgcagatggggtgggggtggggcagga

SEQ ID NO: 2916 - DNA, 5101 bp, Homo sapiens; identical to SEQ ID NO: 2915

SEQ ID NO: 2917 - DNA, 1220 bp, Homo sapiens
accacgcctggctaattttgtatttttagtagagacggggtttctccatgttggtcaggctgatctcgaactcccgacctcaggtgattcgcccgccttggcctcccaaagtgctgggattacaggcatgagccaccgcgcccggccgacgaccatatttcaaattttaacttcctctcgatccccatctgtgttgctttttctccatagcatttatcatcatcacacactacatatttataagttccacgaggacagtgatttatttatttgaaatcattttttggtagaagcagagtttcgccatgttgcccaggctggtcttgaactcctgcactcaagcaatccaccctccttggcctcccaaagtgcttgggatcacaagtctcagccatcgcccccggcctagaacagggattttgttccttcactttttatattcccagcacggaagagtgcttggcacctagcaggagctcaataaacatctgctgaatgagtgaacactactgccaaacggcctccccaatcactgggttcagtattcctgccctttcactcttgaatcctaatagctatacttgttctactttttccccctttctcactactgcacttgacaagtctttaaaaaaaaaaaaaaaaaagggcatggtgtggtggctcactcctgtaatcccagcactttgggaggccaaagtggacagatcacttgaggccaggagttcaagaccagcctggccaacatggcaaaacccagtctctgctaaaaatacaaaaaaattacttgggcatggagatggatgcctgtaatcccagctacttgggaggctgaggcatgagaattacctgagcctgggaggcagacgttgcagcgagccgagattgcgccactgcactccagcctggatgacagagcaagactctgtctcaaaaataaaacaaaacaaaaacaaagaaaggaaagaaaacaaaaataggacgggtatagtggctcacaattgtaaacccagcattttggtaggtctaggtgggaggatggcttgaggccaggagttcaggactagcctaggcctaaaaactaaaaaagaaggccaggtgcaggggttcatgcctataatcccaacattttgggaggctgaagcaggaagagtacttgaggccaggagtttgaaaccagcctgggcaacacagcgacacaccatctctagacatatgca

SEQ ID NO: 2918 - DNA, 1177 bp, Homo sapiens
gaggcggcggcggggggaccccgaaccccagccagccccgtgcgccctttgcccgcagcgccggcgccccccatgcgccagacggcaggacggcggcgtcggggggcgccatggcctcggcggcggcgggcgaagcggaggaaaccacccggttgcgcaagccgcgcttctcattcgaagagaaccagatcctgatccgcgaggtgcgcgcccactacccgcagctctacggcgcgcagagccgtcgggtgagcgtggcagagcggcggcgcgtgtgggacggcatcgccgccaagatcaacggtatcaccagctggaagcgcacgggccaggaggtgcagaagcgctggaacgacttcaagcgccgcaccaaggagaagctcgctcgcgtgccgcactccacgcagggcgccgggcccgccgcggaggacgctttctccgcggaagaggagaccatttttgccatcctggggccaggtgtggcggcgccgggggcaggtgctggggcggaggagccccctgcggccccctcttcacagccgccgcccccaagcgcctgccctcagcgctacgtgttgtcggaagaccgccgggaggaccgacgtgcaggtgagtgtcttcagagtaggctgtgtgcctgcgctgttgcaagccttttacatgtctcatcaaagccttgctgcagccctgtgaggtggatgctgtccttcgccccattttatagctagggaaactgaagctcagaaaaatgaaatgacttgcctcagttccgatagctagtaactgtcaagagccaggaatggaaccagatttaggaggcctgactcaggtccacacctggggtcatcagcacaggcaggatttcattaaatgcagtgtcgagtagtgactctggaggcaggctgcctgggctccgatcacaactttgccactgaactgtgtcatctgagtaagttactgtacttcagttgctgcatctgtaaaatggagataaaaatagtctgcacctcaaagcgttgctgtgaagattaaatgagctaatatgggtaagttgcttagttcagcacctcctcaactctcattgttagttcttgatagaatcatcaatgcggtaagatgcatactatttcactatttcataaataaaagactcagacatgtttggtaattttcccaa

SEQ ID NO: 2919 - DNA, 1174 bp, Homo sapiens
agtcctgctcctcttgggatggggctggggtaggcccgactgcaccctccccttctggtagtcataggcaggattgagtgacggttgggaagggggctcagaagccccctccccagcccggaactgacccctccttcctccctccctgtgcttggctgggcctgacccttcctgtcccagggcccaggtctgtgtgatatctgtatatattgcattttgttgattttaatagaaaacaaagcgttattttctctttctttccctcctttttttttttttttttttttttggtaaggattttttccccctttataagtttttgtttccatatgggaggaggggagggagcctctgggtcacccagaatgaggggccttcccaaaacacaacaccccacctctctgctttcagttctagatctgagggaagccatgggagtagaggtagcagaggcgtctgagctgaaatggggcatttggagcaaggaccccagagttcccagatcttctcagctactctcctcccactggagctgtccctcctaggtgggaatgttcactcttttgttgtcaggttgtatgggggggcagggacagtgctgctgggaaggatgccagctctgggattgggccagtcctgtgggcaagacttgcaagaggctggatcaacttggtgtggtatctctgatggcttagagtaatggcaatgagggtctctgttgtgatgtcactgagtactttctggggtgcttctgggcaccccttatgatgtcacaggaagcagttcctcagaggttacttcctgtgaacataagggagcaggtacttcctgtgatgtctcaatgagttcttccttgaaggtcactttggtgatatcatgggaaggtgtacttccggtgatgcctagaggtcacgtcctgtgatgtcattaggctgaagcatgtacttcctgtattggacagtgaccagtctctgacctgccttctccctccacacccttctttggtgggtgttggcctgggggtcttcctaggaagagaataaggcacgggacttggatccaatctggaggactctaacggaaaaaaaccaatattgtcagggtcatctccattcaaacacgtcaagtctgcgaactcgccctggagggaggggtgggagatggacctagtgca

SEQ ID NO: 2920 - DNA, 1344 bp, Homo sapiens
caaaagatttgtcccaagctgcatgattgctctttctccttcttccctgagtctctctccatgcccctcatctcttccttttgccctcgcctcttccatccatgtcttccaaggcctgatgcattcataagttgaagccctccccagatccccttggggagcctctgccctcctccagcccggatggctctcctccattttggtttgtttcctcttgtttgtcatcttattttgggtgctggggtggctgccagccctgtcccgggacctgctgggagggacaagaggccctcccccaggcagaagagcatgccctttgccgttgcatgcaaccagccctgtgattccacgtgcagatcccagcagcctgttggggcaggggtgccaagagaggcattccagaaggactgagggggcgttgaggaattgtggcgttgactggatgtggcccaggagggggtcgagggggccaactcacagaaggggactgacagtgggcaacactcacatcccactggctgctgttctgaaaccatctgattggctttctgaggtttggctgggtggggactgctcatttggccactctgcaaattggacttgcccgcgttcctgaagcgctctcgagctgttctgtaaatacctggtgctaacatcccatgccgctccctcctcacgatgcacccaccgccctgagggcccgtcctaggaatggatgtggggatggtcgctttgtaatgtgctggttctctttttttttctttcccctctatggcccttaagactttcattttgttcagaaccatgctgggctagctaaagggtggggagagggaagatgggccccaccacgctctcaagagaacgcacctgcaataaaacagtcttgtcggccagctgcccaggggacggcagctacagcagcctctgcgtcctggtccgccagcacctcccgcttctccgtggtgacttggcgccgcttcctcacatctgtgctccgtgccctcttccctgcctcttccctcgcccacctgcctgcccccatactcccccagcggagagcatgatccgtgcccttgcttctgactttcgcctctgggacaagtaagtcaatgtgggcagttcagtcgtctgggttttttccccttttctgttcatttcatctggctccccccaccacctccccaccccaccccccaccccctgcttcccctcactgcccaggtcgatcaagtggcttttcctgggacctgcccagctttgagaatctcttctcatccaccctctggcacccagcctctgagggaaggagggatggggcatagtgggagacccagccaagag

SEQ ID NO: 2921 - DNA, 1146 bp, Homo sapiens
ccgaacccagagagcgggccgggacctgataccgatttcccacccgtcccctgccatgggcgccggacgcctgccggagagggctcccctccttaaagggccagtggcctccaagcccgacgcctgcgaccggcggtgggtgatagtgtttcccctccctgtccagccgagggaaaagttaactttccaggcttggctgtgttcagggaaggaactggtctcgcctgcctgccctccatccctcacaccatcccttgtcccggaccctggaggcggaggtccagcccccaactcggaggccccgggcccaccctccccttccgcccccggcccctcggcaggctccgcccctctctgacgtcgccgaggcccgcgccgattggtcgactgcactgtcgctccggacacttcctcctgggccgccgccgccgccgccgacttaaactttggagggggaaaaagagctactggcgcctggcgaccctccctgccccccacccaaccccgctccggcaacgcccccttcctcacggctcccgaccgaacttttctccaacttctgcgactcgtgagattcccttctacccactccggccctcgggacccctctgcccatcccctggccggtcgggtccctgcgaacccctttatctctggaatccactcggtccccgactcagagactcctgccctccacccccaaggtgaattcccccgggccgccttctgagtgggatcctcttcttggagcactggatcctgggattccctctgcccccttctcaatccctcctctagggaaggggcctttgaatcgcgggctctcctgatccctgtgaccccgacctactagatttcctctcaggcttcttggaatctcaatcgctgggacctccaacccactacttttctcctttctgatcttctgggagccctggattccgggcctctgacccactatagtgcctttctctccttcccaggaccccgccatcctcaggtcccctccgcctgccagatcttttctcggatccccgctctcccaccacctgctcacgagatcccgcggatctagaacccagggtcccccggggccccccggccgggtcccgggtgggctccaggcggccggtccccggcctcccc

SEQ ID NO: 2922 - DNA, 1181 bp, Homo sapiens
ggaacaggatgaggacccagtcggggagaggcaggtgggagggccgcatcttcctccctgtcctgtgactcctagctaggagggctctcaggatacgtgggatgggtggctggggcctgaggcctaggcaaggcagtgacctgcccactgccccacggaggggcccaatcaacctcctctcctctgcccattccccccctcccccagggccagagcttcacagccccacagagtggcagggggccctcagtgtggggaaggcgtcacctatgccagactgggttggaactgctgggtgactccggccctatgcctcgaccctgcagaaagccgtcgggtcaaactccaaggcattctggctgacctgcgggatgtggatgggctgcccccaaaagtgactggcccgcctcctggcacaccccagccccggccacatgaaggtaagaggcaccccccacctggtcccagtcctgcgggcccatggcagagggaggctgcagagctgagcccagggcttctgtgtcttcagggtcgaggcccagcctccagtctgcagcctccctgccccaaaagttcgtctgtctgtctgtctccctctctttttgtctgtcctgccctgtctgtctctctgtctctttccagctgtgattcttcatcttgtcctctccccgtctctctctcttgctctttatctctttctctgcctctctctgtcattctctctctccctggccctctctgcccctccctcccctccccctaccaggttcctttggcttctcctcagacgtcttcatcatggacactatcgggggcggggaggtgagcctgggggacttggcagatctcaccgtcaccaacgacaacgacctcagctgcgatgtaagttctccgggtgccccccacactgtccccattggcattgcgcccagggccagcccctgcaagctctgactgggtgccgcccgtgccctgctcatcctgtttcacagaggggtgcagatgtagacagtggagggacttgactgcggtcgccaaggcgcagggcctggaagactctggagcctgtgttttaatcacagttccacggctcctccactctgcccctcccaccctggtgatttggaatgcaggaagatgacctgtagccaccccctgctctgccaagtcaggccaatcta

SEQ ID NO: 2923 - DNA, 1206 bp, Homo sapiens
aggagagacgcagcctgcacagaagcagcacgaggccggcatggccgcaggcagtgaggcgtgggctgcggggaggttgtggtctcaggagtcagccactcagggccttgggctgggatagagtctgagtttgactcagggttgtgggaagccagtgctttcgagcagcggggtgacataatctgacgtacctgatccactctgagaaggagaggtgtgggagggtcacagaggaggcaggcggaccagttaggagatggctcgatgtctgggacagagctgatggactttagcggtggtgaggcgagaggtgtcagcttccccagaggctttcaggcagtcgacactgaaggactgcagctaaggggagaggaaaagaaacgagcgactccagggtttggtgtgagccattggagcagcatcccctgagacggggaagcctgggagtggaagttctgggggccgccgaggttgtgtgaagtgtgaggggcctgtttacccccatgtggagaagcagagctcgtctggagctgcggggcatttggcccctaaacataggtctagttgaacaagcacatgggcattctttggaaagccatggccgtctgcagtgcctgcaggagtgagtgtagatgacgcagagaagagatctggggactgcccgggtgctctcccacttagaggctggagggaggaacaggaggaggaagctgagaaagaggctgagcctgtgcggcgtgtcagtgtcgttgtgggaggaaggccggtgagaatggagtcctgtgtcccgctgcaagtgcagcgagtgttctgaggatggagtggagctctggtgatggcagccgtgaggcgagagggtacatctgcagtgacctctgcacccgttggtaactggcagttgacaagacctccagggcatcaacctgatggcagaaaggggggacgttttcgtcgatctgcacttggaattgcaccctgccttctcccgcagtcaggctgggtcagtacctcctctgctataacttgtcatgaagttggaagccaggaggtggaaggaggagtgccatctgttgctggggatagtgcaggctcctgggtagcagggatcgccggcgcccctgcttgcgcgaggctggctggctttcggcgcctcccagagcatttgtagaatggccggttcctctttcctgcagggcgtgtttgcct

SEQ ID NO: 2924 - DNA, 1528 bp, Homo sapiens
atcatggttgtgatcactgcagcctccacctcccaggctccagcgatcctcctgccccagcctcctgagtagctgggactataggtgtgcactaccatgcctggctaattttttttttttttaaatatatataaagatgggatctcactatgttgcccaggctgactccaactcttaatttttactttttagattccagggggagagaggcaggaggcttaggccttggccctttccttccctctcaccctctcccctcccgcttactttgctgtcatttctacccctttagcgaccggtcctgtaccgtcctcaatgtagaaggtgacgctctgggggcaggactcctccaaaattacgtggaccgtacggagtcgagaagcacagagcctgagttgatacaagtgaagagtgagctgcccctggatccgctgccagtccccactgaggaaggaaaccccctcctcaaacactatcgggggcccgcaggggatgccacggtcgcctctgagaaggaatcagtcatgtaaaccccgggagggaccttccctgccctgctgggggtgctctttggacactggattatgaggaatggataaatggatgagctagggctctgggggtctgcctgcacactctggggagccaggggccccagcaccctccaggacaggagatctgggatgcctggctgctggagtacatgtgttcacaagggttactcctcaaaacccccagttctcactcatgtccccaactcaaggctagaaaacagcaagatggagaaataatgttctgctgcgtccccaccgtgacctgcctggcctcccctgtctcagggagcaggtcacaggtcaccatggggaattctagcccccactggggggatgttacaacaccatgctggttattttggcggctgtagttgtggggggatgtgtgtgtgcacgtgtgtgtgtgtgtgtgtgtgtgtgtgtgtgtgtgtgttctgtgacctcctgtccccatggtacgtcccaccctgtccccagatcccctattccctccacaataacagaaacactcccagggactctggggagaggctgaggacaaatacctgctgtcactccagaggacattttttttagcaataaaattgagtgtcaactatttaatcaggtgttcttgagaatttgacttaaagcactggccactgcaatgacagtatctgctcatcaagaaacaccactgggctgggcatgggggctcacacctgtaatcccagcactttgagatcactccaggccaggagttcaagacaagcctgggcaacatagtgagacatcgtctctacaaaaaaatacaaaaattaaggccgagcacggtggctcacacctgtaatcccagcactttgggaggccgaggcgggcgaatcacgaggtcaggagttcaagatcagcctggccaacatggtgaaaccctgtctctactaaaaatataaaaattagccagacatggtggtgggcgcctgtagtcccagctactc

SEQ ID NO: 2925 - DNA, 1099 bp, Homo sapiens
agctgaggcccggggcgacctgccctggcctgccgtgggaggccagcattcctcaccccgaacccacaatgcctcagggctagcacgccagcctcttggggctgaaggaggctgactccccaagtcctgcaaaggggtgcaagcctagttccaaccctgccgggctgaggcatgagtaggggctgtatttgcgtgcaggcgggcccccaaagcttccactcgctgccttaaaacgccaacccagcctctcagacaatgctgccctcccactatggtatctaataaccctctgtgtgtctgtctctgcagaaatatcttcccttccaacctggtgtcagcagcctttcgctcagtgagtcctcaggggtgtcctgaggggatgggggtggacagggagggatgccagccagggggagcccttgctacctgattttggttagttcctggaaaaatgcatgtcaatgagaatacgggctcagagcctcctgtgagttttaattctagctgtgtgactctgggtaaatgtgtttacctctctgagcctcggttttccacctctggaaaatgggggtattgatcatcctgccccatggggttgccagcagatgaaatgagatcacattgaaaggatgtggaagggcaggctttgagcattgttagcttggcatggggttgggaggccctggtaacgatggacactgactcttcccaaccccacctacagtactctaccacctatgaagagaggaatatcaccggaaccagggtgaaggtgagagcagtgggaggcagcgggggctctacctctttgcctattgctataattttttggttttatttctgccttagtctttgctgtggaatttgattgacactctgcagtccttccccaatttctgtcttttctgccttctggataggtctctactttgtcccctcttttcccaccccaggtgcccaggctcttcctttctccctcaccccccaaccccattccatgctgccctctccctgcccccttccatccaccctcaacctgctcaaactggcagccagccagaggtttttgttgttgtttttctgacacaggatctctctc

SEQ ID NO: 2926 - DNA, 1179 bp, Homo sapiens
ttctatgggggacctggcccatctcgggtatcagccccgcccctactcgtccagtctccgaacgctctgcagccaatcggcgcccgagggtcggtccccgccttctcaagccccgccccctacccttatccctggcagcttccgctaaacgggctcagagccacgcggcacgcccgggaggctttctctggctggtaaccgctactcccggacaccagaccaccgccttccgtacacaggggcccgcatcccaccctcccggacctaagagcctgggtcccctgtttccggaggtccgcttcccggcccccagattctggcatcccagccctcagtgtccaagacccaggcagcccgggtccccgcctcccggatccaggcgtccgggatctgcgccaccagaacctagcctcctgcagacctccgccatctgggggcactcaacctcctggagccaagggccccacgtcccacccagagaaactctcgtattcccagctcctagggccaaggaacccgggcgctccgaactcccagctttcggacatctggcacacggggcagagcagagaagcctcagcgcccagcctggggaatttaaacactccagcttccaagagccaaggaacttcagtgctgtgaactcacaactctaaggagccctccaaagttccagtctccaggtgctgttactcaactcagtcctaggaacgtcgggtcctgggaaggagcccaagcgctcccagccagcttccaggcgctaagaaaccccggtgcttcccatcatggtggccgatcctcctcgagactccaaggggctcgcagcggcggagcccaccgccaacgggggcctggcgctggcctccatcgaggaccaaggcgcggcagcaggcggctactgcggttcccgggaccaggtgcgccgctgccttcgagccaacctgcttgtgctgctgacagtggtggccgtggtggccggcgtggcgctgggactgggggtgtcgggggccgggggtgcgctggcgttgggcccggagcgcttgagcgccttcgtcttcccgggcgagctgctgctgcgtctgctgcggatgatcatcttgccgctggtggtgtgcagcttgatcggcggcgccgccagcctggaccccggcgcgctcggccgtctgggcgcctgggcgc

SEQ ID NO: 2927 - DNA, 1119 bp, Homo sapiens
cacacccttgttttagcacttagcacactgtttacttatgttttcctccactggactagattgtacctctctggggacacatagatgtgagtcttacttgctcttgtatcttcacccagcacaaggcctgacacatgagatgtttactaaatatttgttgaataaaaaattaatttttactgtagttaattgattaaaatttggttctaaaattatgatgctgatgggttttctttttttttcccccatctaggaagaaatgttggctatttggcgatgagaggtggtgaacagtgaccatactggtatacaacactatgggacctggcatttttgctgcatgtccagcccacccccactaataatgtaggaagctgtctggtccattggaaacactaatctgatctcagaagtggctgatcgtggcaggatgtgtcgacgatgatgatggcaagaaagcaagatgtccgaattcccacctacaacatcagtgtggtgggattatctgggaccgagaaggaaaagggccagtgtgggattggaaagtcttgtttgtgcaaccgcttcgtgcgcccgagtgctgacgagtttcacttggaccatacctccgtcctcagcaccagtgactttggagggcgagtggtcaataatgaccactttctctactggggagaagttagccgctccctggaggattgtgtggaatgtaagatgcacattgtggagcagactgaatttattgatgatcagacttttcaacctcatcgaagcacggccctgcagccctatatcaagagagctgctgcgaccaagcttgcatcagctgaaaaactcatgtacttttgcactgaccagctggggctggagcaggactttgagcagaaacaaatgccagacggaaagctgctggttgatggttttcttcttggtattgatgttagcaggggcatgaataggaactttgatgaccagctcaagtttgtctccaatctctacaatcagcttgcaaaaacaaaaaagcccatagtggtggtcctgactaagtgtgacgaaggtgttgagcggtacattagagatgcacatacttttgccttaagcaaaaagaacctccaggttgtg

SEQ ID NO: 2928 - DNA, 1624 bp, Homo sapiens
tagctgaggttggcagaaacgttcccaaactcccccagccctggaccccagcagatgaggaaacggccccatttactgaccccgcccccttttcgaggttatgctcacctggtcagctcctcacgtaattgggggtggagggaaagcatggtggtgccctgggccgtccctgtgtgaacgcaggcaaaagcagcccagtccccctcactgcttgagctaacactgccacctcttttgtgtgagcacaaaagccacgtcccaagccacctggcccgattccacagatgtatgtgcggccagtgacttccccaggagtgtggagggggtggtgaggaggagcacctgggctctctacccctctcctcacagaagtacctgaaactaggtctggggcactcccaatgcagcgccttgtcagccaaggtgggcaggcagggactgtggcagcttatgtccaaagggagcccccatgcacaggaagccacagggttcctcttgtttcccccgctaacttcagcctctcatctgctgctccgggctgagggactagaggacatctcggtcgtttgaggggcatggccagtcgtggcaggccggccttcagcgtccggtcagggaagcgtgcagcccaaatgggcacttgcatgggagccacagaggagcgtccctggggattgttgggaccatgctgcccccactcccgcttttgttggggctctaagttctggaaggtgtgtgcacagagggtgctcatgggactcgcatgcagctctcagcactgggtgggagggcgttggcttgtccagaatggggacgtggggcagccacccctgcccagcgagagcgcagacaccgtgtgaggggacagcagcccttggtgcaaagccagagactgatcctggctctgacggctgaagagggaagacccaaggctgggtggcgtggctcgtgaatccacttagaattcttggcttgtgtcgcatactgggtgtcacggcacacatttactctgcattgtccccgtctttcccatcgcctagcgtttggggaggaacagggagagagcttcggggcgtctgtctccgtgctctcctgcctccaccgccttggttttgcttcctgctggaggcagggcacctgctgcgacccagattcttctgcaggatgtgtctgtctttgtcacggtggacagagggtgacatcataggagcagctcgctggccagaaggggatgggggcatccctgtgcctcactcagctcctgctgctcttagggaaaggaggcctgggtcaagccagcatccccttggtaaagacccccgcaggccaccaggcattctggacacgcacacacacacacacacacacacacacacacaaaacttcacagcaggccagctgcagtgacttgtcatcaagagtcacctcagctgcgcccccctcccatcctttcctatgagaagccactgctttgggggcgccggctagaaaaagtagggtgcggtggccaggagggcccctgccgcgcggggggctgggtctggttgagtcgctgctttcccgagggcagcgcagggatccggggaagctgcggcagggagcgggcgccggcttcgtggctctg

SEQ ID NO: 2929 - DNA, 1158 bp, Homo sapiens
gggccgctctgttcccctgagacctggggagggcaggcaggggcaggctgtgcgtccttctccatcgccatcggtgtgggtttgcagtgaggggcaggggggctggagttggcacctggaggcccttcccgacatgaaccctcggttcttccctgccacagaggactacgggcactacgaagagctgccaggggagcctggggagcacctcttccctgagcaccctctggagcccgacagcttctctgagggagggcccccaggccggccgaagccaggcgccggtgtccctgacttcctgccctcagcccagagggccctgtacctgaggatccagcagaagcagcaggaggaggaggagagagcgaggaggctggctgagagcagcaagcaggaccgggagaatgaggaaggcacgtgtccgccccaggggccggggcacaggccccaggccgctgtgcaggggagcggcggtggtggggtgttccaggttgggtttcctgtcaggaaggagcccatggctagggaggacccctgtccagggccatgaagccgggctggggctgctgcatgtccctgagaaaactggcagtcaggggtggctttctgtgttgggttcaggagagaccctgatcccatggagtaggatggagggctagttcctggaggagacagtggccaacaggattgaccgcctgtgccctgccagaggaggctttagggagaccctcacagcccctgttttcctaccgtgttctcaaggagccaacaaacaagagctagtcattgaaattaaccagtaataatcatagtcacgagccaccgagtctcagttgctgcatggttgacttagtggtgtccactttggggtaaaatgacaagtggtgtctagatcctgaagccagaggccacaggtggccctgactgtagcgcaggagccagtgggacagcaggaggaggggccgctcccctgatggcccaggctgtactggcctaggttttgcttgagcccatgtctgagtctgcccagccggccctgcctcttatcagctggtgactgcggttggtccacaccagcccctccctgggacatggggacatcacgagccggtttggggtcaagtgtctctgagccccaggcccagccagaactgagtc

SEQ ID NO: 2930 - DNA, 1236 bp, Homo sapiens
ctatgaaaaaaaaaaaaaaaaattgacagttcaatgtcacctctgataagccttccctgaccacccctgttactctgtagccccatgtcctgctttatttttctccaaagcatttatcatcgctgggtttatatttatttctcttcgggcttttctcactggatcgtaaactccatgaggacagggctttgtcgatttcactcaataccgttattttacaacatccctattgctgggatctcagtatgcactccttaaatatttgcagaatttaagtgccacataagtgaccacgtgggcaacgccctcggggccttaagccgcgccatttttggggctaggattggttggaccctccgtcacgtgacatgcagtcgccggatcgcctttgagtctcgtgaggtacttttggtcccaggctccgcggacgaggtactgcgcaggcgtgggagggtctgcgcatgcgcagaagcactccgggcgtgctgccggcggcggtaggtggcgcgcgggtccggcgggcggttggcttgagcgggaccggagctgaggcaggaagagccggcgccatggtggagaaggaggaggctggcggcggcattagcgaggaggaggcggcacagtatgaccggcagatccgcctgtggggactggaggcccagaaacggtcagggccggcgcggcttgaggccgctagggtctggagggggcgtctattctgaggcgtttgcggcccggaaggagcgggaaggtgtgatttgaagggaggaggcgggaattctgtgctctgggatcgtctctctcttggggggactggaggagttgattggggatgtttctggaaggtctgggaagtggttgggagggccgttccgaaggatgggagctctgaagggggcgttggggagtcctgagagagcgggagaattcaaactcaggaaatccgaggcccgaaagcggtgattgtggggtttgatcgcggttaggggataagaggggctggggatacgtggaaagggtgaggtgagggacgcagttcattcattcgagggtatgggacctggttccgtgctgcacacaggggagactggactggccaaccggacagacgggagcttacactcttgtgggagctcacgggcgggccagtctgagagaatgcgggttttgaggagttttggagcaagttatctcaaatgggaatcttgagaggctcggagaggctggagggggacg

SEQ ID NO: 2931 - DNA, 1245 bp, Homo sapiens
gatggcattgcctgcccaaggtcagttggcactaagtggcagaggtgagattcaaacccaagctgttggactccagagtctgatgggtaggcatggtatttgcttagattttctttttgctttttcttttttttgagatggagtttcactcttgttgcccaggctggagtgcaatggtgcgatcttggctcactgcaacctccgcctcccgggtttaggtgattctcctgcctcagcctcccaagtagctgggattacaggcatgcgccaccacgcccggctaattttgtttgtatttttagtagagatggggtttctctatgttagtcaggcggatctcgaactccctacctcaggtgatccgcccgcctctgcctcccaaagtgctgggattacaggcgtgagccaccgcacccggcctgcttagattttcaatttgggcagggccaggggctggtacccaggctcagggtcctctcctgatcctttctttctcccaccccaggtcggctaccagatccgctttgagagcacacgttcggcggccaccaagattgtattcctgacagtggggctgctcctgcgacaaatccagcgggaacccagcctgccccagtatgaggtcctgattgtggatgaagtccatgagcggcatctccacaacgatttcctcctgggcgtcctccagcgcctgttgcccacgcggcctgacctcaaggtcatcctcatgtcggccaccatcaacatctcgctcttctccagctatttcagcaatgcccctgtggtacaggtgcctgggaggctgttccccatcacggtgagtacttccccctcctcccacatccccagacctccaacctggtctctgtccaaacctggacatgcctcttctctctgctgctgtatctcccatctctttcatttaaagatgttctctttttttaaagctaccattttctgagcattcataatcagctggttagagtgctaagtgcttgttagagtaaaagctgttacaagaagacccaaaaatggctgggcgccgtggctcatgcctgtaatcccagcactttgggaggccgaggtgggtggatcacgaggtcaggagattgagaccatcctggctaacatggtgaaaccccatctctactaaaaacacaaaaacaaaattacccaggcatggtggtgggtgcctgtagtcccagctactcgggaggctgaggcaggagagtggcgtgaacctgg

SEQ ID NO: 2932 - DNA, 1203 bp, Homo sapiens
gggggctacgcagtcactgacttcctcacctacaactgcctcacggtaagcatgaaccctccttccctgaaggtgggatttcaggaagaccccaccaccccgtttcaccttagtccagggacatagttcccaagtggggcccgtggccctgagggcttctgggaagggtcccgggggggcacttgggtggtgggtggcacttggcgggggcccagccctgacagctggcctgccacagaatgacacagacctgtacagcgactgtctccgaaccttctggacctgcccccactgtggcctgcatgcgcccctcacgcccctggagcgcatcgcccatgagaacacctgcccccaggccccacaggatgggcccccaggtaagcacaggactgtggggacccggccacctctgcccagccgtctgcccatcccatgatggtctcctgtgcgtgtgagcacttgctagagcttcgaggactgacgacctccacccgctggccctggctggtgccacacacaggccttgtcctgaagatcaggagcccaaggcagggagagcctggagcgccacctctttctgtctgcctgtcccctgtggtgtctctgtgttgctgtctttgtctctgtttctgtctctctgtggctatgtctcttgttatttttctctgtcctgcagctatctctgccttggtcacctccaccctgttgtcacccagggatgccacacactggggttcagtgggggagatagcactggggccacatgcctccatccccggctggctgtgtctgcctctcagtctccatgtctctccttgtgtctttctctctgtctctctcactggcagggatgcggagtaaagacagacctgtgtatttttattaatctgggagggcttcctggaggaggcaaaactgggttctccaaaggccaggagagaacctgagccccacaggtgcctggcatttgggtgcaggtagacctgtgcactggaacacgcccctcacagcctcctccttttcctcccttaggggctgaggaagctgccctcgaaaccctccagaagacatctgtcctgcagaggccctaccactgcgaggcctgcgggaaggacttcctctttacacccacagaggtgctgcgccaccggaagcagcacgtgtgagctgggccaggagccctgcccacctccgtgcagctga

SEQ ID NO: 2933 - DNA, 1176 bp, Homo sapiens
cccacacagctcagccaacaagtgtctgctgaaggtggctggttacgctgcgctgctggagcagtatcagaaggccattgacatctacgaacaggtggggacaggtggggatggcggcttccaccctgccccctctcagggcctgtgcctcctcctaagccccggcaccttgttctggaaccacccctcccccggctcaccctctgcctctcccccgacatcccttgccatgtcatccccccaccctgtcttcagcctggctgaatgttctccacctacgactccatgccgtgccagcaccgtctctctccctggctgtgcccctcccacacccctcgcagagcttcctggaggggcccagagtgaggctggctaaagaacccagagggagggaatgggaagaagtgccaagaggcccagggtggccgtgggcaccccaccccatggcccgatggtcctcatccacagtgggagggagggagtgtcacatggggtccccccagcgtgcacggagccctgggtgatggccgagaaaaaggcaggcagctggccccctgggagagaggggcgggcgccgcctctcatgttcccaccgcctgccgccgctctgcccaccgccatgccagcctcccgttggtcctgacagccaggctgcctccttcccactgtctcaggctctcagaaggcccacgaacacctggctacagcctccacccccacccagccaccatcacaccctgatcttggtcgctcacgcactggccgctgacctctccaagctggtccctggctccctgcccttggggtcctgggttaacagggcctcacctcgggacatgaaccagctcccagctggccccccagtgcctggcagtggctctggccctctggctgcttgccctgagctcaccagtgccacttctccatggctacaggtggggaccaatgccatggacagccccctcctcaagtacagcgccaaagactacttcttcaaggcggccctctgccacttctgcatcgacatgctcaacgccaaggtagcacaccccacgcccgcaggaccaccgcaccaggccaccatgtgcttatctccaggccaggtcccgttgcccccgaagagggacgtgctcctccctcacgtctggcccctgccagccagcctttggatgagaa

SEQ ID NO: 2934 - DNA, 1194 bp, Homo sapiens
gactatgccggtcccatgactaagtgccagttgtccacaccacggtggccacctccttcctccttctccctcttctgttgctgctttccccccttcaccttttcctccccccaccttccttcggcctcccccctccccgcctccccttcctccttccccccctcaccctccccgccttccctcttcatcatcagaacacgcattcaccaaacacttattatacgaccagcccttccttgttatcttcatttagttctcacagctataatatcatattccaaatagcttatctttcataatataaatgatgaggaaatgtagtaattatataatgttggtctatttacaggcccagtaacagtggtgatcctgttactattttgtgatcacacttcttaccacgaccatcatttttgtataccctaagatccccattcaggttctaaacactctccacacgtgacatcagtgaattttcacaggcatcccaggaggcaggttggttgtgaccatctggcagttaagagctcagggggttacagtggcctgcctggtcctcagtcggttggaggctgagccagagccctgtctgcctgccactccccgccactcaccagtggttgacccaggcagttccctcgtctgtgaaatgaggaagggagcagcacccgcctcatgggactgtcaccaacaacagcatggagaatcacaataataatgagtgatgatgatagatgcttctcgagcacctgccaggggccgggtgataccgtgaaccctccatgtggatttactgagaatcctggaagctgcagattttgatgggttatctggtcagtattggtggagatggaaatctgtatcataagtattgtttgtggggctttccacacatatgcctgcagatatttttccatgcgtgtcctgggttgcagtccaggatagcatgaaaagcacttaaaaagcattgaggctgggcacggtggctcacgcctgtaatcccagcactttgggaggccgaggtgggcggatcacctgaggtcgggagttcgagaccagcctgaccaacatggagaaaccctgtctctaccaaaaatacaaaattagccgggcatggtggcacacgcctgtaatcccggctgcttgggaggctaaggcaggagaattgcttgaactcgtgggcggagattgtgg

SEQ ID NO: 2935 - DNA, 1199 bp, Homo sapiens
cattctcagaggccccttcttctccaggagggggctttggactgggtgtcctgggccccgcgggggtgatatttctgaacacccgccctgttctgcaggtaccaggcacctgacatcgacgtgcagctgagctcggagctgacagactcgctcaggaccctgaaggtgctcactgtgtcctgccgtggagccccgtgcccagtgatgacaccatccttgctccccgtgccccccaggggctatgggcgacaccatggctgcccctgggctgggccagtggggccaatgcccaggggctgagggcacgggatgctgggatgagatcccagggtgaggggccaggctaaggtttgagtccgggaccctaagaaggcctttccttccagctggtccctgttgcagtcccggtcacctttaggactagagggaccttcctgaagctcagaaccaaccctgtccctcccctgctcggaacctgctgtggctccccagtgcccctgaggaagcccagctcctctgtcagccacacgcctgggccgacccggccgtggggctccagccagttgtgctcatgagcggactgtgccttctccctctgatccagcctttgccctcgctgtccccttttctgtgtcgtcaccagcccacttcccgtgactcctctaagcccagcttagagatggccataggttggtggctgtcatcccaacactgagccccagcagctgagggccaggctgagtccctggtgcccacaggctgccctggggggagactgcatggggctgagccctgccaggaccccgaggagaggtccaggcccttgggcttctgccaggccctgctgaggcctccctctctgtcctgtagcccgagggcaacatccttcgagaccggttcaagagcttccagaggaggaatatgatcgagcctcgagagagagccaagtaaggggcggccggggctgctgtggggcgagggcatctgggattggccccgggcactgattgctccattgtccctgctccaggttcaaacgcaagtacaaggtgaagctggtggagaagcgggcgttccgtgagatccagtgagtccacccggcttcggcgcaaggaagggagcccttctcccaccccgtggtgcccaccgagtcccagggccccttccagagtgtggctagtggctgagccacaccccct

SEQ ID NO: 2936 - DNA, 1199 bp, Homo sapiens; identical to SEQ ID NO: 2935

SEQ ID NO: 2937 - DNA, 1191 bp, Homo sapiens
agctgaatgcattgtggactgttgctgttgagcgtggggtggggtgccaccatgcaggctttgaattcttttttttttttgagacagagtctcgctctgtcacccaggctggagtgcagtggcgcgatctcagctcactacaacctccacctcccaggctcaagcgattctcctgccacagcctcccaagtagctgggactacagttgtgcaccatcacgcccagctaatttttctagtttttgtagagatgggtttttttcaccatgttgcccagactggtctcaaactcttgggctcaagtgatccgcccgcctcagcctcacaaagtgctgggattacagacgtgagccaccacacccggctatctttcttccttttaacatgggccccacgcctggcctctgttcctgcaaactgactccctaccccaaccacctctttttctctccacagtccagggaccttgacccagcccctctcagcagacgcttcatgataggaaggactgaaaagtcttgtggacacctggtctttccctgatgttctcgtggctgctgttgggggcagagattgacgcccccggtctttgcctctgagcgggagagtctgtgtgtatgtgtcttccccggaatccacaccaccccaccctcctcctgtcccgtggtttcatcatatctctttgcataccccatgtcttccccagttgtcccctggagtttggggggacatcccgcctcaggcatccttctcaaggggaagccaagagaggcatcaggatgggtgggtttctgattgtggcaacgtttgcaaccgttcacgattcaataaatattggatgaatttaactgaatgtgcctgtgaggagtgtatcttgttttacccctgtgcctcctccctccaggaccccgtcccagaaattagcaaccacgtgttgagtgctcagtgcaccaaccctctgtagggaagcaccttactgcaatgctgaggttgttattttttaagacagtcttgctctggagtgcagtggtgcgatcccagcttactgcagtgtccctctcctgggttcaagtgattctcccgtctcagcttcccgagtagctaggaccacaagtgtgaactgctatgcctggctaatctttttctttttctttttctttcttttttttttttttttttgagacggagtctt

SEQ ID NO: 2938 - DNA, 1224 bp, Homo sapiens
ttttgtatttttagtagagacagggtttcaccatgttggccaggctggtctcgaactgctgacctcgtgatctacctgcctcggcctcccaaagtcctgggattacaggtgtgggccactgcgccggccatgtttctcgacttctgctggcaagcatgttccagtatttgcatggctcctagccctcatctccatttctctgcacagatgttaccttccccatgaggtctgccttatacatgaggcctgtattataaagtgcaactccgcattccccaaccccgttgtttcttctctccagaacactaggcaccatctgatctcctatgccttttccttattgtcagatactgaactctcagatacagttccccttcctccctccagggggcgccatggaacgcagggccctcactggccctggggactgggtgacgacaggggggagcctctggtgattggctccctcaccctgcgtaagatcaaagggactaaaggacagccccgacacccggagccattgtggctcaggccggttgcgcctgccctcgggccctcacggaggcgggggttccagggcacgagttcgaggccagcctggtccacatgggtcggaaaaaaggattttttttatcgttcccaatataacgacaaaacgtaaagggaggacgccttgataggaagaaatgacatcttcctaagtgtttttaaattacttccatgtgtctttttttttttttttttttgggagaccgagccttgctctgttgcccaggctggagtgcagtggtgtgatcttcgctcactgcaacctccgcctcgtcggttcaagggagtctcctatctaagcctcctgagtagctgggattacagtcgcctgccaagagatggggtttcgccatgttgaccaggctggtcttgaacacctggcctcaaatgatccactcgccttggtctcccaaagtggtaggatgacaggcgtgagccaccgcgcccagcctcttctattcttttagagacagcgtctcactctgttgcccaggctggagtgcattgatgtgatgtgtgatcatagctcattgcagccctgaccatccgagctcaagcaatccttctgcctcagcctcctgagtagctggggccgcagatgtgcaccactgcacctggctaatttttaacatttttgtggagccagagtctgtataaaataaagtgtaaatagta

SEQ ID NO: 2939 - DNA, 1224 bp, Homo sapiens; identical to SEQ ID NO: 2938

SEQ ID NO: 2940 - DNA, 1224 bp, Homo sapiens; identical to SEQ ID NO: 2938

SEQ ID NO: 2941 - DNA, 1224 bp, Homo sapiens; identical to SEQ ID NO: 2938

SEQ ID NO: 2942 - DNA, 1224 bp, Homo sapiens; identical to SEQ ID NO: 2938

SEQ ID NO: 2943 - DNA, 1224 bp, Homo sapiens; identical to SEQ ID NO: 2938

SEQ ID NO: 2944 - DNA, 1224 bp, Homo sapiens; identical to SEQ ID NO: 2938

SEQ ID NO: 2945 - DNA, 1224 bp, Homo sapiens; identical to SEQ ID NO: 2938

SEQ ID NO: 2946 - DNA, 1224 bp, Homo sapiens; identical to SEQ ID NO: 2938

SEQ ID NO: 2947 - DNA, 1224 bp, Homo sapiens; identical to SEQ ID NO: 2938

SEQ ID NO: 2948 - DNA, 1176 bp, Homo sapiens
agtgagagcaaatccattgagggctcacatcatggagcatttcttgggagccctgccctgtgccccgtgccttacctcatcagttcctaccagcaactctgtgagactggtcttgttaccctcacctccagtttatagaaggggaaatggagacatggggaggcaaactaagccacttgtctcctgccactggctcaaagcaaggaccatgctggggtcctgaccattacagtcaccagggcgggcgccaggctcagttctctccctgactcatcctcctcaagcctcgccaacccctcagggcagctgagatgggaggtgctggtgcacctacttgtgcccctccccagtctatgctagtgggcaggatcattactgcctggctcagtttcctcatctgtcacatggggctgtgtgatatctggggtcccttccaggctctgaagattcttctggtttttgaggagagggtctacatacatcaaggtcgaggagatcagagaagggaggaggcaagattggggaggtgcagacaagcccccttccctggcctgctctctccccaggtccctgagcggacggctgcgccttgggctggcagagcagtcggtgctggctgccctctcccaggcagtgagcctcacgcccccgggccaaggtgagctcctgtggcccgtctctgcatccctcgctggagttacctcaggcttcccccctcctcttcagaggcccatgcccgccccttccccagcgggcccctgccataccaggctcctctctcctgggtgggggggagggggcgtcttgggccgcggcatctgcattccttgccatacagcaaaccacccactgcaccctggtgtagccaaggatgtgggtgccttccaaagcctctggtgggtcttttcttagaattcccaccagccatggtggatgctgggaagggcaagacagcagaggccagaaagacgtggctggaggagcaaggcatgatcctgaagcagacgttctggtgagagctgggcagtgggtggagttgccaggggctgtgggcagagtgccagggtgggggtggagccagaggagcagtgggtggggccagtgaagtgacggacaggcatcacgagtgccggtcacggggtgactgagagcagaggtggtgatctagacaaggct

SEQ ID NO: 2949 - DNA, 1099 bp, Homo sapiens
gtgttggttctgataggttgagagctgcttgtcacagctgtcaccgtgacttgaggctccatctccccagctcttacacccaggcgcccatgggacccagctctggacagtaagtggggccagagcacatcccacgtgtgtaagctggtggctccaaaacaagccgaagggtctttggtcactgccagagatgttcatgacccgccagaggaaagggtcccttggccttctctgctctgtccacactcacttccctagtgaccttgtcccgcctgtggctttaaatcccatccgcgccctgatgacaccggcccagatgtctcccctgagtgtggtcatgctcgttcatccaccgctttcctggctccacgtgcatgtttgctgacttcctacagccagcgtggctgggggcacgttccccaagccatttctaccaagtgggtgagcgttagacacagggaggtgcagggactcgccacaagcacacacagctggagaaaattcatccaggccgcgagagaagggagacacgcagccacaactgtcaccctcgacacccccacccgcgctctcccctgaaggtcggcagctggagtccgtccgggctgaggcagccgagaaaggcgacgtggggctggtggccgagaacagccgcagcacccagaggctcatgctgccaccacctccgctcactgcctccggggtcttcagcaagttccgcgacatcgccaggctcactggcagtgctgtgagtggggcgggccgctcatcccggaccccagacatcttggggacctgaggccacgcgtgtgtcaggaaggcttctgggtagaccatcagctgggtcgcatcagtccttctcatggggtgcacagcttcctctcctccttcctgcacccaatcctaggggagtctcctcttcagagtctagcagacctaatgccatggctgccacatgacaggactcagtaaatacttcctggataaagggagagggaggcaaggaggagagctagctcgttcttactgccctaagagtgggcggccatgggagctgggacatggggatggggtgagggaaggagggcaggtattccaa

SEQ ID NO: 2950 - DNA, 1196 bp, Homo sapiens
ccaaattccttcccaaagttagttctgcctatgcccaggactgaacaaggacagcttaaaggttagaagcaagatggaatcggttaggtgtgatttctttccactgtcataatttcctcagttacggttttgcaaaggcggtttcacctccagcaatctgtgattgtcctcatggctccaggccccagagcctgggactgttctgagccctttcctcttctttctccatttctttctagtgtccacccccttaaacccaccccaccccgacaccacactttgaccttgaggaaccacgtgttcatacccccgtcccctcctccaggctccggatggtggagacgctgagcaacttgctgcgctccgtggtggccctgtcgcctccagacctcctccctgtcctctacctcagcctcaaccaccttgggccaccccagcagggcctggagcttggcgtgggtgatggtgtccttctcaaggcagtggcccaggccacaggtaagggggactgtggttggagggaccagaaggacaggagctcagccagagaaaatgcagaggtcaggtggatcggagagatggtggagagaggctgtgaaacagggttgaggagaaggctgagagggaggagagcctgatggggacagatttgcaggggtgtgggagagaacacaggggcagcagttcaggtgagggaggaccaggcatgtgctgggacagggggtgtggggtgcagggaaggggagggctggggaaagatgctggaggcagagacagcaggatttgggggctgagatggaaggttggggcttagagaggtctgaaaggactttgactggagggattggaaggagtgggaggaaagaacatggtgtgtggggggccagcagcctgaaggggcccagccgccagtgctgggtggaaaggctggtgatgcggatggcccgcctgccaagggcctggagtgctcggtgcttatcatgaggacactggggagccatggaaggattgtgagcaggcaaggggcagcatccagggggaagaggagctggaccccagctgtagagaagagagaagagggcaggagagatctggcagacagtggatgtcagggtgaggaggcaggaggaatgcctccaggatctccctgggtgactggatggatgacaaagccgtcggcagcttgggaccctggt

SEQ ID NO: 2951 - DNA, 1193 bp, Homo sapiens
taggctgaaactccagcacagccatgtggtggaagatttatggacagaaaaaggaaagtgacatacagaaaacgtaagtgaggtacagaaacagctggattgattacagctcggcgtttgctgtacacagttcgaacagttggctacatttgattgcccaaaactcggtgattggcacaagcgtaggccaccttctgtttacacctccacttgttatagttcacgacgtacagaaaaaccttcaggccgaacttaaaatatgtaaggaggcagctttaggctaaacttgatttaacactgtgagctatatatgtggggcatatagagggttaaggtttactaacctttagtttcctcttgccttcctgaagggccaaatactgtaatacgtgcagttccctccaataggaacgtacttcttcattctcttttcctggcaaacacattcttcaaggtccagttctgtgaagatccttctgcctgttttttaaaatttatttttatttgtttgtttatggtcacatacgtctcttcctggtctggactcatccaatccatttgtcacagtaaagcttctggggtaggggaggtggttattctaatgtacatccaatcaagccactctctgtttaaaaccttttgaaggcttcccatacctcccaggataaagactcacctcatcttctatctttaagggcttgcggatttcactgtccaaatctctccctctttcacactctgacccatctacactggcccatcttctctttaccttatgggctgagctcttttccaccccagggttctgtgtgttatttggtgaatcaattaatgaattaattcagcttcccgtcactaaccagatagcccacatctaagaatctaatgataaaacaggcaagtggagaagttttggatttggtttgcgctcaatagctgttgtttgccttcccaggatccctcctgcctcctttcctttctctctttctttttttttttttattttttattttaagagatgggcatctccgggcgcagtggctcacgcctgtaatcccagcactttgggaggccgaggtgggcgaatcatgaggtcaggagatcgagaccatcctggctaacacggtgaaaccccgtctctactaaaaaatagaaaaaattagccgggtgtggtgccggccacctgtagtccc

SEQ ID NO: 2952 - DNA, 1224 bp, Homo sapiens
cctgtggtcccagctccttgggaggctgaggtgggagaattgcttgaggaggtcaaggctgcatggagctgtgactatgccactgcactccagcctgggctacagagtgggaccttgtctcaaaaaaagaaagaaagaaaattgccagtagtgagaaagggtaggaaggaaagaaaccaggaatgtatctgtgagtcctgggggacctccctccctgtggatctgcccatctagcgtgcctgccctgctctggctgtgggaggctgtcccctccctgcaggggccccagcggtaatgccctccctgttttctctcctcacagtcctaaaggggaagaagttgagtttgccggcatagccccggtcctctccatctctctcctcggcagcagcgggaggcagaggaaggcggcagaagatgaagagctttcccatccaggggtgacttttttaagaacccacctcttgtgctccccatcccgcctcctgccgggtttcagggggacagtggaggatccaggtcttggggagctcaggacttgggctgtttgtagttttttgccttttagacaagaaaaaaaaatctttccactctttagtttttgattctgatgactcgtttttcttctactctgtggccccaatttttataaagtgtttttgagtgtcctatgggccggggcagggtccaagatcttttcccttccccaggcccctcggctccctcccagatcccacccccagccccactggttgccaaacactaaatctgccgacacccatctgccccacctcctgccatggccatgaaccgcgacccccactaaatttctagattggggatagggagaaagggaggcccaggaaggtctcccctgattttttttcatagtaatttttttccccagagtttgaattttttggtcttctcctggttttttggcaaattaggggggcccggggctcaagtgcgggaagggggctggcccgaggatcccatggctctcacaccatgtttttgtacagaactgatggttgaatctttgttctcttgaaataaacagaagaaaatgaaacctttcttttgctgctccttgccactctgtccctggtgtgtatggggtcccgcccccgcccctctttctgcttctgcttttgccttattgactatctgtaggcgacgaggcctaggaggagcaggaagaggagaaactgggtctcccaa

SEQ ID NO: 2953 - DNA, 1232 bp, Homo sapiens
gttccacccccactgcttgctggggatctctcttctaggttctgggtctccaggggatcagctcccttccccagactggcgggggtgcatacagtttcatgtgaatggctttaggcccccaattcagccacccccagccccaatctgggcagcccgagggttcatggaccgggaacagggaaccatggcaggcggggaggtggctgtgagttggtgacgtggaccgtggcggccaggaagggaacgggagggaggtgaccggatccggggcctgaggtcagggaaggtcctccctaggcctcacctcaggtccagactgcgggaggaccctgaggggccaggggtagccatgaggcctagtctgggacggagcctcgggctggagtagcttcgggggcctgggctgccccctggctgtggtccgtgggaaagggccctgctcaggcggggcgggctggggaggcctccggggacagctgcactccagagctgcctccaggctggtcccgggcgccctgccttagtttattgcccatgcagcccacccccagcttcctctctccttctgtctgtctgtctgtctgtctgtctctctctctctctctgtctctctctctctctctttctctgtctctggaccacaggaatttcagggaagagccaggtcctgtttgctgtggtgttcactgcccgatatctggacctcttcaccaactacatctcactctacaacacgtgtatgaaggtagaggctccaccccacctctctggcccccactgaggcagaggagccgggtgtgggtcccagactcctaggtctgagggaggaggggctgggggcctggactcctgggtctgagggaggaggggccgggggcctggactcttgggtctgagggaagaagggactgaggcctggactcctgggtctgagggaggaggggttgggggtctggactcctgggtctgagggaggaggggccgggggcctggacttttgggtctgagggaggaagggactggggcctggactcctgggtctgagggaggaggggctgggcctggactcttgggtctgagggaggaggggctgggcctggactcctggatctgagggaggagggaatggggccctggactcctgggtctgagggaggaggggctgggggcctggactccagggtctgagggaggaggggttgggggcctggactcctgggtctgagggagga

SEQ ID NO: 2954 - DNA, 2025 bp, Homo sapiens
ttcaaccaggttgtgttgaagaggttgtttatgagtcgcaccaaccggccgcctctgtccctttcccggatggtgagtggctggtccagagagcacggtagacctgggagccgctgggtcttgtctgtctggaagggaggcaggacttggagctctgggagcaaccagggcatcaagggtttgtctcagccagtcgcgagcgtagagcttggactgttggttggaactgagtgtccatgggcagtgggcaagtctcctggtcctcctctccttctctttgtgaggtggaggtgtcctggtggcttcaggagattgccccaagtcataactgagttttatgtcaaaggctctgctgagggaggccctattgaacagtctgcatttttttttttatctggagctttccccagctggacctgaggagaggcctgtggggtttaaggggtgtggtgtgagtggggggtcccgttagagggcacagctgccctggcctggggatgcctcaagcggggctgaatgtaaacaccagaacaacttacgacgtacatcctccccaccctaagatccggaagatgaagcttcctggccgggaaaacaagacggccgtggttgtggggaccataactgatgatgtgcgggttcaggaggtacccaaactgaaggtgagctggcgggggctgggcagacccatcagacccttgctgtactgtgctgtgctgtgctgtgctgtgctgtgctgtgctggtccatcctcagtcttgccaccgctggtgaggcaagcatcctgcctgtctgagtggctttgaggattggtgtgggtcgtctctggcatggttgatggtggggtcccctgggcaagcttcttctggggcaagttgtaaactgttagtgctggcccctagagccagacagcctgggctcaagtctagactcctttgtcacctctgcacaggtctttttttggcccagcttccttgctgtagtttctagcataacaccagggatgtggtggtgaaagttccggaagtgttgagaactgctgctgtcagcccagggtgctccgggtagtaaacgatagtgttggttaccagggctctgctgcgccaaggcagtggagggtgagtcctggcagcccctgggtgaccacgcaggggtctgacccgccagccttgtcctctccaccaggtatgtgcactgcgcgtgaccagccgggcccgcagccgcatcctcagggcagggggcaagatcctcactttcgaccagctggccctggactcccctaagggctgtggcactgtcctgctctccggtgagtgatacgtggtcgacgggtttggactgagctgtgtggctactggcagccttcaccctcctggatctgggaggccagaagctgggcgccagatccctgtctcacccggttctccttccccttccctaggtcctcgcaagggccgagaggtgtaccggcatttcggcaaggccccaggaaccccgcacagccacaccaagtgagtatcaggcccccagccctgccctctccccagactcagcctgcagggccaggcctggccacacttgggctgcttctcctatccctcgtaccagccagccccaggccttctggaactctcagctgcctcatcctgcctgcttttcccttcaacactgcttggagctgtgttttccagggcctgagcaggcatctcctggggagcatgcagttcaccggcctttgccagcccaggctgggaccctccaggtggtggggcaggtgcttccatagcccctcctggctccttggcttcccactctgccaagcttttccagcagcattgactctcctggggctgaatgtgacaggcttgtggtgttcctgtgccactccacaatggcctcctttaagagggcccccctctcactccctcctctccccacagaccctacgtccgctccaagggccggaagttcgagcgtgccagaggccgacgggccagccgaggctacaaaaactaaccctggatc

SEQ ID NO: 2955 - DNA, 1143 bp, Homo sapiens
ttttccaagagccttagaggcctggccataattcctgtcttcagaactacatctcccggaagcctctgcgccgccttagccttgattccccgttcccatcattgttggggccctctgggaagtggactacatttcccgtgagccgctggggcacagctccgtaggcactcggcctggaacaccccagggcctactgggagttgtagtgcagcttccacctcacgcactgcctccgttgttccgcagtacggaatcagagcccacgagtggatgttcccggtgtgaagctgcaggctgtgctccagatccaccgacccgtagcatctcgtcacgccagcactcgcctccctaccaatgactcacctgaagtgcaatacgaaataaaaggccagcgggcggcgtctgggtctctggcgcccccatgtggttgcgacactcccaaagccgtaagggccgacccaggcatcttggcccccagcccctcgtcgcgggttcaggtccgcccattactccttgtcgtgcggtcaaggatacaccttggccccgattccggatctctccgttctcaggccagacccctggtgctgccgttgatttttttttctctgtctttgctgcaattttgaaataaaatgccaaagaacacacattgtcgggcttcttcagtgacgtgactctggggctttaacccaggaatcctgcttcctcagcccattttattctgaaggactcagtcatccgagcccccagtgttctgatggtttctccaacctgggggagcatttcatgtctccggcactgaacttactatctgccccccaccaaccagctcctcccctactttcccgtctcccagtctctaggccggacccctaggtgctgcatccttttctctcaaagcccacgaggccccgatccctgttcctcctgcccccgactctgctgtccgttcccccgcctctttgtcccctaggccctggcctcagctcagctgctgtcttctactggcacccttgttccagcctgcagtctgctacctggcccaaagggtcttttctacacccagacgtggcccagtgccctcagccaggactgtagtcacgggaccctagtgggtgtggagtgaggcacgatactctcacc

SEQ ID NO: 2956 - DNA, 1179 bp, Homo sapiens
gtgtgaaatagagattcaacgtagtttttctctagatggatatttggttatctattccattattcagtctgtccactcatatagcagtgtcactctgttttaagtattgtagatttataatgttttactacctgatatggctactccctgcccctgccccatcttgcccctcatttttgtggtggtggtttttatccccccaaaatattgtagctagttttgcttgtcttccattcatttatctattcattcatcaaaaacccactatgggaaaaaaaaaaaaagtctggctgggtgcagtggctcacccctgtaatcctagcactttgggaggctgaggcgggtggatcaactaaaaatacaaaaattagctgggcgtggtggtgggcgcctgtaatcccagctacccaggaggccgaggcacaagaatcacttggacctgggaggcggaggttgcaatcagcagagatcacgccactgcactccagcctgggtgacagagtgagaccctgtctcaaaacaaaacaaaacaaaacaaaacaaaaaaacactctgtgccaagcgctgcctaccctggtgcatgggactgcaggagaggctgtctggtaaacgtgtcaagggtaatccctgccttccaggctcttccactctgcagtggagcagatgctgaacaagcaaacttggaaccatggggcagtgatcagggacagagtctccagaaaaaaaaaactaggtcccaggctggagtgcagtggcatgatcgtggctcactgcagtctcaaactcccaggctcaagtgatcctcccaccaccttccaaatacctgggactccagtcacgtgctaccacgtctggctaattttcgtattttttggtagagatggggtcttgctataatgcctgggctggtcacgaactcctacactcaagtgatcctcctgcctcggcctcccaaagtgctgggattacagtgagccactgagcccggtcgtgtcctttgctttctagagtctccgtgtgtctctacctgtttgtctccctgtctatatctgtctctctttttctccatctctctgacccagctgctaaatctccccggtgctctcctcttggcctccatctttcagttgtctgtgtctttgtgtatctgtctctgtctgtcttggtgtctctcatgac

SEQ ID NO: 2957 - DNA, 1301 bp, Homo sapiens
ggaggggctgggggctggacccctgggtgtgagggaggaggggctgggggctggacccctgggtgtgagggaggaggggctgggcctctggggtcctgggggaggaggggttcggatgtcctgtgccaccattccctccctccatttccagacgatgtacctgtcccagctccagccggtgaccagaaggaggtggacacttcagaaaagaaacttctcgagcggctccctgaggttgaggtgccccagcatctgtgatcctccgggaccccagccctcaggattcctgatgctccaaggcgactgatgggcgctggatgaagtggcacagtcagcttccctgggggctggtgtcatgttgggctcctggggcgggggcacggcctggcatttcacgcattgctgccaccccaggtccacctgtctccactttcacagcctccaagtctgtggctcttcccttctgtcctccgaggggcttgccttctctcgtgtccagtgaggtgctcagtgatcggcttaacttagagaagcccgccccctccccttctccgtctgtcccaagagggtctgctctgagcctgcgttcctaggtggctcggcctcagctgcctgggttgtggccgccctagcatcctgtatgcccacagctactggaatccccgctgctgctccgggccaagcttctggttgattaatgagggcatggggtggtccctcaagaccttcccctaccttttgtggaaccagtgatgcctcaaagacagtgtcccctccacagctgggtgccaggggcaggggatcctcagtatagccggtgaaccctgataccaggagcctgggcctccctgaacccctggcttccagccatctcatcgccagcctcctcctggacctcttggcccccagccccttccccacacagccccagaagggtcccagagctgaccccactccaggacctaggcccagcccctcagcctcatctggagcccctgaagaccagtcccacccacctttctggcctcatctgacactgctccgcatcctgctgtgtgtcctgttccatgttccggttccatccaaatacactttctggaacaaatgcatggctccatgcctgtgtatctggactggtccctccaaaacgctattgccacgtcacctgccggagtcctcatctttgaagactggattcaagcatcacttctgagaggctcaatcctggtatttttccatctgcccctgatgagtctgcagccttcactcagggtcccttcagccacaaggacagaaaaccc

SEQ ID NO: 2958 - DNA, 1138 bp, Homo sapiens
cttctatttcgaccgcgatgatgtggctctggaaggcgtgagccacttcttccgcgaattggccgaggagaagcgcgagggctacgagcgtctcctgaagatgcaaaaccagcgtggcggccgcgctctcttccaggacatcaaggtaactagtgtgtgggtaatggactacatctcccagcaggccgtgcgcgcgaggagccttgatttgagggcgtaggtgtcgcgtgggcttctgggagattgagttcggtcttgtgagccctcttaaccgctggaaatagaggcgcacctcgtgcagtgcccacaacacgcggcagtccacaccgctgcgtggtcttagggacgtatagctgtaagagctaggacagggtgcggagagtgataaatacaagctgtcacatgtctttgtggcctgggcctctgacccccaacgactcttgggaaatgtaggtttagttctatgtgccgagtgtgtgtattctgagccatttctcccttctatatagaagccagctgaagatgagtggggtaaaaccccagacgccatgaaagctgccatggccctggagaaaaagctgaaccaggcccttttggatcttcatgccctgggttctgcccgcacggacccccatgtacgtacccgctgcatccatggctacccaaccatacccctcaagcctctgctccctttgggcaaatttccttcagagcctcatttcacacctgtcacattttaatctgcaactggctgctctctccccctcttttccagggattgggtttctaatttctccctcttctctctcagctctgtgacttcctggagactcacttcctagatgaggaagtgaagcttatcaagaagatgggtgaccacctgaccaacctccacaggctgggtggcccggaggctgggctgggcgagtatctcttcgaaaggctcactctcaagcacgactaagagccttctgagcccagcgacttctgaagggccccttgcaaagtaatagggcttctgcctaagcctctccctccagccaataggcagctttcttaactatcctaacaagccttggaccaaatggaaataaagctttttgatgcagctggtggttttgtgtgtggtgtggaagat

SEQ ID NO: 2959 - DNA, 1178 bp, Homo sapiens
tcctcctttcccctagtactatatgtctgcgcgccacatggcgctgtccaaggcctttccagagcacttcacctacgagcccaacgaggcggatgcggtgagtggaccctggatttctgcttagccaggagctaaagggctgggcttcggtggggtgggggtccctcctggagtgggaaggcctagaggtggctggatgcctgggtgggactgtgaggtcctcagctcaccctggtttgcacccacatcgccgtatgcaggcccaggggtaccgctacccacggccagcctcggtgccaccgtcgccctcgctgtcacgacactccagcccgcaccagagtgaggacgaggaggatccccggaacgggccgctggaggaagacggcgagcgctacgatgaggacgaggaggccgccaaggaccggcgcaacatccgtgcaccagagtggccgcgccgagcgtcctgcacctcctccaccagcggcagcaagcgcaactctgtggacacggccacctccagctcactcagcaccccgagcgagcccctcagccccaccagctccctgggcgaggagcgtaactaagtccgccccaccacactccccgcctgtcctgcctctctgctccagagagaggatgcagaggggtgctgctcctaaacccccgctccagatctgcactgggtgtggccccgcagtgcccccacccagtccgccaaacactccaccccctccagctccagtttccaagttcctgcactccagaatccacaaagccgtgcctttctctggctccagaatatgcataatcagcgccctggagtcccctgggcctggaccgcttcccagaggccaggaatctgccattactctgcggtggtgccagaggttttaggaaacctggcatggtgctttcaggtctggggcttttagagccccccgtgtggcttacaaattctacagcatacagagcaggccacgctcaggcccggcatgcgggccaccaagttctggaaaccacgtggtgtccctgcgaatggggcgatcaagtccagagccggggcactttcagagtttgaaggtaactgagagcagatggtcctccatttcaactccagaagtggggctctgggagggatgttctagccctccctggcatgtcagagccaggctctgcct

SEQ ID NO: 2960 - DNA, 1198 bp, Homo sapiens
tgctgtacccccaaagcccagacagtgcctagcacacacgagatgctcgatgaatagttattgattgaatagattagacatcaacgcaatcaggctgttcacctagggactctttgctaggcggcggagaggtacgttacagttctctacgcaaaacgcatgcgcgaaagatccgggaagtgtgatcggaaaggggcggagcatcagggagagtctcgcggacataggcggttcggcgcggaaagcgggaggtggaggggcggcttggggcaagcgcgcgcgcgcagtgcagaagccagccccccgcggctgaggtactcaaggtgcccaaaggcggggtagtgacctcgcgcgtgcgctgtgcccgcggcagcgccgggtcctagtgtgtgggttgttgttggcaccgcacggcgcgtgcgcagtgaggacggcggagggatttgcggccgggacccaccccctgctccagtcgctatcggaggccgcgcgggtggctgagcagcggcctggtgcgctcgcttagcgggcgacggaatcagacggacgtggacgcccccggagtggaagccgaagcaggagttgttgttgctgaggggctgccgcagccgccgcgagcctccggacagacgccagagcgaggagggcgctacgcggtgagtgagtgtgactgagtggcccgacggggtgcggggccgctacccagaagccccagcggtgggcccggtcctcttccccgcggccaggcccctttcccgcgtccccgccacaggtcccttctgcatccctttcccggaccccgaaatctctgggcacccacgcccgcttcccacagcgccctcgtggttccctacccacaggcccttgcggtgtgtggccttttttctttttcgtttgtctatgttgtcctggacccttacccataattcctttcgctttttgcggggtccaggtctgttacccacaagcacttggttttggggcttcgctccttatgtttctctttctttgcttggaaacttccgatccccaggaccctgcaaactgcatctcgtaatttgccctccacggcacgggacgagcagccacagctgctctgggcctccctcctcgggtccttgatttccccagaaattcccagggaacctctccgccccacagctcgtgtcagaggactctgagacttcactcttcagga

SEQ ID NO: 2961 - DNA, 1148 bp, Homo sapiens
ttgatgagacctttaagagctgccttggccctcagagggtgtgcagttgtgggctttggagccctgttctgtcagcttatgttgctttaggcctggtcatcctcactggcactcataagcagggccctgccatcactccactcccatcacatcctctggcactttgttcaatgtgagtgatacttggagctgtgagaagcaatgtctttcctaaatatggaagacagggtgtttcctaaatactataaagctagatgtcacctgtaccagtgcttttcaaactgtctttggtgaaggacagatactgtttccaatctgtttgcttttgataaatatgatagaattactttttaaagaaagatctacagtcaggagttcaagaccagccaggccaacatggtgaaaccctgtctctactaaaaatgcaaaaactagccaacatgctgtcgtgtgcctgtaatcccaggtactcactcaggaggcttaggcaggagaaccgcttgaacgattctagtcagttgctgggttccttttagagagacgggcacaggggggaaagcagggcttagaatcgcttgaacctgggaagcggaggttgcagtgagcccagatcgcgccattgcacaccagcctgggcaacagaccacaacttcgtctcagaaaaaaaaaagacctacagaataaaagaccaaatttgtattaagagtcagtggacatcaaattgtgaaattactgtagaagttcctgaacacttagtcctggtttctgtacttatcacagtccagcaacagtttagatagtactggtccatggaccatgcttagtttttgagacaggattttttttttttttttttttttttgagacggaatcttgctctgttgtgcaggctggagtgcagtggtgcgatctcggctcactgcaacctccgcctcctgggttcatgccattctcctgcctcagcctcccgagtagctgggactacaggcgcccaccaccacgcccggctaattttttgtatttttagtagaggtggggtttcaccatgttagtcaggatggtctcggatctcctgacctcatgatccgcctgcctcggcctcccaaagtgctgggattacaggcgtgtgcactgcacccggcctttac

SEQ ID NO: 2962 - DNA, 1169 bp, Homo sapiens
tgctgcaggggccccgccaggccccctgggagtgtataacccgcctctctgctccctgccatttcctgaagatttctcccacccccttctggttcattttctgttctgatgtctgttccccccacactcacccccctccaaaaaaaacaaaaacagaaaaaaccggtgtggtctggggtgcggagcgtcccagctgggcctcctgccccggcttggtgtctcagggtgcatgcttggggttgtggaggagccccctcccccacagcagagtccagcgtggagttaaccttcagtttctttgcagcgattttggccgccctggcgggagggggctgttccatcatgtgggagaggaagggccggggagcctagggggtggcgggtgagggtggacgtctcccccgaccaggagtggttggggcgctgagaggaagcagacgctgagatggagcaggcccttcaccggtttgggagagggttggtctggctgtcagttgcctggctgtctgttgggcgtgtgcgtgtgcgtgatgatggggacacggggcggggattctgtagagctgggcctgtcctgactagaggaccctctggggactcctctcccctccccctccccacatctgttacagccgcttacaaacacgcagatggcaagaagattgatggcaggagggtccttgtggacgtggagaggggccgaaccgtgaagggctggaggccccggcggctaggtgagcacatcctgccttcgacgggctctcgggggccctgggcctggtggccttgttctcccttctctgctgctttctgcttctctgtctcctgccggcccacctctcccatcgcgtcctcatctccggcttctctctcttgtggccatcacatttctgacagctgcctgcctcctcgttctgggttactgtgaggagcaggggcaccagcctggagaggcctgagcccacatgctggcgtccgcccttgctagctgggggtccccttttcctgcctcattgtactcctcttagtggaaataaccccgagttcactgagctcagtgtactgggcgcccagcttggcagtgacgcatgctggggttgtaaatgtcactcgctcatctgcttctgctgcttgctgttgctcttgttcactcttttactgattcagca

SEQ ID NO: 2963 - DNA, 1191 bp, Homo sapiens
acagattcacatgtattttttgaccttctgccgtgttttgtacattcataaaagctgcgtgtgcgtatgtgcatgtgtgtgtgtgtgtatgtgtgctgatgggggccatccacagagcagggggtctccatccctgacagcttctatcctggccccttcacccttacaggcatgaactcctggaggaggcctgccgccagggcctaccttttgctgcctgggacgggcccaccgtggtgtcctggctggaggtactggggcccagaaatgccctgactgttggtccccaacccctctgacagccccactggtaggggctgcctggtcctcctggcgcaccctgcttctagcccagaggtgggggtggccatgggcctggcaggtgaggacccaggagggctcgggcttcctgttcacctaaacagtttctttctccttctccttctgcccctgccactctggccttgcccacctgggtcatggtctcctgtcgttctctctactctctctttctggattctctgtctctatttttcggcaccattcccatctctgaccacgcttttgtcattccccatatttctcctcatgtctccgatcgccctgccgatgtctccctgtctccggcttcctgtctctccccaccctctatttctctctctctatttctttctctctctctctctttctctctccctctccctcttcccccacccgccccccgccccccgtttctctccctatttgtctccctcggactctccctcatctcgtccacgtctcttttccctgtcctgtttcttctccttgcgaactttcccacgtctctgtttcgctccccacccccttgcctttccccacctccctgttcccccatctctccgattttctcctcctctgtccctctgtcccctctgtccctctgtccctccgctgcagctgtgggtgggcatgcctgcctggtatgtggccgcctgccgggccaatgtcaagagcggtgccatcatggccaacctgtcagacacggagatccagcgcgagatcggcatcagcaacccgctgcaccgactcaagctacgcctcgccatccaggagatggtctcgctcacctcgccctcagcccccgcctcctcccgcactgtgagtgtccggcggccaattccagccttcgcttcctcagagccccgcctc

SEQ ID NO: 2964 - DNA, 1172 bp, Homo sapiens
gggtctctgtcccatctctctgggtctctgtcccatgtctctgggtctctgtccctctctctctgggtctctgtcccatgtctctgggtctctgtccctctctctctgggtctctgtccccatctctctgggtctctgtccctctctctctgggtctctgtccctctctctctgggtctctgtccccatctctctgggtctctgtccctctctctctgggtctctgtccccgtctctctgggtctctgtccccgtctctctgggtctctgtccccgtctctctgggtctctgtccccctccctgtgtgccccgctcccatgtgtccacagttcctccggctctctgaccgaacggatccagctgcagtttatagtctggtcacacgcacatggggcttccgtgccccgaacctggtggtgtcagtgctggggggatcggggggccccgtcctccagacctggctgcaggacctgctgcgtcgtgggctggtgcgggctgcccagagcacaggtgaccgagggtgggtgggggctgtctcctgggcctcggcctgcctgccatctcccccacgactgtgggtggcctcccccgccgcccagtgtgtgtgtgtgtctctgtcttattctttgtttctctccccctgcctctgcatgttcctcggcgtctgtgtaggagcctggattgtcactgggggtctgcacacgggcatcggccggcatgttggtgtggctgtacgggaccatcagatggccagcactgggggcaccaaggtggtggccatgggtgtggccccctggggtgtggtccggaatagagacaccctcatcaaccccaaggtgtgacccagggacttggaaaagggggctggaggcctggactcctgggtctgagggaggaggaggggctcgtgtttgtccttctggccccgatgaggagacgccctggtctggccatttttcccctagggctcgttccctgcgaggtaccggtggcgcggtgacccggaggacggggtccagtttcccctggactacaactactcggccttcttcctggtggacgacggcacacacggctgcctggggggcgagaaccgcttccgcttgcgcctggagtcctacatctcacagcagaagacgggcgtgggaggtgagtggtcgaacccatgacc

SEQ ID NO: 2965 - DNA, 1299 bp, Homo sapiens
agcccctcccctgatgggggttgtgggaagctgggggaggggacgcctgggccctttgttctggctcttctgatggcagggcgcccctgtcccccagcttgtggttctgtgggtctctcctggtctcggcctcagctgctgccctgagtctctgtccctgccctttctaggtctccgtctccctttctctgggtctctgttgccctctctctgagcctctgtccccctctctctgagtctgtgtccccctctctctgggtctctggtcccctctctctctgggtctctgtccctctctctctgggtctctgtccccctctctctgggtctctgtcaccctctctctctgggtctctgtctccctctctgggcctctggacccctctctctggtccctgtcccccccccccggtctctgtccccctctttctggtctctgtctccccctctccctgggtctctgtctccctctctttttgggtctctgtccctctctctgggtctctgtccccctctctggtctctgtccccccctccctctggtctctgtccccccctccctctggtctctgtccccctctctctctgggtctctgtcccctccgtcactggtctctgtcccccccttcactgggtctctgtccccttctctctctggtctctgtccccctctgtctctgggtctctatccccacctcactggtctctgtccccctctctctctggtctctgtccccttctctctctgggtctctgtcccccccccttgctggtctctgtccccatcccctctctgggtctctgtccccctccctctctgggtctctgtccccctctctctagacctcccctcagtcttgcttggcccctcttcttttctggcagctgctgctcacatcttaccacctgttcttggggtgggacaggggaagtttcacccacaccttccttccccaccactaacttttgcctcctgtcttctttaaaacccgtaattcatacccgaacctttagccttcatggccctcggcattactctagggtaatcattgtgacttcatcacaattgagttcctctggaaactctgagaacactcccatcctcagctttccaagaaatccagctccttctcctccctcagactcaggagtccagaccccagccccttctccctcacacccaggagtccaggcctccagcccccgctccctcagacccaggagtccaggccccagatcctcctccctcagtcctaggagtccgggccccagcccctcctccctcagactcaggagttc

SEQ ID NO: 2966 - DNA, 1177 bp, Homo sapiens
gaccctttttttttattactattttttttttagacacagtctccctttgccacccaggctggagtgcagtggcgcgatctcggctcactgaaacgtacaccttctgggttcaagtgattctcccgcctcagcctcttgagtagctgagattacaggcgcgcaccaccacagctcggctaatgcttgtatttttagtagagacggggtttcaccaaattggtcaggctggtctcgaactcccgaccttaggtgatccgcccgcctcggcctcccgaagtgctgggattacagccaagagccatcgtgcccggccacgccgatcctcataaatccggagccctcctaactattcgcaaagtacccacatcgccgtctccccttcctccccgttttaagcagtgcgcatgctcctaaatacgcttccccgtgggggacgtaggcggggccatcgggtcctaaggaaaaagtgtgggcgtggctgctctctgtatcttgtagccccaccccattcccattagccccgcccctttgggctggaaccggaggtgtcgctcttcggacctcaaggttccccttaacacagagcgccccgcagtcttcgcggaaagcgttcggggtaggcgatggctgcgacgcgtgcagggccccgcgcccgcgagatcttcacctcgctggagtacggaccggtgccggagagccacgcatgcgcactggtgagagtctgcccggccggcgctgctcgctgcgttccccaggcctgggcgcccggtttttcgcggggagtcccgtcatccactgcggtagctcagccgctccgcctctcttagtccccgtgattcccgccgcccaataggatcgcgccctgtaggacgctcccttgagccttggcggtggcagccttttagtctgttccggtcttccccactggttctcttgccccttgatcctgaactcctcgtagtgtttccgcggttttcctgaactcctctagacgctctcgtgattcctcagggtcccctcagaacctgacgccacccaccagaccccttaggattcctgtgaggctccagtgacccacaacccccattgtctttccacgactcttcaaaacatcctatggcttccatgggcctccagagcaccccagacctcctgagggactcccttcatccctttg

SEQ ID NO: 2967 - DNA, 1097 bp, Homo sapiens
agcctgtgcaacagcgagaccctgtctcaaaaccaaatcctacagtttattagttacaaggtcttgtaactgggtagtcagtgggcagagccttgctggtcttcgttcaaatccaattgctttgcaaaatacaatctgagcataaaatactcatagaagaactcagatatgaggggagtttgggcctcttaaactgctcactcactgatcctgaggcagccttgctttctcagtccctgttcctcatctgtagaacggggctccgtgcatagttcccagctctgatggctgggtgcaaggcacgctgttggcacggtaggacaaaagaagggaatgcttgcttgtgaggacaatcaaaggctgtccttgtctctgagtccttttgcccttgtctcccacaggtcctggtgcttgatggtcgaggccatctcctgggccgcctggcggccatcgtggctaaacaggtactgctgggtaagtcgctgctcgtggcccctctgtcatgggcccccgctggaggtcagtgatgagcaacattcaccatctttcgtttgagtctcacggccatgagatcaaccccatgcaccgctctgagacctgccagccactcttccccagggttggggactccaggctcaagaagtaattatgtattaggctagtttttcatttaaacaggaacttagctctggcaagtactgcgctgtgtctggagggtgactgcataggcagtggtgggaccctcaggcggctcggccctgctaagcctttccctccctctaggccggaaggtggtggtcgtacgctgtgaaggcatcaacatttctggcaatttctacagaaacaagtgtaagttaggacctgggaggagcactggagagggtctccctgtggggtgttgaggctctgaaagcaattgcagccgtgttgggagaggctacttggggtttctgagaaggcccttggaagtggggttttgggggtgctggtagactgggcaggcctcacactctcccctctccctagtgaagtacctggctttcctccgcaagcggatgaacaccaacccttcccgaggcccctaccacttccgggcc

SEQ ID NO: 2968 - DNA, 1097 bp, Homo sapiens; identical to SEQ ID NO: 2967

SEQ ID NO: 2969 - DNA, 1097 bp, Homo sapiens; identical to SEQ ID NO: 2967

SEQ ID NO: 2970 - DNA, 1087 bp, Homo sapiens
aacaggcctgcagagaacagttgcattatgatatgcccagctgtcagtcacctcccagctctcaacagctccggctcttcagggtgtgggggcttagatatccttacaacttcatttgttcaccccccccccccccccccgcagtttgcctatctggggcgcctggctcacgaggttggctggaagtaccaggcagtgacagccaccctggaggagaagaggaaagagaaagccaagatccactaccggaagaagaaacagctcatggtgaggccaggggctggtgctgaggggggcatctcactcctggacaggcctggcaggtgccttgctcacagagtactcttaactggcaaaggaccagccggggttggggtgggatgcagtccatgtaatgagggcaatgcaacccctcctgaccaccaccacctgcacttattcttggcagaggctacggaaacaggccgagaagaacgtggagaagaaaattgacaaatacacagaggtcctcaagacccacggactcctggtctgagcccaataaagactgttaattcctcatgcgttgcctgcccttcctccattgttgccctggaatgtacgggacccaggggcagcagcagtccaggtgccacaggcagccctgggacataggaagctgggagcaaggaaagggtcttagtcactgcctcccgaagttgcttgaaagcactcggagaattgtgcaggtgtcatttatctatgaccaataggaagagcaaccagttactatgagtgaaagggagccagaagactgattggagggccctatcttgtgagtggggcatctgttggactttccacctggtcatatactctgcagctgttagaatgtgcaagcacttggggacagcatgagcttgctgttgtacacagggtatttctagaagcagaaatagactgggaagatgcacaaccaaggggttacaggcatcgcccatgctcctcacctgtattttgtaatcagaaataaattgcttttaaagaaatctggcgtctttgcactgtgtctgctgtggaggcaggcccctggcaaatggggggtgag

SEQ ID NO: 2971 - DNA, 1087 bp, Homo sapiens; identical to SEQ ID NO: 2970

SEQ ID NO: 2972 - DNA, 1247 bp, Homo sapiens
gggaacctggcgttcctgcacgtgtgcccacgacgagttgccctgcctgcatctaagtggcttctggggctgctgggaattgtagttgcttccctgaggccacgcccctggctcttttaaggaaccgcccgcccaaggctcactcctttatctttcctatcctttcaggctattgagggcacctacattgacaagaaatgccccttcactggtaatgtgtccattcgagggcggatcctctctggtaagtgcgggagttactggtgtctggggcctgaaatactgaaagaagggtcttggggcccagactcctgggtcctgggtgagaggggtggttaggaatgcaaacttgtaggtccaggtacattggcagatgatgtttgttttcacgatggtcttcagatgcccacgtgggcactgctgagaaagccacttggtaaaactgatgccggaaatggggctttttgggatccctgctcagctgcttctgagtcccagcatgccctgggttacctatggccctctttcccatgggacctgacctatgatcggcccccgctcctaggcgtggtgaccaagatgaagatgcagaggaccattgtcatccgccgagactatctgcactacatccgcaagtacaaccgcttcgagaagcgccacaagaacatgtctgtacacctgtccccctgcttcaggtgagcgcagtggcccatcaggttgctcaggccacgctctctcagccttcagattccagatcggaccaatttaaggccaactgagggagggaaagactgaggtggcatctctgggaagccccagaatctcaggatttgtatatcatatgttcttcagaatcaaagcgttctacagggtgaatatctctacctgaaatgcttggaaccagattttggaatgttctcgcatacatagtgagatgttttggggatgtgacataggtctaaacaagaagctcatttgtttcatatacaccttattcacatagcctgaaagtagtcttacgcagtgcgttttataattctgtgtgaaacaaagtttgcgtacattgaaccattggaaagcaaaggtgtcacgctggtattgaagaagtttcagattctagccaggcaccgtggctcaagccagtaatcccagcactgtaggaggctgaggcaggaggatcccttgagcccaggagtttgagaccagcctgggcaacatggcaaaaccctctctctacaaaaaataca

SEQ ID NO: 2973 - DNA, 1247 bp, Homo sapiens; identical to SEQ ID NO: 2972

SEQ ID NO: 2974 - DNA, 1152 bp, Homo sapiens
agtggtgagccaggaacaaagtcctgctccctcagagggcaccttcaagcagtgtgggtgccagatgacagccaagtataaccagaatggggatgtgggcagctgatattggtggccctctgggcggggaggatcttgggagcaaggtgaggagtcctgtgggtggagaggagggtggcccaaactgatgctgagcgataagggacctgtggttgtcagtgctgcaggatccccctgctgctctgctggggaagggtggtgaggctgctgacaacttgggggcctccagtttgcttgtgaaatggagctcgtccaccccagcggtcctcggaggggtggtggcctgctctgtgtacagcgttgagcttggtgcttggcacaaaacttgtacgaaaggaggggacaggttgaattggcgagtagagcttggttggggtttggtggagccgaagcagagagcctttagcctggtgaaggggagggagggcctcctggggtctgctggggtggcccctcctgaggacatggccctacctgcctccacagggacgtccagatcggtgacatcgtcacagtgggcgagtgccggcctctgagcaagacagtgcgcttcaacgtgctcaaggtcaccaaggctgccggcaccaagaagcagttccagaagttctgaggctggacatcggcccgctccccacaatgaaataaagttattttctcattcccaggccagacttgggatcttccgcgcctttaccagagcattggtgggggtgggggtgtgcctcggggaattgggcagagctgctgtcagagaggctgcctgcccatgtctgtgggtgaggacagtggagcctgaactgagatgcctgccttcccctgggtctccttctttggtccttgtcaccttttcggtgtctgaataaggctgattacctggcgttgcgctgtccccccgccccctccggtctctggggaggaagtgagtgacggcggaggcccctgggtcctccaggccctggtctgtctctttcctgaccacctcgggtggggaggggaagaagctgcagcccccccctgctgtgggcatgggctcacccaggtagagtgggatgtgctgaggccctgttgtctggctgtgaagtgtaaaggtct

SEQ ID NO: 2975 - DNA, 1168 bp, Homo sapiens
gacagaaacccagagatgggagaacagaggtgcagagagagggggacggagacagagacccagagacgggggaacagagacccagaggggacagagagaggtgcggacagagggagggggagacagacccagaggagggaggcaaagatgtagaaagaggggggacggaaaattgggagaaggggagacaaaggcccagaaggaaggggatagagactgaggaagagtgtgtgagacacacacacaaatgggggacgccagtcagacccagagcgcctcagagattctgatgacctctccctctctctctctcctcagccccttggatctcccttcgtggagacgacaccggggtcctcctgcccaccccaggggaggcccaggatgctgatttgaaggatgtaaatgtgattccagccaccgcctgaccatccgccattccgactgctaaaagcgaatgtagtcaggcccctttcatgctgtgagacctcctggaacactggcatctctgagcctccagaaggggttctgggcctagttgtcctccctctggagccccgtcctgtggtctgcctcagtttcccctcctaatacatatggctgttttccacctcgataatataacacgagtttgggcccgaatcagtgtgttctcatcatttttcaggcaggggaggtaagggaataagtcgggggactgaatggcggctgggcctcggatctctcctacaggtaacatgctgccacaggggaacctgccagttttatacatcaggtcatgtattttctttttctttttcttttttctttttttttagacggagtcttgctctgttgctcagtccggagtcctgtggcgcgatctcggctcactgtaagctccgcctccctgggttcacgccattctcctgcctcaggctcccgagtagctgggactacaggcgcctgccaccatgcctggctaattttttgtatttttagtacagacggggtttcaccatgttagccaggatggtctcgatctcctgacctcatgatccacccgcctctgcctcccaaaggggtgggattacaagtgtgagccaccgcgcccggcctaaggtcactttttttttttttttttaagacagagttttgctcttgttgctcagactggagtacaattgcg

SEQ ID NO: 2976 - DNA, 1223 bp, Homo sapiens
gcctgggtgggccagcagccgcctatgccactgggaaggcctctggggctggaggggcagggggccaggcttattcccccggtcagcctcaagggcttctgggaccccaggcctacgggcaagggtttggaggggggcaggcacaggacttgagcaaagcccccagctactcagggggccccccacagccccccagcggcccccctcctcctggcctggccacatgtcagagctactccccggaccagctgcaggggcagctgtatggggtgcagggcgagccatacccagggccagccgcccactcccaggggctgcccacagccagcccctcgctcagctacagtaccggccattccccagcgctctcgggccatgggggtggctggggacccagctccctgggaggcggcggtgaggccagcccatctcacatcattcgtccgctccagtcaccgcctgccaccggccgtccacctggagtcggctctccaggagcccctggcaaatacctgagctcagtcttggcctcagcgcctttcctggcacctccgggagctggcagctatgcagccggagcaggtggctacaagggcaagggggatggctcggagctgctggcgggcccaggtgggcctcctgcggagcgcacagaggatgaggagttccttatccagcacctcttgcaggcgcccagccctcctcggacctcaggggcggacggcttggtgggcgaggacggggcagcagatgcctctaagggacttggggggagtggcggggccgggggaccaccgggtacaccctacgagttggccaaggaagacccccagaggtaccacctgcagagtgtcatccgcaccagtgccagcctggatgagggtgccactgcggcactggagctgggcctggggaggctgaaggagaagaagaaagggccagagcggggtggcgagacccccgaggggctggccacctctgttgtccactacggggcaggcgccaaggagctgggggccttcttgcaaaagagccctccgcccccacctcccacggcccagtctacccagcccactccccatggcctccttctggaggccgggggccctgacctcccactggtgctgcctccgcctcccccccagctgctcccctcggtcctcagccatgcccccagtccctctcccagcgcctccaaagtcggcgtccacctccttgagcca

SEQ ID NO: 2977 - DNA, 1191 bp, Homo sapiens
ctgatagggtagaagggacactgggagctgagtggtagttacagaggggcttttggtatagaaagcagtgtttaaaggacaagaggaaaggtgccaggaatgatgaataacatccaggcctgatgtccctgtctcccccagagcccccgctgctggaggagaaacccccacccactccacctcctgccccgactcctcagcctcagcctccgccaccccctccgccgccacagccagccctgccctcgccacccccgctggtggcccccacgcccagctcaccaccgccaccgccgctgccgccgccacctccaccagccatgccctcgcctccaccaccacccccaccagccgctgccccactggctgctcctcctgaggagcccgccgccccgtctcccgaagaccccgagctgccggacacccggcccctgcatctggccaaaaagcaggagacggcggcagtgtgtggggagacggacgaggaggccggcgagagtggcggagagggcatcttccgggaacgggacgagttcgtcatccgtgctgaggacatcccttccctcaaggtgagtcccagccttctccagaaactgggcctgatgggtttggtcacctgtttgttgagtgcccgctggatgacaggcttgtgctgagacctgcagatccagtcgtggccgggccgccctggaatttgcagtcctatggggctgatagaggtgtcgaggacctgcgggcctcagaggtgttatttgcgtttgtgtctgtacatgcattacctgtatataaggtaaagcgattgttaacgcgtatgtgtctatatgtgcgttacctgtatataaggtgaaccgcttgttaatgtttatgcagataccctgctgtgggtggtagaggaccagtactgtacaagcagatgaggctctggccctagggagcttctagtttaatggaaccagccagagaggcgggctgctttgccatttatggcacaatggtggaaatgtgtcattgacatagactacctgcagatacacacttatgtaacctgtaaatataatcatgaattgggccggacgcggcagcttacacctgtaatctcagcactttgggagtttgagaccagcctaggcaacataatgaaaccttttctctcaaacaaacaaaaaaagtgaatcatttaggaatggttat

SEQ ID NO: 2978 - DNA, 1242 bp, Homo sapiens
cgtctctactcaaaataaaaaattagctgggcgtggtggtgggcacctgtagtcttagcttccctggaggctgaggcaggagaatcagttgaacccaggaggtggagcttgcagtgagccaagatggtaccactgcactccagcctgggcgacagagcaagactgtctccaaaaaagaaaaaaaaaacaggccaggcgcggtggctcacgcctgtaatcccagcagtttgggaggccaagacggatggatcacgaggtcaggagatcgagaccatcctgactaacacagtgaaaccccgtctctactgaaaatacaaaaaaattagctgggcgtggtggcgggcgcctgtagtcccagctactcaggaggctgaggcaggagaaaggcgtgaacccgggaggcggagcttgcagtgaggcgagatcgtgccactgcactccagcctgggcgacagagcgagactctgtctcaaaaaaaaaacaaaaacatatatatatatatatatatagagagagagagagagagagagagagagaaagagagagagagagagatattaatatgactgagaattttgagtgagatagtagttttctcagaatgatgggtgggacgttgggatgaccgagaattctggaatggattcttagactggtgtggagaaatctaagctggaatgttatgctgactctgaaaattcgtgggtagagtgctgggtgggttggaaaattctgggtagcattaggttataaaaactctggaggatatgaatctagtctacaaattctgagatggattgttaggctggcactgaggattgtgggtgagatgttacactagggtagataatcccagtgtaggatattagagtaggtctgagaagtatgtgttattagtcgggagttagaattctgggatagatggctgggcgcggaggctcatgttggtaatcccagcactctaggaggctaagggaggtggatcacgaggtcaggagaccaataacaacccatcctggctaacatggtgaaaccccgtctctactaaaaatacacaaaaaattagccgggtgtggtggtgggtgcctgtagtcccagctactcgcgaggctgaggcagaataatggtgtgaacccgggaggcggagcttgcagtgagccaaggtcgcgccactgcactccagcctgggcgacagagcgagactttgtcttaaaaaaaaaaaaaaaagaattctggggtaga

SEQ ID NO: 2979 - DNA, 3154 bp, Homo sapiens
gctgactgtgcatggctccagggaggccagggacagggccctgagcgggtgatccctgggctggacaccaaggttgagaagttaggccggcagcgtggaggggacagcactgtgggggtggcccggtgtggggaggggacatggggttttgggacggtcacaccacttcatctagacaccacagccaggcacatctgtcaggcttagttctcccatgcgccatcctcaagaggcaccagcactttatctgttgagcctttatgtggcaccaactgtgtgcactattacccggttttacagatgatggaggcccagaagcaggaggtggctggtgttaggtcacacagctaggaggcagcagaacggtggggcgctgcctgtgctcttaacccccaggccaagtcaccccatcaggcagtcaggagggctggcggcagggggtgatgtgggtgggaggtagtgccttcttggcattctcaccgcagcctgggtgccgggtgccactctgacctcagccatggcagggtcgggggatgccgatgggcgctgcacgggctctcagaggcccctcacctatggccatggccttgactgtgggggcctctgtccaccgatgatctcccttcatcccctacaggtggggcggtccagggtggtgggggcacagtggccccgggcagtgaccacagggtcctgacccgcggcccccgcaggcgggctgcatgctgttcccccacatctccccctgtgaggtgcgcgtgctcatgctcctgtactcgtccaagaagaagatcttcatgggcctcatcccctacgaccagagcggcttcgtcagtgccatccggcaggtcatcaccacccgcaagcaggtgtgccagccaagcacagcccctctggggacagagggggattagaccccactgccctggttgggcagccagacttggtgtgggcggagtgtgatgcgatggctggagcaaggagctgcaggggagcccggaggatgccgggcgggttcccaccagggctccatggaaaagcggccactgggcggctctgcagggctggagggtgggtcttggcgcggcggcagggaagccagcggagcggggagctgggcaggggttgggatcgtcctgcggctggaaggccctgcctggtaaccacgtgtcctggtcatgccttgccagttgaggcagactctgcaggtcctgtgcaccaggtgagggccgggacctgtctcaggccactggggagccatggggggctgtgagcagatgaggggcagggcctgttcccctgggactagagaatggacccagctggggctaacaggccaaggctcggagggagggatggcaggccccaggacagacagacaggtttcccaggagcctgggcccctcttcccaccccgttcccttccaacaggcagtgggacctggtggtgtcaactcaggcccagtccagatcgtcaacaacaagtttctggcatggagtggtgtcatggagtggcaggaggtgagcactcggcagcccagggacttgggacccccagatcctcacggactgtggctgggaggggacactggcattgggggtctccagccctgagggctcctctttgcctctcccccaaaagcccaggcctgagcccaacagtcggtccaagaggtggctgccatcccacgtctacgtgaaccagggggagatcctgtgagtgctgggctggggggtggaggcagcatccaggggagctggggcttcctgaccctcgtccctttgtgccccacaggaggaccgagcagtggccaaggaagctgtacatgcagctcatcccgcagcagctgctggtgaggggctggggccgggtgctggagcctgcacgcagtagctcttccagagggcggggctgggggcaagagcgcctccccaggtggcctgagctggctgtgagggagcggagctgagggtgctgaagcaggtgtggtgggtagctcctcaggcttggcttcaaggggtcccaggcagccagctggtggctgtgcagggactgagcggggcaggggcagccacgacctgcacctggggggctgccaagggatctgagagcggcttccacagcactccagggttgggctggttgagcggtggagatgacgtttcctgaggtagggaggacaggggagtctcagtttggtcctgggcccgggggactcagcgggctgggagccgggaggccgtggtgggagaagccagagctgggggtcccctcgcttccccgcagaccaccctagtgccgctgttccggaactcgcgcctggtccagttccacttcaccaaggacctggagacactgaagagcctgtgccggatcatggacaatggcttcgtgagtggtgccagcagacgcaggggaggggccggccagggcagagcgagcccggaccgctcacgggggcggacatgggagaggaacagagcaccatgtcccagaccagctggggagagagggtggctagtgtgggcgtgacttctgggggctctgtgctgtccccacggcactggatggggcactgaccctggttctgcgggggcctgctcctcctctgccacatcagggctgactcagcaccaactccgcgctctccactcctcagggacaggcgcccttgtcactcctggtttcccgggagcttgtgccacatcccaaaggcccattgctgggcagggagggctgtctgcccccagcaaggtcccagaatatttggcgattgtcttatctgggggaggctcagctgactcctcttctctctctcgggctcagtttctccatctgtgaggtggagaaggttggactttggtgtttctgagccctccccccgatgtccaccttccagctgggccatacttgggtaatatcccgaaactaccttaaaattaccttcgactcagtctgagtaaactgtccacgaagctgttcgtgggtggggggggcctgggtgtaggtgcttttacatgaaagcaatttcaagcattccctcaggggccgggtgcggtggctcacgcctgcaatcccagcactttgggaggccgaggcgggtggatcacctgaggtcaggagtttgagaccagcctggccaacatggtgaaa

SEQ ID NO: 2980 - DNA, 1427 bp, Homo sapiens
tcagggcgcagtggctcacccctgtaatctcagcactttgggtggccaaggcgggcagatgacttgaggtcaggagttcgagaccagcctggccaacatggtgaaaccccgtctctactaaaaatacaaaaattagtcaggtgtggtggacgcctgtgatctcaatctcagctactcgggaggctgaggcaggagaatcacttgaacccaggaggtgttgcagtgaaccaagatcacaccactgcactccagcctaggcaacagagactctgtctcaaaaaaaaaaaaaaaaaaaaagaaactcccaggagacagcagcctagttttcgagtgtgagcttgtgcttgtgaaagctaaccatgctaaccaccaaggcaaagcagcacagtgtgaatagaacagagcgggatcaagaatttcacagaagacaggtcagctgaggggcctgcacacacagggtgttgaggaaccacagatgggcgccgagaggcctgccttttgcctggcccaggctcacccccaccttgggcctcacctcctccaggaagccttcccagctacccgaagctcaggtggccttcttgcaggtccccgtagcaccctgagcctgtaccttgggtggcacttgttatgctatcctgtgctagccgtttgtgcctcgtctcgctgttagattgtgagttcccatgggcagagacccactgtcgttccccgtgtgtccccagcccggtccctgtcacatttgttaaatgaaagaacaatgaagcccagtgtaacgtcagtccacagaaatagccacagcttccagtggtggccgtagacttggctcggaacttagtggcaccagagtaactctagtcagttacagtaaaatccactgtgtgtggaaggcagaagctagcggttgtatcccaagcatcttttgtatttgtctttatactttgctgaattctctgaaatacctattactgtatgttgcttttctaaataaatgtattgtgaaaccaaaacagctgctgttaatatggataaatgttaggaggagaaagctgagtaaaaagagcaggttccaggagactctgcaggggtgccattcacatgaaacgcacaggcaagcaaatgaagtagtgcttgcatagacataggggtatgcgatgaagcagcttttgtttgatgagacagagtaatagacaaatgcaaatcgtggtttgctccaggaaggggtggtgctagtggtagaagaggaacacacgagtgaagccgccacggggagtgggctccaggtgttttgtgacagttatgtcgtagaatatacacaaatatggctgggcgaggtggctcacacctgtaatcccagcactttgggaggccaagatgggcagatcacttgaggtcagggattcaagaccagcctgggcaacatggtg

SEQ ID NO: 2981 - DNA, 1137 bp, Homo sapiens
tcccgactttgtgatctgcccacctcggcctcccaaagtactgagattacaggtgtgagccaccacgcccagccgtattattacatttttaaaatatgtcttagatcatatattatttgggagcttaattttttgcatttaagagactgccttggagatcattgataatcatgtgggtatgtatacatctacctcattgattttaacatttttgcagtatattatagcatggaggtgctgtaatttaaccctgtctgcttttgatagacatttagattattggtaagtttttcattatgagaaacaaaggaataatgaacagtcttattacatgttgtttcatatctatgctagtactgccttcgtgcttttagggtaggcagaattggtggaattccatggtcctttggtatgtgaaatagccatggtgtgcatacgttgtcatggagaaaaggatcaagacatgtccccgtccctcttctccgcatcatctattgttatccacctcagattgcattggaattgttattataggggtcattgtcattcgaagatgtggctgtgggcttcaccagggaggagtggcagtttttggaccagtctcagaaggtcttgtacaaggaagtaatgttggagaactacatcaacctagtatcaataggtaaggacagcattgccgtcacttaccttttctttcttatttggtgaccactgtacggtcccataaatatttaatggtttagactaaagtattatatgttatagattttttgttgtggtggtaaaatatataacataaaatttaccgtcttaaccataagcgtgcagttcagtgggttaaatgcattcgcgcacatagtgttatgcagccaccaacactaccttctgtcttctaaaactgaaactctgtacccacaaaacaacaactactcattcccccacttctccccagctcctggtgaccaccattcactttctgtctttaggattttgacttctctaagtacctcgtataagtggaattatatagtgtctgtctttttgtgtctggcttatttcacttattatgatgttctcaaggtttatccatgttgtagcatgtgccagagtttcctttttaaggctgaataatattct

SEQ ID NO: 2982 - DNA, 1175 bp, Homo sapiens
gaccaggatgtggacgtcaaatactttgcccaggaggctctgactggtaagacctagaaagcacggagccctagcaggagggtggactttgaggacaggcactgggcctgtgggcagcagcttctgggagggggaggtaccttggcattgtgggcagagagagggctctggttctgattcttgcctgttcctgttttcctagttctgtctctcgcctgatgctggaagaggagcaaacactggcctctggtgtccaccctccaacccccacaagtccctctttggggagacactggggggcctttggctgtcactccctgtgcatggtctgaccccaggccccttcccccagcacggttcctcctctccccagcctgggaagatgtctcactgtccacctcccaacgggctaggggagcacggggttggacaggacagtgaccttgggaggaaggggctactccgcccacgtcagggagagatgtgagcatcccgggtcactggatcctgctgctgtaatgggaacccctcccccatttacttctccacctcccgtcctccccatcattggtttttttttgtgtgtcaactgtgccgtttttattttattccttttattttcccccttttcacagagaaataaaggtctagaagtagttggtcctctggccttagtcatcagcttggaggagggggcaccaccccagagccacaacatctgcgcttttctctggagaagatcttgttacaggacccattatacccctatgtcccgaaagaatactctggggatccccccaggagtgctgctggcctttggggtagagggtccatgaggtgctctgggtggtgtcctgtagtgcagttcagattcatagatgtcggccgagtatttggggggttaagagcaggtgccttggaaccagactgcctgggtccaaattgtggctccttcagttaatagacgtgtgactaggagtagcttgttaagtctttatgagctcagttttgtattgtgtaaaatgagagttacagtaatacctagattgcagggtgggtggcgaggaccaagtgaattagtacctggaaagtgtgtaacagtttcaacatgagaagtacacaacatgagaagcagagttagctgtacattgccagagaaccccctgtgggccatt

SEQ ID NO: 2983 - DNA, 1150 bp, Homo sapiens
gatatggcctcgtgggaagggaaagacctgaccatcccccagccagacacccgtaaagggtctgtgctgaggacggttagtgaaagagatagccctctttgcagttgagataagaggaaggcctctgtctcctgctcctccctgggaatggaatatcttggtgtaaaacccaatcgtatgttctgtttacagagataggagaaaactgccttatggctgtaggtgagacatgctggtggcaatactgctgtttactgcactgagatgtttgtgtaaagtcaaacataaatctaccctacatgcacatcgaggtacagcatctttccttaaacttatttatgacacagagagctttgcttacatgatttcctgctgaccttctccccaccattaccctacagtccttccacatccccctctctgagatggtagagatagtgatcaataaatattgagggaactcagagacctcggctggtgcggatcctccgtatgctgagtgctggtcctctgagcccactgttctttctctatacgttgtctctgtcttatttcttttctcagtctctcatctcacctgatgagaaatactcacaggtgtggaggggctggcccccttcaataaggaccagacgctgtggctcatgcctataatcccagcactttgggaggctgaggtgggcggatcacctgaggtccagagtttgagagcagcctgaccaacatggagaaaccccgtctctactaaaaatacaaaataaggcaggcacggttgcacatgcctgtaatgccagctactaggaagtctgaggaaggagaattgcttgaacctgggaggcggaggttgcagtgagccaagatcgcaccattgcactccagcctgggcaacaagatggaaactccgtctcaaaaaaaaaaaaaaaaaaaaggttaaataagttgtgaggatggagcagaagaggtggaagagaagcaatagagggaagaaggggataaattgcaggagaggagagaggtacaaaataaggagcacaatcccagggaaaaagaaaagaaaacaagagctagaaagagaaggggagaatgagagatatgcacagaattagggagggaagcacagtaatgaagaaagaggggccaggcgcagtgg

SEQ ID NO: 2984 - DNA, 1176 bp, Homo sapiens
ccagctccgcactttacccagcgacacgagaaccaaattgtctcctcaccttttttttttaatatatatatcccgaccctcactcccttggggcccaggctcagagctgccccccagccccagcctgacctcagcacccccattccccatacgcctcctcatctccactccccgaaccaggtcggacgcctgggtccctcactgctgggggagggggaagcagcgagaattgggagccaaaaggtttttctggggggggtgccaacagggggggctcgacgtcccctcctccgtgcatcggagagttgacctatcattaacagaggtgagacagatctttttattaatcggaggtgggtggaggtagaattaatgttctgtgatccccccccccgaattctggagaaaagagctggtccccttcctaaggagaaaggagagtgaccccctcatatccggaagctttagaattgggggtccccagctctcttctccctggcagctgctgaacgatggactaagagtccctaaaaccagattgtgccccaaattgacaaaatgaaaagatcttcgaatctttttttttttttttggacggaaggagaatttccctcctttccctcctcttcccttcccctcttatcccaggttgttaggggcctggggtcacaggcttaccccactgagagcagatatctgttaagacagggtaggtggccctgctggtggtgaggggcaccaattcggggagaagaggccaagagatcaagaagagaggaaactcagcatgcggacagaaaagagaggaaggggccggcgcccaggccgggaggctgggggttgccctgtccagcgggctgctgaactgtggcctgaggaagggctgtgtgtgggcagacgggagttgaggtgggggagggaacacaacgtgtggggcactaggcccagttgccatggagacaccccccatagacaacctttttccacagcccctcctcggagcagccccagtctgaggccagctgatggggggcagtggagacgggcaagcaatcaggaggccaaggtcaccctgtactgggacctaggttctggtttttgttttgtttttttttaatcccctcttcgtctaaggtttccaggctcttaactatagtgggtttgggggaagaagtt

SEQ ID NO: 2985 - DNA, 1154 bp, Homo sapiens
gactaaggagattccacgcaggtccgcaaagtcaggcttgcgcttgctcctgacaccacttcctttacctccacggctccatctttgttctgcgcgagtgcgcacgcgcaggctccgaaagcgggccgtcgcacagagggaccacaactcccagagtgctccgcgtccttgctttcgcctctacttgtgctccagggcgcacgcgcagccctgggagcgggttctcgcgcatagggaccacaactcccagggtgctccgcgtcctcgccgctgtcgccgccgcggagacaaagatggctgcgagtaagtgcaggttccggtggcgcacggggctcgggtagttctgggaacctctgggcggtcctgggactgaggtgcggcagggcaggggtggaagcgatggggtccgtgctggaggggaacgcagaagtcacgagggggctcctccagggcaggggtggcacgagagggttagaggtcaccgggggcagctacttgcaggggtgacgcttcttgccaccccttcaggagtcggcgccttcctcaagaatgcctgggacaaggagccagtgctggtcgtgtccttcgtcgtcgggggcctcggtgcgtgagtgctccaggcgcaaacttgcatcgtccacccccgtccccctacatccctccatcttgtacccctaaagccctatcgccgccctcgggtcccctctagtgtgtctgcacccccacggcatccccttatctatccccatacccattataacctctccaccatcgccccccgcgttcctctccacctacccaatacgctcttaacccctctaaatgagacgttctcaaccctgcttatgccttaacacctgagcaccaaaaaaaagtccagatcctcctcctccttttcatctttcctctcccccattctgaattgagttggcttgggtggaggtgggactggggaatctgtgtcttgtgaaaatccccgtatgatcccaatgtgccttgctgattgaaaatctctgccctctgccctggaactgccctactcacactttaattagcaccggagttcctgcagggatgggggcgggggattgttaaaatgtagcttttttttttgcgatggagtctcactctcacccaggctgaagtgcagtggc

SEQ ID NO: 2986 - DNA, 1135 bp, Homo sapiens
aaggttctccctacttctcaggtttccactccctggccggaaaaaacctagtcctcccaggttagcacgccgctctagcccagcctcacgtctccactgcttctcagccagccaacgcctcttctgattggctctgacgtgcgtggtgcgtgaaaacgtcacgagacgccggcgttactataagagcgcagccgtggcgcttgcgcgcctctttctcagtgaccgggtggtttgcttaggtgaggtgcggcggtgtgctttttctctagggtttgggttggatggtggcccgggccttccgagtttccatgagtaagctaaagacgttaggaaacagagcagggtggttgaacgggagtgcagcacggttgtgggggcagatactgactatgagagcgttggaggttattctcgcgagatcggatctgggctccgcgaggttttggcgtagttgtgggactgcgcaggcgccgtttggagcccttacgctcacacttctctcccgcgcaggcgcagacggggaagcggagccaacatgccagtggcccggagctgggtttgtcgcaaaacttatgtgaccccgcggagacccttcgagaaatctcgtctcgaccaagagctgaagctgatcggtgagtggccaaggcttccgggaagtggttcggcttccgggaggcggttagcacgtggatgaaggtgcccatgtactctatctagtccgtcccctaaatttggtactattcgtggtttaggaaggttttgtgattccaaagctgccagtctagttgttgtgccagtacgtgggactacacttgtccacccccttctccccaccaggcgagtatgggctccggaacaaacgtgaggtctggagggtcaaatttaccctggccaagatccgcaaggccgcccgggaactgctgacgcttgatgagaaggacccacggcgtctgttcgaaggtgcgtatgggagtccacagcagagggatggggtgcagggcttgtgaggttcattctcccttctgttgcctctgttccagtgatgagagttgtgtcattggataaatggaaccagccttctaacttttagtggcacttgtgaagtaggaaaagtgtatctggatcagtctttgcc

SEQ ID NO: 2987 - DNA, 1100 bp, Homo sapiens
gtgggcattgctgctgcacgtggtaatacagctcagtgtcaggtgtggggttcacgatatttcagactcggaacttgggggctctcacatggccatctcatttgctttgtggtcttaggtgggatactttcagatttctcctataaaatggggttgagaaagtcatctgaagcatttttggggattaaggtgataccctaaaaccccggagggcgcacgtaggatcaggtgcacccttcctgcagcgccttggtgtctgcagccgtggcggcctcacggggtgggtggagaggaaagagtggtgcggtagctggggttagcgtccgtttctcctccagtccacctcaccttgtcgcttcttccagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaattggtgtgtgggggtctctcatccttgactctttcccctgctctaaacatgcagccttccctgggaggctcactcacttgggagtgcctaccagctagtggtccctggcctctcagtactattctacagtagtgaacacacatctttaccagaaacttctgtcatcaggggagagacgagtggtatttttggaaaaactgtgtcaaaaccagaaggaaattccaagtaagccggtgtttgcatataggggtgggagggagccggtcattgctaggcagggcaggcgccgagtggaggtgggggccttccctgcctgctggccctgggaccctgaccccgccaggcaagagacaggtgggacgggagctgaccagaggctgacgggttgctggggaaggtgaactgttggtgattgttggggaacacttcacagaatttgcttgctagtttcaaagcttgtgatgcggttgatgttgggcaagttc

SEQ ID NO: 2988 - DNA, 1138 bp, Homo sapiens
ttgcctggcaatgtgggcgagtttactgcctaccgaatcctctactacatcttcaccaagaactcgggaggtgaggcccagtccccaggacagaggccatggtacccagggttgagccctgctgacttcaccctctttgtcttggtgctagacatcaccacggagctggcatacctcacacgagaactgaaggcagatccttgcgtggcccacgccttggcattaaggacagcctgggccctgggcaactaccaccgctttttccggctctactgccatgcaccctgcatgtctggctacctcgtggacaagtttgcagatcgggagcgcaaggtcgccctcaaggccatgatcaaaacgtatgtggtgccaagctcccttctgcctttgctcttcccatccttccgcctcgcaccgcccctcagaccagctcctggccgcaggcctcccccagcccccaacccttgtcctggtccttgcttccccatcatctttctccattcagccctcccctctccagttcctcttgctctccttgttggtcacctctgtgttccgggtcactcctctccctctccccactgttcccagctcactgcctctggggcctcttctccaccccatctgtgtgtctcttcctcctgttctctcctgcctggaccccctagttcactccttgccctgggcttcctcagaaccctgaggtctctgctttctcagcttgtcgctgtgctcccaccatagagaccatctagacagcctctggtctaccaggacaaggcccagtcccactcagctcctttgagagcaccagaaacgcttagggagacacctgtgttgaggccacactgggcgcggtgccagaggcccctggtcaggccatgcccctgcagtgtccttcgttcactagacattgcgcctggcttgctgtgggtggggatgagttgcttgactcatgtttagacgcatggttctgtctggtgattgaggtgcccaggcgacgctgggcaatgtcaagagaggttttggcttgtcacagcaaggggatgctcttggcatctagtgagtggaggccagggatgctgccctgccactgccattgggcctcagagctcagtcttgccaaggtggagaaatt

SEQ ID NO: 2989 - DNA, 1324 bp, Homo sapiens
atgggattggggaggaggggatgggcagcggagggttgggggcatggtctgcaggctcatctgtgtccgcctttcactccactaatgctgtctcagtgttttctctctctctctttcgagcttgcactccggtacccgacccggcgccctggcccatcccatgccggggggccagtggaaagaagacaggccgtccagcccgtgcccgcctgcggcgggggcacccagcaagcccgcccaccgcccgctgcctcacctgcttcgccacagactcttgttcccagccccttggggcctccgtgtttggggtgggggagctgcttagagactgtgcccgtcctcggccccccaccctgaagtgccagcaccaccagcaccagatcctccgccgccacaccgcactgaggacacgccggccgggccgcctcgtctcaagttgtataaagttgtctccgtgtcccctcctccctctgcccccagtgtttcttctgatttttttttcccctttccctccctccctctccgcattcttcccttggttcagcacaggtaaaacggttcccctccctccctgccttcatggatcaccagctcacgtcatgttgccttctcttttctttgtgtgtgtgtttatttaagttatttttcttcctcctctcccttttctttttggccctccctccctccctcttctgccatgtaactggaggatgtgctatgagtttgcaaacagctggactgtcaggctgctttttttccagatgttcctcctctgcctccccttcccctcctctcccctccttttccttccttccttcctttccttggagcactgagcaccatttggaagcttgagagaaaccaaaattaaagagagaaagagagagcgtgcacgctcctgctttgtctttcctgtgtgggctgtttgcatccattgtctcctccagaggtctgggggtgtcactccaggcggatctcagccaggggctggaaaggcccccctgtcctccctatacggcacagccagagtgtctgcaggggctggcaccccacttcctggctgagggtgaactccagcttggggaggtggacctgggaaccatggggcaccttggccacggtgaggtgggggtgcagctgccctggagactgtagtgtactcagcccctcggcttccagcctctggctcagcacttgtgccatgctttccagtgtgggagagggtggggcacacagcacatgcgggcccaggaggaccagctttctaaagctcagccgagggggtgcatttagccccggggccaagagggcccgtctcagagct

SEQ ID NO: 2990 - DNA, 1177 bp, Homo sapiens
ggctgtgacctgtgagacgggccataatcctcccagcctcttccacttccagcgggggcggcccaccctcaccttggagctgtgcctctccggtctttgcctctgtccacacatggccttctccccatgtgtctctgtctctgttttcccttcctataaggacaccagtcattggattagggctcaccctaatgaccgcatcctgacatggccacttcggcacagaccctgtttccggcacaggccacattcacaggttgtgggagcacaggagtgtttctgctggtgcatcaggctggggtctgtcctcaccgggatgtctcctcctccacccctctcttccagaggaggagcgagtggacattctaatcaacaacgcgggtgtgatgcggtgcccccactggaccaccgaggacggcttcgagatgcagtttggcgttaaccacctgggtgaggcctgggcaggggctgcaccatgggttcaagcgatcctcccccgtcgtcctcccaaagtgctgggattttaggtgtgagtcaaaagtgaccttttcatcatccttaatccaggtcactttctcttgacaaacttgctgctggacaagctgaaagcctcagccccttcgcggatcatcaacctctcgtccctggcccatgttgctgggcacatagactttgacgacttgaactggcagacgaggaagtataacaccaaagccgcctactgccagagcaagctcgccatcgtcctcttcaccaaggagctgagccggcggctgcaaggtacgggggcgctaggctcggcctccctcttgctttactctgagcctagagcggcctttccatgatcctaggctgatgggaggccaaacggtggatccagaacagagtcagcaaaagtagagcatgtggaccacgctgcccgcttctggtgcctgaagcagacatcactaatcgatcgttcttctgaggattgtctgttcatcccaggtggtctagtctgcctggatcagatgtccttccctgctgctgttgggcaggcagctcagccttttggctccagccagtgagtctcaaccaggggcagttttgacccgcagttgtcaatgcctggaaacacagtgatcacagctggcttggggagagattgctctgggcatctggagggtaaaggcccaga

SEQ ID NO: 2991 - DNA, 1199 bp, Homo sapiens
cctgccttctccccttgcgcctcaagggtcattggcggaccccaacccctccccgtgaagtcgttgtgaattttcaagttattttcccctcactctcattcgccgcagctagtctcggctgcctgaattcggtcccgccgccttaggtcactcagtcccgcctgacaagagttctaggtcgctgtctgccctcaggggtctcccattcacccaagttcccagtcgctctcttcctctgctgtccgagcgtggcccgtggcctaacgctgctttagttctctgtgtctgacgctttccctgtgcccgtttccccgcagccgccgccatgtctgcgcatctgcaatggatggtcgtgcggaactgctccagtttcctgatcaagaggaataagcagacctacagcactgtaagtggggcccggatgcgtggctcctgcgggaggagggtcctgagtctcttgactctgggtcagagggcgggaccttcgcatgtctccgggtcccttattcacgatgccttgtgccgcctccttcccaggagcccaataacttgaaggcccgcaattccttccgctacaacggactgattcaccgcaagactgtgggcgtggagccggcagccgacggcaaaggtgtcgtggtggtcattaagcggagatccggtgagttttgtctggtttgggccagagagcggcccctttcccgggtctgggagctgtgattttttactgtcaggcaggaagagcggtaactgccatcgcggcgggcatccctggcgccagggtgttggtctgggtaccggcttccctctcggccgacttgtcagctctgtgagccgcgcgcgtctgagcccgtgtcctcacctgtaaagtggagaaatgaaaaaggacctgaacttcctcggtggttgttgagagttaaggcacggggttgatgttttcagatgaaattctcaaagcaagtcagggtggggatggatggtttcatcccacaggtgggaagattgaggcacaacaggggaggggccctcgctaccacacttaggaggggacaggctgggttggttgcagccatttgattcccattttgcctgtgtaggttagagaagaggtcttggggaccccactccatacattgtgctgtcaggtgcaggcctttttggggattccctgaatgttcgtgtgagtcgggggtctctaa

SEQ ID NO: 2992 - DNA, 1151 bp, Homo sapiens
ggtgggaaaacagctacctgctggcctgcccaggcacccgccacgggcccacgctgctcagcttctcaatgtgagactgtccacacctgcgaggtgtgctaaaggtgcaggttaggtggactgaccccaggacctccctgacccccaaccaggccagcggaagcctgccacctcctatgtgcggaccaccatcaacaagaatgctcgcgccacgctcagcagcatcagacacatgatccgcaagaacaagtaccgccccgacctgcgcatggtgagctggggtttggggatcaggcttggggagactggccagtgctgtggggaagggcctcccactactggttgcaatatgggctggagagggatggattcttgctttcagcctactccccacacccagcattggcctagggggcggcttgtggagtgtatgggctgagccttgctctgctcccccgcccccaggcagccatccgcagggccagcgccatcctgcgcagccagaagcctgtgatggtgaagaggaagcggacccgccccaccaagagctcctgagccccctgcccccagagcaataaagtcagctggctttctcacctgcctcgactgggcctccctttttgaaacgctctggggagctctggccctgtgtgttgtcattcaggccatgtcatcaaaactctgcatgtcaccttgtccatctggaggtgatgtcaatggctggccatgcaggaggggtggggtagctgccttgtccctggtgagggcaagggtcactgtcttcacagaaaaagtttgctgacttgtgattgagacctactgtcccattgtgaggtggcctgaagaatcccagctggggcagtggcttccattcagaagaagaaaggccttttctagcccagaagggtgcaggctgagggctgggccctgggccctggtgctgtagcacggtttggggacttggggtgttcccaagacctgggggacgacagacatcacgggaggaagatgagatgacttttgcatccagggagtgggtgcagccacatttggaggggatgggctttacttgatgcaacctcatctctgagatgggcaacttggtgggtggtggcttataactgtaagggagatggcagccccagggtaca

SEQ ID NO: 2993 - DNA, 1183 bp, Homo sapiens
ccagctcctcagaggttgagtagaggctgaggtgagcggagcacttgagccaagagtatgaggctgcagtgagcccatgagccccaccactacactccagcctggaagacaccatgacacacagtgaggcctggatggggaaagagtcctgctgttgatcctcacatgtttcctgggcacctaactctgtcagccactgccagggaccaaggatccagcatccatggcacccctggttcctgccatcctggggtacccgattcaaagaaggactctgctccctgtctgagaccacccccggctctgactgagagtaaggggactgtcagggcctcgacttgccattggttggggtcgtacggggctgggagccctgcgttttgaggcagaccactgcccttccgacctcagtcctgtctgctccagtcttgcccagctcgaaggagagcagatctgaccacttgccagcccctgtctgctgtgaattaccatttcctttgtccttcccttagttgggtctattagctcagattgagaggtgttgccttaaaactgagttgggtgacttggtacctgctcaggaccccccgcactgtcccaatcccactcaggcccacctccagctggcctcactccgctggtgacttcgtacctgctcaggagcccccactgtcccagtcccactcaggcccatctctggctggcctcactgcgctgggactccgccttcataaggagagctcactgctcacgttagtagatggccccttctcgtgaggcctctcccctggcacctgcttcagttgtcctccacagcactgatttgcagcccacaagctggcaggtttatctgtctcatgtttgtcttgtgctggtgggcaaggggtttgtctagcacaccagcatataatgagatgcttgatgaatggtgcatattgaatgtataaagcccaccggtcctgagagtttgctcactggagactttctggagatggagtctcgctctgttgcccaggctggcgagtgcaatggcgcgatcttggctcactgcagcctccacctcctgggttcaagcgattctcctgcctcagcctcccgagtagctgggattacaggtgggtgtcaccacacccagctcagtattgtatttttagcagagatggggtttcaccattttgcccag

SEQ ID NO: 2994 - DNA, 1241 bp, Homo sapiens
gtgtggttgtgtggtgtgtgtgtatggtgtgtgtgtggtgtatatgtggtgtgtatgtggtgtgtgtgtggttgtgtggtgtgtgtgtggttgtgtgtgtatggtgtgtgtggtgtgtgtgtatggtgtgtgtgtggtgtgtgtgtggtgtgggtgtgtggtatggcgtgtgtgtgtggtgtgtgtggttgtgtgtatggtgtgtgtggtgtgtgtgtatggtgtgtggtgtgtgtgtatggtgcgtgtgtgtggtgtgggtgtgtggttgtgtggtgtgtgtggtgtatatgtggtgtgtgtggtgtgtgtggtgtgtggtgtgtgtatggtgtgtgtggtgtgtgtgtgcgtgtgtgcatggtgtgtatgtgtgtgtggtgtgtggtgtgtgtgtgcgtgtgtgtatatgtggtgtgtgtggtgtgtgtgtatatgtggtgtgtgtggtgtgtgtgtatatgtggtgtgtgtgtatatgtggtgtgtgtatggtgtgtggtgtgtgggtgtgtgtggtgtgtgtggatggtgtgtatggtgtgtgtgtggtgtatatgtggtgtgtgtgtgggtgtgtggctgtgtggtgtgtgtgtggtgtgtgtgtagtgtgtatggtgtgtgtggtgtgtgtggtgtgtgtgtatggtgtgtgtgtggtgtgtgtggtgtgtgtggtgtatgtgtatggtgtgtgtgtgtggtgtgtgtgtatggtgtgtgtggttgtgtggtgtgtatgtgtgtgtggtgtgtgtatggtgtgtgtgtatgtgtgtgtgcgtgtgtgcgtgtgtgtggtgtgtatgtgtgtgcgtgtgtgcgtgtgtgtatatgtggtgtgtgtgtatatgtggtgtgtgtgtgggtgtgtgtggtgtgtgtgtatggtgtgtatggtgtgtgtgtggtgtgtgtgtggtgtatatgtggtgtgtgtgtgtgggtgtgtgttgtgtgtgtgtgtgtgtgattgaaatattaaaggatgagatttagtttaaaagaatccatcaaggtcagatgaggtggctcactcctgtaatcccagcactttgggtgattgaacaggagggtcccttgagcccaggagttcaagaccgacctgggcaatatagtgagactccatctctacaaaaaaaaaaaaaaaaaaaaaaaaattagctaagcatggtggctcatgcttatagtcccagttactcgggaggctgacgtcggaggattgcttgagtccagaa

SEQ ID NO: 2995 - DNA, 1222 bp, Homo sapiens
gggtttcaccatgttggccaggctggtctcgaactcctgacctcaaatgatccgcccgcctcggcctcccaaagtgccgggattacaggcgtgagccaccgcgcccggccgtacatttcatggccttttatatgtttttcatcacttccttaacctcactttatctcttgtaagttagttgctcatccttgcctaatctttctttatctcttttgaccaaattgctcatctttagctttatttttcgtggccaaactgctactgcaagtccttctggcttattttccttatcctgcatgttccaactcactgcttcctcccttatttcgcatgtcctgcttctgccatttgacacgttttgcttctgcttaagctaacctatgtccaacggtccccttcgccccccgaatttctctgctattctcctgcctcaagatgtccgtgagtctggttcacgcctgtggtattgggggtggcctgaaggtgaaggtttcctgtcctgttctgctccaggtctcaggtacagagggaagggtccagggtcccttggcaagaggccgaagggagaagacccctgggtctctggaggatgggaagggaaggattggctctgagggccgggaaggggcccgccgccacgtggctggggtatgacctttgctaccttgatacacactttatcgtgtgtattcacatctggtagctcttatttcaaaatttgcattccacagtccaggggccaagagcaacatccgccggccagctctgtcccactcaggccggccagcaatgcacagggcggccgcctgcaggctgcggcctcgggactgtccaccagggggcgcccacccggccggtgctgggcggcccggctcaaggggtgcggcccgagaacttggggccctctcctgtctcctgtcattgagaacaatcaaccacagcagggagctggcttcatggggtctttgttgaggacctgcacttccaggtgctggaaggtcttccccagcctcctctcccctatcccagcccttgaaattctgtgtgtgttgggggtggatttagtcattcaacaaacatttattgagcaccttgctttactgagcagtggaggaggtgaagtcagagaagccgagggggcgcggggagcagacctgccgggctttgtgagccaggcaagggttgggctatgagggtaagcatgatggagaaccatagaggg

SEQ ID NO: 2996 - DNA, 1354 bp, Homo sapiens
tcggatggctgagccacccctcctgcccacaggccggcgtgaaggacacggaaaaccgcgtggccctccatgccttgacacggccgccggccctgctcctcctggcggcggccagcagcggcctgcgctttgtcctggcttccttcgccctggccctcctcctgccggtgttcctggctgtggccgccgtgaagctgggcctgcgggcccgatggggctcgctgcctccgccgggtggcctggggggcccctgggtggccgtgcggggctccggtgacgtgtgtggggtcctggctctggcccctggcacaaatgcaggggacggggcccgggtcacccgcctgtctgtctctcgctggcaccgccgccggggcgtgggcaggaggctgctggccttcgcggaggcccgggctcgggcctgggctgggggcatgggggagccccgggcccggctcgtggtccccgtggctgtggccgcctggggggtgggagggatgctggagggctgtggctaccaggccgaggggggctggggctgcctgggctacacgctggtgagggaattcagcaaagacctgtgaagctacagactgacagccagggcaggggaggagggaggggcgccagcacctgatgatcgcctactgtctgcgggttcttttacctgctctccctcagtgagtcctcaaccaccctgggcccagaaacagaggcctgccgaggggaggagcctggcctctgtccacccgtcagcagtgtgaagtctgttgtgtttgagcttctcagagtggaatgactccttttccttcctggccctcgggggcctctcgaggtcagcctctccaacccctacctcagctcctgtctgcactgagaaacctccccgggtgatgtctgcaaagtctgtgctgtccgtgccccaggctgggagagctatctggggagggggagaggaggccgagcagaatacaccccagagttagggtttgcgactccgcctccctgggacctggattgggtcagatgcctgtccttggaggggacaaggttgactgcttaggaggcgcgacgcacagggctgccaggcctggcccctctctgggaaggttgagagctgagacgggcagccctgtcccttcctccagatccgtctggttttttacaccgtttgttaataaagcctgaaaccgctgtgtgcctgtctcttctctgatggctttcccagtctgtctccggacacccccgcccatttctgtctggcttctcctttccccagttaacattaattgttgggggacggtgctggactgggagaaggggaggctgtgagctcaggggcagcccgaggccctgc

SEQ ID NO: 2997 - DNA, 1360 bp, Homo sapiens
ccctcccgagtccaggggtccggccctcagtcgcctcctccctggggattcccggcagctgggtccccagcccccgcctcccccttgtcctgggagcccagccccctccccagcccctcctccaccgggacccaggaatccacacctcctccataccagagtccagattccccaatccgtcatgacctggacccaggagtctcaatccccagctcccatccccatcagtcccaagagtctgggcccctagccccctcccaactcagaccagaagtctgaaccctcctactccccgacctctcccagcccctggcatctgagaacacactctatttccggggcctaccggcttcaaatcccaccccctccactcaggccccatgggctgtgtcccagcccctcccaaaacgttcagcctggccgggggacctggagcagaagcggttcgctgactttgtccccctccgtgcctctgcccagttcactccctctgtgtctctgtctccctgtctctccggcccccaacccgccactgctcttctgatctctgctcttgcactatctctgcctctggttctccaagtctctttgtttcctcttctctgtgtctctgtctctctgctgggtgttcctcactctcctctgtctcttctctgctctgcctttcaccatcctgtctttctgcgactcctggtctctgtctgtccatccccacttctctgtgtctcccatctctgccttctcctgtctctattccctgctctgtcgctctgtctctgatctctctcctcctgtctctccatctctggcctcccctcggtgtctctcatctttgtctctgtctcatatctctctcctggctaaatacctgaccctctctgcctctccatctctgactgtctctgcttctctttctgccacaccccacgcacctctttttatctctgccccgcttcccatctctcccctctctccccacaggcatggatccgcagcctcctccacccgcccagggcagcccacctcaccgtggccgaggccggggccgtggccgaggccgtggtcggggccgtggccgtggcagggggggcgctggagcccctagggcgcccctgccctgccccacctgcggccgcctcttccgtttcccctactacctctcccggcaccggctgagccactcggggctccggccccacgcctgcccgctgtgccccaaggccttccgccggccggcccacctttcccgccacctgcgcggccacgggccccagcccccgctgcgctgcgccgcctgcccccgcaccttcccagaaccggcccagctcaggcgccacctggctcaggagcacgcgggcgg

SEQ ID NO: 2998 - DNA, 1081 bp, Homo sapiens
cacagacgcacgctgcccctcagtttttttctgacacgcctctcgttctctgccgcctgtcccctatcctctcccccacgtccctcccatggtcgctgttcttttatttttgatcgcccctgacctcccccttccccaccactccttttccctctcccctctccccaaccccttcctgtggcaccccctgagaatcccgagatcaaagagttgtttccatttctctttaaagtgaaatattgtggggctgagatccctcgtagcaacaaaaagtttgctaccatcgtcgaaggcaagtaaggtccattctgactttctcaacctgcactttgctacatttgataaaccagcccccggactccagggccagattcctccacatcactcttttctcctcccctcccgtccctgcccctcctccctacactcctcctctcctgcccctgcactcttgacttcctcctcctcgctcgtctctgtcctgctctccctttctgtcctttgctcgtctctgcccctgcctgccacttcctttctactttcctgccacttttctgtctgtctccactgggtggcccttcctgtgtgctctgtctcttcatctcttgtgtttcgtgtttttcttcattttgtgttgtcatcatgccctctgccttttcttgaacaatcttctcctttcccctgattttttggggcccctgtggctgtcccccaacgcctgtccatcgcctgcccttggccgtctcttgctactgcttcctccccattttctctcttgcttctgttcttactattgacttctacacccccacccatattccactgttccttccccccctcctccctcccctcatccctctccccttacccccaaacccctctgtgtctccctctctcacccttcccctcctctctccacctcccttcccccgcccccccccttgtctcctattccctctgcaggaggccatgatggatttcttcaacgcccagatgcgcctgggggggctgacccaggcccctggcaacccagtgttggctgtgcagattaaccaggacaagaattttgcctttttggagg

SEQ ID NO: 2999 - DNA, 1241 bp, Homo sapiens
ggtggacgctgactggctgttgggcgtgagccttgttcacaaacctgcctctcctttccccacagatctttgtggagttcacctctgtgtttgactgccagaaagccatgcagggcctgacgggccgcaagttcgccaacagagtggttgtcacaaaatactgtgaccccgactcttatcaccgccgggacttctggtagaggcggctgggggagggtgggggcagggctggctgggggcttctccccactcccgccccccccttatccccctctgaagacgatgggcagaggagtgacagccgcagacacacgacagccggcagcaactggaatggcagcaattaagggtggggggcgggggttggggggttggggggttagggcagggaggggactggggaagtgcgcacacagcccacacagacaacacgcacccacacagacacagagggaaggggttgggatggggacagggtgcacagcagggcggggtaggaccccagcccctcccaaaacagcctctccttctcccatagacccctttcttctccccttccccacggtaggaacatagcgtgtttatattttatggccaaactattttgaattttgttgtccggccctcagtgccctgccctctcccttaccaggaccacagctctgttccttcggcctctggtcctctctggtcccctcctgggtttcttacgtagttgatttttcctctttagtctcccccgacctgcgcccagccccgtggcccctgcccctctcctactctctgtggcagtttcatatttgctaagacgaatttgctcattaaacattttgttgtattttactttatggagcggctgtgtgtccagtatgtccgaccctcttcctcggttctgggctcgggtgggggttcccttggcaaactgcgggcccctggctgggacgcccctgctgccggcgccggcagcctcgaggccttccctgcttgcgcggtgcccttctcggggtcggcacaggcacagccccgggggacgtgaggttcccgagtgctctcccaccccgccgacaggagggatggtggccgagcgggccggggcgggcgtggcgtgggtgtgccaggagctccgcggttgccgccaagcgagctggagctgactctcggcgttccgtgagcaccgcgcggatcccccgctgcagcgggcggaagtgacgtagaggcgcctagcaacggggcccagcgcg

SEQ ID NO: 3000 - DNA, 1106 bp, Homo sapiens
ccttttatggagacttggttgagaggcataactgaagcatggacagccatgtagaaatgtgattagataaaacgggtgtgatcgaatccgagtagaccgagcggggaaacctcgcaaggcctgtgtgttcagacccttcttggcctcctttggctttctttcctccagggtaggggcaggaccccttctgaaggggggtgttatggcccacaatcagacaaattaggtcagaaaaattttttatggccagaggtgggggaagatttaaggatatttttagtttttaaggcctgccttgtggagaaagaagagcaggtgaaagtagggcagaaggtcagggagagactctttttctgaggcctaaagcttcccatcgttagaacaagaccgtaacaagggctgtgggagtcatgagccaggagccgtggacagagcccaatgtatacgtatcataaaatcacagggagggttaggaccccggggctgctccatgctccccccttctgtgtgcctggccccacaaggcgcgcctgtccccgcatgggtgtgccctggatgtctcttcctgtggacaatgcctggccagcgtcccctgtctctggggcctcaaaccaggaagttccccgaggaatgggtggatctcaggcttttctgtgcccaagatctctgggagaaccgtctgctggcacggcttcccaggctccactctcaggtgtgtcaaccccggtgcccttgagctgaggccaggacagcacccctgcccagcctctgcctgtggctgacaccacacaagggtcatgggagccccgccaagggccaaggagctggagggtggtccagggtggtgctctgggcccgagtgagactgtgctcttctgactctctccgatgggccccagagcccatcacggtcccacagccaggttgcgaggcacctaggatctagtcagcgttgtgccaagcccccatcctcatgcctcagctgcctgagtcactgggattacagtcatgagccaccaggcccacgctcttgtattttgacccccttatttaggaaacgttttcttgtctgtcagagtgagggcaggtggtttgcccctgccgct

SEQ ID NO: 3001 - DNA, 1099 bp, Homo sapiens
agggtttcaccatggtgcccaggctggtcttgaactcctgggctcaagcaacctgcttgcctgggtctcccaaagtgctgggattacaggcgtgagccacagtgcacagcatgttcagtttttcatcatgaagtataatgtaagttttataaaacatatgtcctctataagggtaaaaaatttcctctgttcccagttttctgagactctgtgttgctatgaataagtgtggaattttgttcagtactttttctccaccagttgatgtcattatgctattttccttctacatcctattgatggaatgtattgctttgatcaagttttgaatattgagccagccttgcatccttagaataaaccatacttgtttgtagagtataattgtttttatatatcatttgacatcattccctttgtttgtattttgttgaggaaatattcctctaatttattggctaataatgtgtagttcttttttcttttgtttcttatgttctaaatgtcttatgtgtggttttgatgtctaggtgatcttgacctttcaacatgaattggaaggagttctcttctaatttttggaagactgtgtagaattggtgttatttgttcttgtcatgtttgatgacctctagtcaaccattgggccagagatttttcttctggaggcttttaaattacatatttattttattggataggtagaactattcgaagtatctatttcttgtgtaataaattttgatagtctgtcctgttgaaggaatatttcatctgtatttgtagcactcccttattcttttgatagcaggatctgcacttctttttatttttaatatttaaaatgtgcatactcattttatgattgagtcttcttagacatttatcagttttattgcgcatcatgctgaaagatgtaatttttgcttcatctctcacttcagagaactagcactttatattaatgatttgtctctattcttgatttctttgatttctgctctgatcggtattatattccacttgctttggttgtatttggctctttctaacttttcaaggtggggttttagattattgatttgagatttttttgctt

SEQ ID NO: 3002 - DNA, 1152 bp, Homo sapiens
gagttcacaccggagaaagaccttataagtgcaatgattgtgggaaattttttaggtatatctccacactcattagacatcagagaattcacactggagaaaggccttatgagtgcagtgtatgtggggaattgtttaggtacaactccagccttgttaaacattggagaaatcacactggagaaaggccttataaatgcagtgaatgtgggaaatcatttaggtaccactgcaggctcattagacaccagagagtccacacgggagaaaggccttatgagtgcagcgaatgcgggaaattctttcgttacaactccaacctcattaaacattggagaaatcacactggagaaaggccttacgagtgcagagagtgtgggaaagcctttagccacaagcatatacttgttgagcaccagaaaatccacagtggagaaagaccttatgagtgcagcgaatgccagaaggcctttattagaaagtctcacctggttcatcaccagaaaatccacagtgaagagaggcttgtgtgctccatgaatgtggggaattctttagctaaaactccaacctcattaaacatcagagatttcacaatggagaaagtttaccattgactattgtaattgggtagtaatgttatataaattccacatttttatgcaactaatctccagaacatttttcctcttaccaagaagtaaaatgctgtacccattaacaacaactcattccccttccctacttccccagaaatgtctcaactatatttctatactctatggtacttatatgaggtaccaatagatatctatgaatttgatatatatttgtacctcatataagtggattctacagtatttatcttttgagactggcttatttcacttaggataaggtcttcacggttcacccatgttgtataatgtgtcagaatatccttcctttttaggtgaaataatattctatggtatttatataccacatttatttatccattcatctgttagtggatacttgggctacttccaccttttgcctattgaaataatgctgctatgaagatgagtgtacaagtgtctattcaagattctactttcaattcttatagggtatatactcagaaatggtggtgctggatcatataggatt

SEQ ID NO: 3003 - DNA, 1603 bp, Homo sapiens
acaggtctagctatatttatatcaggtaaaataattatttttaaataatgcagtttttcaagttaaaaactaaaaaagagaaagtaattatataatgaaaaaagtcaatttagaaagatgtaacaattgtaaatatatatgaccccaacattagggcacgcacaaacacataaagcaaatattagtagatcaaaaggatagacttcaatacagtaataccagagaacttcaacacctcatcttcagcaatgggcagatcattcagagaatacattaacaaagaaaaaaacccaaaagaaactaaagcaaaaaacctaaaactaaaacaaagaagaaaactaaaacaaagaaattaaactcaaaattggtagaaggaaataaagatcagagcagaaataaatgaaatagagattttaaagtacaaaagatcaacaaaacgagttttttttattttaatttttagttctggggtacatgtgcagaatgtggaggtttgttaaataggtaaacatgtgccatggtgatttgctgcacctatcaacccatcacctaggtattaagcccagcatatattagccatttttcctaatgctctccctcccccagccccatccctcgacaggccccagtgtgtattgttcccctccctgtgtccatgtgttctcattgttcagctcccacttataagtgagaacatgtggtgtttggttttctgttcctgcattagtttgctaaggataatggcttctagcttcatccatgtccctgcaaaggacatgatctcattcttttttttttttttttttttgaggtggagttgcactcttgttgcccaggctggagtgcaatggtgtaatctcggctcaccacaacctctgcctcccgggttcaagtgattctcctgcctcagcctcctgagtagctgggattacaggcatgcgccaccacgcccggataattttttgtatttttagtagagacggagtttctccgtgttggtcaagctgatctcgaactcctggccacaggtgacctgcccacctcggcctcccaaagtgctgggattacaggcgtgtgccactgcgcccagtctagctcagtactttgtatgaacacatagtttgcattaaggttgaactgcatatatggttttacttaagggtatatgcttaagtgaaaaaggcatgggtcagaagagtgtacaaaggatgctgaattatttgaagccagcagaggcatatgtatatagggacagacaggtggggaaacagaaatgaaagttaggattctatggaattattctgtgatatatctttgggtttttacaaacataaatactttatataattcctaaataatgttcaattaaaatgaaattataaaatccataaaactcaggggttctacactcacaaaggaatagaaataaaacaagggaaatatttaaaagatataagatctatcaaagttaataacattattgtgatattatactataatttgcaaatgtaaccatgaggaaaaactgggcgatatgggccaggctctttctgttttatttcctacaactgcttgtgaatctataattatttcaataaaattt

SEQ ID NO: 3004 - DNA, 1155 bp, Homo sapiens
ggatggccctctatatctctgaagttttttctctcctgtactctgctctgtagactccagctaccttggcaaaccgagactcttagctatgtctccttaacacaggatgacttttgggctctgagctctccatctttgtactagggcctcagaattaattttcacagtaaccttatttagttttttcttttttgagaaaatctatgaacccatgttttttctttctgatatagtggaaggtctatcaattttaataatttattcaaggtgtctcctttttttaatcagaaagaacgtaaatcacatattacagataggagcaatgaaacatagtatagtactagataactttgaaacatataatggataatgtgtgattgttttaaacaaccctttctcagtaagttgaaacttggaaaacaaaaatccattgaaagataccaactgaccaggctcactcgagatctgaaaaatcctctactaaagatatttaatacatatatctatatatctcttagagagaaagaataagtcatattctagtgagatttgttaggattttttttttttttgagacggagtctccctctattgccaggctggagtgcagtggcgcgatctcagctcactgtaacgtccgcctcctgggttcaagcaattctcctgcctcatcatcctgagtagccgggattacaggtgcacgccaccatgcccagctaatttttgtattttttgtagacacagggtttcatcatgttggccaggatggccttaatctcttgacctcatgatttgcctgcctcggcctcccaaagtgctgggattacaggcgtgagccaccgcacccagccttgagatttgttaggatcttaaagttggtttaacagtagaaaatctattaattattatattaaatacagtctgtggtgtaataaaaaatatatctggatctttgtcccaggcttagtactacaaaaatcttgtaattctttgagtgagagaagtgtattttttatactaacgaagtgattcattataggctcctagaaaggttcagaatgggggctcttcatcagaaagaccaaccatgtaataagagggttgaaactttgagccagattgacctttggggagaggaaaggaactagagattga

SEQ ID NO: 3005 - DNA, 1107 bp, Homo sapiens
atgtcatactgggccttaattttagactttacaccataacttagcacacagcgtccagagtatgctcgacagattcaaacggatctaatactaccctagatctcccagggcatccactagtggtagcagccccaaatcctatgagggctccctggctggctccattctttgcctcagatttaggccacacagaaccacatgtgcatctcagatacccatggccctattccacttccgtgctgcacttgctagcccctcagcagtaacaaccttcctctgtccacttaacactcaaagactagctccactgatcacctaccccaggccaagtgactgtcacagatgaccacattggcacctggccttatcctccaggttgaataaacaccctaggccccatcaaagtcatcaaaaaatcctggtgattccacagagtgctgaataagcacaaaggaaaaaaaggacagccatttgcctcaaatacacctatgcctctgcatccaccttatatccactcttcccttgaaagtgtatgccacctgcccaactatcctctccaaacaccctacctccatagccactaacctcccttacctctgtttagaaagcccaagaatatcacccacttatccaaccaaaaggcttggtccttagcccccattctgcccttcctggccaaataacctgtaccaccatgcctaaagattaacccttgtaggccggatgcggtggcttacgcctgtaatcccagaactctgggtggctgaggcgggtggatcacctgaggttgggagttcaagactagcctgaccaacatggagaaaccctgtctctactaaataaatacaaaattagccgggcgtggtggcgcatgcctgtaatcccagctactcgggaggctgaggcaggagaattgcttgaagccgggaggcggaggttgtggtgagccaagctcgcgccattgcactctggcctgggcaacaagagagacactccatctcaaaaaaaaaaaaaaaaaatagaacaacccttctaaatgtaatccacagctcactcaccttagtccacacaatgaccaccacattttggatgtctccattctgaagc

SEQ ID NO: 3006 - DNA, 1194 bp, Homo sapiens
tgaataacatcggcttctaaatcataagttgatttttaactactgggtttaggccaggcgggcctaggcctggtttcgggcctggcgcggggttgcctgtctttggttttacttccttgttgtttttactgaatataaaacaatgtgagagggtctctctcttctctcatgcatacatactccatgtttgaacaccgcagccattgtcctgtaacataatagcatttgtctcattagctttttgatgttgatatcagatttctagaggaatctgtaggttaaagatataaataaaagtgttgctaatgggctgagaacggtggttcacgcctgtaatcctagcacttcggtagaccattgcaggcagatcacttgaggccagaagttcgagaccagcctggccaaaatgaggaaaccccgtctctactaaaaatacaaaaattagcagggtatggtggcacacgcctgtaatcccagctactcggatggttgaggcacgagaatcgcttgaacccgggaggcataggctgcagtgagccaagatcacaccactgcaccccagcctgagtgacagagagaactatgtcttaaaaaaaagacaaaaaaaaaaaaaaaaggaagaagccgagcatcacaaattctgaaataagaagtctccaaacacgcgggcaatcagttgcacacagtacccccagaaatgtgcgtatggcctcttctaagatgggagaccctcctccgcatctggacctggagtcgccatttcctagcgcccctcgcagtggagcttgcccctttcttcggaaagtcggaagaaagccaccttaagcgctgcccatgtctgggaactacattacccagaatccgccctgcgaaatggtaacgtggctgagccaatgaagcttcagagaagccgtgccattgccggggcacgtaaagtcaagccaggacttccggcgtcctagccgtggcagccattttggcctgtcaggtccatccggcgatgctgggtctggacgagctcgggaggagtggttgtggccattgcacacaggcggatctgaggttcggcgacgccgctggtcgcgacccgggacaggacaacgacaggaacaccgccgagcccgcgttccccccccgcccagagtcatggcggcagcagccgctctgagggcgcctgctcaggtgagcgctgcg

SEQ ID NO: 3007 - DNA, 1205 bp, Homo sapiens
tgcacagtggcaaatgctgttagagtacattattctacatactgaatcttctgtttccatagttaagtttctggtttattaggagacatttttttttctttccagaattttaatgcaagttttactttttcaaattaataaaatgttagcaacagagaataacttgggaaaacaagtagcatttttatttcaatcattcttcatttgaatgcactaggaagctggagaattttagactcttaagaaatttactttaaagccaggcaccatggctctgtagtcccagcttctcagaaggctgaaacaggaggattacatgagctcgagtttgagtaaggcctgggcgacatagtctctttaaaaaaattcagttcatgcgggtgcggtggctcacgcctgtaatcccagcactttgggaggctgaggcaggcgggttgcctgagctcaggagttcgagaccaccctgggcaagacggtgaaaccctgtctctactaaaatacagaaaattagccggacgagccggcatgtgcctgtagacccagctactcaggaggctgaggcaggagacttgcttgaacccgggaggcggaggttgcagtgagccgagatgtgctactgcactccagcctgggcgacagagtgagactcatctcaaataaataagataataaaatccagttcagtaaaatgtgcctgataaaatataagtgactactggcctggagcagtggctcacgcctgtaatcctagcactttgagaggccaaggcaggtggatcacctgaggtccggagtttgagaccagccgagtcaacatggtgaaaccctgtctttactaaaaaatacaaaaattaactgggtgtggtggcacattcctgtaatcctggctacttgggaggctgaggcaggagaattgcttgaaccctccgggcggaggttgcagtgagctgagatcacaccactgcactccagcctgggcgacagggcaagacaccgtctcaacaaaacatatatataagtaatgaatgaatattatgtcaatattctaagtcagaatgttactgtaatactttttaattctcattccatttaaaataactggttaattttcaaatcataatgaaatttttacaaatttatgtgtagtacaaagcatgcatatacattcatatgtattatatgtatatatagcctttaaaaatatt

SEQ ID NO: 3008 - DNA, 1185 bp, Homo sapiens
aacccaagatggaaatgacaaaagttacttaaaatgtgcaacataaaaggtagtcatttaggctgggtgcagtggttcatgcctgtaatcccactttgggaggccaagacaggtgggtcacttgaggacaggagttcgagaccagtcaggccaataccgtgaaacagtctctactaaaaatccaaaaattagccggatgtggtatcatgcacctgtaatcccagatgttcgggaggctgaggcatgagaatcgcttgaatgcaggagcagaggttgcagtaagctgtgatcatgccattgccctccagcctaggcaacagagctagatccttgtcttaaaaaaaaaaaaaaggaaaggagtcatctataattttactacttatacagattacattgagataaatcgcaaaatattaggcaaaactttaaaacaatttttaactatccagtatatcaaagagagatgccacacattgtatttgtttgcaagaatgtcattgtgattacaaaactgaccactaaccattcagttgaagttgattgagaacttaaaactatttccgtctatggccataccaccctgaacgcgcctgatctcgtctgatctcggaagctaagcagggtcgggcctggttactacttggatgggagaacttaaaactatttccttttttttttttttttgagatggagcctcactttgtcgcccaggctggagtgcagtggcgtgatctcggctcactgcaacctccgtctcctgggttcaagtgattctcttgcctcagcctcccaagtagctgggattacaggtgtgtgccactaagcccagctcatttttgtatttttagtagagacagggtttcaccatgttggccagagccaccgcattatttttcagccaggtgcagtggctcacacctgtaaccccgcactttgggaggccaaggtgggtggatcacctgaagttgggagtttgagaccagcccgatcaactttgaagaaaccgtctctactaaaaatgcaaaaacctagccgggcgtggtggcacgtgcctgtaatcccagctactcgggaggctgaggcaagaggatggcttgaactcaggaggcagaggttgtggtgagccgagatcacagcactgcactccagcctgggtgacaagagcaagactccgtctcaaaataa

SEQ ID NO: 3009 - DNA, 1176 bp, Homo sapiens
agaacaaattccccttcccactttgctcccatgaataagctctcttagccaaatgaacccttcttatccattcttatccagggaaccagaacagttcctgcttattactttgtagtgggtttcagttccctatcaattttttgagttattcaaacaagccagtcccctcctctggggaccagtggagcttctccatcttgatgctacaaaacttacattctacagcacctggttgttactcttttctggagtactacctccgtatggccctgtgtggagtgtggtattctttcacaggctatgagtatttgtctttaattaataagctgttcagccaggcgtggtggctcacgcctgtaatcccagcactttgggaggccgaggcgggcagctcacaaggtcaggagatcaagaccatcctggctaacacggtgaaaccccttctctactaaaaatataaaaaattagccaggcgtgatggcgggtgcctgtagtcccagctacttgggaggctaaggtaggagaatggcatgaacccaggaggtggagcttgccccactgcactccagcctgggcgacagagcaagatttcgtctcaaaaaaaaaaaaaaaattaataaactgttgatctcatttgtccaatgtcacgtgtcttatatttggctgttggttatccactctttttttttgttctttgagacgcagtctcgctgtgtcaccacgctggagtgcagtggcgtgatctcggctcattgcaacctccacctctccacctcctgggttctagtgattctcctgcctcagcctcctgagtagctggtactacagccgtgtgccaccacgcctggctgatcttttgtatttttagtagagatggggtttcaccctgttagccaggatggtctccatctcttgacctcgtgatccgcccacctcggcctcccaaagtgctgggattacaggcatgagccactgcacccggcccaggttatctactctttcactcaggtagcatgtggggaagccaggatttgcctgtggtataggacgtagtggtggtcatggtcatgtggcagtgggatctggagacctgaggtatgtgcagtgtaatgaatgatatgcacttggagagggagtgtgcctgatggccccagtgtcctgattgagacttacatg

SEQ ID NO: 3010 - DNA, 1199 bp, Homo sapiens
atgcgctccgccccttcctgcacccggccagcctctgcggcacacacccaacagctacacaggcgcctggggctgcccgggtcgcggacgcaagtcgggccaacgtagcttctccctggcggtcctcctccggccccaggccgtctttaccacccctggaaccttgctgagttgacgccactgagctgcgtctcacacccacgcgctgtggaacacccaccaagctggaatccacgcggtttttaaaatagagtcgggggccgggcgcggtgactcacgcctgtaatcccagcactttgggaggtcgaggcgggcggatcacgaggtcaggagatcgagaccatcctggctaacacggagaaaccccgtctctactaaaaatacaaaaaattagccgggcgtggtggcgggcgcctgtagtcccagctactcgggaggctgaggcaggagaatcgcttgaacctgggaggcggagcttgcagtgagccgagatcgcgacactgcactccagcctggggcgacagaacgagactccgtctcaaaaaaaaaaaaaaaaaattgagtcgggatctcagaagctaagcagggtcgggcctggttagtacttgggagaccgtctgggaacaccgagtgctgttggctaaaataaataaataaaccgggcgcggtggctcacgcctgtaatcccagaactttgggaggccgaggcgggcagatcacgaggtcaggagttcgagaccagcctgaccaacatggtgaaaccccgtctctactgaaaatacaaaaattaggcttgttggcgtgtgcctataatcccagctactcgggaggctgaggcaggagaatcgcttgaaccggggaggcagaagttacagtgagctgaggtcgtgccactgcacactccagcctgggtgacagagcaagactccgtctcaaaaaacaacatagaccagatgctgtaagctaaaataaatgaatagctagagacggggtctcgctatatggcccaggctggtcttgaacttctgggctcaagtgatcctcccaccttggcctcccaaagtgctaggattacagacccgagccactgcacccggcctccacgagctctttttgtaccaatttttcccaatttgtactagggagctctcacctcagcccaggtggtttgggcaggtgtgggtacatggcccaggtcc

SEQ ID NO: 3011 - DNA, 1218 bp, Homo sapiens
cataccaggatcccagacagctgttggactaccccgaatgggtacttgatctctcctctggtgtctggccaacgcccatgctgctcctgaccattttcccttcatttcctgctccctgctgccccaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgaggtagggctctgtggcctggtgagggcaggctgtgccctcagtacacccgaaagccccacggagtgtatgtcaggcttatcccctgtgtggtgtggtcactcttgttttaggtatgaggaaaggggaggaatgcatggggctggatgtcaggctcatatcccccttctctctagaaccctctgcaggtcctggtgaacgccatcatcaacagtggtccccgggaggactccacacgcattgggcgcgccgggactgtgagacgacaggctgtggatgtgtcccccctgcgccgtgtgaaccaggtgagcctggggcttatgcacgtggcagggtggacacagccacgggagtgggtggggtcttgcctggggcaggaaggctcctctctgtctgcatgttttacctgcagcatcacttcctctaggaagccttcctggattcccaccctgcataggggctgatccaggctctgggtcctcttcgggaacacatttggcagaggtcttctttctttcctttgggtgtatatttttacactgtgtgtatatgtactttttttttttttcttggacattttgagaatcagttgcagacattttgattgtgttttccctgaacactgcaggtgtctttaaaaacaaagatgacctacccccgtcgtcacccccaggaaggaatttatattcacagcaatagtcgttgttccatttagcatctgtccccagaatgccagaatgccctttatagtggcgcattgtcaattgggtccaagttaaaagcaaatatattgccttgttttttagaaataattgagatggaatctcagggtgttcttgaattcctggtctcaaatgatcctgtcccctcagcctcccaaagtg

SEQ ID NO: 3012 - DNA, 1178 bp, Homo sapiens
cctgctaggtccaggagcccaggtgggggtggggtggggtgggggcggggagctgtagagtctgacttgcgttcgcggcccgccctgtcttccgcaggggagaagccgcaccagtgcgccgtgtgctggcgatccttctctctacgcgactacctgctcaaacacatggtcacgcacaccggcgtgcgcgccttccagtgcgccgtctgcgccaagcgcttcacgcagaagagctcgctcaacgtgcacatgcgcactcaccggcccgagcgcgcgccctgccccgcctgcggcaaggtcttctcgcaccgcgcgctgctggagcgccacctggcggcgcaccctgcgccctgatggcgctggggcctggcctcgcccacggtggatccggggcctcccgcacagtcggccacgcccgctgcgggacccgtggttcccgccactagaccacgctccctcctgagcgcaggtcctctctctcccttcaccctttctccataccagggcctaagtccgccttactcctctcctccatgtacttgaaccctccaggtggtgccgggctggggctggggctggttagaccacttctgagaactggactatttcctgcgtaaaccgggcgctcaggcgcttggacccggcccaagatttgactccggttctcaccccgccctctcctggggtggtggtgggggctggggggccgcttgcctgccccagggtcaggctgggcaaggtccctagctctctacccaagctgttactccctcatggggcgcctaaggagactcaagtggacccatcatatatgggggctgggcctcgggactctcgctctaataaaggactgtaggccatggggcctaaaccacgaagctgtgagcacctggatcagtgcgtgccttgccctcatagacaagatgtgagtgtcagggttcagcgtccctgttcttgggtggcatccatgcggcccacaggctgtcctgggcaggaacaggatggtccactttgccatctaggacctctattctgtaggggctaaggtgggctgcatatataaccagcacttggttctcttggatccctcagtcctgtggggagtaggataggcaggccacatctgaggtgggtctccgagagggaggccacgtgaaagccccatcatactcctggtt

SEQ ID NO: 3013 - DNA, 1404 bp, Homo sapiens
gcagacagcactggcgtggtggccaagctctcaccagccaaccagcgggtgagggctggggttacttaggtggggttgcccagagaggctttataggtgctgcccagagctgtgacatcccttacaatgtttgtagaaatgtgagcgtgtactgctggccctattctgtcacgaaccctgccgccccctgcatcagctggctaccgactccaccttctccctggtgagtcctaggatgggaaaggggaagggggtggtggctgctgggtctcgccctcaacctgtgcatgtatatgtgtgtctttgtgtgtgtatgtgtgatctctgcctgcaggaccagcccggtggcaccctggatctgaccctgatccgtgcccgcctccaggagaagttgtcacctccctacagctccccacaggagtttgcccaggatgtgggccgcatgttcaagcaattcaacaagttaactgaggtgagccagtggaatggagaggctgtgggcagggggagatgtgaaggaaagaactaggacccattcatccactgcattcctgcttggcccaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaacttcaccagttcctcaggcgttggctggttgggggactgtggtcctggggcctggtttattgactgtatctactagtcagccttatcaagcactggtggcacaagggaggggggtcttgtcccccacctatcgaagcccatgtgtatggatgcctagggagtggggaagactgcctccttgccctttctgggtatggggagggtcacccagggcaaaggatgtacacactagaggcttgttgggtaccctgtgggatactgggtaggtgtgacctacatccctgtgtaggcagggttagccccaggtgtagcacagccactctactgaatgcttcctaaattttggtgctgtagctgtttctcatcttcagaaggtcccacagtgaactgagaccttccagatgtggtttttttccctgtctccctttgctgagtccacttaacattatcattcatctctgtgttatgatttagttactctacagtcgagcctgtgtgaatcccaaggccac

SEQ ID NO: 3014 - DNA, 1128 bp, Homo sapiens
cccaacattgacctcgagggcaacgtctgcctcaacatcctcaggtgaggacactggccctctaatgccctcctcagcgctgcctgccaggcctccctcatggtcttgtgggcactacatcagactctgtcccttcccacccctttgttgtctgtggtttcttgatttcccagtcatcttcctcatggcctgaccttggttttctccttggcctgtcctgctccacaccctccctcccagcctctcacatgctcactctcctatgccctggatctgacctgcccaacaccagaggggcctgtggcagtctcccactcaccaagccctgaccctgatgctctctgtccacagagaggactggaagccagtccttacgataaactccataatttatggcctgcagtatctcttcttggtgagtaggaataggtggttgggtctggggagattggccttctgtccctctggcctgttgaccccccctacctgtactggccacaggagcccaaccccgaggacccactgaacaaggaggccgcagaggtcctgcagaacaaccggcggctgtttgagcagaacgtgcagcgctccatgcggggtggctacatcggctccacctactttgagcgctgcctgaaatagggttggcgcatacccacccccgccacggccacaagccctggcatcccctgcaaatatttattgggggccatgggtaggggtttggggggcggccggtgggggaatcccctgccttggccttgcctccccttcctgccacgtgcccctagttatttttttttttttaacaccatgtgattaaggtcggcgctgcctcccccgacccactcagcgatgggaaatgaattggcttgtctagcccccctgctgggtgcttgttcagcccccactctgggctgtggagtgggtgggcaacgggcctgggtagctgggcccaggcaacccacccctccacctctggaggtcccaccaggctattaaaggggaatgttactgcatggcctctgcttcttacttctatggggtgggaggggcagctgaggtccattagggcctgcaaagctggggtggtggaaggtgtggtcacaggtggcattggagcaccct

SEQ ID NO: 3015 - DNA, 1158 bp, Homo sapiens
cggggcgcccgaggccgttgccgacctccgcgctaaagccgctgctgccgcggaagacgatcctccagtacccgcccgccgtcaccgcagctgccgtgtcctcctcccacccctagccgcaccccctcgcggagggatcagctgagcggccaaacggcacggtcgggggagccccgagtccgcagctgcagcggggcctgagaccagagttggcgagggcaaggaaggagcggccccgggcagtgggggcggggccgggcgggcccgagaacagccgaatttggccgagcgctgccgagcgagtccgaggcgctgggccaggccggagccggactacgggagccgaggcgggccgcgcggtgggcgcggagaggagcggagcggcgcggcaggccgggcgggtggcggcagcagcggaggaggccgcagctgcgggtccgaggagcggaggcgacgcgggcggcggcggggggccgggtggccggggtcccgggccccgcggcggcggcagcggcggcggcggcggcaggatgatcaagctgttctcgctgaagcagcagaagaaggaggaggagtcggcgggcggcaccaagggcagcagcaagaaggcgtcggcggcgcagctgcggatccagaagggtagggggtcaggggatggggttggagccggaggtcggaggtcagggcctgaggcagggtgatgtgggagtcaggaaggggtaatgcggttgctgagggtcagaggtgaagggccccgagcgtggggggggtcggaggtcaagtcttgagggttgggatcatgcagtcacggggagggggtcagagataggggcccggtatgtggtggtttaggatattaggaaggcctggtgtctgctactagggactcggaatctcagagtcaggcagtggagtggaggaactgacgactcgagagtctgggggttagacgggaacttgggtttggggtgacaggcggagaagagagggatagtagaggccaggggttggggatatgagtggaagaggatttagtttattatgctggggtctctgggaatctctgagtcaaacgggtgaagtaggttggaggaccagggactcatgggcctgcctgagtcacagcaatttggggtttggggtgacaggtggaggagg

SEQ ID NO: 3016 - DNA, 1229 bp, Homo sapiens
aagagaataatcccattccacttagatctctacaaacacccagttctctggcatgtgtcctactctgataagggcaggggccacgtgtttaagatctggaggtccttaagtcttctcagaagccagtgctgccttcaacacccggcagttctggtgggggtgtcttccgtggtgcccagccctgggccgccccctccacgggcacgtaggtgaatcagggtggacccactgctaagcagatgaatgactacctaaggtagctctcctgagtttgctctgatagagaacaagggctgctgattttcggaggcaccctgacacccctccccatccaacagatgtgcggagcagctctgagttgccttctctgggtggaactgcatctgctccttctttcctgggaattcagaatcattcttgagaaatcactctgcatctgtgtcattctcccaactcacttctctaggctccgttacgctttctctggggcagtggtccccacccgcactgtgtgacactgcttccgagattccccgggtgctcctctgtctctgagtctgtctctgcctctgcctctctctgtctctcagaggtctgtctctgtctctgcctctctctgtctctctgtccctctctgtctctgtctctccctgtctctgtctctctgttgctgtctctgcctctgtctctgcctctctctgtgtctctctgcccctccctctgtctctgtccctctcagtctctggttttgtctctgtctctctctgtctctgcctctgcctctctctgtctctgtctctctgtctctgtctctctctgtctctctctgtctctttgtccctctctgtctctctctgtctctgtctctagctctgcctctgttagtccctctctgtctctccctgtctctgtctgtcactgtctctgcctctgtctctgcctctctgtgtctctctgcccctccctctgtctctctctgtccctctcagtctctggttttgtctctgtctctctctgtctctgcctctgcctctctctgtctctgcctctgcctctctctgtctctctgtctctgtctctgtctctctctgtctctgcctctgtctctctctttgtccctctctgtctctgtctctctctgtctctgtctctagctctgcctctgttagtccctctctgtctctccctgtctctgtctctctgtcgctgtctctgcctctgtctctgtc

SEQ ID NO: 3017 - DNA, 1189 bp, Homo sapiens
cgatggcagggagctgcggactgcagaccaggaaacacccagaactcgtgacatttcatgacaacgtccagctggtgctgttacagaaggcagtgcaggaggcttccaaccagagcatctgcggagaaggaggcacagcaggtgcctgaagggaagcaggcaggagtcctagcttcacgttagacttctcaggtttttatttaattcttttaaaatgaaaaattggtgctactattaaattgcacagttgaatcatttaggcgcctaaattgattttgcctcccaacaccatttctttttaaataaagcaggatacctctatatgtcagccttgccttgttcagatgccaggagccggcagacctgtcacccgcaggtggggtgagtcttggagctgccagaggggctcaccgaaatcggggttccatcacaagctatgtttaaaaagaaaattggtgtttggcaaacggaacagaacctttgatgagagcgttcacagggacactgtctgggggtgcagtgcaagcccccggcctcttccctgggaacctctgaactcctccttcctctgggctctctgtaacatttcaccacacgtcagcatctaatcccaagacaaacattcccgctgctcgaagcagctgtatagcctgtgactctccgtgtgtcagctccttccacacctgattagaacattcataagccacatttagaaacaggtttgctttcagctgtcacttgcacacatactgcctagttgtgaaccaaatgtgaaaaaacctccttcatcccattgtgtatctgatacctgccgagggccaagggtgtgtgttgacaacgccgctcccagccggccctggttgcgtccacgtcctgaacaagagccgcttccggatggctcttcccaagggaggaggagctcaagtgtcgggaactgtctaacttcaggttgtgtgagtgcgttaaaaaaaaaaaaaaaaaagaatccctatacctcatttgtatttttaaaatgcgtgatgttttatgaaattgtgtccattttttaggtattagatatggcagaaaaaccatttccactatgcaaagttcttttagacgtcagtgaaaatcaactctcatacctcatggtctctctttaattgaccaaaaccttccatttttctctaaatacaaagcgatctgtgtt

SEQ ID NO: 3018 - DNA, 1200 bp, Homo sapiens
aataagtgtatatatgtgtgcatttatcagttagtatacatacatatatttcctagctctgtctgctaagatagtagcagtgacacccagcagcaataagctcaccccaaatgcagatcttggtttctaatactattctcctataaaagaatccagggatccttggataagttaccaatttcagggctctacaggaaatacataacatgatcccaaagcatcttttagttccagaaagaaaggaactgctgaaacagcacaattatgtggacatgttaaagggacaaaggtgtcaacctgctagagctcccaaggatgaaagctgaaaaactttgagcagcaaaataaataagagtattggattaaaacccaaagtataaaataaatattcatgagttcacactgatataaataaatgattgaatatgtaaataaaaaagatttcttagcctgttttctgatgttattattgaatactaaagactaggtaatttataaaaggataaatatatatttctcactgttctggagactggaaagtccaagagcaagacactagcatatggtgacagtcatcccatggtaagaaaccaagcaggagtgagcatgggagacagacagtgaggaagcaggggggagagagacagtgaggaagggcggcaaacattaggagaccactcctgaaattactatcccattctccaggaaatggtattaattacttcatgagagtgcagccatgatgacttgattccctcataaaggttctgcctctttatactgttacaatggcaattaaacctcaacatgggttttggaggggacattcagcccggagcagtgagagaaggaacaaatctgcctcacagatgaatttcaaataaattatgtagacactctaccctcaaggagttggagcataaattaccaccacttaagtatgggctggtgacagtgacttccttccaaagagtacagtacaaaaagggatgaggggaaagacccttatagaggagcaacttggccaacactacctcagtcaggtgatcaagcccaacatcaatagccctaaatcatgttgatggcacttacctttgataggatattatgagtgttgaaatttacctctatggtcttcctctccaaaatatagccctccagtctagctttgagagaaatgtcagacaaatccagattgag

SEQ ID NO: 3019 - DNA, 1154 bp, Homo sapiens
ccctgcgtgcgaggcacacagtaggccctcagctcggtcagcaccttgtgcgctcctggggctccatgctccaccccgcgtgcgaggcacacagtaggccctcagctcggtcagcacctcgtgcgctcctggggctctgttctctacccggcatgcaaggcgcacagtaggtcctcagcttggtcagtgcctcatgtgctcctgggtctctgtgctccaccccatgtgcaaggcacacagtaggccctcagcttggtcagtgcctcatgcgctcctggggctctgtgctccaccccacatgcaaggcacacagtaggccctcagctcggtcagtgcgtcatgcgctcctggggctctgtgctccaccccatgtgcaaggtacactgtaggccctcagcttggtcagtgcttcatgtgctcctgggtctccatgctccaccccatgtgcaaggcacagaatcctcagctcacacatgcactatttctgtgcgtctgactcttggtggtacctgacagcacatggtctgttttcctgaggcattttgagtctctcactgttgggactgtgtctagactatggcaagaggttggcgtggctggggaaggtgtggaccaggtcagggggctgtgaggccaaggagcctggtggcctggctagcgtctgttctgcagccaactttgtggtttgttacttgaagttatctgtacagcaaccctttggggaaaaaagtagtaattacacagcttcattgtgaaaagtcaacgtgaagacagaaaaactgggtgaaagttgaaaagcaggaacttgaggaatgggtctcatagaacgtgtgagtgtggcctgtgagttgggagagaggcaggattctgtccaaatagtaatgaatttgcaacatcaggtataatggctgcctgtggattgcctcataggaagtttgtgtagaagtatgggacttaaatgtacctaatcaaggtctatttcaggcattaaataaataaataaatagataagtacttaagccaagctggtgtgccacagtggctttgcaaaaacatggtaaacagatggtgaggagattgttcctctgggcaggtgctgcagactccaagataaaagcatgagggtagaggggtcctgggtgtggtggaggggg

SEQ ID NO: 3020 - DNA, 1141 bp, Homo sapiens
tttgctgacagataactaaccgatgatgaggccgaggtaaaagagacatctgcagtgtgacagaagggagcatgagaagcatggctcaccagccagcctctgtggtctttgtaattagaagcttcagaactcactaatactactgtacctttcattggcgcattaccccataaaactttttgagacgaggtgagatctgagtataaagataggtcagaagtattttaaagggcttaatgtgccaaaaagaaaaaaagctagagaccctttttgcaaacatttggtgaccacacatttgagggaagacgtggcgttaggtgaagcagaagcaaaccctgctcttaggggctcacctaggtgagtgcacagcctgtgacgctacagggagaggctgagtaaaccgagatccagcgttctgtatggcaggggtattgcttatcacagaggttctgaagagtaggaagtacataatgaagagggctttaaaaattgccaacaaagtgagtcaccagggctggcagtagtgtgacggggctgtcctgagctgttaggagagtagatgcggggagggctggtgacctccgtgggtttatatgtcggaaactcttctctccaaatcccaggcctggcttccagcaccatccagctgtgcccaagaagccaccctggtctgttctccaactcttttaaatggtgcccaacttttctaagtgagcttagcaatgagaagaaaaaaaaacatgaattctttttctggaaaatcagggagacatgggtaataataggtactaataaatatttatagatgagtgaatgaggaaataattacatcaaaaaggtcagtgacaattgataaatgacaaggaaatatttaattaggtaaaactaaatcattgctctctatactaggatagactttatctacttcatctgttcctaagtcagcatgttagttctggggaaggatcataagaaaggaaatactttttaaaaaaaaatttggaaacatgtaacaaagcaagggtaaaatatatatatatatctatataagtgctgtgactgtaaaagtgtactttccattaattattagccgagttaagagaatggtcacattgaagtactgtgtggactagaaatgtac

SEQ ID NO: 3021 - DNA, 1127 bp, Homo sapiens
aattatatactactcagggaaaaaatgaacaaaaataactactcatccttcaatttcattttcttgaaacagtaagagtataatttggtatgcctcagctgtcaccattttataagtggctcattctgttcttaaagtaagtatttttattggaactcagggtaattgggggaatttatttagcttctaaaatatccggcaggatagagaagatttatttggcttcaaaaatgtctggtgaccacttctcttattagccactactgcccatttgcttcaaaaatatatttattggtctccaccatgtgtgacacacacaggatttccaaacataccacttttgagaaaaatgtgcagtaaaaaggaggtttctagaaagtgacagtaactcacatttaagcactagctgacctaggaggagacctggatcttcattctggttctgcctttcatgagacttaagacttggaggagccacctgtcctgtagaccccaagttcctcagccataagcaaacgggttaatcctaagagttcaggaccagttgggtgtcgtgaacggagccattagcaaggtctgtaggattcaaggacttgggcacattcacagtccacactattgtcatggtcattgacttactacttgagctcaaagccctgacatttcaaaaggttgtcatgataacagtgaaacctctgaatcccttaaatcagaaggcatggcaacatactttttctactggcaatagctcttacaatgagtgtttcataatgaaatagtctctgctgaagaaaacatgttttccttttgctctctctgctttgttggtttctgtgctgtgtggaattggagaagatatatgctctgaaatattttatacagattactgactactggacagggtttaccactatataacatctcaaagttattcaaggatatttaaagcatatttagtttagttacaccttattttaaaccgcagaaaacaatagctttaaaatttttgccattaaaataattataaatttatacttttactcaaggactagatcacagttttaggacaaaaatctctcctatttaaagttcataccttgtaagtatttagtttgtatattcatgaa

SEQ ID NO: 3022 - DNA, 1224 bp, Homo sapiens
attgcctgcacattcttggtatcttagtattattgttgttgccagtgaaaaaaactcaaagaagaaagaatacacatgaaaacattcagctctcacaatccaaaaagtttgatgaaggagaaaattctttgggacagaacagtttttctacaacaaacaatgtttgcaatcagaatcaagaaatagcctcgagacattcatcactaaagcagtgatcgggaaggctctgagggctgttttttttttttgatgttaacagaaaccaatcttagcaccttttcaaggggtttgagtttgttggaaaagcagttaactggggggaaatggacagttatagataaggaatttcctgtacaccagattggaaatggagtgaaacaagccctcccatgccatgtctccgtgggccacgccttatgtaagaatatttccatatttcagtgggcactcccaacctcagcacttgtccgtagggtcacacgcgtgccctgttgctgaatgtatgttgcgtatcccaaggcactgaagaggtggaaaaataatcgtgtcaatctggatgatagagagaaattaacttttccaaatgaatgtcttgccttaaaccctctatttcctaaaatattgttcctaaatggtattttcaagtgtaatattgtgagaacgctactgcagtagttgatgttgtgtgctgtaaaggattttaggaggaatttgaaacaggatatttaagagtgtggatatttttaaaatgcaataaacatctcagtatttgaagggttttcttaaagtatgtcaaatgactacaatccatagtgaaactgtaaacagtaatggacgccaaattataggtagctgattttgctggagagtttaattaccttgtgcagtcaaagagcgcttccagaaggaatctcttaaaacataatgagaggtttggtaatgtgatattttaagcttattctttttcttaaaagagagaggtgacgaaggaaggcaggaatgaagaagcactgcgtggcctccggtggaatgcacggggcacagccgcgactctgcaggcagcttcccccccatgccagggctctgcgccgtcatgtgagacttaaaaaaaaagttgaatgacttcgtgatactttggacttctaaattaaatttatcaggcataaattatgtagaattagaggctttgaaaataatactggtaggttgctcaaaggttttgaa

SEQ ID NO: 3023 - DNA, 1134 bp, Homo sapiens
ctgctttctatccctatagatttgcctcttctggacatttcatataaacagaatcatataatatgtagtgttttgtgtctggcttctttcacttagcctaatgccctcaaggtttatttgtgttgtagcttgcatcagaacttttttttttttttggcagagggtctcactctgtcacccaagctggagtacaatggcacggtcatgactcactgcatcctcaaactcctgggctcaagggatcctcctacttcagcctcccaaatagctgggattacagatgtgcaccaccaccctcagctgattttttagagatggggtctcactttgttgtccacgctggtctcaaactcctgggccagatgatcctcctgcatggcctcccagagtgctggaattacaagtgtgagccaccacacctaaccttttttaaataaaactcttatagtgtggtaagataacacgtaacataaaagttagcgttttaacccttcttaagctacagttcagtggtattaagtacattcattttgtcgtgcaatgcaaccagcaaccatcgtctgcaactcttcatcttgcaaaactgaaactctatacccattaaacagaagctctccattccccgctggcaaccaccattctactttctatgaatttgactactctaggtacctcatataagtggaattatagaatagttgtctttttgtgtctagcttatttcattttgcataatgtttatgttgaaacatgtatcagaattttgtgcttctttttgtggctgaataatattacactgtatagaaatactactttttttggacggacgtggtggctcacacctgtaatcacagcactttgggaggccgaggcgggcggatcacgaggtcaggagatggagaccatcttggctaacatggtgaaaccccgtctctactaaaaaaaaaaaaaaaattagccgggcgtagtggcaggcacctgtagtcccagctactcgggaggctgaggcaggagaatggcgtgaacccaggaggcggagcttgcagtgagccgagatcactccactgcactccagcctgggcaacagagtaagactctgtctccaaatacaaaacaaaacaaaacaaagtacta

SEQ ID NO: 3024 - DNA, 1072 bp, Homo sapiens
ctcttctaacattatcctcttgtgctaattgattgaccattttaaataacttagctgttacagaaagaccgaaaggtgttcttcagtaaaatatattcaagtaagttacttaagtaacgccttaaaagatacagaaaagcaaaaaagtattggcgtattaaaaagaaatcaaaactttccaagtttaggcctgaacattgccttaaaaatatttaataaggcctcaaatgacccagtccgagactgcatgagcctatttattattaaattgtaaatattcttcatataaacaaaaatatataaccatgtctgtaacaaaaatggttttgctagcgttgttactctcttcccttctccgaggggtgatttaggcaacttcggaggttgacaatgccaagcagtcacaatagatagagctttaaagcaaattctatgcatgggtttggatttatgacaggcccgtcaccctgggcctgtcatagtaccccatgccagagcaaactgtgtccccgaaccattgcctggcctctgtgcccgtaggctgctggcactgaagtgggttgcacagtggaaaagaagaaagctctacctggcagaaatttttaaaggttaaaataaataattttaagaaagctggttcacaaggtgccacatttgatgaaagcaaaatacagtggcttttattgttactagagtgatgttcttgcttgtttttcttttttggtgaagttagccccaaattattctcatagctaagcaaatacgagagtgactgtaaggacagttggcattcccggaattgctaaacttggtaggcaacgctggtttaagaatactgagttctagccgggcgtggtggctcacgcctgtaatcccaacactttgggaggctgaggcaggcggatcacctgaggtcgggagttggagaccagcctgactaacatggagaaacgccatctccactaaaaatataaaattagccaggccccgggtgtggtggcacatgccggtaatcccagctactcgggagactgaggcaggagaatcgcttgaacccaggaggcggaggttg

SEQ ID NO: 3025 - DNA, 1278 bp, Homo sapiens
aattcttgatattttgaaccattcacgaagatagtttgagtcatgagcatgctgttgtctagagtgggcggggatgactcattggagtggatgcgctgctctgtacttgatttttttgagtctgaaattagctttccaggctggggcagggaggggagcacaggtggatcagtactgcccccaagcggtggagctgtggtggtggatcaaatactgctgccgcctgtctgcacaaacatatttctctcttccagcccttcagaagtgtattggaatatgtcgataacaataatgatggtagtgaagatgatgatgatgtgggtaattctggctaccttattgggtccaagctccccacaattcgttgcacaaagcactctacatacattctctttagtcctgatcaaaccacctttcagagtaggatttagtgtcctattttaaagatgaaggagctcgggctcagagagagatcgtttagacacacacacaactttggaatgaaacatttacagccgggcgcggtggcgcgtgcctgtagtcccagctacttgggaggctgaggctggaggatcgcttgagtccaggagttctgggctgtagtgcgctatgccgatcgggtgtccgcactaagtttggcatcaatatggtgacctcccgggagtggaggaccaccaggttgcctaaggaggggtgaaccggtccaggtcggaatgaaacatttacaaaaattgacatttccttatgcatagatatttcactaggtccttaaaacccacgtgaatctgtgattagaaaaaaaaaaacaaaacaaaacagatcattgttctccaaaccaagggtaaattttattggagccctgtcctggtgatagcctaatccacactctgaatattgtctaggtatcttgtcaaactccgggccccccaaaaaacgccacaaagggtggtctccagaatctccatcagctccagatggtggctgcccccaaggtggtgggaacagagctaagtatggtaagtgatggcagccttgcccagaattccagacttgggtactggtggtagtgctgctgccagttgtgtgtatgtgtgcgtgtgtgcgtgcgcacgagtgtgaatgtgcgtgtgtactgatgagggagttctaaggaggcagagtttggtgtgacaaaagacctctttctcacatgttaaaattgctttgcaaggtctaggatccgtgtatgatagtgagttctctgatccttgagaaattttaaaaggggctatttatgac

SEQ ID NO: 3026 - DNA, 1190 bp, Homo sapiens
aaaaacgcagagcagcttcttttgttgataccagtgcacagtcttttgaaagggctggtttctgtttggcccttagggaggaaagcgtaatggtggttactgaggtggggtatgaggaagcctgtcctatctcccattccatcatggcctggaactcagttcttaaggtttctctggcatctccttgtcccagagggggtccgttcagtcagttgcgagcttagaattttatttctagtttattttcaggagtggcgaaggttctggaagagcaggtaggaccaggatattgatgtggctagttttagaagacaatctgccacacaaatggaaagaaacaaatccttgcaaatagacatttcatgcccccacctaatgtggattttgggatgatgtctcctgattggtcctttgagttaagttcaagaggaaactcttccttgagtatgtgtgaaggatcccagccaatagttgatgagttttccagggtgtaatttctaatgtctggggctggggaagctttgattgcagcttgaactctcaccagccatgtgaccctgggctggttactcctcttgtctggcctcagctcctcagccaaaaaaggaggagctagaccaggtggtctcggaggaatctttctattagcttgctgcaaaaataattgcagtttttgccattatttttaataattataataatggccaaaactgcagttatttttgcaccaacgtactgttttgggttccatctttcctggtcagggacctgccctcccgaacccagaactcctccagtcctcaagtgacagttcccttggatgggacggcctgactgagactgggagttgtgtggcacttcagggtgtatgcgatgatagcgtatctgtggagacttggccgtccccatgaggtctcctgtcctggtgaaggcagttcattcttttcttaaccatgttttcccttcaggttgacatagaaatcaatggggaatctgtggatttgcatatgaaattgggagataatggagaagcattttttgttcaagaaacagataatgatcaggtaaggaagcctgggtggtcagggttacttcctagttttgagctttgagtaatggttatctggaaacacggcagaagtttgtgcaaagtaataccggccgtggctgtgtggacgatggggcagaga

SEQ ID NO: 3027 - DNA, 1133 bp, Homo sapiens
acctgtatacccagccatttccctatccacccttccctggattatattgaagtaaatcctggacagcatattattttatctgtaaatatctcagtgtgtatttctacaaaataaagactctaaaatataaacataataccattagcacatctaaaataattaacagtaatctgtcagtatcttcaaatatccagactgtgttctcccctgcctcttttttagacaggttctcactcattctgtcacccaggctggggttcagtggcacaattatggctcactgcaacctcagaactcctgtcctcaagcgattctcccacctcatcctcccgagtagctgagactgtaggtacctatgactacacctggctgatttttttttttgtagagatgagatctcactatgttgcccaggctgatcttgaacccttggccacaaacaatcctcccaccttgtcttcccaaagttttgggattacagacatgagccactgcatccaacctatgttttcttttaattcattgatctgctctccatatcctccttctgtctgttgctcttttgctttgattatgtgtgtgtgggttctgaaaaaaaaaaaacccaggccatttattttgtattttctcactgtctagtttttgttgattgcatctttgtagtgttgtttaaagtatttttcttttttcatcaatattttctccaaattgagagttagattctgagggataatatgattttatctgcactagatatactcctttttttgtgaaatattttactgtaatagaatcatttgagaagaatgaatgctctgggcaagtaatactcataatactagcctgactttggaccacagtctcttttgccctggtgagcagggttaattacgtgttagctctaaggatttgcttagggtaggaacaaccaaaataggttgcttcaaggcatcgtctcaaagttttttacttccaatttgctgagatgaaaatttgttagagctgcataaaaaggcagtagggaaaaggctttgtgtgtaggcccaagctgtgtttctgtgaagaaagtgcatttgaattactttatggtttttgagattttgagttgggctacattccataattaaacctag

SEQ ID NO: 3028 - DNA, 1190 bp, Homo sapiens
tggatagtttccatttatttgttttcatgttcactggtggtttcttccacatgtttaatgtgctgctaatccctttggccgtatttttcttgtcagatattgtctttttcatctctcaaagttttcttttcttttttttttttgttgttgttttgttttggtttttgagacagagtctcactctgtcatccaggctggagggcagtggtgagatctgggctcactgcaacctctgcctcctggattcaagtgattctcatgcctcagcctccggagtagctgggattacaggtgtgcatcaccacacttggctaatttttgtattgtttagtagagatgggattttgccaggttggccaagctggtctcaaactcctggcctcccaaagtgctagtattacaggtgtgaaccaccatgcccagccatctcctgaagttttattggtatttttagtatcttccatttatcttcttatcatgttcatgtttttttacattcttgaattattaatgtaaatttataatagctgttttaatgttctgtctgctaatatcatctgctctgtcatttttagtagtgtctatttctattgattgatttttctgctggctctggtttgtatttttgtgcttctctgcatgtttgctaagcctgtcaatttttactagatgcccaacgctgtgtattttgtgctgttaggttctgggttttgttataattctttaacatgaactcctttatttcctgacatgtagttgagtaacttagcataagcttgacgctctctaggattgcttttaaactttgttttgggagaacctaaagcaacttttattctagggctaatttaaccctattactaagtcaatactttttggatgactatatcaactattaaccaattttcatgagctcccagaattgtttagcctcctagtttctgatgtttcttcttcctcttcccctcatttcgtcgagtttttcccatgcatgaagagataactagtcagtcaaagagttagggctggcccctttgcagatctccagacctctctctgcagcttccctttttttttttttttccagtattttgcctgcaagttggctttctggaattctgatttctgtcctcaactcagtgagactgctgggtcttgtttgggttctctttcctgcactatgtactgaa

SEQ ID NO: 3029 - DNA, 1162 bp, Homo sapiens
tgaacctgggaggtggaggttgcagtgagccgagatcacaccactgcactccagcctgggcaacagagtgagactccacctcaaaaaaaaaaaaaaaatcagtggttttggccgggcacagtggctcacacttgtattcctagcactttgcgaggctgagatgggcggattatttgagctcaggagttcaagaccagcctgggcaacatggtgaaaccccatctctacaaaaaatacagaaaattagccgggcatggtggcacacacctgtagtcccagctgcttggggactgaggcaggaagatcacttgagccaggagattgaggctgcactgagacaagatcatgccactgcactccagcctgggtgacagagtgagactctgtcaaagaaaaagaaaattcagtggttttccactctaattaaagcttaagtaaaatgttattacattaacgtttttgatactagtctaatgttcttgcctttgtgttatactattttgacttttactatcagtgtttgatgattaatgtattactaatttatatatttcaggaacttattttttcgtatctcatatttaacacaaatggatgtaaaactggtatttgttatggaaggggaaccaccaaagctgaaagctgatgtcataagcaagaggaatcagtctcggtatgggtcttctggaaaatcgtggtctcagaaaacagggagatcacattttaaatcagtcttaagagaggtgagcattcagatttgattcagtaattccgatttgaattaaagggtgcattttactcttaatagtttgtcatctttaatacttattaattttattgtgactagcagggatgtgcctagagaaaagagtttattttttagagtgaaattgacctgagtttcattcttggcactggtatgtagaaactctgagacactgagcaaaatttgtaacctatctctaccttgtatgttaccttgtgaaatgacaacagtaatactcagcagggatgtgataaaaataagagaaagtatatctaaagcaactagtacatggtaggaacttgatcatattaccttttataacaccttcaggacttaaagaagtcccagaatacatgagatctcattaattcgtacttcactcattcagaattcatg

SEQ ID NO: 3030 - DNA, 1093 bp, Homo sapiens
tcactcctccactgcataggtgtgcctgttaccctcgaagacatgatataagttcatgatcttctgactacaaactgattctgatgaaagtcaggatccaggagctagcgtcttattgggtgtttcctattgcatggtttaacccaactcctcaacacctgaagtgtaattggcactggcacttcatcggtcacactggaatgagggcagagcaatggcacccactgcctgcctgtctaggaatccttgtccagaagcaggactctctctccccacctccctctctccaccctccccttcgctagcaatcttggtaaaattccaggttattgaggcatctacttgggaacattttagctaacagtttcttcagctcttctttatggttttgtataaccctatttagggcataaagtctgaaagctgaattatctcacaaaggattttaaaggagaattaaatctgatacaattttttttctctctttagtacgttttgccaacctatgaaatggccgtgaaaatgcctgaaaaagaaccaccacctccttacttacctgcctgaagaaattctgcctttgacaataaatcctataccagctttttgtttgtttatgttacagaatgctgcaattcagggctcttcaaacttgtttgatataaaatatgttgtcttttgtttaagcatttattttcaaacactaaggagctttttgacatctgttaaacgtctttttgtttttttgttaagtcttttacattttaatagtttttgaagacaatctaggttaagcaagagcaaagtgccattgtttgcctttaattggggggtgggaagggaaagagggtacttgccacatagtttcctttttaactgcactttctttatataatcgtttgcattttgttacttgctaccctgagtactttcaggaagactgacttaaatattcggggtgagtaagtagttgggtataagatctgaacttttcatctgcagaggcaagaaaaatatttgacattgtgacttgactgtggaagatgatggttgcatgtttctagtttgtatatgtttccatctttgtgataagatg

SEQ ID NO: 3031 - DNA, 1397 bp, Homo sapiens
agctttacctgtgatgttactgcttttgcccgccctcaggaagctttcatttaggtggagagacagtgtgagaaggtccctggcattcctgagacaggtgcaccgggtcagcttgcctgtggtcagtactgtggggatctcggggaggggtggcctgagcctcccctggcaagtgtcctgctttttggcagggcctgtaagggtgggggcaagcttatggggcaaggggggtgtgccgtgggaaatcttgggtcttggggccattgagtcaggagagcagaacaggcggcggctggacctgctcctgcactcagtcacttgcccagcgacctctcctgctgcgctcggggcttcccgaggctgccactggttcctctccccactgggagcccctcaagggtctctgacctcctggcttttatggcttcgtggctgcctaattttgtgtagaggatgggcctcctctggccgtcagccctgggaaaaactctctgcctagtgattcacctgagggttgcagcaccatgagatgctgtgtgtgtgtgtgtctgtgtgtgtgtgtgtctgcgtgtgtatgtctgtgtgtatatctgtgtgtctccatgtgtctgtgtgtgtgtccatgcatctgtgtgtctttgtccatgtacgtgtgtgtgtccctctatgtgtctgtctctttgtgtttgtgtgcgtccgtgtgtgtgtccgtgtgtacgtgtgtctctgtgtgtgtgtgtgtctgtgtgtttatgtgtctgtgtgtgtctgcgtccgtgtatatttgtatctgtgtgtgtctgtgtccgtgtatatgtgtgtctctgtgtgtgtgtgtctgtgtgtgtgtgtgtctgtgtgtgtggtgggggggtgcttactgcacaggttgccactgcatttgggccttgcctgggcactcctgacttgccttcccctgtcaggctgcagtctcagttttggggggcctggtcactacctggctgcagcttccttttcagacaccagcttcctttctgcctcccacctctgctggtggccttttctctttttcactgtggctctgacatccatcatggccttggccttggaaatctgtgggagttattcctacagagacgggcagtcaggtcacctggccttcctggttcagctgagccccgactgtttggctgtggcaggccattgcctctctgggcctcagtttcctcctctgccaaagggtcgttcttcctgtcctcagttctgagagccacatggttacagagagaccttatcctgggaagggcagaggtggcactgaaggacttgttgggggctcacatttctctgccagtattctttcttgggactcgaaggagagttggttgcccaaggggtcatcggtgggatgggca

SEQ ID NO: 3032 - DNA, 1172 bp, Homo sapiens
caagcttgttctgcacagactgcagtccatattggttttaaccgatttcagccagttttgttatcttagagagtttctgcatttctttctgcaaatttgaacagagtttctgcatttctttctgcaaattctttcttttcatatctgccatcctgcaaactcaagaattttcattagtcactgctttctttaactttttggagcacagtttcagttttttaaaacaattactatgacaattaaaatagtgtggtactggactcaaaatgtatgagtagatcattgaacaagattactttgaaatagatccatgtgtgcatgcatgcttgtttagggtagagtgatgagatgaatttcaaatcaatgccaaaagaatgattatttggaaaataacttgggggggcggttattgggtctcattcctaatggactgaaatttttaatgagaaaaacaaaagcataaaagatttgatacaatttccttgttgatagccaaacaaccatggattaaaacaaaatttttaaaaaattttttaatttacctattaggttggcgagtcttcagaatgtttgataatgtcctgttttggcaggagtgtaagtggcactcatacttttggaatgtaaactggtacagttttcctggaaaataatctagaaatgtggatcaagaatttatatgacagaaacaggaaagtcaggtgtgttggcacctgcctttattctccgctactggaggttgaggcgggaacatcagttgagcctaggaggtcaagaccagcctgaactctgcaacatagtgagacgttgtctcttaaaaagagaatttatgtttttgtctgttgaagtaaattttttttaaggatatagtaatgtacagacctgtgtatctaaagagaataatagcattatttatttatagcaaaagattatgaaccatctaaatatataaaagtagtagattgattatatcatgttccttctatacagaagactacatattatgtagccattaaaaagaatgagtggctgggcacagtggctcacgcctgtaatcccagcattgtggggaggtcaagttgggtggattgcttgagcccaggagtttgagaccagcctaagcaataggcaaaaccctgtctctacaaaaatcagccaggtatggtagtgcg

SEQ ID NO: 3033 - DNA, 1141 bp, Homo sapiens
gacgaactattcaatgggctttgggctctgacctgtttaaaagaatttctctgctgcagatgtccagttgaatactttttaagcccagaattagccttttcttaaaaaaaaaaaaatttcaggccaggcgcagtggctcacgcctgtaatcccagcactttgggaggctgaggggggcggatcatgaggtcaaaagatcgagaccatcctggccaacatgatgaaaccccgtctctactaataatacaaaaattagctgggcgtggtggtgcatgcctgtagtcccagctacttgggaagctgaggcaggataatcacttgaacctgggaagtggaggctggagtgagccgagattgcgccactgcactccagcctggcgacagagcaagactgaaaaaaaacaaaaaaaaacaaaaaaacaaaaaaaacaaaaaacagctggtctgaaggtagtgagttatcgcattgattgttcacagtcagttacagactgaaccccttgttctacacttttcccccttctcgctactgcacttgactagtcttacaaaacatttaaaaataaaaaatttcgggattagagggcctgatagttcaagtttattattaaggtaaataaaggatatcaacttctctagtttaacctctaaagcaaaataaatcattgacaagacttccactagagcaaatagcatggtaattaagatgctattacctgatttgaccaatttatcatctgtttagttctgctacaggccagtctctgtgctaggggttagggaggcagagatgaaggagagcatttctgcctgttgagaagttcaccctcttgtaggagaggttggcataaaccagtcataataaaagtcttaatgataatagtttcgagggtccagactcggattgaaaatgctgaatgaaaaaagaaaatagttgccaagtgttgtgactcatgccagaatcccagctacttgggaggccaaggtgggaggattgcttgaggccaagagtttgaggctgcagtgagctatgagccagcctagatgacagagcaagaccctgtctctaaaaaaattaaaaagtggctgggcgtggtggttcacacctgtaatcacgcccagcactttgggaggccgaggc

SEQ ID NO: 3034 - DNA, 1150 bp, Homo sapiens
aaagtaatgttctttatggaaaattttaacaaaagaaaaaccatgcaaatttcatcacccagagataaaaaaacaattaacattttagaatctattatttgtcactttgtagcagaattgggatcgtactatatatatcattttctttcctgctttttttcctcttaaccttgcattgcttctcccttgtcattattcatttggaaacaatcttaaaagaccatgtttcattatattctgttatattaatgtgtcttatttaactgtttcctttttgccatttagataattcagtaatttgctactataaataacgttgcaatgaaatactgatgaacaaatctgtggacattttgggttacttctttaggattaattcctggaactgtatttaccaagtcagaggtggagcagcatgtgaatactcactttaccctattctatcctattataatttttttttaatcttagtctgttaggtaggtgagtaatggtatctcgtggtctcggttgcgtttccttgattaccagtgggttggagcatttgtttctgtgtattgacgtacctgtcctctgtttgtccttctatttatattcatcttttttcttattgatttttaagagctctttatgcataagaggatattaaccttttggtataatgttggaaatattttttcagtttgtcatttgaattctaaattcatttatggtttctcggttgtatagatgcctttactttgcttatacgaatcatcaacgtttttgttgttcagtgtttcctcttgtttttaggcttagaaagcccttccccatcctggctttggatatctgcgcagttgcattttcttctaattgttttgcaattcattttgcaaattcaactttttatcaggttttctcattttgctataaaatatgatcggaatttaactttttcttaatagtcatttaattcttccatttgcgtttagtgaatgatctttctgtcctccctgatttgaaatgctacctctcatacattaaattctttgttgggttttttgttgttgttgttgttgttgttttgagacggagtttcttgtcatccaggctggagtgcattggtgcgatcttgactcactgcaactccacctcccggttcaagtga

SEQ ID NO: 3035 - DNA, 1430 bp, Homo sapiens
ctgtgtgtctgtgtcggcatgtctgctttgtgtgtctgagtgtgtgttcatgtgcctgtgtgtcttggtgtgtgaacctgtgtgtgtgtgttatatgttgtgtgtgtgactgtgtatgtgtgactgtgtctgttagtgtgtctctgtgttgtgtgtatgtgtgtgtgttcatgtgtgtgtgtgtgtctgtgtgcatatgtgttcatacatctgtgtgtgtgtccatttgtctgtgtgtatgtacatctctggctccaaagaccaggtctgtgtgtgaatgtgtatttctgtatgtatgtgtgtatctgtgtgtctgtgtttgtgtcagtttatctgcctctgtgtctgagtcagtgtgtctgcctttgtgtgtctgtgtgtgtcatatgttgtgtgtgtgttcatgtgtttgtctctgtcagtgtatctgtgtgtcatatgtcttatgtctgtgtgtgttcatgtgtttgtgtgtctctgtgtgtgtcagtgtgtctccctttgctgtctgtatgtttgtgtgagtgtgtcagtatgggtgggtctttgtgtgttgtgtgtgtctgtgtgagtgtgtgttctttgtgtatctgtgtatctatgtgtctctgtgtctgtatgccagtgtgtctatgtctgtgtgtgtagtgtgtttgtgtgtgtgttcatgtgtctgtgtctgtgtgtgcctatgtatctgtgtgtctctgtgcattttgtgtttccttatgtgtgtacatgtgccagtgggtctgtgtatgtctttgtgtgttgtgtttgtgtgtgtgtgtctgtgtgtgtctctgtattttcatatgcctatgtgtctgtgttgtgtgtgtgcctgtgtgtgttgtatgttcctgtgtgttgtgtgtctttttgtgtctgtgtgttgtgtgtccctgtgtgtctgcctctgtgtgttatgtgtgtctctgtgtgtgtccatgtgtctgtgtctctctgtgttgtgtgcctgtgtatgtgtccctgtctgtgtgtctgtgtctctgtgttgtgtgcctgtgtgtgtgtccctgtctgtgtctgtgttgtgtatgtgcctgtgtgtgtgtccgtgtgtctttgtctgtgttgtgtgtatgtctgggtgtcatgcggtccgcctgtgcaggtgagcgggcagtgcccgtgtgtgtctgtgtgtctgtgtctctgtgtgttgtgtgtgtgcctgtgtgtgtgttcgtgtgtctgtgcagtctgcatgtgcaggtgggtgggaagggctgtgctctgcactcctgatggatgccgctgtgctcctccaggaggccttgaattccccattcagtgctgagcctgcgagggatccagtcactcgcccacacctctgttggtgaaatgccagcaagccatttatgcccctattgcttagaaaatgcaaactcaagtcattcaacaaa

SEQ ID NO: 3036 - DNA, 1112 bp, Homo sapiens
cataatcacagccctcgttgagaggagccactgtccctgttggtcttctttctagaagtatctcttatatactgatatacagcagtgcatttacattgttaactgtaaaaatgacaccaacacatttagaaaggccaccagataaaataaagaaaaatgtatccctcaacgctgacatacttactggcttgcttttggaacgttcttctttctgtcttcaggtgctagaactttaggagagtaagtgggctctgttgagggactctgaagactggtcacccccccgcccacacacacacacacatcccccagcacttgagctgcgcttccacataaccacttcctttatgctgggactgtggtttctttgtgtgtttttatgtcttttccatgtctgggtctgggtttgcctcccctgagagaccgtaaacttctaaagaacaagaactgtgttgtctccttttataggagtgtatgtttcattaaaaaaaaaaaaagtaaaagtaaattttaaaaaacgtttcttgtctatgcctacgatgttcttattgacttgagggtttagacagtgtctctgaaaattctctggcaaacactccctggccccaccataaacagctggttgatgtaaccacaccgtagctcagtcaccacgtcacaggagctgtgtcttcttctgcccgggaactacctgtcctgtgtgacagaaaaatgcagcggttgccagccaagggcccacaggcaggattcccctgaagctgtgggactttgctaacaatgcatctcccacattgaggcttttcagaaatgcgattgaaaatagaagtgtgggtgcagcattttccttcctgccacatgggaattctggggaaagagctcaccttgaaggaacaaccttgctgggagtgcagtggggggacctttcccctggagccggagcccctgctgggttctggcagccccaggatgcccactgagctctgcttctctgggcaccctgagaaatggacggcagcggccctgactccgggctaaggcagggcttcaattaagccagagaaacacgatttattatcagcatgttttcagttccaagccgtgctttgaaaagg

SEQ ID NO: 3037 - DNA, 1178 bp, Homo sapiens
gtaatcccagcactttgggaggtcgaggcgggcagatcacgaggtcaggagatcgagaccatcctgactaacgtggtgaaaccctgtctctactaaaaaatacaacaaaattagccgggcgtggtggtgtgcgcctgtagtcccagctactcaggaggctgaggcaggagaatggtgtgaatctgggagacggagcttgtagtgagccgagatcgtgccactgcacttcagcctgggtgacagagcgagactccgtctcaaaaaaaaaaaaaaaaaaaatacactttggtttgtgtataagtatgtatggaagaataaacaaactgaaaacagtagttgcttactggaggagacatggttgttggaaactgggtggtaagatttcctcgttgctatatactccttcatacctgctgcatgttgtaccatttgcttttattacctattaagaaaatataataaattttaaaaatgaaaacaaatacaataaatattatttgttttcttcttactaggcatatttgatgagaccttctataatattttttgatgaaatagatggattagctccagttcgctctagcagacaagatcagatccacaggtaatttttctttatctgattatcttgatttcttttttacgcattgacttggtagttagccttagcccttagctaagtgctatgaggcttacaaagaaatttaaaacaatctgtgtctgtgaggactacttctttctcttagtacaggggtcagcacaccacagcctgtgagccaaatccaggcctctgtgtgtttttgtaaatgaagttatattggaatacaaccatgttcattccttaagcattgcatgtggtttcttatgtgctacaatagtagagttcagcagctgtgatagagagaccgaatgcgttgcaaagtttaaaacatttactatgtgggcttttaattttttttttttttaatttattttagagacgagttcttgctctcttgcctaggctggttttcaactcctggcctcaaaccatcctccccagtcagcctcccaaagtgccgagattacaggcgtgagccactgtgtccagcctatctgaccttttacagaaaaagttttctcatcctaatttagcataattttttggtttttttttttagagtcagagtctcaccctg

SEQ ID NO: 3038 - DNA, 1174 bp, Homo sapiens
gcgcggtggctcatgcctgtaatcccagcattttgggaggccgaggtgggcggatcacgaggtcaggagatcgagaccatcctggctaacacggtgaaaccccgtctgtactaaaaatacaaaaaattagccgggcgtggtggcgggcgcctgtagtcccagctactcgggaggctgaggcaggagaatggcgtgaaccccagggggtggagcctgcagtgagccaagatcacgccactgcactccagcctgggcaacagagagactccgtctcaagagaattagtgtagaactgtactgtgatgatatatgtctactatgactttcttttttggctaatgctattgatgaaattcatttggctgtagattggtaatttaattttggtgcttaccacatttccaggcatttcagaagatggacacaaagaagaaggaggaacagttgaagcttctcaaggagaaatatggcatcaacacagatccaccaaaataaatgttttctacattttcatttggactaaatcccacgaatgacaactaccacctttttttcctttttaattaatactaaatattgtgatttcttatttgaggttcaaaatgacctgcttgaaactttgatacatattggaatacattatgttaataaacttgtagctttttgtgaaacacctcagtcttttctcttgaactttcccttcctgtttgataccaggaaaaaacagttgaagcttatcaagaattgtaggtgctcctagggattctgagtttcttgagaacaggatctctttacattcttaatgcctccagggcccggtgcagtgcttagccatcaaaggaacttgctgtttattgcatgtccattaataatgaaatcttcataacaactcagtgaagataggtatttgcattttgcaggtgaggaaaccaaagttcatgatgttggttgaatgaataaaatgctaacatacaaagctggtgtgataacaaccagttattaaccaagcctttacatttgaataatgcttgctttatagttaacaaaacacctgtgtcaatatgggtacccttgtctttagaacagaggtctattatagaaatggtcatttagatgatagtacattgttagaaacttagatttgcctctttaaattgttttttaattattatgg

SEQ ID NO: 3039 - DNA, 1204 bp, Homo sapiens
aggcaggagaatcgcttgacccgggaagcagaggttgcagtgagcagacatcacgccattgcactccagcctgggcaacagagcaaggctccgtctcaaaataagaataataatgactcttgggtttttgtcctgggcaactggaaggatggagttgccactaacagagatggggaagagaagcaggcttagttcattttctgtcatgataagtttaagattcctattagacatccaagtgatgtaaaatcagcagttggacatatatgggcctgaaatgtagggagctgattgaagatataaattttgaagacatcagtatatggttaattttaaggtcatagtttttgttttttgttttgttttgttttttgagatggagtttcgctcttgttgcccaggctggagtgcaatggcgcaatcttggcttacctcaacctccgcctcccgggttcaagcaattctcctgcctcagcctcctgagtagctgggattacaagcatgtgccaccacgcccggctaattttatatttttagtagaaacggggtttctctgtgttggccaggctggtctcgaactcctgacctcaggtgatccgcctgcctcagcctcccaaagtgctgggattacaggcgtgaaccaccgggcctggccaaggtcatggtttttaaagactaaaagatgactggaaaccaagtctcttaactctgtctctcacattaaataatcatgcctagcagagtttatcacaggaacaaagatggttcaatatttgaagtctaggagtacaattcaccacagtaacaacagagaataaccacatgatgatgtcagtaaatgcagaaagggtatttaagacatccatttattaactgaaaaaaattttagccaaccagtggcagaagataaaccccttaatctaatagagcatttgtcaaaactctcaacaaataacatacctaacagtgaaggtctcagagcattctcactaaactcaatcgcgagtcagagacacctgctaaactgctattgttgcactagaagtcctggccagtgcaataagatgagaaaaagaaataagtatgaagatggcattaaaagagactaaattgtggtgattgttagatagtgcttttatagggtatggtttaaactggtcttcacaatcctgctaaaacttactcacaggtgaggaaactgaag

SEQ ID NO: 3040 - DNA, 1099 bp, Homo sapiens
gagtccaccagcgccactccaggagggctgggggaggaggggctgcctcaggcagtccaaggtgctccctcccccgctggccaatgctaaggtcttcccggctcccagggtcaggacagagtcttctaaggctcaggctctcccaagccactgcttagtgacagttagcctttcccagcggcccaagctccaccggaactgggcctggtgctccaaccaaagggttggtgttgggacttgggaagagacttggtagccaagggcatggcaagcctgggggattcctgtgggccggcttgctcgaggagggagtgctgggcacagaggagcccttatggctgacagcttgagagcacttgttcctccagatctagccacttgaccaggccctagaatggaccagatgccccaggggtcatggcccccccccccccccccttgcagggacgagagttaacaatcaccagcttttcttccggcccagcctgtgtgcttggtctcacagtagaatttaggagagtgtggggctttgggattgtgccaacttggccaagctgagatatgcttaatccacctcaacgctggggcctctggggacaggtattgggtcaccttccaaggggtgctgaacttcagcaggctgtagataaggcagaggttagaggcagtggagtgggggaaccaagaaggcctagggaaaattgccaggcatattccctgtggaattttctttccgaagagtaggcccatttcccccttagaaacaagggttctgggggctgatgacagcttcccctgcaggtgccaggtggcgcatgatgccaaagagatccgtggctcttgcctgggggaggtagccaggtgctcgtgctggggacacagtccttggcctcctgcctaagcaggaagctagtttccagcaggcggctggtactaaccccccgccccacgggagcgacaggctggtgcaccggcagactggggggccgcaggcgggcactagcaggggtctgcagtccatagatgatgacatgaatctgttgctgtccttttgtctctaggccccagagacttcttgctattgaacatcctattggaa

SEQ ID NO: 3041 - DNA, 1180 bp, Homo sapiens
acttagggatgaacagactataactaggaaaggaggaaaggtatcagggatttttaagtccgtttagagagcaaaccatattgtgcctcttcatcttgacccaggctcttatagataggtcctaaacattgctgttcactagattatcttaacaaataatactcagctaaatatttgcatttaggaatactcctaaaacagatattgccaactagatacactgcctcaatcttgaccagacaagagaacagttaagttctctcagttgggtagtaacttgaataccagtctatttatcagttggtttcaacacagaggtttcaagtggaaagccattcatcttaaaagctgaacagaaaaattaaaaaaaaaaaaaacacattacaatctggccttttagaaaatgaagcagtagaaacaaaacctttattagtatggtattccagcagcacctttaaagcaatctttaccttagttttttgagttgttttacctttcatcccaatctgaaaagttttaataaatgctgagcttattcttagggtatgacctggcattatttccagtgactagtcaggcattatgcctgatgcatacgcctcccgtgcacccctatctagccttcagatgtcctccactgcaggtcaccccaggagatagcatcaataatatagtctcagtcttgtttataaagattctaagttgtctagtaaataagtctccctgaatcttaaataattttggagaattagaattctccatcctattaaacagaaagtaaagccaaatagcctggagttgtttgtcctacttgttccataacccctatgctcaagatactgaagctatctgtggtatttcatgtaacatttctaagaataagagctggcaaatgggaaacttggggtggagagagcatacttattgggctgtgaaggcatacggatgtacatgttttagagcttatctcagatttaaatagccaaaggaagacctcattgccttccaggtgaaggtgcaaagtcatacatattaatgacctgacagttaacattctgttgtttattattgcctttctccaccttagagagccataaataactctctggtgaagtgatttgctataatgggggtgaggagtggggagacttctctggtcattacactgctatttatttct

SEQ ID NO: 3042 - DNA, 1287 bp, Homo sapiens
gatcacgaggtcaagagatcgagaccatccttgtcaacatggtgaaaccctgtctctactaaaaatataaaaattagctgggcctggtagcgtgcgcctgtagtcccagctactcaggaggctgaggcagcagaatcgcttgaacccgggaagcagaggttgtagtgagctgagatcacgccactgcactccagcctgggcgacagagtgagactccgtctcaaaaaataaaaaatagttgtgtggcgacatgaaactgctcacccacaatctgctgagctcgcatgtgcgggggatggggtcccgtggcttccccctgtgcctccaggccaccgaggtccgtatctgccctgtggagttcaacccccaatttatgtggcatcatacgtggcacgtatcatacgtggtacatatgatacctaaggtggagtggtcggcgttcctggaggcggccgatagcttgcgcctgatccagatgcctaaagggccagttgagggatatgaggagaatgaagagtttctgaggaccatgcaccacctgctgctggaggtggaagtgatagagggcaccctgcagtgcccggaatctggacgtatgttccccatcagccgcgggatccccaacatgctgctgagtgaagaggaaactgagagttgattgtgccaggcgccagtttttcttgttatgattgtgtgtatttttgttgacatataccgtttccgaattctgccgtgtgtatccccaacccttgacccaatgacaccaaacacacagtgttcttgagctcgatattatatatttttttctcattaaaggttcaaaaccaaaataaataaataaataaataaaaataaaaataaaaaataaataaataaatgggaggctgggcgcggtggctaacacctgtaatcgcagcactttgggaggccgaggcaagtggatcacgaggtcaggagatcaacaccatcctggctaacacagtgaaaccccgtctctactaaaaatacaaaaaattagccgggcatggtggtgggcgtctgtagtcccagctactcgggaggctgaggcaggagaatggcgtgaacccaggaggcggagcttgcagtgagccgagatcgtgccactgcaatccagcctgggcaacagagcgaaactctgtctcaaaaaaataaataaataaaataagtaaataaataaataaaggagggagggaggaaaagagaaagtagtagtccaaatatttgcaaagccaagaaaaaagaggtatatttatatgtttatactat

SEQ ID NO: 3043 - DNA, 1200 bp, Homo sapiens
cccagggcgcggctttttctcgcgtttacgagctccacctacacgggaacacatggccacccaagcccgtcgctgcgccaagacctccagctcaacacacccgacaagcgctgtgcagagaaaccgcagcgcagtccagcgggagaccccgggaggggaaggaggtgctgggctctgtaagggtgtcccggggagcggggagcgggaggcgggaggcgggggtcggagggggggcgctgcgcctgcgcagtcgctaggtagcgtctcccccggggcgtgctcgtaacgccgcgcaccctatcaggcggccacagggagcgcgcccgcggcctcgccctttctcgcccctcccttctcccctctgggtccagcctcagactgaggcttggagacaggagcattccactcgccacttcggcgcgcccccatgccctcttgtgcgcgtgcgcagaggcggaccgcaaggctagggcgtgagggaagggcgggcgtacgcccttgcgtgcgtctcaggcagcgcgcacgccggcgtgagagggcacggggaaaaggtggctctggccggggtggctcggtttcctggggctatgtaactgagctcgtcgacttaggggtccttcttcgctgccctcgccgcgtgctagcagggagtttccgctcgggagagagactgtcctcacgcccgctgcgcctcctcgacggcagagcaggcttgctcgcccgtgggagcgtcccggccgagaagccctgaggggggaggggaggccattttgtcccgaccgactccccggaaccgggcggacgggctgggagaggctgcggagccgcggtcgccgccctcggaggcactggacgccgccactgtcggggcttcctcaaagctgttcgtaggtcgcccgcgccgtctcgagcctttttcccacgcttccccggtcctccggcctgagaacgcccgagtgaggagttggccgtagtgagagggaccgatcccttggggccgccggcggcgagagcccgagccgctcctcccaatggcgaagaagacgtacgacctgcttttcaagctgctcctgatcggggattccggagtggggaagacctgcgtcctttttcgtttttcggatgatgccttcaatactacctttatttccaccataggtaagacctgtgggaggacggtgtacggtctcggtagctgca

SEQ ID NO: 3044 - DNA, 1204 bp, Homo sapiens
attttatctggttgtgtgtgatgtgtgtgtatgcctatttaatatgtacacatatattcactacatatgtatgtatgatatattcatatatacatgcagtctgcttgattatcagcaaaatggtcagcctttatcagatagtttcttcatgtggagttcatctgcatgtggcccttactctgaagcctcttcctgatctggagccacagtctgtctgtcttccagttcatctcagtcctcgagaaaggccctttaaatatgtcactttcccattttcctttaaccatgggttgtgtgagccagaaagagctttgagaaagatggctgcttccaccagggtggaggcttctaggtctgcatgatgatggggcccgtttctggccagagggtggctctgggagcagttgtgctgcgggcttgctgggggagaactctaactgttgcagaaacagagcttcatggcttgcttaaattacttagctggaatattttaaagtgtcagataatgtgatgtacaaagagagtatgccgatgcatttcattgtttttgcattatctgtatcagtgtttcccattgctagcccgaataatcaagaccagactgtttcttgtcactggattctggaagccttgccctttcaactggatttatgtttgtttctgctgctgtgaaaccccaaagtaatgcagtaggttttaattgaaaattgtttaattctattattgataattatttattgtaataaaagtaaaagagtaatttttaaatccttttaattgttttcagattgtcttctttgttttccttggtaagtgcaaaaggggagggagctatggggagaaaactaatgtccagccacttgtctcagagaatcattgattattttaaagcaaaacactgaaaaggttttgttctgtttttagagagatcagccgcttgctcctgggcgttctgtgatcctgtgacttgtttcaaaaggcagaatacgaggcaggtggcagtaacagcttttcatagtatactgctcctgactcgcccagaactgggtggtggcagtctctatagtctaataatgactgggtcacgcctaagttagtttgtaaggtggtttcttcctcagaagcattttcccatagaaagagtgttaacatatggtattaattttccagacgaatcccataaaaacctgttagaccatactta

SEQ ID NO: 3045 - DNA, 1273 bp, Homo sapiens
cggggggttcggcacagcccgataatgcgccgcgccgaagcctgcagcaccccgcggtcgccgtctctcttgcactggtcaggacgaatagagcctgacaaaacctgagttaattggccgagcgaatgtcgttcgcgtcaggagagcacgtccggagaagccaagggaaatgtggagcaggagcagccaaagtggcccatcggctctcgagcagggtttgcgcgtcgcggtcgcaaagcccctgtgagtgcaggtaccgcggcacaagcgctgccccggagctccaggaggcggcggcgggctcggcgttcgcggtccaggagaaaccaccgcggggtgttgggaacattttgttaaaaagccgggaagctcagggccggtgtggcctccgttctggcctgagaacccggactttgggcagcttcttttccttgcctttgggtctccggctttctcagctctgtgaggtcccatgggtctcctgccctggcaggttccttcagctggagaaagcgggggtcatggctggatgaggttgcggtaagcattagagggctatcagcagcatcttatcgcagcggagccttcgatagctcagttggtagagcggaggactgtagtggatagggcgtggcaatccttaggtcgctggttcgattccggctcgaaggacttcgtctgtaatttttaacctcaatttaattcaattatcccataaggggaaaggcttggaggcctcctgtgacttagcattcgtactgccgtcagtccatagggaacaccgtagtatgtagtatacggtaacgctctttctgcgttcaatgtacatgtggtaacgtgttttagaatgttttctgcttaagcacacgattatatgcttgatttttagaatcttgcacatggatgccactgtattgtactctgctaaataaatgtcctgaactgtggttgatccactggtcagtgaacagtgcagtgaacctgtaaggcaaagggaaagaactaagcagcaggcgggggattagctcaaatggtagagcgctcgcttagcatgcgagaggtagcgggatcgatgcccgcatcctccactcagcttttgcgtccgtcacactacagaacacaaaacgggagggattcccggcgcagtgggctacgtgtttcattttagagacacaagactgttaagcgataaggagtttcacacgatgtctttttatttcgcagttgagtcccagtttctgccgctttatctttcccgcctcccggcaggcag

SEQ ID NO: 3046 - DNA, 1191 bp, Homo sapiens
agcgggcggaggagaggcttttaaggtaaagtgaaaactgcacacagctgcagagtcgccaggaacgcttcagctccgcctcagagcagctccaggggtcttatactggccttttccgggaggtcttgcctgccctctagcagcggcgagagtggtgcatttgggtttaggctaagttccttccctctcctgagcttcaccctgttctgtaaaatagaggtaataatcccagtcctgctcactgtgtagatttgtgaggcccaaatgagagaaaaaagactcgagaaacccttgtgaactagaacgtgcagaaagcaaaggggtaagacatcagactcttccctaaacgtgctctctgggcacccctgaacttgctcatccgggttccccctcccacagcactttctgcagctagagctgattaatgggcgcttgagtgcctccttgctgcactcccatgacacagagacacgggccaccatgaacttggcactggctggtgacatccttgctgcagggcaggatgcccactgtcagctcctgcgcttccaggcacatcaacagcagggcaacaaggcagagaaggccggtgaggagctccctctctacccccttggggaaagggttgaacgagtaaggtcactcttggtgtctctaaagaagtgggtctggaagtagggttttggtagcaagctagaagttgtatgggcacctgccatggagagaggggccagtactccttactgtagaagcctggaacctggccaagtgtttgtgttacaggttccaaggagcaggggcctcgacaaaggaagggagcagccccagcagagaagaaatgtggagcggaaacccagcacgaggggctagaactcagggtagagaatttgcaggcggtgcagacagactttagctccgatccactgcagaaagttgtgtgcttcaaccacgataataccctgcttgccactggaggaacagatggctacgtccgtgtctggaaggtgtgggtttgcagggttagggagggtgaatgtcagtagcaacaggatcaaaattgtgagaagttgaacgtggcatctgggaaacttgtgaatgaagcttgcattgaggggccattagaaggggtggcgtgggcatcagtcacagtgtacttgctggacacctgagttaaccatggtggttgtttgg

SEQ ID NO: 3047 - DNA, 1098 bp, Homo sapiens
agggagctcagtgacctcgaggtgggctgggacctggtgggttacccggaggctggatgatgcttgggggaaagtgtgaacaactcagctaagctccctgcctcctgtagtctgctcgccaattctgccagaccgtggggtacccctgtgtggtgcgcccctcctatgtgctgagcggtgctgctatgaatgtggcctacacggatggagacctggagcgcttcctgagcagcgcagcagccgtctccaaagagcatcccgtggtcatctccaagttcatccaggaggctaaggtgggaggctgcagacagtgaagtctctgagggcatgctgccagccctggaggagacttccttctctggtccagcagaatcataggcaccagggctgggaacagtgggctatgtggggctcgttaaaggaagagacaatcctagagtaagtgagagaagaaagtggccctatgtcccactgtctgtgtccccccgctaggagattgacgtggatgccgtggcctctgatggtgtggtggcagccatcgccatctctgagcatgtggagaatgcaggtgtgcattcaggtgatgcgacgctggtgacccccccacaagatatcactgccaaaaccctggagcggatcaaagccattgtgcatgctgtgggccaggagctacaggtcacaggacccttcaatctgcagctcattgccaaggtaataaggctaaaggaaagaactaaagggccacagctcttgcatgttctgtgctggccacagtgccatgaagccctgcactgtctcctgccttcatccaagtaggcagggaagctggagggaaagggctgtagctagagctcatggtgttggggcttatgacagtcagtgaccctgaaccctgctcagtctgatcccccagagctgaggacggagaggaagagtctaggcctatagatagtgtcagcaaggccaacctgcagaaggcctgaccagtcttctctgccccaggatgaccagctgaaagttattgaatgcaacgtacgtgtctctcgctccttccccttcgtttccaagacactgggtgtggacctagtagccttggcc

SEQ ID NO: 3048 - DNA, 1136 bp, Homo sapiens
ccagtgcctgcgctgccaggaacccccccaagcctgagccatggccctgccctcaccccactgccaggccgaggctcagccccagactctcagcatctgctgccctgatcacagagacgggaccgagccaggtccataccccttcctctctccctcctaccacctgccagtttccccagcctcagccccagccccagccccagtgggcaagaccaaagtgtggcggggagtggggtgggagtcaggggaatagatgtgactagttcaggggcggggactcccaggcctcagtgtggcagggtgtgttgaaggcctgtggtgccatctccccatggttcatgtggagccacgaacatcctttccctgcagtccatttgtctgtgtggcaggctggctggctgggggcatctgcctgtctatgtgctgttggtgtgcctatgcctgggggaggtcagtaggggccccctccccacatggccctcgctctgtctatgcaggggccccaaagcccgcactttgtccgtgtgtcttagccctgtggttttgtctgtgtgtgtgtgtgtgtgtgtgtgtgtgtgtgtgtgtgtgttcttggtgctgtggcctgtgtgtctctgtgcctatgtggctgtgctatggtttctatgagtctgctccatccatgtgtctgtttgggggtctatctctccatccctctgttggtgctgtgcccttggctatccctgaaagagggaggactccgctgcagctccaccaataaacttgtgtctcactgcatctttcagcctgtgtgctgactcctcaggagggggaagtcaaataggtcacttgagaacaacagaatccctcctgtcccttcccagcctctggagtgacctcccacagacctcctgtcccttcccagcccctccaccctcagatggagggtaaaagccaccagtctctttactccccttcccctggctcacagcatgcctgggtccttggctcagggacagtcccatgtgccctgggcttggttgcaggagaatgctggaaggtaaggagccaaggaatccctgggagtcagtcgttctcagaggtccctgcatgccagtgggcctcaggctggctggagggaggctgggtccctttga

SEQ ID NO: 3049 - DNA, 1211 bp, Homo sapiens
ccagtgaagtagagaaaggggaaggtcagccctgccccagcgcgctctgcgtaaccgggacttcctccgcgcggcaaagccggggaacctccctggcgcctgcgccaccgtggcgagactcggcgccgtggacgtggagagagggcgacgcacctgcgcgaagacggcagcgggagaagccgctccagtgcggttgcgcggcggcccaggcgtcgaggggagcctcggcggggagcgcaccgcgcgcctgcgcggagagctgcgtgacgcggcggcgcgcaagggacgtgcggagtgagtggcgctgcgggtggggccgtcggcggcgctggtgagctttgcggagctgggcggtgccgaggaggaggaggtggcggcctgggtctgacgcggccctgttcgagggggcctctcttgtttatttatttattttccgtgggtgcctccgagtgtgcgcgcgctctcgctacccggcggggagggggtggggggagggcccgggaaaagggggagttggagccggggtcgaaacgccgcgtgacttgtaggtgagagaacgccgagccgtcgccgcagcctccgccgccgagaagcccttgttcccgctgctgggaaggagagtctgtgccgacaagatggcggacggggagctgaacgtggacagcctcatcacccggctgctggagggtgagtgcgcgcctggccgcgggacagagggaggtcgggcaccgccgccgacccctgcgtccccgtctgccgccggaacgcgaggggacccctttcccgccccgagacgagtctctgggagcgcggcgcggcggacgaaccgaggagggggcgaggaggctctgggcgcgggggagcggcctctgggagcgcggtcaggggagatcgggggagagggggccgttcccgcggaccctcgggggccaggcccgccggccgaaggctgtgcggagcgggtctgcgggagacagcctttcggaaaggccgccgggctccgcgcgccgtggtgctcgcctccggtgacccgaggatggggagaggatgcctgccactgggctttgtgcgtccgtggaatcactgttcttctctgttctctttgtgcattgcccttggctgcctccgattgtcgttccgggagtgaattttacgtatatatatataaacctgtccttaacaggactgcttcgtctgctctgcatttttac

SEQ ID NO: 3050 - DNA, 1209 bp, Homo sapiens
cgtggctaattttttgtattttttagtagagacagggtttcaccgtgttagctatgatggtctcgatctcctggcctcgtgatctgcctgcctcggcctcccaaagtgttgggattacaggcgtgagccaccgcgcccagccgaaacaaggtttttttaaaatttaaattttattatatacaccaactatgtatccacaaaaaagaaagttaccttttaaaaaacaaaacagattttgacacagggtctctctctgtcgcccaggctggactgcagtgacgccatcatagctcattgcagccttgacctcccaggctcaagcgatgtctcacctcagcctcctgagtagctgggagtataggcgcttgccaccaggcctagctcaaaaaagattttcttaataaaaaagtttttactatgtgatgattatggtaattttgatttctagcctacatccagcatttagtccacttactgtatttgactgtggagatttagtattatatttttggaggaggaaaaagctttcactcagggcttacggaatatttggtgctgtgatgatgccttaatattgtggtttcgactcactgagagtaaaatgaggacctacaattccttggctgtgtctgagcacccaaagtatgccttttaaaatggatagaattaagtgaatctttaattcaagaatgtaagaaacaaaggtgcggagtggtagggtcatgggagttagaaggaacatctaaattttcagtattttcagatggatttttttaaaaagtgggagaattatagcacaaataaccttatttgcttagaattgaattgaacagttacttcatcgtggagctctcctttccgatatgtatcacatatggcttgttttgataatatatactattaatttttgtccctgctttgaatctgctctcctaactgagatttaactttctctagcatttcacaggacatgcaacgccagtttcgtcactgatgttcactaccatcagacctcctaatgagagccagccctttgatggaattacaggtctttatttcttatctggagcagtacatgaccggttacttaatgtctggtatgtagttcttttggatttgggaggtagcattgaaagaatctgtcagagcttatgtagttaatgtaaattatgaatatgggactttatttgttgtatctaatgttggatt

SEQ ID NO: 3051 - DNA, 1209 bp, Homo sapiens; identical to SEQ ID NO: 3050

SEQ ID NO: 3052 - DNA, 1181 bp, Homo sapiens
catggctccttgccatatgtgaattccatccctctctgtttgcagccattgttgactatttttttgcatctttcccgatattgattaattacatgggcatatagaattatgtatcactttaaatctttattggtttgctgcatctgactcccccgatcctatttaatatcgtgtcaggacatacagatgcattttgttaatcaacagtgctacctttgacttgcttatggaaaggacaataggagagttaagagtagaaccatttactattttgagcagactgtttcttaaaaggatgatgaactgatacgttttctttaaaacctgttacgtttaaaaattctgttgaactttaaaaaataaatgtgaaaaattcaagcagttcatagctgaggaaagtaaaccttggtacccaatgtcttcagaattaccatttttcttaactgccgtcagtctgagtggtgatcgtggttaacaattgagtgtggaagtcttccatactttttaatattttataaaaatgcacaagtagtcatttatttttcattttgttcttattcccagttgctttgtttgacactcttttttttttctttcctctcatcttcccctttaaaaaaaatatattttcaggctttaaactccagagaacctcatatgtgtttagtaagagatatttcaaactgctgggcccccaaagtagaaacagctataacaaaggtgagcacattacaaatttgaagttttaagaaaaagaatatttctttgggtgaatggaactgttacttagtattatgattaaactgagttttttattctttaatatctttattctcttgtcttataaattttgtgggattatggttttagatgtcaagattgtactcctgatttgttgagtgaatgaatgaatagaagactagcagttgaagaccttggatgtggttcttccctgcccaccatgcatgatcatctgggccaggaagaatgtagggataaatatcaatatcagatttatcagtagatagtttttatcaatctcagtacttaaaagagcattactttgctgagaggaatgctgtatttcagggtgtaataaaaccgtcatggggctagaatataataccacaaaagcataggagcatcatcatggtgctccattttgcatataacttggtgtc

SEQ ID NO: 3053 - DNA, 1205 bp, Homo sapiens
tatatcttaaattgatatcaagttaattatattgcatttttccaatagaggagccctttaaaagctgttttctcattgaggatacttaaggactaaggtatgatttcctttttcacactttggctattcctgttgaacaggtgaggacaccagtgatgaattctgaagcaaaagttctggtgcctgggattcctggtcatcatgcagctatcaagcccgctcctccacaaaccgagcaagtagagagcaagaggaagtcagggggaaatgaggtaatgcaactgctttgaccatatatttgagtttgtgatttaaaattactgggaaattctaacaagtgtgttggatagagccaaagttaaatctttagaaatttactgagatttctcctgttatgctctcttttatcttcaccatcatagatttcataattctagattgtcatctttgtttaacagagaagatggaaccttcagtaactaaagagggtgctgttttggccattagttagtagttagctgggtaacataaaatggaataagtcaagccaggacttgctgtgatgactatcattgggtttcgcatgttgctgagttccagtgatgcctcttttctcttggctgtctgagcaatcctggctaacctagtgccagttggtctctaaaagtgatagtcattataactgcctaagtgtttatgatcttcattttttcctcagttcccaaaatcctttgtggttactgtacatgtctgtgcagagttgttttttatcttccattcacattcttccctcttacataaggaatctggaattttaactgtttcattcttacagaaatactaggtttctttagctgattttactttaatttgtattctttttttttctttgtccaatttttgaaggataatttagctgattttaaatgcgtttattgggtggtggggtggggataacatagcttcataaaacatgttcataacatgttcataaaagttattcctcagttacatgatagctgactttaaaaataaagcgccaactttctttggcttggcctagtttcaactttttaatttccccatgtcctttttaatcttttttgtgttaggataaaccaagcacatctgtttgctatgttagtcataaaacaaatttctttttgataaccaagaggctgacagaacatgttagacttgattta

SEQ ID NO: 3054 - DNA, 1208 bp, Homo sapiens
atgaggaaagtaagtcacaaggggtgacatgtgctgtgctcccagctggggatttgaacccaggtagtctagtatcagcatgtgtgcccttaaccgtaaccctataacggttagaagagcttcagggaccttcgtcaggacatacatcttgtaaataattggtttgggagtaaaatgcatgctgagtcaccagtgaatcttctgtgttctcatgttactttgggcatatcttcatcaaaacattgcagcagtctcttacaagttttgtttgtttcctagtcatgaggactgggattctgcttttcatgtttgattactcagagtacatagtttggcatattttaggcacggtaaatattgatccaatctgattcctagttcagtggttttatgctgtaacagctttttcctcctcctttacgttgtcaagccactttctcatggtttcatcttttccttcttgctttgtttctggagcacacgttttttacttttttttgattgccttctatttggttttctttaaggtggtgcatttaaaaagcagccccctcttcttcaaaaaaaaaaaaatagggctgtctctaaatgaactgctatctcaatccagctgtcttcctgtcatcttctgattgtctcattcatcatcatcaaatactattaagtgtcttttagcacttatgctgtgctaggcattctataagcgaataaaacagacatggtccctgattttgaggcgtttctaatctgaaccagctttggaactcttgaaagataccactgatcttcaagatggaagaattttaaactagggactgcttgaggacagtcttaataaggtagtgtccagtcacaatcacaccttgcatcttcttccttctcaggactatggctggcctttccccccacccctttctgtttgtaaaatgtgcttcctatcccagaatctttgcacatgttattttttctgcttggatggctttctacacccgcctactattgcctaactttcacttatttaatacctttcttctgctaatatatgaatcagtcaaaacttctttagagaaactctaggaaaactcactgactaggttaatcacatacacacacagacacacacacacacacacacacacacacacactgctcaagtaatcttcattagcataatattcactttcttagttcttactattattaggcac

SEQ ID NO: 3055 - DNA, 1196 bp, Homo sapiens
tctctagaatttgtttccagtagaagactatctttggctgctgctgaattatttttctaaagcaataatgccttaactctttctagttacaaagccatctgaaaaatgttagggatcctctctgcagaaaaatactttatacatagcagatagatttagggggctgaacccttgaatacatttcatgagtcattgtgggtaaactaccctttgctatgtgaagaaccgattgtaagagggaaaccgatttaaatattttcatcattttgcttgtatctattaaaagaaaaaataatatgaatgacagatatgaaactagcccacttgtcccatagaactgattttataatttcttttgaataaacgtagaaattgaccctctcgggcttaaaacctgagacagttactgttgtcttatctgagttcctttttcaggataccaaccatcaggcctcacagatagtatcaagagaactgaaacttaccaaatcaccgtatctggacaatgagacaccagccccttcacccatcatgattgcccgacccaaccacctgctgcctgttgaccaactcctcttccttaccactccctaattccgttttttgttttgttttgttctgtgtgtgtgtgtgtgtgtgtatgtgtgtgtgtgtgtgtgtgtgtagttacatttctttcctgcttataaaatcctgattctagttgggcaagaaggtgaatttgagactgatctcccgtctcctttgctggacacccagttaaagcctttttctctgtcaatactcatctcagtgattggctttctgtgctgcaagcagcagggacctagaccaaacccccagtgctttggtaacaaatgcctctgttttatttgacaaaatggtggtgtgttcattcagtttgcattaatctgtaactttaaaaaagtcttttataaaagataatgatgtaactatagattttgtaaagaatatgagcagtttgtgttttaaagatctgattgtaggctgagtgcggtggtcaacatggtgaaaccctgtctctatcaaaaaatacaaaaaaaaaaattagttgggcatggtgccccacgcctgtggtcccagctatttgggaggctcaggtgggaggatcagttgaacccaggaggtggaggttgcagtgagccgagatcataccactgccctccaacctgggt

SEQ ID NO: 3056 - DNA, 1099 bp, Homo sapiens
attatcgcagtctttttggattgttttccactctaattctgtattcaaagtattatttacttttctcaatcttttgtctgcttctgctcacaatgataaccatgaggaattatataaatctgaagaattttcaaaaaatcagtgtgatactacattataagcaatataattttagggtttttaatacatcctaattcttcagaaatgtgaaaccatatatattacttcttgaattgttgttgtaatcagaactttctcttcttcaaccggaaaagacaattgaatattgttattcactgagatgtttgcatattttgtcatgagaaaatataatttagacttaataaatactaatactttgggtgcagtggtgcttgtctgtaattccagcactttgggaggcggaggtgggcacatggcttgagcccagaagttcaagactagcctgggcaatgtggcaaaactctgtctctactaaaaatagaaaaattagcggtgtgtggtgtcgggtgcttgttgtcccagctacttgggaggctggggtgggatgattgcttgagcctgggtggttgagactgcagtgagccgagattatggcactgcactccagcctaggtgacagagtgagaacctgtctcaaacaaacaaacaaacccaaaaaacaataagaccaataaactgacaacaatatcctcaaggaggttataacaaaataacatttttattgttattttaaaagtaaaacatgtatattgtggaacatttaggaaaatagaaacttaaaagccagcaaaccaaattcctatttataattcccccttttaaatagtatcaaataaactactgccacattacattagggtccctaatattgacccttagatagtacttagtgtcttttctttgtagcattagttggactcattacctatgtcagttatttattactaagtaacaaaacctcttacttaaaattacctatattagttatcttttactaagtaaaagtaacttagtaaaacttagatttaaactgtgacttaaaatcacagctgtttattgcctaaaatttgggggccaggaattggggcagagaaca

SEQ ID NO: 3057 - DNA, 1220 bp, Homo sapiens
catacctgtgtagcttgcagtcagatcaagaaactgaatactgccagcatctcagaagccatccatgtgaccccttcaagtcattattctttctggggtaatgatcatcccattgtcaatacattttttaaacatgttttaaaattgagttcataaccagatttaagccatacaaaaatttcagtctcattaaactattttgttggctaattaatttgcttgcttatctcatttattttatttactacaaatgtcctttgactgtgaaatgaaaattaaacttaaaaagatgagttttcattatggaacaatatgtttaaattaacacacctaggaaatatatttctaaactttggatttcttttcccttacagaccaccaaatcccattgaatttctagcatcttatcttttaaaaaacaaggcacagtttgaagatcgaaactgacttaatgggaagaacagaaaaatttagttgctactgtagatttacatgattaagaggcagctttaattgccatgatcattccctctttttggatgtataagaaccttccggacaacagaacctatttctggaattgcagaagataacatatttcccttattttgatttaatcaccataaaccatacctatttaatgagtgtattctgtgcaatttttttctcagattgtctttaactttgtttttaaaatgaccttcaaaataaactgtcaaaacaccattattttaaagtagtttttgttctgtatgacaaatattttacatgattgaattgttttatgaatttctctttttcttctgtcttcaaatgctgcagagttttacaacagagagaaaatacagcagtcaagtataatttaaaaaattcagccaatttttctcagcattgtttctggacctttctgagggtgggatctgggcatcttcaatggcttaacaagtatcacaggtgattctaatgtacattaaagttggagtactaataaaagcattgcaaaggggatacaatatcttctaatgttatcaacatttatagtaatagctgtaatttattgcattcctactaagtttcaggcatagtacatttttacttaaatgatctctgatataagcagctctgcaaagtagatattattattcccattttgcagatgaggaaacagacttggagaggttaagtgacatgctcaagacaacactgctggtaagtttttg

SEQ ID NO: 3058 - DNA, 1122 bp, Homo sapiens
gtggtagctgaagccacttctgtggatgagttcagcatggagacatgagaaccgttggcagtttagaggccagcagtaggaaaggagtctgcagatgagacgatgaggtatgaccagaggcagaaaaaccagggaagagatgttgccaggaaaaccaaccaaaaggagaatttaagggagggtgtggtcaagaagtactacactgcggctaagccttagcataagaagacaatgaagagagcttagcgggtgtaatgacttttgccagagtagtttgaatagagtatgagggcaggaagtagaaggggagttagacagagcttgatttgggtggtctgaagagaggatcaaatagaaccagcaaattctacttggctgtgagggatgggagagatggccagtagagggttgctaaattttgtttgtttgttagtgtttggttttggccagaagacacctcacgtttatctatgtagaggaaatacaaggggagttacaagctagaggaaggagaagtggtaagacgcatgaactctagacagttacaccaaggaactggtgaagagagaagaaaggcatggtgctgtttctgtgtgtggaggtgggtgggggttggggggtgtagataccttcacatggtaggtcaagggaaattagttcactctgggcttcccttcatttgtcttaatttgctcacactttagtaaattacaattgattaattcctccttttacaacctaccaacaacatccttattcctattccttggtctcttttaactgtctctttctttttttctttcttttttttttttttgagatggaatttctctctgctgcccttttgcctaggctggagtgcagtggcagaatctcggctcactgctcactacaacctccgcctcccgggttcaagggattctcctgcctcagcctcccaagtagctgagactacaggcacgcaccaccacacccagctaatttttttgtatttttattagagacagcgtttcaccatattgttcaggctgatcccgaactcctgacctcaggtgatgcactcgccttggcctcccaaagtgctgggattacaggtgtgagccaccatgcccagccttcctc

SEQ ID NO: 3059 - DNA, 1173 bp, Homo sapiens
taagagaaacaatgataaatttctgtattgtaagtatgtcccaggcattatttaggtcatactaacactaaaaatgattgtcagaaattcaaatgtaactggtcatcctgtattttatctggcaaccctgcactggtttaactctggtttctatagtaatcaatttaataaataactactcccatgtgggttgactttctttgtgcaacggataacccaaaatgctgaggtggatatgaaaacaacaacacaaggagcatacagctgaaaagtgtataatctagtagcagatatgacgtgtatgaatgtagaatgtagtcaattgtgctactcacattcgtctgagtcaaaagactgagtcaaaagaccaagaaacaattacagaggcatatgccatgtgctataaggaattacaatgggatatgggatgggggaagaggcaagcagcattcctgaccaagaagactaggaatggtactatgaacatctgagagggccctgaagcagaatttcagtgaagggaatatgaccaatggatggtggtagaaaggtgcagagaatgttccagaaacattaagtagacagtttgactggggtatgagctgtgggcagtaaagggaaagaaatatggagggcagtgaaactggagagacagacccgggtccatccgaaaggccttaaataccaaggtacagagactgaactctgttctacaagcaacttgcctctgaatagaggaaagtgagagcatcgagagatccaaaagagatgaaaggagaaaaggctcgtaccaaacatctcaatgcaagtgcacagcagttcatctaatgttgctgctttcccaaggccacttgatcccatggttatttagccgttgtcaaaaaactagagacattttcagcatcagatagaccatctccataatcatgcaagtcagcgatgttagtgcctagtggtgacctgtccttagttgtacttcaagaaaactctaaaaaaaaagaaaaaagagagaaagttattagactagagttcagaccccactagagcatcactttcctacctgaaaagataatgacttccatagactgtatctttgtacaagaaaagtatcatagtgactgagattacatcaaccttttatgatgccaaaatacctgctaagctgttctcggg

SEQ ID NO: 3060 - DNA, 1178 bp, Homo sapiens
agcaaattaatattaggtaaccaaattagaaatagcctataatgtataatttaactgcttgaattttttagtaatcatgggtgcttgtaagcttattgtactattaagacttggtgtcatataaaactgatattctctaaagtctgccacttattttgtaaaaggggtaacagaatctctgaacctctataaaatgtagaagtaatgccaccatctccactggaactggcacacagaaatttatgtgtgcctagaaatacatcaagataatagaaccataagaatacttggatcaactcgctggctaaagacgatttaaagagctacaaaaaatatattaaaaaattcttaagtcatagaagaaggctgtgatgaataggttacagcagaccaaagttgctactaaatacaatgagaaaagccagggaaaatatatgttaaggtctattcgaagtcatccagagctaccaggtaaacaacatcaagacaccaagatcttagagaagaggaagccattggaagaagagtccaccattttgtcatagtttaccaaataacagaattaccaagtcttagtgttaggtgggagactgtgaaaccaggcagagtgaagccaccaagagccagagaagcgagcagctttggcagcctgacagtattggaatgcaagagtcccaaggcaggcaggatttgagaggccaaaatgtgggagaaaaggtaggtcctgagaaacgagccaaatgtgtgtttttttttttcttcttttttttgcttgtgtgtttgtttttgtttcttttcctagtagcgtttgttgaattcctaaggtgcttggggaaagagacaaataaactaaaagcatacttgaaaatcaatacagttataaagcgtgacatggtaaaggggagacaaaaatgggagttcttcaccagcaaaggagcagggccttctgtaaaccctcctcaggctctcatttgtgatctctgagagctaaactaaggagctgacaaatagaggtccacaaagctttcccaaaaccataccacatcctgaaatcaactcattccttggttgaataaactaatctgctcctgcttaggttgcctaaaaaaggatagaatcaattctacctgaaagaaacaaatattacttaaccactctaaatttttcatgcacaatat

SEQ ID NO: 3061 - DNA, 1220 bp, Homo sapiens
ctccagtttctgaagtagccatgatttgtttgtgttttaaggtacactgttttcaaagaacagcctttaaagctcttttgaattcaaagatctttcagttactcaaggaatgggtccagttttcagattctccacgccatgggtgcatcttcccttcagctttcttcattttggtcattgctccagatgttcattgtttaacacaagtgggtagggagacggagaagaagggaatttcaggctcatattttggtgtcatgggcagatcttgggtgaggttttcattgttagttaaactaagtttgaaggtttacactgaatttctttccctaccgtcctctttggctacttaaatagatcatcaggactgtttgttcttctgttgaaagtgccccacactgccctgggcataagctaaattctttctctcccttttagaagagaagccagattgctccaaggcccgctgtgaagtccagttctctccacgttgtcctgaagattctgttctgatcgagggttatgctcctcctggggagtgctgtcccttacccagccgctgcgtgtgcaaccccgcaggctgtctgcgcaaagtctgccagccgggaaacctgaacatactagtgtcaaaagcctcagggaagccgggagagtgctgtgacctctatgagtgcaaaccaggtatgcacgagctctgtctcagcagccttgttcctttgcatcagagggtagcagatccctcctcagccacccctggcctctcctttcacacgaagatgggccttctcaccggtgtcctgtgaatctgccactttgggctaatggcagcttgacttctggccttctagtcagagaaccagagtgatcatccactggtacataagcgccttcggagagcgagcgtgtcttttcctcttttcttctttttttccttcaaagtatgcttgactggggaggtagggttaaaatttatggtactatggcaatctgcttcatttccccagagaaggtcagagaccttatttgcagctatatctgccactttgaattattacatttaaaaacaatcatcatacgtaaaacagaaagttatttttagatgaatacatgcatcaaaacgccagaagtttcataatgcaacactcagccccaatctttctctttgccaattcccccgcatctgccctctttactttatagcatgtgccaagtcatctttg

SEQ ID NO: 3062 - DNA, 1198 bp, Homo sapiens
caacatttgatgtactgttgtatcccagctgtttcttgctttatattatttctaacatccttgctcttgtggcagcatttccgatgtggtctgtgaacacttctgagttatagcgatttcctctttgcaagtttctaatcatcggccagttgtttttttgtttgggtttttctttttctttctttcttttttttttttaactgctagataaacgctccaagcaaagtgatcctttgtccgtctcttgaactattctatcaatcagaaatgcctctggctaactgtcactatccatgtaaccactgctggtttaattctttctctgtcttcattgtagctcttaaatatctcatccccacctctttccttacacagaaaatttgaggaatattgcagttctatagcattaactggagtaacatgtcgacactaggactgggtttgtggaagcaaggagactttggacatttgtcaagagctagtatttcatttagggactccaaaagcaagtaaatataacaataaacggtgcctctctgtttgcccctttcagttttcggcgtggactgcaggactgtggaatgccctcctgttcagcagaccgcgtgtcccccggacagctatgaaactcaagtcagactaactgcagatggttgctgtactttgccaacaaggttagtttgccattagtttgtcaagttttctcctcatttgttagcatcatctaaggtacattttgagcatgcagtttgttttcccatgagaaacctagtcctttcctgtttctctggaagaaatcactgaactgtttgcattacttggtatttatatgtatctttcctcagatcaaaaccaggtgtcatcaggttaagtcgttaaaccttatagattctttctgtaagggtgcctgtacacttttgagggctgggacctatataagcaaatatgcccctctgtatatagatagggaggcaggcagtgaggtgtctatcaagagtagacacatcatttgatcctctgcagtgaatcttgtaggtgcttaaacaacatgttcaatgtgatgaaacattgggacccttgatgtttggaatcacacatctacccagacccatttcttgctgaggtcaagaggagtcttaattcttacaatgctttctggaataacaaacacatctctctttggcttgactgcggggaa

SEQ ID NO: 3063 - DNA, 1150 bp, Homo sapiens
acgagagagacaggaaaataaattaaactcaggtgatagaattggaaaaggagaatttttttcagcaagaaattacaggttttagactctcaataaatttaaaatcatgtttaaatatatgactcaaagctacagtagcaaaataaaaaactaatatgaaattagaaaggatgagaacatttttgtaattaccttcagagattatatggccaatttgtgaacatcctgagtggaaatagtgctttttaatgactgcaggttaataagatgtcaagtctggtagataagatggataaagagaactaggcgagtgaatccacattttcccccaagagatgtgactctaaattaataggactttttacttgacactggaaacattttgagaaaacttccaagaatgtttttaacaaaggcaacattactggaataaatgatcattattttgagttgtaatatgtcctgacattttctaaattatgttttttacttttaaagttgtataaagaaaacttaaattagtctcttattatgttttactgtgaactaccccttgttatttataattgattgtgttgttctgttttggaatttagcatatttttttaaaaaaatgaaaggaccaaacaagcttcaaggagaaagtgagttttatatagagtttaaagtgatgaaggatgtttgttagaataggaataaattacccttcttctcattgatgtcaatggcgatttgactgtggtaaagtcaaaggtagttgaagcagatacgtcacaagctaggtatgagtagtgttctttgcattctgccgacttctctgatttatcatcaagtggagaagcttccttaaaagtgttaccaaataagaactttcttttgcctgtttccatgatttgatttcaatcatatttattttctagctctcaaagcaattgaggctattctctgaaacgtctctctcagaatatatgggatatttcacttaaagtatttctttttttgttgttactgttattctcttgctggactttaccacgggtgttgctcaatggagtattatctgtggaggaaataatgcgtagtctgaattttataaataaacatctctttgtttaggatctaaaccaggtgtaactgactaagaacttac

SEQ ID NO: 3064 - DNA, 1331 bp, Homo sapiens
aaactatatttgaaaggtcagaagtggaaagactaagagggcctgaacaataagaggacagaaccaagaggagttggcaactaattggatgtggggattaaggaaaggtaagcatcaaagattacctccaagtttgttagaaggttagtagcaggattctgatgccattcaagtaaatacaagtctcagtcagatgaaccccaagagccacatgtatttgaggggtactttgtctcacacttttacctgttacatggttttcagtaatttagaatttaagccagtagtggggcgactgtacatctatcgacatggtgaggtagagcatgtttgggaggaaagacgttgaatcccatttggtgacagtgagcttgaggtgctgccagaacactgcactgaagataggaggagactgtaggaaatacaagataggaaaggtctccactgaaatgttaactctttctctctaaacggccatccaggcctcaatgtctgcagtttctgatctgtgattatgacttatccaaatcttacatttcttaaaaatagtcatagatgaagggaatcacagttgatagttatatggtgacattattggcttaaattctaaataactagaaactgtataataggcaaaactgtgaggcaaataaaatgcttctcaaatctgtgtggctcttatggggttaatttgatttggacctgtattaatttcttatggctgctataactaacaaattaccacaaacttggtggtttaaaacaacacacatttattctctttctgttctggaggccagaagtctaaaatgagattcactgggctgcagttcactgggcaaggccatgctcctctggaggcttccatgatgcatcccatattcagtgtttcccgagtaagccccacccatgcaggtctgcagttttacctcaacaggcttttgcactcagtggctctctcctgtggtttctatctgaaattctcttcattttttttttaataactgctttattgagatataattcacatgccatacaattcacctatacagtatacaattcagtagtgtttactatattcagagttgtgcaactatcatttttctcacccccaaaagaaaccctatgcccgttagtattcactctgttttctcacaactctaggtaaccactaatctactctccatctctatagatttgcccatgctagacatttcatataaatggaatcatacatgtggtctttttcactgagtatattttcaaggtgcatcccagctgtggcatgaatcagcatctcattcctttttattgccaaataatattctatc

SEQ ID NO: 3065 - DNA, 1369 bp, Homo sapiens
atgtaataacgtaacacaatacaactctcagaaacataatgttaagcgaacaaagcaggttttcagaaaatatatgcagaataattccatttatataaagttccagagcatgcaaaactaaatcattttgtataaaaaacccaacaaatgtgatgagacaataatgggaaggaagggaatgagaaatattaaattctggatggtggttatctttgagggaggggaatgatgtgattggggaaatggactttcaaaggtaatggtaacttccttaagctggatggtaggtccactagtgtttgctgcatagttataccttttatcttaaatacattttgtatctattgtaacaaccactttaaagacaaccgtgctgtaaggcagtagctaaaaacagaaaatagtccatcgggaagggtaagatggctttctgctgagcacagggctagaagtgacagcccagtgggccttccaactatatgccagggtgttagatgagtagagaggagaccacccaggaagtctggacaaggggtctggcatgagctctggagaagatatatttgaggaacatggggtatgctagtttgttgtcctgaattgctgtagagaagataatttaaattgcatcttagaagacgaccctgagggtgaatttcaacttagggcaattgttttagtttgtttcttattggtttaaatggatacttgaagctggataatttataaggaaaagagatttatatgacttacagttctgcaggctgtacaagaaacatggcaccagcatctgcttcttccccggctgcttccactcatggtggaaggtgaaggggagccggatgtgcagagatcatatggcaagagaggaagcaagagagcgagggagaaggtgccaggctctttttaaataaccggctcttgagggaactaatagattgagaactccttgcttctcctccccagcacaccccacccccagggacggcattaatgtattcatgaggggtcttcccccatgacccaaacacctcccatcaggccccacctccaacactgggatcaaatttcaacatgagattttgggggacaaacatgcaaactatagcagcaaccagctaccattctaaaactgccatatgattttaggatttttaaaaagggccaaatttaggttaagcaaaaagtgaaaatacagtaagagaaaatagttttataaaggctttaaaaagtgttcataaagagcagttcatagatttttcacgtaacgttcatcaatagatgctaaaactattggatgaaaagctattgtggaataggatcttctacaaggatttaaatataatcctacagaagaggtatcaattat

SEQ ID NO: 3066 - DNA, 1416 bp, Homo sapiens
atgcctgtaatcccagcacgttgggaggctgaagcgggaggatcacgaggtcaggagatcgagaccatcctggctaacacagtgaaaccctgtctctactaaaaatacaaaaaatcagctgggcatggtggcgggcgcctatagtcccagctactcgggagaatggtgtgaacccgggaggcggagcttgcagtgagccgagattgcgccactgcactccagcctgggtgacagagcgggactccatctcaaaaataaatagcttctctcgccaggcatcctcgtggaagtgacatcgtctttaaaccctgcgtggcaatccctgacgcaccgccgtgatgcccagggaagacagggcgacctggaagtccaactacttccttaagatcatccaactattggatgattatccaaaatgtttcatcgtgggagcagacaatgtgggctccaagcagatgcagcagatccgcatgtcccttcgcgggaaggtcgtggtgctgatgggcaagaacaccatgatgcgcaaggccatccgagggcacctggaaaacaacccagctctggagaaactgctgcctcatatctgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgagtgatgtgcagctgatcaagactggagacaaagtgggagccagcgaagccacgctgctgaacatgctcaacatctcccccttctcctttgggctggtcatccagcaggtattcgacaatggcagcatctacaaccctgaagtgcttgataaaacagaggaaactctgcattctcgcttcctggagggtgtccgcaatgttgccagtgtctgtctgcagactggctacccaactgttgcatcagtaccccattctatcatcaacgggtacaaacgagtcctggccttgtctgtggagacggattacaccttcccacttgctgaaaatgtcaaggccttcttggctgatccatctgcctttgtggctgctgcccctgtggctgctgacaccacagctgctcctgctgctgctgcagccccagctaaggttgaagccaaggaagagtcggaggagtcggacgaggatatgggatttggtctctttgactaatcaccaaaaagcaaccaacttagccagctttatttgcaaaacaaggaaataaaggcttacttctttaaaaaataaataaataaataaataaataaataataaataaataaataaataaataaat

SEQ ID NO: 3067 - DNA, 1155 bp, Homo sapiens
cacttttggtcccaagcatttcagataaaggatacttaacatgtatttgaatactagtcagggtacaccatctactctccaccaaattctttagtagcttttaattttgcaatgtatcagatttaagcccttttcgtctacccagtggtcccctgatggtatataatggctgctaatacactatctgtgcttttcagtgcagcgaaacaaatctcacagactgcacactactgcttatccatctcttatttctagaccagcactgtcctatagaaatatgtgagccacatgtataacttcaattgtctagttagcctcattaggaaaagcaaaaataactttaatacattttatttaacccagtatatcagaaatattgtcatttcaacatgaaatcaatataaaaatttatgattgagatattttacattccttttgttctaaatctttaaaatccagcgtgcattttacacttacagcacatctcagttcagacaagccacagtcagatgctcaataatcacatgtggctagtggttgccggactgtacagctcaccttttgaaaggctaccttttcaatctagatcaccaataattttttaaattaatttcatgtgaaactttaaagctcttctaagaaccctttttcatttgttcgttattaaatcaaaacttcaatccagtcacctttaactctttcatgaccatttccacatgcccttaccgttggctatcttagctcgatgtgctaatcaagttccccctaatttgacatactagaatctaatactagaggcagcatgacattattatgggggaggaggttgagaagcactaacctcgaagttagaatttctggtttgtcatcccagtctgctaattagctttctgatttaagacaaaatactttttctgtgccttctgggggtcaaattcgatttttaagattctctcagttggaagaaatctaactaaaaatatacttaaaataattctttggtagtatattattttgaaatttggtccagaatcctatttgtttattcctgtagtatacatacgtctgtagttacccagtagtctttgttgtctttgggccatctaaagtatatttgggctgggcatggtgtctcacacctgtaatttcaacact

SEQ ID NO: 3068 - DNA, 1166 bp, Homo sapiens
ttattgtgttatagagatatgatgctgtagaagttctcaagaaggggaaagatgtgttgtagcaagagtagtaacagtagacttcttgcagaaaataatagcttattttgacctattcccaacaaatgtaggaaaatcggccgaatagacagctataaacatttaaatatgagatactgaggccatggaataaagtgatgatggcagggtataaaacagagaaaaccaagtcagggaaattaaagacaggatctggaaacaaattggaagtaataggttaacaagagagacagacagataaatactagtagtgatagagaacttggaggagtgtagtaagttatatcacatgttgaattctgttttagagaagctgtggagggatgctggcaatatatccaagaagagaaatttgtttgtctgcttttttatcatttaagaactttattcagagaacttagagcatttcacatcaaattctacgaaagcttcatattttattatacttttttatatctctgactgtataggtattgatggatatgtttcatcaagatgtagaagatattaatatattatctttaactgacgaagagccttccacctcaggagaacaaacttactatgatttggtaaaagcatttatggcagaaattcgacaatatataagggaactaaatctaattataaaagtttttagagagccctttgtctccaattcaaaattgttttcagctaatgtaagtatcattgtatatatgcctctcattgaatgtgttgtgaaatttgcatgaccacttcaaatttgaagttgtacagttcatcattactaatttgttaatttttttaagttgtgggacttaattcatgatcacaaagttttacaacagtttcaagagatttaacattagaaattaagagacaaaatacaaagtagactgattatgtaagtgaaaatgaattcacagaattctccatgtactccaaaggataaagcttcttgtttaggtggaagatatgtttgtttgagtcatttgaatcattcaacctacacttcatcaatgccaactgtattgtcaggtaccatgcttggcagcagggattcaaagatgaataagaaacagttctgctgggcacggtggctcacgcctgtaatcccagcactt

SEQ ID NO: 3069 - DNA, 1164 bp, Homo sapiens
caaggtctctgactttgggttttattctccttgttatctgtattactgtggaattcatttctcactgcaggtttcattctgtatttatactctgggtcagttttaccaactgcagtcttttttaaaaaagaaatcaataaatatttttcttatagcaactgaaattaaatacctgaaatattttatagaagtgatatgaattaattaaatatgtcaccaagtgttttgggcatctcagagagcacactaaataaatatataatggtgataattatatatcatctttctaggcttgggaaatgcaaacaagaactctggttagtagcattccatgtaagaatgtccagtcaattaggccagtgtgtatgtgatttcaaacacaattgttttgaggttttttgctaccgttatcttccaaaacactaatccctcctttacttctaatccctatattttaccaatgttcacatgttcccttcctatatctttcatttaatctaacacacattcattttagaaaaataagatattcatataatgactttttcaactgaccagagttggcaagtccttctagaagtttggagctgccctgaatcttatgttcctctgctgttcctcatctggtccattctgatatgcactcctgtccttctgatctatattcactttgtcgctatagggagctgccagaactaaagatgtggggtggaggcactgctttctttccacaaaagctattcccaaggagcatttctggacagtcattcttccctggagctttgtcaatagatcctgtcttgaacctcacagatactaccactctggagctttgtcaatagatcctatcttgaacctcacagatactaccactctcttggttccatagaaagtggagaaaaggtgtagcaagctggggaaaatttcaacaggaaaatgtctgggagacaagcagtttcacttggaataaccagtcagtttcctctcattctaagaatactgaatttcctttagagtccttataagagtttggaaaatggaagcagacctaccagagagtgaggatgcaagccagaagtgggtatgaaagagagatcttttgctaaagggggaaagcacctaattttatcgtaactgtctgcttaattaaattaatttcctagg

SEQ ID NO: 3070 - DNA, 1356 bp, Homo sapiens
aaatttcttagatggtgctctggttctggaggtggatgagagggaccaagatgatgaagaagctaggcgagaaatggctaggattctgaaggaacttaagcagaagcatccagataaagaaatagagcaattaatagaattagctaactaccaagtcctaagtcagcagcaaaaaagtagagcattttatcgcattcaagctactcgcctcatgactggagctggcaacattttaaagaggcatgcagctgaccaagcaaggaaggctgtcagcatgcacgaggtcaacactgaagtgactgaaaatgaccctgttagtaagatcttctttgaacaagggacatatcagtgtctggagaactgtggtactgtggcccttaccattatccgcagaggtggtgatttgactaacactgtgtttgttgacttcagaacagaggatggcacagcaaatgctgggtctgattatgaatttactgaaggaactgtggtgtttaagcctggtgatacccagaaggaaatcagagtgggtatcatagatgatgatatctttgaggaggatgaaaatttccttgtgcatctcagcaatgtcaaagtatcttctgaagcttcagaagatggcatactggaagccaatcatgtttctacacttgcttgcctcggatctccctccactgccactgtaactatttttgatgatgaccacgcaggcatttttacttttgaggaacctgtgactcatgtgagtgagagcattggcatcatggaggtgaaagtattgagaacatctggagctcgaggaaatgttatcgttccatataaaaccatcgaagggactgccagaggtggaggggaggattttgaggacacttgtggagagctcgaattccagaatgatgaaattgtgtaagttctatattatatatgtgtgtgtgtgtgtgtgtgtgtgtgtgtggttcagtgtgtttatgaatgtgagtctgtgcatcattttttaaattaaatagcatgcaaggaatggaatagcttttatacaagatccctttcaagatatcagtctttgcttgggtgccagttatcaatatgctctgcacacagagatcttaaatttatttacatcagaattttatttttacttttatacatttacacattttaactacattgtgactatgataaaatgagtgatgggacacagtttatcagatgacttaagacaggctgagaaattggtcttctattttgaatcacatggtatatactcagaaaaggaatatttaaaacatcacaataggtctctaacttcgtttctgagtacaaattgggaaaacccaaaaaggaaacaccctgaaaata

SEQ ID NO: 3071 - DNA, 1155 bp, Homo sapiens
ctcttttgttgccagactttctattctttgcaaccttaagtctcttccctcccattccctcctcctgctgagtccccccacaatgtcaggtcatagttaggaggttcttgcaggagtagtgatgaaagataatggtgactagagtttgagtagtgatggcaaaagaaacggtagggtttgggatatattttgaggggcctatggatgtgcttgatgaatggatgtaagggacgaagaaaaccaatgaatcacagataactcctagtttttcagcttgatcaacttggtagtactatttagtgatgtggggaagacttagatgaattagatgagctatacagtgaatgatgggaaatcagatagaagctatttttttaagttttgttttcataaaaagtaatatcacatctcagacattggaaaggtagagactagatgaaattacttatgatcctgacttcctgacacaataattttaagtgttttggtgtgtatctttatagtcttgcataggggttggcaactttctgtaaaggcagcttcttaactctgttgtagcatgaaagcagccataaacaatatgtaaacaaatgagcctgcttgtgttccagtgaagctttatttatggacactgaaatttgaacttaaggtaactttcacatattgcaaaaaattcttttactcatttttttccccaaacattgaaaaatgcaaaaaccattctttgtgtgcaggccacacaaaaacagttgacaggccagatttggctgtgtagccagtttgcaggcccctggtcttgtgcatttgttttatggttatagtcatatcttacattgaattttattacctaccttttctactttatatatgtgcatactttttaaattgaaagacaaagtgattgcattcgttgaatagtaagccctgataaacttagtttacaaagtgcctttatgttcattattttttttaattcttagaataaccatgggaagtgtgtgtcatgcttaatataaagtaaaatatgtattatgtacataattgagggtaagttatacattatcattagaactctgtctcttccatttctctctatatgttggctttattctctgaaatgatcttcccccagcagcagtggtcatggctaccggt

SEQ ID NO: 3072 - DNA, 1148 bp, Homo sapiens
tgccttcccagaataattaagcaggttatatgtttacaaaaatcatataagcattttatctgtggtcataatataaagatatagctcatctttcatgaattgagaacattttagaaaaatatatccatatagtttactgacttaatcgcggcctttggtttacaaataatggcttgcaaaaagtgaatttattacgttacataattagctgggaggaatattggagcagctctcagaattgaagggccaaggcttcagagagtataactggaacacaaggtagttagaaccacctttatttttgacagtcctagggtgacatcctggtagctggagaaccaaggtggatgggctataactctacctctgggaaattcaagagggcttcatttggcctatcctgtatctcatgactactactcctgtggtagtattagactgagccatattaactaactcacttccttcctccctccctctctcctttcctccctcccttccttcccttttttctcttttcttttctttccttttcttttctcttctcttctcgtctcgtctcgtctcttctttttttctcttttcttttttcttttctttctgatagggtcttcctctgtcacccaggtttaagtgcagtggtgtaattaaaactcactgaatccttgaattaaacccatctttgactgggtttaagtgagcctcccatttcacttttctgagtagctgggactacaaacacgtgccaccatgcccagctaattttttccatttttgtagacatgggttctcactacgttgcccaggctggtctcgaactcctgggatcaagcgatccgcccaccttggcctccctaagtgctaggattacagtcgtgacctgccttgtccagctgaaatttctagtagtaatatttatacaactgaaaaggtcattttatatggttcagtctcatagtatggggcgcagagggtaaagtgaagcatcatagattgacagctctactaggaccaagaaatatggtggagtttcacaaaagacaagagtggctattcttcctgtgagaagaaggagaataggaaagaattttgggtagaaagaatagtgaccatagtctaacatacttacaaagaatatagatcagcta

SEQ ID NO: 3073 - DNA, 1100 bp, Homo sapiens
tcaaatgctatgtaatatttctgataaaatttcagatgtaatcggagtggtcatcatgagtggccagaagctcctgaagtcctaagtgacctagagatgggccctgttgaccccgcagcatctgctaagcgtgtggcttttgtgcagctccctggagagctggagtgcagtagccacagcccccacaccagcagcaggaactgaagagtggctttctcgaaacacaaccatgttgcctttcacttaatttgtttgatccaaataattattttctcgggagaatttataaacgataacttgtctctttcaaaagtgtcagaggggccgggcacggtggctgacgcctgtaattccagcactttgggaggccgaggcaggcggatcacgaggtcaggagatcaagaccatcttggctaacacggtgaaaccccgtctctactaaaaatgcaaaaagttagccgggcgtggcggcgggcgcctgtaatcccagctactagggaggctgagacaggagaattgcttgaacccgggacacggatgttgcagtgagccgagatcgcgccactgcactccagcctgggcaacagagcgagactccgtctccaaaaaaaaaaaaaagtgtcagaggatgttctaaggaaattgtattcggaccagaaaagagatgggacagtatttacttcgtgaatgtcaggcataagcaattccttttttcatagactcgttttataaagatgagtagtgtgagttcatttaacaccttggttttaccagtttatttcttcttcacacattttaaaatgtttgtttatgtttattaaatagtgacggtaaatcagtaatgatatagagctttttgccttattgtacaaatcattttatcaccttattttaatttcattgaaagcagcaaaccaaatcccaaccaaatatccactagtaatgggaagcctggtgctgtgaatggagctgtggggaccacgttccagcctcagaatcctctcttagggagagcctgtgagagctgctatggtaagttttctctagcaggtcagttaagcatcgggaactgttctggctcatggggtgtgagcgtctgg

SEQ ID NO: 3074 - DNA, 1231 bp, Homo sapiens
gtgccaggaaggcagacaccagcgaggaagaggtggggtggcagggccctccagaggacccccccacagtggtaaaggcagagggagcagaggagggtgagggagagaaggagggagggagaacagaggaggagagagagggagatggagagctcaggttatgaagttccatgggctgcttgggccatgggcctgagagaaggttctggagtcttctacccctgcaggagtgctcagggcaaagtgggatgattggcactatcagctggccaccacggtgacacaacatcctggggttttcatcagcattctcgcagccactgagaaacaccctgtgttcctgtttgcaggccaaggggaaccctgcagccctccctccttccctccgcctcggggtactgagtgatcccaccacatgaggtctctgagcccagcctgggggttgtgctgctggtagaggaggaagcagggctcagcaggggcaagatggaagcccagagaaaccctgaagtgggaggatagtccagccgggtgaggtgggggctctcaggatcatgcagccctccctggacaccccctcctccactacatatagaggctggtggctgcctccctgcccccaccagctctggcttcagggactgtggagccaaaaggacattgtcctgagaggtaggcagggagtcagtgaagacctccaccgccctgctggtggcctggagggaaccagtcctatttgtgctccgccagcctgctgtgtgtctgaaagcccactgtagttcagctttcagttgctcccaggttcctgatggttccgaagtctgtgatggtcccaagtccgggtacacggtgaagtaggccccatggacggggacgcccctgccaaatttctactgccatggcacggggagctgggggcttctcccgcaaatagaacaatcctgatttttccctgtctgtgtctccccatggctccttgtccactccactccttgcccccattagcattcactgcggaatagggagtgggaggctggggctagctccagacaaggtacaagtccagctgtcccatggtgaggtattctcatgagcccatgggctggtcctgtgggtggagatgagggcttcaggctcctgataacccgggacagcagggccaagggaggtgctggttccaggctccagggcctgaccccatcactgccaactggctggggtcagcagtctg

SEQ ID NO: 3075 - DNA, 1216 bp, Homo sapiens
tcaataaaccctttccatgttcattttaatcacttatttattgactgcctaccatgtcctcaatactgtgtgacatgagacatgacactttttctttttttgagacagagtctcgctctgtcacccaggctggagtgcagtggtgtgatctcggctcactgcaagctctgcctctcaggttcacgccattctcctgcctcagcctcccgagtagctgggattacaggcgcctgccaccacgcccagctaattttttttatttgtagtagagacggcctttcaccgtgttagccaggatggtctcgatctcctgacctcgtgatccactcgcctcagcctcccaaagtgttgggattataggcgtgagccaccatgcccagctgagacatgatacatttttaataggaatacttgcatcacacaattgtacagcacttgacagttgataaaacacctgcacacctgtgatctctttactatgcaacattcctgtagacaaaagggcattataaacctaaattaacagaagaaaaataaaatgaagctcagaaggattcagtgaaaactctgagggctaagtgtaagcaatgctcacggcagactgtgatccagagctctctggctacccaacctgtagctcacacctggaaatcaagggagcataaaaatatctcctagctaacaaaaacacaaactgtaatttacacatatttggaaaatttctaaatgagtggttttttgttgtttttttttttaaaaaaaattttaaggatcatgaaaatatttcagaaactaatgtaaactatggactctctcacaagaggaatatatttatgaacatatgcacacaatttcccacacagtttcaggttcgtgacacacatccaaaacccttgtggggggagtttcccagacccaggtggagaacctcctgctgctcctttgcatacatcaatgaccacacgatgtggctgtcaggtttgtgttctgctgcatgtgacacagcagtgaagaacactgctcacagggaaccaccagcttagaggcgatatacagcctgctcatcacaaatcggtggtacccatgcagacattcacagccgaagagtggcacagaaaagtgaagtgggaggcagagctgagacaattttctgcaacagatgaaggatcttcaaatgagggtgaaatacacacttggacttaacacttgaggaacc

SEQ ID NO: 3076 - DNA, 1128 bp, Homo sapiens
gtaggtctggaaggatccttcaaggggcatctaatccagtccagcatcgtgcttatagagagattttgaagcaatttccagacagactggcttctctcctgttcttcatgttttctaggaaaagagattccacaagtttctgtggttacccacgctattgtttgggaaagaattgaattctcaaaactaaaattgaaagctgcagggcaattgggttttcatattttagagaatgtaattattagaattcagaatagcttatttgcttcgaactacatagtaacttgtagcaagccctatttggccaaattgaaaaacagaattttcttttgactgtggccggggtaatttttttttcttttttttttttttcccccccaagacagagtctcgcactgttgcctgggctggagttgaatggcaggatctcaactcactgcaacctctgcctcccgggttcacgcaattctcctgcctcagcctcccgagtagctgggattacaggtgcacactaccacacctggctaattttttgaaattttttttttttagtagaaatggggtttcactacattggccagattagtcttgaactcctgaccttgtgatcgcctgcctcagcctcccaaagtgctgggattataggcgtgagcggccagggtaatattaacatcctcaaacccaaacagttctaattttctccactgaacaagcatttattatgtttttactctgggccaggccctctgctagttactgggatccaaagataaatcagaaatactctctgccctaggggactccaagtctgatgaagaatatggcagttatctgtggtgctggagtctctgttcagttgtgtagaaggacaggagaagttgtgaaggaaggtaacatttctttagtgcgtgggccatgccagaccctttatacatgtctaacttagccgagatcacagctctgcgaggtaggcagtatcatcctcatttcacagaagagggacctaaggctcatgaggtttagctacttgcctgtggccatacagccagaaagtggcagaactagaacacaaagcgagctccatctgcagagcacatgctgttacacaccaaacaacggattccctca

SEQ ID NO: 3077 - DNA, 1221 bp, Homo sapiens
ggctgttaagacatctattccttgaatatttttgaaactttttttttcacatgcctggtaaaaacatttataaaacattttggcagttatgggctgcacagaatgtctttaaatgatactttttaaaaagtccctgacattaaactgctgatgttgaaaatattttatcttttcaactttttgtttccagtgtagatatgacttatgaacttttttttccctcaaaacacaacacactccactcctatcaaatcagttaacaagaatgtatgaataccagcagtgtgcttagtactgtgcttggtttggatgatattatggtttttttataagatgaagttcctgttattaaagagcttatgttttagtttgagaaataagtagagatgaaattcaaaatatttaacaaaaggtatgttgtgagcactgactggtcagaaccaacactggctgtatacagcacccagcatctctctgtgtgtggatgtgtgtggactgattaccagcctggaagtaagaccgacacacttgaacaagataaaactgccaaattttgggtgaaatttataaaacatataggaatagcagagagagaaagcaatggggataggctggtagggcttcatggaagaggtggaatttgtgctaatgcatgagttgaaagaaggaaacattgtgagtaaatgttcagaggctagaatcagcaaggtgaataaataaacctccttcctgtagtggtggagttggtaggaaataaccaggcaagttgatagattgaggccaaattatagtgtcttggaaatagatttactgtagcagggatggagagaggcatcaaacatttttgctctgaaatagatcataggaggcatcatagaatggaggaataccagtaatctgtgactctggttcttagttctgtgtatattcattccatttattggcaatgagattgtacaaaaattaacctccctaacctttgatctcttcatctttaaggaaaagggtatttgccctattgacagatctctggcttttgttgtatgaatcaaataaaatagatatttaagaagacctctttgcattatagaatttcctacaaatttaaaacatgagattgatgttggttgtggggttggcatgtaaaagcagttttctggttggaaatgttaggttagatagattgtaatacagattatagtaaggagagcctgcaatcag

SEQ ID NO: 3078 - DNA, 1139 bp, Homo sapiens
tcctgctcttgtattttagaggctgtgacaacactgaaaacagtattggatcagcagcagaccccttctaggttagcagtgacccgtgtcatccaggcattggccatgaagggtgatgttgaaaacatagaagtagttcagaagatgttaaatggactcgaagactccattggactttcaaaaatggttttcatcaataacattgctttggctcaaataaagaagtgagtatttgcaagccttcttttccttcattggtcactagaatgggcattgcctcagataccaccttttaaaaacttttttagacatgtggaaaccttatcaactgcagaggaaatgttgatgctagttgctgattagggaataattatatgttgaaaaatatgttttttctttaccttaaatcttagaataaacagcatttaccaaattcataaatcttgctccacagttgataacctttctcattcctgtgtatatatgccaggcctcttgttgtcgaaacactttgttcagaagtgaaaaatgatctcatttgtttgtcagtaatatttgatagggacactagtagaatattgtgaagcagaaggccccgcaagcttattaaaaatgtgcatttccgtattcatattccttacccaccccgtgaacactctcccacccccacaaaaagggaggtatttagagctgattttcttaccactgtctctagattccttttgagaattacccctgtagaaataaataaggacttgatttttaataagctccctagcaaagtactttatggaatttgatactttcagtatgcttttagaaaaaatgttctttagtaatcttgcatacatttaatgggacatgatattaaaatataatgtttgtttttgtaggggtttttttttgtttgtttgagaaacagttgtgttttgttttgaccttttcaaactatttcgccagatagaacttccctttaataagaaaatgtgattgttttacattagaagattgaagaaattactcatctaagaactgggtgaattttaaagttttaccacataaacacagttttatatgattcggagaacatattcactattaagtaattccttaaaacttgtaagagaaatatattgtaa

SEQ ID NO: 3079 - DNA, 1129 bp, Homo sapiens
tatattgtataaatgattccaatataaagatctctacccgcaactttttaaaattttttccttttgccactttggaatctgttttggttgtaattggtcagtttctacatatgtaggatatattattatagaatagatctggggtttcttcttcctgatatttatctccactttcatatttgtaatgagcaggcagcttgagagaggaagagattattgaaaaagaatgttacaggctttgaggtttttgaaaggtttgtagttcatacttagtgtcaaagacaagttttgttgccttgtggttttaatgaattgtaggtgaatatttttaaattaatatggtataatacatgtaataatattagaagtgagcttttaatagtgtctcatttttatttaatcatgtgaaagattgagaaagtaaatcctttgtgcaattcttagtctcatgcatgagttgttgacttaagttgttgacagatgggacaaagggagaaaagtcaaactgagcaatgggtactttggtgggataaagaggattggtcggaggaataagaaaatcctgtgtccagggactgcaggggtggaccttagaggctgaaagtgactgagagaatgggcatgtcgtagtgtctctgggggattttcttgggattgatgaaaataatttagcagtgaccccacttttgttgcaatctgcccagcttatatgtccgtgttggcagggcatgctgttgttggcaacagggtcatcactgagctcgataaggcaaatgggagcaattgcttttgctccttttgacctgtttagattttctaatccggagatgaactctgggagcattaaggatgcagaaatttcatcacaggagatgcgcaaacagtgtagcaaacagaaatctccagctaggttttggggttttctgtttgtttttgttgtttcattttgctttttttaaatcctgtaggttttattgaaaagtcaagtgattttttgctcttgagttttaaaagttggtgttttgtttcaaacttaagctagggcaagatggttgtgtgaaatttttaattttaaagtaccaatagtttgagttctgcagtatgttcagcttcagaaactgtatgaatc

SEQ ID NO: 3080 - DNA, 1158 bp, Homo sapiens
tgtcccatccctagggattctgatttaattggtctgattattcttacgcgctagggctgagaaaccactgttctgtaggatgtaggggaggaaatttcttgggcttttgttgttgctcccgtaaattaggataatactaaaaaaaatacttgaggtaggagttactagactatagagggaatattgtacatacattttctgtcaaatttaaacatttaacacctgcattttttatttcagatttattgctaaacatgggtgcatttttggataaacccaaaactgaaaaacataatgctcatggtgctgggaatggtttacgttatggcctgagcagcatgcaaggatggagagtggaaatggaagatgcacacacagctgttgtaggtattcctcacggcttggaagactggtcattttttgcagtttatgatggtcatgctggatcccgagtggcaaattactgctcaacacatttattagaacacatcactactaacgaagactttagggcagctggaaaatcaggatctgctcttgagctttcagtggaaaatgttaagaatggtatcagaactggatttttgaaaattgatgaatacatgcgtaacttttcagacctcagaaacgggatggacaggagtggttcaactgcagtgggagttatgatttcacctaagcatatctactttatcaactgtggtgattcacgtgctgttctgtataggaatggacaagtctgcttttctacccaggatcacaaaccttgcaatccaagggaaaaggagcgaatccaaaatgcaggaggcagcgtgatgatacaacgtgttaatggttcattagcagtatctcgtgctctgggggactatgattacaagtgtgttgatggcaagggcccaacagaacaacttgtttctccagagcctgaggtttatgaaattttaagagcagaagaggatgaatttatcatcttggcttgtgatgggatctgggatgttatgagtaatgaggagctctgtgaatatgttaaatctaggcttgaggtatctgatgacctggaaaatgtgtgcaattgggtagtggacacttgtttacacaaggtatgtaaacttttttgtcattaaaataacatgttaattttgaaaagttacggtaggt

SEQ ID NO: 3081 - DNA, 1199 bp, Homo sapiens
aaatgcggaattcggggagagcgcgcatgcctggtccggtggagggagggtgccgggcgtcacaggtcctgacagggaagaagttggcaggtcctggcaggggacgagctgcggcggtggcacctccgggtgtggaaggctccagtgagatggagtcgcgagtcgcggacgctgggaccggcgagaccgcgcgagcagcgggcgggagtccggcagttggctgcaccactcgggggcccgtagtctcggcgcccctgggagccgcccggtggaagctcctgcggcaggtaagggagaacctgctcgcctcacctttgcctctggtcactcctctctcacgtaccgggggagcgactgttcgcagttctttcctcttggcagctctgggagacccttctcagtttgccgggagccacctgcgaagctccccctcgcttcacctaagcgtcccatccaagaggaggaatcatgtggggttgggtggggagcgggacagccaaggctgagctcctgggaaactcagatcgaagtagaagaaccccttctagacatttttgtgcgtctgggggacttttccccttctcgccagtctctggtgcgcccgccgctccccactgctcttttcctgcttctgttttgcctccttccccagtttcttctagcttaactcccagcctggttcgagttaccgatattcgtctgcaccctctggccccgtcttttgcccagcgtggttgactatgccgggactgagacacggcatgcgttccctcggcatcttccgtacagcggagcgtgcaaggagtaggaaaagctgataccctctctcactgaggtctcaaagttaaatgattatcttgtagtttgtagtgatcagcgagattctccgtgtccaaggtgggctagtcaaagtgtgttcgtttttgaatgatggtatcttctggtacttcaaagtttctgctgttacttacaactccactcgtgcaagcttgacggaagttctgatttatgatcactcacattcttcgctcacttcttgaagtgaagtctggttattgtttttgcatagcagtgttatgcctctgcctgaagttttctgccgaaaactttactcaggaggacatttttccatttctgacagttgtgtttggaaaagagtttcccagctattgccactttacttgagattgtgcttttag

SEQ ID NO: 3082 - DNA, 1230 bp, Homo sapiens
tctgccttgggtagctggcaggatgatgatgcagttcactgaggagggtacagttttggaggcatttaggtgagatgatggatgtggtttggggaatattacatttgaggggcattgggcatgatttgagttggtataccatacagattaatttcttgtcaatatttttaaagtattgtaatgtgtttttttaaccacaccctataatttaagtaacaataggatctccagaatgagaataatagggggacccatagagagatggcctctcaaaggcagtagccttttagtgggctctgaaagatgagagatgccaactgtgcagttagggaagactccaggcagaggcacagcagacatgcaggcattcatcccatgtcaccaaaacatccagtatgttttcagcaaatgctgaaaactgaattacagcctattctctgtcccttgctctccctctagtttccctagatcagggtggaaactctccatccagccaaccgtgcacttcaaaaacccagaggtcagcctggacacctcttctcccccgacctccagtcataagtcctgtggattgtccttgaaatctgactgtcactctgctcccttctgtcctagctgccatcttctgtctcttgaactgtgcagcagccccctgccggtgccctgctttcattcttgtgctcttccaacccaatctccatattcagctgagtgatctttgaaaaacacaagtttgctcctgtcattccctgttgcaatgtatttttacaaacacatcctaagatagttagtcacgtaccaacttttagacctttaaaaattgcatttatctgccaagcaattgttccccatggaagaagagctctagtgactactttgttcctttgttgtctctaattttaatattccaaaacccacatttttttttacaattgtcatttgatttagatgacttaaaagctttttattacaagccatatatatactaatagaacaacctttaacaatatatttttttgattcaccagaaaaggtgatcatttcttgatcacaagcagtaaggtttcttgtcctcagctcaacctcattataactatatatttgaacaaactaagatatcctctgaactgagtcacctcatcccagggttcaactgacatggggaattaccttattttagtcagaaagccttaattagattaggttggcctttctgaactttatgtgttg

SEQ ID NO: 3083 - DNA, 1179 bp, Homo sapiens
ggccttggaatccccgtctcttctgggagaaaaatagattgtgtaacgccagctcagcgttctctaagcttgctttgcaaggagctattgtcactatatattagatgtagtaataaaggatgtgaaaaagacttgaatgatcatgtgttgaacttgatgttcacagtagataagtagatcttatgtctgattagagaagtggtacaaatcagcgactggagaatctgagagtcacttgcaagagatgacttttgtttccagaccttgaacagcttaacatggaaacaggcataggattttctttgatggtcttaatattttcacttaatgaatttatatttcatctaacctgtatgagaaggtgacactgattagcttccatgtgttttgaaaatggaagcagttcatatatatataaagactcagtgtaaatatgctactggagagggaggctgcctttagaactattcataagagttgtaatagttatcttttttttctagctaaatctatcttataaacgaaattagatgtgaatttttattgatatttggtaaaaaaaaaaaggacaataaatgacgaacaagtaaaatcatgacacagttaaaggaatgtttgaaattaactctaaagtttcttgagcatggattgtaatggtcaagaaagggatgtaattagaactatggtgtgttaagagacaagcagttgggacagaaggaggatcacttgccagggcaatcttgcagtcatattcaaggccacatgagtatattcattagccaagtaacttgatctctggttgcattaagatatgattctgctgggcgcagtagctcatgcctctaatcccaacactttggaggggtgaggcaagaggattgcttgagcccaggagttcaaagctgcagtgaactgagatggcaccactgcactctatccagggtaacagagtgagaccctatctctaaaaaaaaggaactttaaaaaaggaggtaattccgtcacttgttcattatttgggggatcgagttctaataagcatatttgacatataaatatatttgtaataatgcagaattatttaaaacaaggttttgcttcctctgtgaagcatgaggtatcctattatgctttacgtaaagaatgaagaatgaataggtaatcatgtaagtataggga

SEQ ID NO: 3084 - DNA, 1197 bp, Homo sapiens
tagtttcagaaaaattattatataaagtgaagataatacacacattactggtgactctaaggattacttgagataatatatttaaagtgcttagataggctctacaattagtaatgctcaatggatggtaacaatttgtagctactaaatattgcacctaggattttacatgtttgtatttatcttagcacaggttatcttttcaaattataaaaagtatacccttccaactccagataatcaaaaattttcaattagtagaatctgaaatgagatttttagatcatcaaagtctcttcttgtaaatgtgttagataggctttgtatctgcattttattttctaagagcatgttagggttttccttatgtgggaggtatgttacttgaaaaaagtgtaagtaaatgattattttaaaatgtattcttgtttaataaacgagtaaaaaattcatatagctgtcagctacatagtcgcctgatttgtttcatatattttgtggattattagtctttgccttatgtttgcactcagattctggcaattaaccgtggagaaaatttgaaggtactgacggttaaggtcaatatttctgatggagtgaaggatgaattctgtaggtggtgcatccaaaacaggtctgtttacagatatttacagaattttctttgtttcttttctaaaatatgataccgatatctatatgtactgatatgtaaagatgtctattacgtgaacatttttaaaaagccagtgacaggccgggcgcggtggctcacgcctgtaatcccagcactttcggaggctgaggggggtggatcgcgaggtcaggagttcaatatgagcctggccaagatggtgaaaccctgtctctactgaaaatacaaaaacaaaaaattagctgggcatggtggtgcacacctgtaatccccgctacttaggaggctgaggcagagaattgcttgaacccaagaggctgaggttgcagtgagccgagatcacaccactgcactccagcctgggcgacagagcaagactccatctcaagaaaacaaacaaacaaacaaaaaacccaccaataacagacaaggtatgtagtgtcctttttgaattaaaaaaaataataaaataagtatgtgtgtcatgcatatttaaacagagaatatccaggagggtgtgtgaggaatttttgatagtg

SEQ ID NO: 3085 - DNA, 1203 bp, Homo sapiens
gtgaatctttcccactgaactccctggtcagtgtggcctcctgctcctcctcttcctcctcaagaggcctacctgggctgtcttgccactgaccccacgtttgctggcaggtggaactcttacctgtccgggccatgggctctgggcttgcttcacatgctggaccatttctgttcttggccttagaatgcatggtgaagtgcttgcaggactgtcctcagcccagggagctctggctccaggtgactctcatttcctctctgtcaactgtcccaattcctaacccactcccactctgagctccgtagcctgtgtctggctgctgtctgctttcctgcctgttctgtctcttcctgagaacccctgcccatgaccgtctggctatcttagagcacactatgagattgtgtgaagaggatttgcttagaggggacttggcattttaatgctagcagtaaaacaaacctgccatgctgacttctattgcattaaaaagtgaagcaacaggcttgcttaaacataaacagcaacagtaaaaacccagaactacctaactacatgggcacaggaaatagtccagccatcttggagaatagcacaaaaatacagctgacgtgataacagtaaccctgcaatgagtcttgacaatgctgaagtcaaatgactttttcaaacctttctaatgcttggctataatctaaaggaagcattgcacttcgagtgctgattttttatgaagctcgtaaacctttttctttaaatgccaatgtgctgaaaagttatgagtattaaagacttagaaagtgcctttaaaagtgtgggaaaaggtccctcttttcttgattatgattcttgaatgctagtaatgatagtagtagtaataaatgtcattcttcactagaatagttttttccaaagacctttcgggtctactctcaagttctttcctatctttgtgtgaggtggacgatgtcactagcctcacgtggcagaacggggtcagaagctcagagtttaagtaatatggcctggaattagaacccaggagtattgctccttcttgtaaactctgatgcctgggtttttacatggtgtctatctgtaatggcttataacagagttgctcctccagaagttttagcctcgttcctgcttgataggcagggcctcccattgggcctgacccaggatacatgcttggtt

SEQ ID NO: 3086 - DNA, 1149 bp, Homo sapiens
aaaattcaagtctaaactaagagccaagaatgctcttttttatattggcctatctaaagcgttaatttggctcttactaataaacctgaatagttatggttaatgaagttccagcctgggcaataaactagcttccctctgtacttaatggtaattctgaggaaagagaggaatggaaagagtactcagtaattgagtaaatgtgattttttttttttttttttttttttggtcttttgctattgactcattttttgtgtacttcttctttttcagagtttgtacaaatgatgacagcaaagtgaagaccttgtacagaatgtgttaaatttcttgtacaaaattgtttatttgccttttctttgtttgtaacttatctgtaaaaggtttctccctactgtcaaaaaaatatgcatgtatagtaattaggacttcattcctccatgttttcttcccttatcttactgtcattgtcctaaaaccttattttagaaaattgatcaagtaacatgttgcatgtggcttactctggatatatctaagcccttctgcacatctaaacttagatggagttggtcaaatgagggaacatctgggttatgccttttttaaagtagttttctttaggaactgtcagcatgttgttgttgaagtgtggagttgtaactctgcgtggactatggacagtcaacaatatgtacttaaaagttgcactattgcaaaacgggtgtattatccaggtactcgtacactatttttttgtactgctggtcctgtaccagaaacattttcttttattgttacttgctttttaaactttgtttagccacttaaaatctgcttatggcacaatttgcctcaaaatccattccaagttgtatatttgttttccaataaaaaaattacaatttacccaatggttgctctgcatctgagtcatttaactgttgaagtctaataattttgaaaataaaatatggcattggtttctgcttggtatagtctagataattttttctcgtgtggggaagcatatggagatgggtggcagaaatagtgaaggtgggaaaggaaggagaaaaggattggaaaagtgagaaaagagggagagaagcacagaaaataagaggaacaaaataaggggtgtaa

SEQ ID NO: 3087 - DNA, 1136 bp, Homo sapiens
aaagggaaagtagcctgttttaatttagtaggtgattgatttagacatagtggctaactctaaacacagtatacagaaacagtttaattactctgtagaaatacgtatttgggtaccagtagtcttatttttgttttgtgagtgtaggttaggtctgtaattttgaattatgttccacagagcagcttcagtgacagaggagccagtcatttggggatttggttcttttcctctgtaaacctaggataattttacttaggtcagcatgaaagtacagtggtatgattggtcaaagatatatttgaaatattatcataaggtatcataaagattggttaatctttaggagtcaaagtcacatttcaattgctacctccattggtatttttccgttaaaagtttttgggtttttctgagacgtggggtcttacagtttggccaggctgaagtgcagtggctgttcactggcacgatcccaccactgagtaggctttaagagttaatacgtttcatttaggttacattttattattaatctgtgtatttggattgtggtctttctttcaaacagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaagtcttcaattttgtggggctgggaggggttgaagaagtgatacttagatgtttccactaaacctttgctgtttgcttatatgtttccactaaagctttgatgtttccactaaaccatttcaggtaatggcacaattgacttccctgaatttctgacaatgatggcaagaaaaatgaaagacacagacagtgaagaagaaattagagaagcattccgtgtgtttgataaggtacgtcaaggactggatatgttaaattttgaggatgaaatgaagataccaggactcattatgaagacttgtgtttttttggttgtttttttttttttttttttttttttttttgatgatttaccaacatattttaattaccaagcaaaagctttttaagaattcagtatagactttctaatatatgt

SEQ ID NO: 3088 - DNA, 2396 bp, Homo sapiens
cgtctacccctcaataaggggcgggaaagtgggtgagtgtggcagggaaggatacgtggaagaggaaggttctccagccaagcgcaaagcaggcgactctgccgcctggcgcagttgccaggacagcgcggcccgagcagcaacggcagaagccgcaccgcgtcccggcggcggctgcgagtcccagtgacgcattgcaggtacaaaccagccaatcagaggcaggctcaacgaccaacgggggacgcatcgccgccacgatgctcctccgcgccgcaaagtagcgcccctcaggggccgctccaccggccttttaacggctcgctggaaatgaaacccacttacgtcatccgttcgcccactttccttgatctcttgcctcatcgaccaaataactgtgaagaaaggggtcccgagaagagtttgaggggagggggttggccgggactcgtttgcgatgttccgttatctggatgcggcggagggatctggcggagggaggtgtttatgaggcgctgggggcggaggaggcgaattagtccgagtggagagagcgagctgagtggttgtgtggtcgcgtctcggaaaccggtagcgcttgcagcatggtgagtgcatcgctgagctgccggcgctgggcctgtggggggaagagactggagcgaactgactaaacaaaggaaactcgcctcccttacaccttcaaggagtggtttctgccagagggatggcgcgaaagaggccagggatgccggcgacggttgtgtcgcaggtgctcccccacccccattctcttcaggggggcttcctctagtgagttgagggccggacgcacagttcccgaggtggtgaagctcctcgggggcttggctggaggaggatgggtccgggatgagggacagcccagtgcacgggaaggagagaaagtgaaggaagggagagagggagcgtagagagccttctgtcgggcgtctggaaaggtcaagcagggggcgaattcaatccacccgaccgacggttagtgcgggcgccaggaagcgcctttgtccgcttgcggccgccatgcgcccagggggcgggaggagcgcgcggggccctggggcgagcgtcggcgtcgcagttagcccgcgtcctccgcgtgccgggatccagggggcgcgcgggcgggcgggcggcgcgctgtgtgggccgagcccgcgcggcgcagggagcggccggtgggggcggggcgggcgagcgcctcgcgggacccggagccgccgccccgctcggccccgctcgagctccagctgctctgctggcacctgcaggactgcggagatctccttggcgctgcggggccattggcggggatgggcgggggaggggggcctcgacggtttcccatccccctctggcaaccctaatcttccttctccatctgggccctggggcgtcttccaccacccaggccggatgctttaaaaaaaattgctttttaaagtgtctgtcgttgaaagaaattagtcttacccttgaagtcaggggcgcgtcctcgcaatacacatcttgttagggaaagtgttcggctccagctagggttctacaaggcgtttcttgttcaccgccggagggaagcaggctccggagtgactgccttctgaaagtcggtcttgtaacaattggatggatgcctttgaagagcccctgtccctattctatgcttgaaaacagcgtgcagtcctaatgttcaagaaccacgaccacataaaaacattgctccccttctgctgctttgaaaacgacccctaaattccgtgtagaagttgccaggtcgtcttgacgtacacttcgtttgtatgatgtttgtctgtcaaatactgtgatggaagagtgtatgcgggggaggagcagggaatttttaaaagcattttccggtcacctcagactgggagatcatgttctttcctgaaaaaaaaaaaaaaaaacacctaatgagggcggtgatctgtgatacttactttgtggttcctcctgccaagtggttacagcgatgggtgtgtccaggaggcaaggtgacatcttaaacaggagttagggatccttgccaactgaaacctccagcctgtatgggtgtggggagacgatttcaccttaaataaaactagcgttcattgacgtttgatggatttgcttcatcttgatgcttcaaatgttattctgaatttgaatgtgctggttacatttgctttcttaaagatgtagttacaggcatatgtaataaacattacaagttgtggagtaagcttttttttttaaataaacgaagggtaaagttttctttaatcagttttgataattgaatcagtaattcgaatagattttttcttggtagagttggtatctacgcatttgtg

SEQ ID NO: 3089 - DNA, 1160 bp, Homo sapiens
gagaaaaatgagatgatgaagcactaacattagtcaagaataggaggcaggaggaaaaaaggtgatttggggtagaggagaggcaactttcacgttttgtacagttacattttttcaacaaattttaaatttttcaatatatatatttttaatagagatggagtctcactatgttgccctcactggtctccaacttctgggctcaagcaatctgcctgctttggcctcccaaagtgctgagattacaggtgtgagccactgtacccagccttcagtaaattaaaaaaaataagaattccaggtcaggaaataacaatggcagtataattatcagcatcattattagtatattaattttatcaagtgcttatgatgtgccaggtacttttctcaatgttccacactattagcttattgagtcctcataacaaccctgaaatacttgatataacatctccattttgcagatgaggaaaccaagtcaaagagaggttatctaaagtggtggaacatggatttgaatctaagcagttgctcttccacactcttcaccaccatgctaacccgaacaacaaaaaaacctttttgggaggcatccccaggtcagaagtattaagtggttattacacaccaggcacctattctagaggctttacataaattatcaagctttatttcattctcacaataatcctatgaataggtattgcaatcccttccccactgaaactttctggaatccgaaattctgatacacctatatagctatatctacatctatgtagatacagatagacacacacacacacacacacacacacacacacacacacacattcttctatgtatctaactgtagttcacatataaagtaatcataaatcactcctattgagataattagaaaaaaaggaatcatgggctgggaagagaaaagggagaaaaagcagaggacagaaaagacgaaaaggtttgcagaaaaactttagtataacagaaatcaagaaaatggagggaaagtaaactcaggtcttagtagtaactcctgagactttaagaaaaaggaggctgtgaccataatttggaatgacatgatgacggcagaaaataaaagtggttttggaaggggaataaattaatactgctttgctactcataaa

SEQ ID NO: 3090 - DNA, 1127 bp, Homo sapiens
tattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaatatgctttggtattttcatttcatgaaattgcagcagattaaaaatgcacacagtgggtaaactgcttcaaccagcgaatggtagcttgtgcttttagaagggtttttttcagctgatggtgcagctgtttgtttgtttactgtggaaacaaaagtcaacaaatgtgtttacataatcaaattttatttgacacataaaatgtttaagtgatgtgttttatactttgaaaataaattcatgcaccaatgttttaactcacatatatcatacagtgcaggatttatgaacatacataaaatcaaaatcataccatataaacgtttacaaataagtttttcatgacacacggacact

SEQ ID NO: 3091 - DNA, 1109 bp, Homo sapiens
aaacgtgatgagacaacatagtgtcaactttaagaaaaaaaaaaaaacaaccatagtcataactaccatttactgagtgcatccttgtgctcagttgcattaggcacttttctcactgaattctcatgataatctccactttataaatgaggaaactaagtttagagggaagaataaataactttgcaaaattacctagccaggtaagtggcagagcatcagattcaagcccagatcagtctggcttcaaagtgtatgctttttctgtgctagtcagcagacagtgcatatcaaggaaataccccttactgctgagtttttatattgcccctaatttggaaacagttggcttttatagtagaatattttcttaatttcttacagatatataatttctgattgacatttaggggaaaatcactccaattagtgacaattatgatgtgttttgttttctagggcatatctggaatctgaagttgctatatctgaggagttggttcagaagtacagtaattctgctcttggtcatgtgaactgcacgataaaggaactcaggcgcctcttcttagttgatgatttagttgattctctgaaggtaagtttattttgcctttcatttttgatatacccagaatttagtatcaagagagttgagtgtaaaattctgttcttctatattcaagtaaatgataaatattaattaaatcacatggctgtaaacttgtgttttaaaattcagaatccaatcaaataaggatgaagaagtgctattccctttttttttctggtcatacttaatacagagagtcctgtattcctttttaaaggagaataagttataaatcatacttgtgggccgggtgtggtggctcacacctgtaatcctagcactttgggaggccgaggcgggtggattacctgaggtcaggagtttgagactagcctggccaacatggagaaaccccgtctctactaaaaatacaaaattagccaggcgtggtggtgcatgcctgtaatcccagctactcaggaagctgaggcacaggagaatcgcttgaacccgggaggcagaggtttcggtgagctgaggtcacgccattgcattc

SEQ ID NO: 3092 - DNA, 1173 bp, Homo sapiens
tcccgggaggaaagtttccactctcagttcccccaggataacgcccttccggtggcgcgccagaaaccgcgccgacccctcccagccagcagcccgccccctttcccagtgctctaacgacatacggacgccagctgcgggcaaggccaagaccccaccccaactcacggttacccaaagtgggggtggagctcccagctctcagccccgcccattgaacgcaatcccagccggtaagagagaggaagtgccgtagtccccacccactttcatctccttccctttctgttggcccggctggtcgcctatcttctcgatcctgtagccgattggctctctccctcccgcgccagtccctgccctcccctggggagggtgagtcacgccaaactgggcggagagtccgctggcctcactcctagctcatctgggcggcggcggcaagtggggacagggcgggtggcgcatcaccggcgcggaggcaggaggagcagtctcattgttccgggagccgtcaccacagtaggtccctcggctcagtcggcccagcccctctcagtcctccccaacccccacaaccgcccgcggctctgagacgcggccccggcggcggcggcagcagctgcagcatcatctccaccctccagccatggaagacctggaccagtctcctctggtctcgtcctcggacagcccaccccggccgcagcccgcgttcaagtaccagttcgtgagggagcccgaggacgaggaggaagaagaggaggaggaagaggaggacgaggacgaagacctggaggagctggaggtgctggagaggaagcccgccgccgggctgtccgcggccccagtgcccaccgcccctgccgccggcgcgcccctgatggacttcggaaatgacttcgtgccgccggcgccccggggacccctgccggccgctccccccgtcgccccggagcggcagccgtcttgggacccgagcccggtgtcgtcgaccgtgcccgcgccatccccgctgtctgctgccgcagtctcgccctccaagctccctgaggacgacgagcctccggcccggcctccccctcctcccccggccagcgtgagcccccaggcagagcccgtgtggaccccgccagccccggctcccgccgcgcccccctccaccccggccgc

SEQ ID NO: 3093 - DNA, 1140 bp, Homo sapiens
ccactcatctcccaggaatctacatgacctgctattttcagatttctgaaatgtcaccttatcagtaagctcttttgtctttcctgacttactgcccttatagaaaatggtatcctcccaccttccttactctctatcccccataccttgttttatttttcttcatacaacttaacccctatctgtcatactatatttctatatatatataatttttttctttctttttttttttttttttttgagacagaatctccctctgtcgcccaggctggattgcagtggtatgatcttagcccactgcaacctccacctctctggtccaaatgattctcatacctcagccacctaagtagctgggattataggtgtgagcccctgcgcccagctaatttttatattctttaatagagactgggttttgccatgttggccagactgatctcaaactcctaacctcaagtgatccacctgcctcggctttccaaagtgctgggattacaggcatgagccgctgtgcctggactattttttttcttgtgtgttgtctgtttctacatgaatgtaacctttgtgagattagggactttgttttgttcaatactgtgtctccattgtctagaataatggcagacaaacaataggtgtcccccaaatattgaataaataaatgtagcacaacttaagcattgccctagattttgttttactagatgttttccctaatgtttccttgcccccttccgtaggctgatgagatgcccctctggccttctgtagcctattgtgcttacctctgtcacactgccttttctgctttgtagcagtggctcatttactagacctggaacacttgactgggaacccttgtgacttgtcaacacatccctaaatgtctaatatgaatgaatgaatgaatgaatggtaatcttggttggtttatgtaactcaatggcattttgtagatgttaaggaacaatccctttagctgtgttctggtttgagagcaccacaagtccaatgtcttatgaatagactagattattgttcagtgattattgattattcagcaaacatatgtttgagtactgctctgctagaaactgcattatgcacttgaatgcatatggtagaggaggg

SEQ ID NO: 3094 - DNA, 1044 bp, Homo sapiens
gtgagatggagtctcctctgtcgcccaggctggagtgcattcgcttgtcccggcttactgcagcctccgcctcccgggttcaagtgatttttgtgcttcagcctccctattagtggggattacaggcgtgcaccaccatgcctggctaatttattgtatttttagtagagactgggttttaccttgttggccaggctggttttgaacttttcacatcaagtgatctgcccacctcgacctcccaaagtattggtattacaggtgtcagccactgcagacaaccaagtattgtccctaatattaaatgcggtaaaatgtgacatgtaaagatttagaaccatgcctaacctctagtaagggcttattgtcagcctttagtatcatgtatttgattaaggggtgttaccttataagtctggagcacatcacaggcttggtgtgctgtgacttaatttttgttttttgtcattaggaattcctcctgatcagcagagactgatctttgctggcaagcagctggaagatggacgtactttgtctgactacaatattcaaaaggtctgtctaggggaagagcagcctcttttaaaaaaaaaatgttattttggaaattttttattttactttttttgagacaggctctgactctgtcacctagggtggagtgagtggcgcagtcactgcaacctccacctctcagactcaggtggtcctcccacctcagcctcctgtagttggaactataggcacccgccaccatgcccaggctggtctcaaactcctgggcataagtgatcttcccaccgtggcctcccagcgctgggattacagacgtgagccactccatgtggtgtattctggacattttgacacacaaaaagggaaaatggcattcgaatagcagtagatttttaggtaactcctatactgatacttgagaagcactgctatagttctcccattatgaattttgcaagttgtatcccatggtgtaatgtaatgcattctttaatgtccctataaactgtcagttaagaatctgat

SEQ ID NO: 3095 - DNA, 1044 bp, Homo sapiens; identical to SEQ ID NO: 3094

SEQ ID NO: 3096 - DNA, 1178 bp, Homo sapiens
cattgctagattccttcagcatttttctcttattcttgaatgtcccagagagttcaccgcagtgttcccaattctcaggctcatgatcaagagcccctaacccagtctgtacacacctctaaatatgtgggttttagcttttccctcttttagccagagggatggtagaaagttttacagagaaaataaaatcccaaggtccatgccctaaagatgaaggctaaaaataaagacacatatggaaaattggtttttaaaagttcctttcaaaattttttgctatcacactaaccaacagcaaaatattcactttgccacacaatgtttgatgtaagggaatgagattttcagagaaaatcactcttaaaccttcacaactagacttcggtggtaaccgagaatagtgacaaacctgagtaaaccccaaaataggagaattctgataaatgtatgttgatggcaattaggataactaactctatagtttaattaatattaatatattgtgttgtatttaagcttgagttgagtgaaaggggttgaagggaattgcacaaaccactctgagtgcctcatgccagccccatacgtgaaatgactcaggctcacctaccctgctttgcatttcggagacttccatcctgcaggcacctttcttctacatatggttgtaatacgcagacgtgctgctgagtttaggaatgcattaccctgattcctgctcttcaaaattctgagacatctggtatattcaacaacatcagcagttttggggagccagatgtattcagcactgcaattttaaaagtggctttaaggagcagagcctccctttgagcctccattctcctaagcctgacagatgctgagctgcagatgctcattcacaaaagcccacacgtgcatctccacctgaaggatgctctgaaggcagagccaactcacctccaaaactagacttaccatttatccaaccaaaactacttcccattctttatcttagttatcaccagccctagccaaccactggcccaatctataaacctgtgagtcatgttcaaagtcccccatctccctcaatcctcacatccacctacttgtcaattctaggccagaaagcccccacctgccagcgcatcaacaatgaactggcctagactctgagcgcttcagaggaa

SEQ ID NO: 3097 - DNA, 1195 bp, Homo sapiens
tcaggacattgataccatttactatactgaatcctacttgaatgtagtatcttactctcttttagcataatgagctgtgtatgtacttaatggggccacagatactttactttgtgtatctactccaaatacagtaaacatttcattagtcttattttatctacattgatgattcattgaagttagagagttgatattgttcattgtcagcatcactaagataaatagcaactcaaaatgaactaaattttccatttttgacccacagaggtttcaagtgcacattatttttaaagaattttgacattttagaaggaaaagagattttgtaacacttctagttgagttttgtcatttttacatgtgaaacagccagagaaattaaatgacttgttcaggatcatacaacttagttagcagagctggaaccaaagaaagctgaggtctctgtctacatttactttgagataatcacgatttttaaatatggcatacaaattgtttttccagtgattacagcaatgatactctgaagcacatcatctgatatttttaattgtctgaaatagaacttcctcttttaatttcagcatgatatttttttctttttttttttttccagaagtagaccactggaatatttttatatgatttcttatctatttgcctttgtgttaattagttctacatagccagattccattagtcagagtgtatattgatagtaaatctttttagccaacttattattgtagctaaatgttaatttttttgaaagtgttgatttcaaatgtttgttaaatactgtagtgatttttttcttcccttttacttacccagcagagtactgaaaaataagaggctgaaaaaagtgaaagcctaaaacttcttttaataatttgtcaaatgaaagatttcctaaaactaattttctttcagtacatttagctttttaatgaaaagaaatgggtatttttaattacatgtgactttgaagaatcagaattggattatagagaaatcattaagtatgattctctaataaggaaattgattttaagaaattttatcttttgcctttgttaacttaaaaacttggtttgtcctcatgactgccagtttttatatgactagttgaagaaataattttgtatttagcaatctttcaaaggtttttcttgctaaaaactgtttt

SEQ ID NO: 3098 - DNA, 1200 bp, Homo sapiens
tacagatataaaacctgtaacctcaacattttctatgctcttaacgtaaattattgctaattaacaagaattatattctaatgtatgaaatacgtttaacatcggtctccttgcaaaacatttggctagtggtgttcagagaaataccaaaacgtgtttttatcattgctggtatattattaaaaatcagacaaagtgggacacaaagaaaatatgaaaatacaattctcatggtgtagtctactgatttgcattgacatcttttctcagtggcaatcaacatttcctttctgggcatctgataatttctctgcattttaatgcaaattcccctttccctaaaaaccttcctaaccctcagccatttaccccctccctcaattcaactccatcctccttcgccccaacaataccaacatttctaagctccggcctaaactccggctacaaagcagggagtcctcgattgaagtggaagggagtgggcaaataatcataataattagccgcgaattctctctacgaggggaggaagaaatagaaaataaaatgcttctacgttcaaacagcaagacagcctggaacgtctcaatgtctcagtgacagactgagatctctttcctctctgtgtagttgcaaaagaataaatttaagggaaaaaaataatccttataggaaatgttggtaaggagcgagcaaaacgagagctgccggggagcggagggggagggggaaagggagatgtgtcttcaagtttgctttccaagtccttctccttgattgtcttaacagggtaaagaagcaaacggaggctgaaattcagagaggaaaagcaaagaaacaaaagcaaagccgggggctacaggcccggggcaggggccccggcaagggtggaccgtgcagaaagtgaagttgggcgcggggactctgaggcacaaagcgagcagcgtgctggctgcaggctcccgccgcgcttgctgcgaacacgtgcagcagcggccgcggggccttggggcccgggggcccggagacggagggcagccaggggccctgactgctgcctccatgcccgtccagctcggccagctcggccgcggggtgacggttccctgggcctgccagttggtgaaaaaggaagtgaggtttggaaaacccggctggttaacctggtgcagtctcagtatctccgcacacacctca

SEQ ID NO: 3099 - DNA, 1195 bp, Homo sapiens
aaaaaatatcttatggagcaatttcacttttgacccctcactcttactttttcatattctgcgatcacagactcagaacacatccatttgctaatcagatttgtttctttcctggaggattgtgactttttaactgctgcatcattaaaaaattttttttcatatgtttaaggtaagttctttagcatcaacagttctaaaggttctaaaggttctctgccctttcagatcagtgcccactgttttataacatatatttgtaacatcccctttagtaggttgaagtgaaattcataatctaccttacatgaatattttcaaataaataaaaattatgttctaacagcaatatcaagaattaaaaagaaagcaatttctaggaaaataatatcgactacagtatgtaaatgcttgggcataactacatcaaaagacataatggggccagatgcagtggctcatgcctataatcccggcactttgggaggctgaggcgggaagatcatttgagcccaggagttcgagaccagcctgggcaacatagcaagaccccgtctcttaaaaaaaaaagacataatgggttgggtgtggtagcacgggcatgtagtcccagctgtttgggaggatgaggtaggaggatagcttgagcccaggaggtggaggctgcagtgagctgtgttcatgccagtgcattccagccttggtgacagagcaagaccctgtctccaaaaaaaaaaaaaagacataatgaagttgccagatgtttgtacttgtacctagaatcagtgtgaatgcaagtgctgcaaatgcagcctgatactactgtggttttttgtttgtttgttttctgagacacagtcttgctctgtcatccaggctagaatgcaatggtgtgatctcggctcactgcaacctccacctccccagttctagcgattctcgtgcctcagcctctcaagtagctgggattacaggagcacaccactacgcccagctaatttttgtatttttagtagcgacagggtttcaccatgttgcccaggctggtgttgaactcctgacctcaggtaatccacccgcctcggcctcccaaagttctgggattacaggtgtgagccaccacagctggcatactgtgttgtattgatgagctgtcagagttacaattttccaacttttaaaacattttttaata

SEQ ID NO: 3100 - DNA, 1211 bp, Homo sapiens
tttttttgaggtagtcttgctctgtcgcccaggatggagtgcagtgatgtgatcacagatcactgcggcgttgacatcctgggctcaagcggtcatcccacctcagcctcccaagttgttggtgcaccaccatgcccatgcccagctagtttttgtattttttgtagagacagggtctcgccatgttgcccaggctggtctcaaaactcctgagctcagcaatccacttgcctcggccttctaaagtgctgggattacaggcatgagccactgcacccggtctatttagtcttctattaatgaacatgtatgttgttttcattttgttttaaaagctccactgaatatacactgtgagctcttgtgtgattatttccctaggataaatttttggaagtggaaaatttctgggtcaagagtatgctcatttaaaattgtgattcattgccaaattaataggccagacttttaaagaggcaggtaagtctagatgcaatataaaacaaggaaattataagtgatagctatcatttattaagcacttcttgtatgtcagggagtaaacgttagtgctttatgcacactactttatttaatcgttggaacaattctgctttatggaagagaatgccaagacttttgttatttaactgtcccaaatcatgctgcaaatataagtggcagacctggaattcatatgcaggttccttgactccagtggtaaaggcattaaaaaggaagatgctgtctgtggaatttctttttcttagttttggcagctcagaatcaggcttgttttttgagatgcccgggctggagtgcagtgatgtgatcacagctcactgcagccttgacctcccaggctcaggtgattctcccacctcagcctcctaagtagctgggattacaggtgtgcatcaccatgcccagctaatttttttttttgagacagagtctcactctgtcacccaggctggagtgcagtgtcacaatctcgacttgctgcaaccctcacctcctgggttcaagcgattctcgtgcctcagcctctcgagtagttggaattgtagatgtatactacgcctggctaatttttgtatttttattagacacagggtttcaccatgtcagccagcctggtgttgaactcccaacctcaagtgatcctcctgcctcagcctcccaaagtgttgggattacaggtgttagcc

SEQ ID NO: 3101 - DNA, 1219 bp, Homo sapiens
ggcagtaatcttaattatgatggaattatcattatgctaagtaattaactttacctagtttgttttacaactagaacctgccctaaatgttgaatatcttcctagcaagaaacagtctgtcattttacttacacgatgtctaaccaaaccataactttacataaactagtcgtttcggtcaaatagaaaaatgtgtgaatgccataaaaacaaaaattctcagttaaatgatactgggaaatagggaagacagcaaagtgagacttgggctcaggatggttcaggaagaaaaaaaaagaaagacccctgagtaccattaatattcctcagaaattattatttcaaaaggaaatatttctgtattataaatttttcatgagcagccattatgaaatctcacaagaatcatagaattcaataaaaaaggtagaaagtaatttttttacttaaaaatataaattaaaataaatttttaaaatcataagcacataaatagaacttaccagggagaaagaaaaacctgaaggcacaatttcttttctgttcaaaatgtgaacccaggatgtctctagatgatgatggatgataggtggggagattttttttttttttaatacagaatctcatagttttggattaattagcaccaatcagtttaaacactgactgttagaatagctgcatgggtttttttctttaaactaattaagcgttggctacttagtataagtaagtataagccgaattaaggttctgctacatctgtgtttagaatatttttttaaaactaaataagtgttggctagttttgcggtgtaagcagaattaaggttctgctacctctgtgtgtagaatattcccaatggatttttcatttttcaggtgctattttttgaccctgtatagactttaatttaaaatgaatttggtaacgtttctcctctgtctctacatatattcatgctttcacctgctcttttaacacctgcttttagtatctgaggcactttttctgaactctacttgtgcactggatccctcctcctttctctgccaggctgtgtttactttatccttacatcaccacttagtgattcctttctttgtataaacatggtaaatgtcttcattagcctaaaaggaaagaccaaataaaacctttcctaccacttggatgcatttgcatcctgacttctgaaatgcctccagcctccatttt

SEQ ID NO: 3102 - DNA, 1160 bp, Homo sapiens
ttatctgtgtgaccttggtctttgcttctccaagattcagattttccagagcactgttacctccatccagggtcattgtgaggattaaatgagaagtttatacagcacctaggtcaatgctttgttgatagtaactgcttttacaggttagcgcaactaataagtcactaactcctcagcattataacataggcttaataagtttaacaccaagttctttccttgggtgtaagtttagccttaaaagacttctaaagattttccaaagttaatgttctgtaattagcatatatgtaatcaaataggacttttatgtatatctcattctttctttataacttaaatatatattatctggttacaatttaacacccagttctttcctttggtgtaaggttagccttagaagacttttaaagattttccaaagttaatgttctataattagcatatatgtaatcttatatattgaacttttatgtatatctatttctttctttataacaagtatattttaccatatctgtatgttattacaaagtaaattatcattatttttcaattaagaagaaaactaagactgtagaacattgaatgatttgacctcctcaggtaccttttggtaggtcttctgactgcaaatgctgggttccctctgttaaatcatactacttcctgagaagaaataaaagataaagtgggaaaattctgcatcttaggcaagctaaagaaaagtggtttaaaaattattgccacttcaaaaataacaatggcagaatagaaggtatctatttttatcacctcttgggatctttttgtggggccaaggggaaagcagaaagatactaaaagagatgttcatgtccctttttattcattttaattattaaagggaacagtggctttgtgattaatgactgctgttcagtctattttatatcttacaaggatctgacagttttgttttacattttatagctgcagcttatcttctggtgtcccttataccaagcaattcattccgtcagatgttccggtcaacaaggtctttgcacatcccaacccgtgaccttccactcagtccagacacaacagtagtcctacatcaggtctacaacgtgctccttggtttgctctcaagagccaaactttatgttgat

SEQ ID NO: 3103 - DNA, 1377 bp, Homo sapiens
taaatttgtataagaatatgagggaaacattgggtaagttaataaatactgttaatctttacctttataaatctattctggggtggaaatacattttaggaaatgtacttgtagtttctaaatattttctaaatgtattgttactcatcaataaaattctgctcattatttgcatttgaaaccatgtttttctttgtagtttatcttactcatctggattatgtagatacagaaagaataatgacagagaagcttcacaatcaagtgaatggtacagagtggtcatggaaaaatttgaatacattgtgttgggcaataggctccattagtggagcaatgcatgaagaggacgaaaaacgatttcttgttactgttataaaggtatgcaagggataggtatgaattagaattgctaaataagtattatgttgttacaataaataatacaaatttgtcttatttacaggatctattaggattatgtgaacagaaaagaggcaaagataataaagctattattgcatcaaatatcatgtacatagtaggtcaatacccacgttttttgagagctcactggaaatttctgaagactgtagttaacaagctgttcgaattcatgcatggtaaatctctttctttactatattttgcttttatttttattgaagaaaataaatgaatgtttttgtcttgttagagacccatgatggagtccaggacaaaataaatgaatatttttgtcttgttagagacccatgatggagtccaggatatggcttgtgatactttcattaaaatagcccaaaaatgccgcaggcatttcgttcaggttcaggttggagaagtgatgccatttattgatgaaattttgaacaacattaacactattatttgtgatcttcagcctcaacaggtatgttaagcactgagcatatgttatttttagaaagtaacacttgtatcaatctgtatgtatcaatggaaataggagggcaactattggatccaatagaagtgtttctgattaaattttctttcttttttccttgagacagggtcttactctgttgcccaggcttgagtgcagtggcacaattacggctcactgcagccttgaactcccaggctcaggtgatcctcccaccttggcctcgtgggtagctgggactacaggcatgcactgccatcacactcagctaacctttttcccccccttggtagagatggggttttgccaagtggcccaggctggtcttgaactcctagcttcaagcgatacgcttgcctcagcctcccaaaatgattttatatgtgtgagccaccacgcccagcctggttaaattttcatagtgagacagattcttgaccagaagattg

SEQ ID NO: 3104 - DNA, 1179 bp, Homo sapiens
ctctgttgcccaggctggagtgcagtggcatgatctccgttcactgcagcctccgcctctaggcctcaagcgatccaccggcttcatccttccaaagtgctgggattacaggagtaagccactgtgcccaagccatcaataaatttttatgggttagaagtttgggccaggcctggtggctcatgcctataatcccagcagtctgggaggccaaggcaggtggattacttgaggtcaggagtttcagaccagcctagccaacatggtgaaaacatgtctctataaaaatacaaaaagtagctgggtgtgctgggcgcagtggctcacgcctgtaatcccagcactttgggaggccgaggcaggcagatcacgaggtcaggagatcgagaccatcctggctaacacggtgaaaccccatctctactaaaaatacaaaaaaatagccgagcatggtggcgggcgcctgtagtcccagctacttgggaggctgaggcatgagaatggcgtgaacccaggaggtggagcttgcagtgaggcgagatcgcgccactgcactccagcctgggcgacagagcgagattctgtctcaaaaaaaaaaaaatagtagctggatgtggtggtgcgtgcctgtaatcccagctgctcaggatgctgaggcaggacaattgcttgaacccaggaggtggaggcggaggttgcagtgaaccaagattgcacctctgcactccagcctgggcaacagagcaagactgtctccaaaaaaaagaaagaaaaggccgggtgcagtagctcacacctataatcccagcactttgggaggccgaggagggcggatcacttgaggtcaggagttcaagatcagcctggccaacatggtgaaaccttgtctcttattgaaaatacaaaaattagccaggcatggtggttgatgcctgtactcgggagcctgaggcaggagaatcacttgaacctgggaggcagaggttgcagggagccaagattgtgccactgcactccagtgtgtgtgacataacaggactccgtctcaaaaaaaaaaaaaaaaaagaaaagaaacacatggaaccaaatcaggatgaaagaaactggaatagcagtttgttataggctgggcttgttggcttgttcctgtaattccagcactttgggaggcccaggcag

SEQ ID NO: 3105 - DNA, 1276 bp, Homo sapiens
acttcccctcccccactctgcgggcaaatcgctgctgaaaagaggtaggggccgaagcggcgggctcgtgtggagccgtgaggcgggattgactggcgctcgggccaatgagagataggctcatggcgcggctgtagctggaactgaccaataggagggcgggctgggggcggaggcccaggttccaaacgctccgcggcgccatgggctgaaaactcaaccgagatggaatctcccagtctgaaccggtttcaaccggttccgagtttgaggcactaggaggagggggagaagcggctgcagcggccgcggcaggagcagcgggagctacagcatcagcaagagcaacagtagctacagccccggcggcggtgcctgttccagtctttgctgctgcagtccgtgcaaccacccagagggggaggggggaaccaccagtcgctgaggaacaagagaaggggggaaagtttaggcgagccttgggggggggggggccagcgccggagccgcgtgagagagggagccgtgttttggtaggggggagtcggactgcaactggcagcagagcgtctccccggccgtgtggactctacaccccctactcctgccgcttctgctgctgcctgtggctggagggtccccctggggctgaatctttgggacttgaccccgttccctcccccttccctcactccccagccgggcgggagcatttattccccagattaattccccttttgggggggggcgggtgtgtgtgtgtgtgtgtgtgtgtgtgtgtgttgggggaagcgtccctgaaatagtaaatattattgagctctttttgcccttttcctgtccgtttttttaatttccttttttgaggtgggaaaactgaaacccaccttgattcgtcccctctcccccctccccaccttccctcgccctaatcccccaacgaggaaggaaggagcagttggttcaatctctgggtaagtcgactgtgtcttcggggccgagggtcgggcggcggcgcggccgggcgggcgggaggaggccggcgtggggcgcggcggcggcggccgcgggaagcgagcccgggaggcggcgggcgggccgggggcgcggcgggcccacagcggagcctgcgattgaatggagccgcttttgccgctgggggatggaggcggggaggcggcctcgggaggggagcgcttgctgggtcattcgcgtgtgcgggtggcggtggaggaaggcgaggagtgtgatagtgaagcggggccccgcgcggggt

SEQ ID NO: 3106 - DNA, 1222 bp, Homo sapiens
gaggcactatcatagatcaatgtagctagcctcaaactccagggctcaagtgatcctcccaactagctgggactacacatccgggccaccattccctgctaattttttttttttttttgagacgagatttcactacattccccagtgtggtcttgaactcctgggctccagtgatccttttgcctcagcctccccagcatctgggattacatgtgcaagccactgtgcccagcatgtatggaccttatttggatgcctggatttttgaagacactaaggagttattggatttttaatttgttattatggtattatgcttaacattattttaaaagagcatccctatcttttagagatacatagggaaatatttacaaatgaaattatgtgatatctggaatttgagtctagttaatcctgggtggagaatgtgggtaggggagacaaagacaccaagatagcctatgaattgaaaattgttaaggctgcttgatgagttcttggagattgaccctatcaatctgcttcttttacataagtacaacaagtcaaaatttaaaaaattaatagaagcaggacggtggccacggacatcagaatccactaaggactgtgtaacaactcacctgctgacaaaattaatagaaaagagaaagacagcattgctcctggccttcaatatatcagactcagagctaatgccaaaattccaagaagcatttttaaaagcaacacaaatctggtgttgaatgtctacatcttgacagtttgaggcttgaaggagcagttgttcctcatggacggtggggagccacaggcagagctgactttagaagctcagggcgttttgtcctggttgcatccagacgatccagacagcagggacaggaagtaatgacaacaaagacttattccatttgagtattgtcctgtagtacttggatttccaagaagaaacttggattcagggcaatcctttttgcccaagcctttttaatttttggctctcgttccagcgctctcacaataatgagcagcacaattcatgagagtaaactggatttttattgaatgaaagtaaagaacacaactattcaatgtagaccagagctctccagtagaactttcaatgatgatggaaaagttttatctgcactgtaatatggtagccacatatggctactgaggacttaaaatatgactagtgtgattaagaaactga

SEQ ID NO: 3107 - DNA, 1165 bp, Homo sapiens
gactgtaagaattgtgttcaccgcatggcatggtactgctttaggggcatccatggtggaaatcgtgtttctgattaataagaaatcattaaagatagcaagtgcttctttataatatttttccttttgtgtgtgtgtgtgtgtgtgtgtgtgtgtgtgtgtgtgtgtgtctacatttcttcacttttagattaccctgcaacaaagccacttttttcttttgtaaagttggactgttattgcgtattcttaaactattatgctaatgtaagggaagagaatttaaaattaagtactttgcaaacagaaattaacttctctattttgaaatgtaaaagtttaataaaactattaaggtgtgacattgaaatataactttaaaattttttttctagattcaagatggaaaaggtgatgtaaccattacaaatgatggtgctaccattctgaaacaaatgcaagtattacatccagcagccagaatggtaagtgtaattttaggtgagtctttttttttttttttttttgagacagagtcttgctctgtcatccaggctagagtgccgtggcacaatctcagctcactgcaacctctgcctcccagattcatttctcctgcctcagcctcctgagtagctgggattacaggctcgtgccaccatgcctggttgatttttgtattttcagtagagacgggtttcaccatgttggtcaggctgttctcaaactcctgaccttgtgatccacctacgttggcctcccaaagtgctgggattacagacatgagctactgcgcccggccagatgagtcttcttttttaagtgtgtttgatacttggtaaacagttaaatttatttgatcacatgatatttaagcacgatgaacacttttcgtgctgaacaggcatatttttaggatacattgtgtgcctaacattgtgctttttggtgtgaggtgataataaaacacaaatcaagccaggcatagtggtgcatgcctttagtcccagccactccataggctgacatgggaggattatttgagcccaagagtttgtggctgcagagagctataatcacaccacaacactccattctgagtgacagagtgaaaccccagaaaaaaaaaaaaaagctgggcacagtggctcacacctgtaatccc

SEQ ID NO: 3108 - DNA, 1215 bp, Homo sapiens
gatttatagctttattgtgtctgattacacaggtatatacatttgttaaaacatcaaatttaaaatgggtgcatattactagatgtaaattacatctttatctttttaaattattacaagcaaaagttttaaaatatttacaagaacattaaaaatacgtagtatgctaagaataaagctaacaagaaatatgtagacctttaggcagaaaactaaaacattctgaaagatataaaagagtaaataaatggaagggcatattatgttcatagattagaagactcaattttttaaacattttattgtggtaagaacagttaacatgagagctactcttttttaaaaaatttgagtggatacaatgttttattgcaggtctgcattacttattcatgttgctcaaatgaaactttattcctgtagattagtaactgcccatttctccctccctccagtccctgtctaccactgtttcgctctttgattccatgaatccgactattttagatgcttcatataagtggaatcgcgcagtatttgtctttctataactggcttatttcacttagcataatgtcatcaaggctcatctatgttgtagaatgtgacaggactttctgcttttttaaagctgaatggtattccactgtatatgtaccacattcattttatccgttcatctgtcaatagacatttaggtggttttcacatcttggctattgtgaataatgctgcagtgaacataggagtgctaaaatctcttcaagatcttgatttcagctttttctgataagtaccccgaagtgggattgctggatcatatggtagttctgtttttaattttttgaggcaccttcatattgtttttccataacagttgcactattttatattaccaccaacagtgtgcaaagattccactttctccacattctcaccaacacttgctactttagttttttaaataatagccattgaacaagcatggagtgacatctcattgtgatcttgatttgcactttcctgatgactagtgacattgaacatcttttcatgtacctgtacctgttgtccatttgtatgtcttctttgaagaaatgtctattcaagttcttagcccactttttaatcgggttaacagtttgttttggtgaggggtggctaatgagttataggagttcttatttattacttaaaggaccactggtttacttt

SEQ ID NO: 3109 - DNA, 1261 bp, Homo sapiens
ttgccaattgggtaattttcattagttgttttgtttgttttgatttgaaacctggaaatacagtaaaatttgactgtttaaaatgttggccaaaaaaatcaagatttaatttttttatttgtactgaaaaactaatcataactgttaattctcagccatctttgaagcttgaaagaagagtctttggtattttgtaaacgttagcagactttcctgccagtgtcagaaaatcctatttatgaatcctgtcggtattccttggtatctgaaaaaaataccaaatagtaccatacatgagttatttctaagtttgaaaaataaaaagaaattgcatcacactaattacaaaatacaagttctggaaaaaatatttttcttcattttaaaacttttttttaactaataatagctttgaaagaagaggcttaatttgggggtggtaactaaaatcaaaagaaatgattgacttgagggtctctgtttggtaagaatacatcattagcttaaataagcagcagaaggttagttttaattatgtagcttctgttaatattaagtgttttttgtctgttttacctcaatttgaacagataagtttgcctgcatgctggacatgcctcagaaccctgaatagcccgtactagatcttgggaacatggatcttagagtcactttggaataagttcttatataaatacccccagccttttgagaacggggcttgttaaaggacgcgtatgtagggcccgtacctactggcagttgggttcagggaaatgggattgacttggccttcaggctcctttggtcataattttaaaatatgggagtagaaaacaacaaagaatggaatggactcttaaaacaatgaaagagcatttatcgtttgtcccttgaatgtagaatttgtttttgatttcataattctgctggtaaatgtgacagttaaaatggtgcattatgtatatatattataatttagaaataccattttataattttactattccagggtgacataatgcatttaaatttgggatttgggtggagtattatgtttaactggagttgtcaagtatgagtccctcaggaaaaaaaaaaaattctgttttaaaaagcaatctgattcttagctcttgaaactattgctacttaaatttccaataattaaaaatttaaaatttttaaattagaattgccaatacttctacatttgagaagggtttttttagaaatacatttagtaaagtccccaagacat

SEQ ID NO: 3110 - DNA, 1198 bp, Homo sapiens
ctgcccatgatgctactccttggactacatttccactaatgcgatttcaattagtctttagtattttgaggatttctttgtgtcgtaaaaatgtctatcccagatgggcgtagtggctcacgcatgtaatcccagcattttaggaggccaaggtggggggattgcttgagcccaggagttcaagaccagcctgggaaactccacttatacacaaagttttaaaaaaattatccaggtgcagtggcacacgcctgtagtcccagctactcaggaggccgaggcaggaggatcacttgagctcaagagttcgaggctgcagtgagctttgatgcatgcaccactgcactccagcctgggcaacagagtgagaccctgtcttttaaaggaaatggatgtctatctgatcttattctaaatgttgactctactatccgtaaccccttctggaaatatttaatagttgtctccttaggaggctgttgtttggtttgcacatggttaatgtagtactgccgagtttatagccggtcctgagcttggacgtttcagcattcactgtggacctttagtgaagtctgaagctttgtatttggctggcttttgggaatgtattttggcttttggatgtaaatcaaatgttattagttcagtgttggctgaaagattgtgccgataaattctttggcagaagtgtaaaatgccccaaacatagattcatttatatttctcaattcaaccaaatgtgctcatcattgtgtaacccttttttggttaataatgaagcaaatcttctgtagtcttgcaacattaaaaccctaattatgattttctgcatgtctgtaccatgcctattgattttaaaaatttctgaattatcagaggatttcttcagacacagctctttatggaattatattaatccaattcaggcaattacataggtgtgagtttaacttctagtttgttttgagatgctgtgattccatatgagctctgataggaattcctatgccttcactatgcctgctttaggctctagagcaccccaggggctcaatcctacccccttctcctttccctctgcaggcctgcctggatggaatctagtcctatgacttcacatcccatctgtgtgcagatgactctcagattgatttctccagcctggccattctcagaactccagagttatatcagt

SEQ ID NO: 3111 - DNA, 1204 bp, Homo sapiens
attcctgctgtgttcatttcattaatatgatttacagattttgcatctatatttacaaatgaagttggactctttggggaggggatgtgtttatcgtgtgtgctaatttcatttaaatggattagaacagtttttcttccctaatcagagaaataatttaatagcacaaaaatagctgtttctcgaagacgcaaaactcatttgtgaatctctttgggcccagcgtttgttgttgctgttgttgtttttcagggtttgggtgtgtggatttggggtgggggcagtgcgagattgggggagttcttttacaacatcttaaagaaccctaacagaaagttgaaacagcctttcaaataatttccaaagttacagaagtttcaagtaatgagtccagttattggagaggtcaaatgtaaaataacagaatgtgaagataaataatacaaggtaaagacaagtaaacacctgagtcacgcaacacctgcttttgttttcctagatcaggaagtgtgctgcaccactggaatgaaatctattactttgtggaacagttggctcacaaattcatcaggtgagaaacactatgcattttgttcacttgtagttctctgtcatgagtcaaactagtccatgtttgctattctattaattactacatactttggggatgttttttgactaagttgggctctcagatctcggaccagagactgtttgctttgttttcatctttgccacattttagaataacatttggctttatgtttttgggaggagccaaatctggttacgagaccaaaaatatttagcattctcccttctctgttgaatagcctattcttattacctttaacatttttcttgcacactgcatcatgcagcagcaattggcacattttagctggactcacgtgtagggtgtacagtgtgtaggatgaacaattcatcccagtttgcccagatctttcccagttttagcactgaaagtctcacatcctaaggggaaccctccttagtcctgagcaaaatgtgacaattggtcgctctctagctgtgtgtactattatcaggtagaatcctctgagcattttcaacaccactttcccaggcaaggcaatgcagttttgaacatagtcactgcaaatatcatgggagtcttggacttagtggtaaggaaatgaggtcacttcaccccactgtgtgc

SEQ ID NO: 3112 - DNA, 1190 bp, Homo sapiens
tggttccaaaagaatgtaaagtgcctctagttggatggtggagaaagttctgcttttggttttgttttgtttttgtttttctaagacagggtctcactctgtcaccctggctggagtgcagtggcacaacaatggcacactgcagcctcaaactcctgggcgcaggtgacccttccaccttagcctcccaggtggctggaactataggcacgcgctgccacacccagctaattttttgtattttttgtagagacagagttttaccacgtttcccaggctggtttcaaactcctggagtcaagccatctgcctgcttcagcctcccaaagtgctgggatgacaagcatgagccatggtgcctgacctagctctgtttttaaatggtctgattggttccagtgtgtctttagctgcagaagcagagagaggaggtagatgggataaatcagggcctgtagactaggtagacctgctagggcaggggcctttgtcagagaaatgtctcccagtgatatcaatggccatgggcactgaggggcctgaccttggctttggagcctggacccctatcttcagccagactatgtcttagtctgtgagggacctgcctctctctgctggagatgttgatagctaatgttcaccaagtgtcttctatgatcctgaccctgtgccagacatctggtatgatattttattaaattttcacccatattaggtgggtactagtattatcattgccaatgtaaatgaggaaactgaggcacaaaggggttgagtaatttgctcaaagttgcacactgacgagcttcacagccaggatttgaacttgtcagtatgactctatatcctatgctttaccactctgtgtaataggttaaaagtgggggaatcaggccagccgcagtggctcatgcttgtaatcccaggctaagcaggtggattgcctgagctcaggggttcgagaccagcctgggcgaaaccctttctctaccaaagatataaaacaattggccaggcatggtggcacactcctgtagtcccagctactggagaggctgaggtgggagaatcgcttgggccttggaggcagaggttgcagtgagccaagatcgtgccactgaactccaacctggatgacagagtgagaccctgtctcaaaaaaaaaaaaaaaaaaaaatacaaagtgg

SEQ ID NO: 3113 - DNA, 1196 bp, Homo sapiens
tgaattcattgtaaattatttccatgaatttatgtaatcttagttgaaataagttgaacttatttacaacttatttttcccttttgtaactgctattgagataggtctcatatgtttaattcccaactatctttcagttgctccaaaactatgtcttaaaaacttcagatccctatcctaagccctagtcgtagagttcagatactgttaagaagctgtagtcacccacccatgttcttcataaccctaggtttttaagacatcactaaaaagtgtatcaccttcagccttcatctttccatctggaacagtcctgatgcttttagagttatttgaatcacccccaaaatgggagcgtgtttgcattttacagatgtaaaaactgaggcatagttgctaattatttcgccccatctgtgagcagcaaaggagcttttaaacccccaacacagtctgagtcattgtggacttggtcacaatgtgcagcttatggattgtagaaagggcttcagagagaaagaacaaaggaatcaaggaaggtgagatagcaaagaatgtcgggcagaggctctgctaagagcatggcactgcgaggcaggtggaaaatgaggtgggaaggttataggtggaacttccagaagaaaggcttttcagcccttgggagctgtcattctgtgcagctaagagaggccttagcaattgctaagagaggctgtagcaattgtgttttggggggtgcatttctttcctctttctgctccccccatccttgtgccaagagttattgaggccttaccaggtgccaggctctatgctaataagcatttgtgtagactgactttacacatactatctgatataacaatgaatcgaggagtaccattttctgcatttatttgtatattctatttagaaatctgtttggtggccaggcgcagtggctcacacctgtaatcccagcactttgggaggccgaggcgggcagatcatgaggtcaggagatcaagaccatcctggcaaacatggtgaaaccctgtctctactaaaaatacaaaaattagctgggcatggtggcaggcgtctgtgatccaagctacttgggaggctgaggcaggagaatcacttgaacccgggaggcggaggttgcagtgagccgagatcatgccactgcactccagcctggcaacagagcgaga

SEQ ID NO: 3114 - DNA, 1099 bp, Homo sapiens
ataaaatttttcagtaaaagtatttgaaaatgaattgccttctctaacattttaatcatgttttaaaatgtgtttttgaaacaaatttattttggcttgaagtatgttgcccagatactatatcagaatattgcttttaacttcagggtatgattcatgttgtttctttttaatatctgaaagcagttttgtgaacttgagggtaagaatacctctgttaaaactttacccctcgtggaagatgtattataattcaagccacatgctaaaatataagccccctgaggacagaaacaatatcgattttgtttattgctatattcacagtgccttctacatactaagtactcagtaacatttttaaataaattagttaatatttgatccatttcaaagtaattctaattatgaggagtgctatctggcagatacctaaagacttcattctgtacctttccaagaattcaggtccattctggacatttctcattaaactaaattttggattttccctggtttctttggcgatcatcctgtttttgctgacttgggactggtttggtcctttatagccattcaggtgtacagtaaagattcaacagtttgagtaaaaagctaaccaggttcaaataatatacatgaattcaatttagatagtaatataagaattttagttttttgtcaaaaatagtactaaaccaaaagtatattttgatacacctaatagtgtccttatcttaatttcttttctcctgtggacatatttggcagttctttttctgttgaagtaatagaatggatgagtttagttaatggatagaatagttgcttagaattagaaatgggcaaataatttggaagacacagaaagtacttgataatcgttgacttttttttttgtttaagtctggctacttttctagtatgttcagtggttcttggaaagaatccagcatgaatattattgaactggagattcctgaccagaacattgatgtagaaggtaactaccacaataattactattatgcaacaatcgtaaaaacataatcttattcttctggtagaagataaataattccttccagccttgtagtct

SEQ ID NO: 3115 - DNA, 1229 bp, Homo sapiens
ttgaaaatgctataagctaaggtactagaatcatcttggacagtcttttgtaaaattaccttcaaataaggtcttagggggagaatcattacagtgtgcaattgaatttgctcaatgggtgcctgttttggaactcttttctatttctaaattatatgtttcgtgttacctaaaataaataaggattttcaattgattttttttttaagtctgtaaatcttctcaaataatttcaaaattaaacttcaatactgctatctggagttaaaagaaatctgaaagtctttggtttattttgaaagtaaaataatctctaaatatacattaaattaccttgaatagtttctaccctagactttgctattataaagatggtttatagttttcatctctgatgcatgtttttttttttataagaggagtataggattaaaaaaaaacaatgaattttctcttctcatcataggcagtacatgaatcgaaaaggtggattcaacagacctttggatttcattgcatgagaattgaagtgttgaaggatgattttttttcccctcatcttggtcagagagtggattttgtattttgtatttaacttgcattcaaaaaacaggatctcagttctcctttcttgtaaagtaagaaaatcttatttatgatatatgcagttaacttaccttgcctcaacagaagaaaggttaaatattacatttttttcttttaggaaatatcatttgtggcaggcgtcaaccccattttatttgtccttattcctgtggaagcagtatatgttttcttcctgaatgctcattaggacttcttaaaaaacatgaaagtaatttggaagtaagtttatccaataaagcagtatttctacccttttagatttgataaatatttttattactaaagaatctccccagacattttcttttttttttcacacatagatttaagtatcttgattgttagtagtctaaaaatgggaagaatgaaaaagcataactagatttttctatcttctgtggtcgcccgcccccccccaaaaaaataccatttatggttctctccgcaagtataaaagcattacatgcaaaaaaaagatctcagagaaaacaaaagtaaaagaaaagcagaaaatcacctgttatctactcccagaaataatcaatttcaacattttggtatatgtttttccaggcttctttgggttgatcccacctatgaga

SEQ ID NO: 3116 - DNA, 1178 bp, Homo sapiens
tacacaaattttgttcccttccctcccccagtgcaagcccacaagctttttccaaagtcttgagcttttgatgctgtcccgcattgtggacttgtgaggcgcttggatgtagcaatgaaacaaaatgcttgagaggtctagtgaatggcattcaaaagggacctcaaagtgcagacatatctttttcaaatatgttacaggctgaactggctctttgaacactatcactctgcttaaatccaggaagcaggctttaaaaatgcaaaaggcatacaagttgtatttcagtgcaaatctttagctggttattggaaaagattccaaaaattaaaaaaaaaaaaaaaaaatcctttgtgtcacctgcccctccccccacccaaagccaaaatgaagaaaagacagaacaaaacaaaaacagaagaattacaggtgactttggaatcatttaggaatccactacttccaatcagaatgtttagaaaaatacattaaagaatcattttttaaaaaacacaaaagtaatcttgctttctgagactgctcttcgggtatagaatgagcttccgtgtggagtgcgtttgaactttgaccttagctgtgtgcgaggtgcaggcgctgggggagcttcaggctgtggtgtgcgagtgaccgcaggggagcgtggggtggctgcccgctgccgagtcagccgttgagcccttaggtcgcagtgcgtccgtggattttagtaatgttctcatcactttgtgacacactctgcttcagcatcacagattttacaaatggttcaaattcaatgaaaaagattcgccagaggctgaaaacatcaagacctcaaaaatatgaatgcaaaaatattcaggggaatgaactaattttgtagatacctacatacaaagtttctagaacatctataaaaccacaaagtcataagaatttgttttccattacattagtttatataaaatgaataaatagtatttatagatttaatgtgtcttatgtacatatacatgtgctctgttttagcttaaataaaaatgctacaaagtcggagaccacttaagggagaaatcataaccaaaaagaaaaatcagccttttaaactatcaacccaaaagcctccataaagaagtttctgggtgtgtccaaaaataatcaataaggagaggagttct

SEQ ID NO: 3117 - DNA, 1128 bp, Homo sapiens
agtgggctgggcgtggtagttcctgcctgtaatcccagcattttgggaggctgaagtgggtggatcacttgaggccaggagtttgcgaccagcctggccaacatggcgaaaccccacctctgctaaaaatacaaaaattagccaggtgtagtggtgcacaccagtagttccagctatttgggaggccgaggcaggagaatcacttgaacctgggaggcggaggttgcagtgagctgagactacaccactgcactccagcctgggcagcagagcaagactctgtctcaaaaaaaaaaaaggattttgtggttgggcatggtggctcatgcctataatcctagcactttggaaggccaaggcaggcggatcacttgagtccaggagtttaagatcagcctgggcaacatggcgaaatctcatctctacaaaaggtacaaaaaaaattagccaggcatggtggttgcgtgcctataatcccagatgttcgggagactgaggtaggagaatcgcttgagcctggggagacgtaggttgcagtgagctgagatcataccactgtactccagcctgggtgacacaatgaaaacctgtcttaaaaaaaaaaaaaaaagaaaagaaaagaaaatcttgtaatgttatgaatttttatgagctttcatatgctaataattgttttgatttcttctttgagtagtataatgttcctttttcgttgtagggaacctacctgactctttcaggtagtggtttcctcagcaaatatgttcaaccaaggcatagagatgagatggatagctttcttttccaagaatggggttaggtttttctatattcaaaggagatgaatgttgataagttcagggtattttcttagctttaatttctaacaaaattaaactgtccaaattaaacatacagggatgcttgtttttaagagaaaaaaactttagtaaaagatttcattttccctagcataaattattctatttgggattaagaaaaagtatgtttcccatttcccatatttgttcttgttgtttgttcttgccaatactttattttaatcagtggatttcctctcccctctgcttctttcacattctccaccagtcagacacagtcttctgc

SEQ ID NO: 3118 - DNA, 2033 bp, Homo sapiens
taatgtataatgtttgagttttaggctatataaggaattagctttcctgcatttaaaggaatcatttggcagtcagtagcatattttcctgattttttgttgttgttaaaggagataagttgataactgtatgttgaagggttctcatgatattctctaaaaagtgcaaatatcagtgcttgatttatagatgtgtaataaacagtggtctgtaaaagcatgtagtataaaaaatatggtattttcccttatatacagcctataaactcttcctattccttgagtttagggtagactaacaaattacagcgtagaagagagtcagctaccagattaaatgcatgcgtaccatacagataatttattaagtatttttgcatattgaacattgacttacattaattttcccttttcaccaccacgtctttgtcattttgaccctgaacacttaataaatcactcagattgatctaaaatatgcttatgtatactttaatagaaaattacattgcatggctttctgacttgggtttttgttataaaagtgcctgttttgttcatgtgtcctgagagagcaagcattgtgacatacctgactaacttaaaagcagattgcctgtgaagcacaatttgagtccaattttttgaggtatggagttttagctatcatggctgggtttttactcaatctcaaataatagggctctggttattttgcagagtgtctctgaagaatggacagaattgccctggctaactacaagctacggttcacagtggataaatgttggcgtgcttttttactttctgactttttaaaattttgcttttatatcttgtagttccaatcaattttatatgaatgctattataaaattcagtgtaaaatcttttcttgtctagcttaaaacttgtgtgtgtctagtatttttcttcaatgatttaacatttctgaaaatgtcaagttctcaaaatttagacaaaaaggggggtataaattgatctgaaaaaattaaatagtttaattagtttagggaatatacaactttttcattcttttggtttccagttttctatttttttttaatgattaggtagaatatagtgtcaaataagttataaattgcatggttaaagaaagccattcatctaatgtcctgtgaactttataagtggttaagtagttcatgtgagtagctgctttcaccatgcttaatatttaaaagtttaaaaagttttttgaagagagaggcaatttctgtacaatataaatatacatatatacttaagttattgatttgcatgtctataaaattaagcctcatttcctaatacatgataaattttgtagaataaaaggtgaatttgcattaaaggttcactttaatgaaggtgaaacatgagaatgagttgtgtgtgaaattcttatttgatatccagaggatagtttgcaaacctaaacttctgattgtttctgatttcagagatgcccgagtggtaaaagacatggcaacaggaaagtctaagggatatggctttgtctcctttttcaacaaatgggtgagctcagtgagaagtgcatggataatgcttaaagagtaaagaatggaaacactccgttttaattactaatctttttttcgtctgctgtttattttactgatgattaaaataaaccctcactagaagatttcttctgttttgtctgtttaacatttattggcacctgaggcatgcagagtactgataagatgttttcagaatgtagaaagtaaagttgtttaaattatcagccaaaggtagatgttgaaaatctcatttatggatttaattcattatctccctagtttatattcccatggtagtttaaaagtagctaataaaatactgtgaggaggccggacgcagtggctcacacctgtaatcccaacactttgggaggctgaggcgggtggatcacctgaggtcaggactttgagaacagccaggtcaacctggtgaaaccctgtttctactaaaaatacaaaaattat

SEQ ID NO: 3119 - DNA, 1205 bp, Homo sapiens
gtaaaaaaattagccagatatgatggcacacgcctgtggtcccagctacttgggaggctgaagtgggagaatcccttgtgcccaggaggtggagattgtagtgagccaagattgcgccactacactctagtctgggcaacccagaagaccttgtctgaaaaaaaaataaattgaggtaaattgagctgggtgtggtggttcctctagtccgttactcaggggaccaaggcagtaggtttgcttgaggccaggagtttgagagcagcctgagcaatatagccagactatttctcttaaaaaaaaaaaccgggtgcagtggctcacacctgtaatttcagcactttgggaggctgaagcaggcgggtcacctgaggtcaggagttggagaccagcctgaccaacatggagaaaccccgtctctactaaaaatacaaaattagctgggtgtggtcacgcatgcctgtaatcccagctactcggggaggctgaggcaggggaatcacttgaaccctggaggcggaggttgtggtgagccgagatcgtgccattgcactctatcctgggcaacaagagtgaaactctgtctcaaaaaaaaaaaaaggtaaattgtttctctttgtgtttcagatacgtcggtaacctttccagagatgtgacagaagctctaattctgcaactctttagccagattggaccttgtaaaaactgcaaaatgattatggatgtaagggtattttacttagttaactttattctttttttttttacacattacttaaagccattgcttggaaggaattcttagtttaccatggtctaaatatagtataaattattagtttactgtagtctaaatatagtcttagtttaccatattctaagttaatagggattttagtgaatttgtaatgaacctgttttgacagctgaatttaatttgttttattacatgatggaagatgacaatagaactagttatttctagatcagatgggaacatatatatgggctctttcaggtgcattgaggcatcagaaatgtttatatgtggtgtcaactggttggctaataaattcagctcttacaattaaattggaaaacaggtttaaaaataataggcatttggtacagtgaaagtatttttaactttatttttaaaggtcatcattcaagtttttcttgtatttaggcaattcctatttatg

SEQ ID NO: 3120 - DNA, 1190 bp, Homo sapiens
tcaataaacttttacttttaaatgaataaataatacatgacaattcttttcacatgagagaacgtctgcttctatttcctcctaaaatactgtggcggctgggcatgtcaacagcgccgctggtgtagtggtatcatgcaagattcccattcttgcgacccgggttcgattcccgggcggcgcataggcgttttgcttctcgctcgctaaaaaccagatagcttgaagagtctttatatatctttccaaaagaggaaagatttaggctttttactgtccctgaaggtttccactccctcataattcgcggtcgaaacactcgaatccgcagccagaagacaaaaaagttcacgcaaatcgtgaagtagttaatacttgcgcctgcgcagtctgaggcgtccctcgcgtcgggtggaagagcggctgcgcaacaagtgaacctatggattaaggtgtagccgggcggcccggaggttgagagtgcaagattattctgcgcctgcgcggcccgggtaactttgctggctgctcctaggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctgtgagtctggggcagcgatgagggaggcgggatggtggtcgtcccggagggaaggcctcggccctgcgccgctcccagcctattgttctccgtggacaccgcgatatcgtggtttttgtttccttagcatgcacctggatgcttacaaccaagacccaatctgtgaggacgaggtgaagggagacggggctcaaccctctcaattaatcccttcactttagcaacaccattgcatgacctttgctctcgccacgggccctctgtggtcttagacctggagaaaagactttaattcagacctctttttagaactcgtcgaaccttccttttgtcctatgctttctttccttttcccgcttctccccctttttgattaacctcttcttatctttacagccgtctccctttaattttactttt

SEQ ID NO: 3121 - DNA, 1166 bp, Homo sapiens
tctcagaaaaaaaaaacaaaaaccagtttaggctgggtatggtggctcaccagcactttgggaggctgaggcaggtggatctcttgaggtcgggagtttgagaccagcctggccaacatggtgaaaccctgtctttactaaaaatacaaaaattagccaggcatggtggcgtgtgccagtaatcccagctacttgggaggctgaggcgcgagaatcgcttgaaccctggagatggaggttgcagtgagcagagatcgcaccactgcactccagcctgggcaagagtgagactgtgtctcaaaaggaaaaaaaaaaaattaaaaatgttgctggtattacatcaaacctactctggataaattttccagtagggcatctgaaattgctttggcaaaagcaaaacaggttatcaatacaccaaggacatcaagtagttttaatgcaactacagtgttgagtgcttttttactgggagaaaaatcctagcagaacctgctactctgggcgcattaggtagttttatgcaactatagtattaagagttttattggaagaaaaaacactgtcagagcttactgctccagacctttttttttaatagaagagactggtaaaaatgatgcaggggctgaatgaaagccagctctgctccagtggctctctgagttgagcatgcatcagttaccttaagggcttgttaaaacatcgctaggctccaccctgtttattcaataagtttgttatgggatataagaagatgcattttattaagttccccagtgatgctgctgttctactataggaaccacacttgaagaactagttctacaattcagctgtatgttgtaaaggagtcaagtcaatgaaggagttataaagagttgctgaaaaatggagtaacagtgtatgggacttcacatcagttctccttattgattgttagtttgatccctcttgttcttttgttgtaaacattttctataattaggaaatgccatttaagagtgagagaggtatatatctatgagccattgtgtttggtgttttacaagaactttaccatactggtgtgtagtccattctgtacagtttaaaagtgattcacgatttgcaggctttttatcagatcacaaaaaaatcagtctttaagcatttgcttggtaagg

SEQ ID NO: 3122 - DNA, 1196 bp, Homo sapiens
gggaaaaagattatgattcgttgtaattgagtacattcatttcaagtggaatcctaaggtgtgtgttaaggcagtatttattctcagacatgcatggacttagaagatatttcactaatacatctttttctaaaacattaaaatgaagatcttaagaaatggagaagttattgtataaaatgttggcggtgaacaatgaaaccagttaaacatagactaaaatctaaataatcacatttttataaaataaatttcaaaaaatatcacttaaaattaccagaaagataattttcgtgtgaaatgtataatcaaaaattggaatgtagccaaggagtaaaggctaaatgtttcaacttatacatcggaacatagtagtttcaaatttcttttaaaattgaaaattaccattagtagaatagcactagaactaatttcttctaaataattgagttgaaggaacatgtgggataaaatcccatatagtgcaaaaggaaatgacaagagtgcccaaaaagaacagaaagtatgaaattgcatgagaacagttatgatgaaattcagatcaattaacaaatacttgctgaatgtttaagcatgactttatgcactgggaatagaatattgaagaacacaaagtctctggtatcacagagttttaacttcaaggggtagagagagaaagaccacaaataagttaaaaatgcatatgtattatgtttgttttcaacaagtgctatggtaaaaaaaaattaggaaaggggaatagaagtactcttgttggggaatgaagagctgtgcaactttcagtaagttagttggggaagatctcattgaaaaggtgatatatgagcaaacatttgaagaagatgagggaacaaaccacgtcctggattgagagcattccagacagaaggaatagcacctgtcaaacctatacctttgtagcatcttagaggagtagaaaggatgcttggggatggagtgaagaagtataggaaggaagtgtattgtggtttgggagttagaaggtaggtagaacatacgttgtaaacttttagaggccattgttaagtactggctttttttccttgagtctaatgagaggttttgagttgtggaacagcaggttcagtctgggtttatgttgtgaatagagagtgagtgaatggcaaggactgaagcagagaccattacga

SEQ ID NO: 3123 - DNA, 1186 bp, Homo sapiens
tgtagacattagcatattaaagtttctgaattgtctagccagaatgaatcctggttaacttcatgcaaaccatttattaaactgatttaatcacaaaaccttttctaaattgtacacatctttaagaagtgttactctggagaatcatcattaaccataattgaagtggtgactctagttcctgctgaatatttgagagtttcgtacatcctctctgttgaatttgtggcacagacactcatctaacatttactgagctgttctatgctggaagcttatttaatctcctcatgaacttcatgaggtagatgctattattccaatcttaaagatgagaaaatagacttaaggaggttacgtatctaaacccaaggtcacatagctagttagtagcagacctaggatttgaactccgctctatttcattctaggcccaagctcttatacattgtgctttgctacctgtgtgcttaacttagttcatcatgtcacttttccatttaaaaccttctagtagcttcatattgcacttggtctaatatccaaacttcttattttgggtcttcaaagccctgcatgatctgatttcttttctacttctctgaatgctttctgtgtttcagcttttctggctctctctgttctgtttttcatacatgagagacccattgctgcctttgcacctttatactgctgttcttttgccccttcccagtcctactcgcatggccagttcttcatgtttttcgtctcaaatatcagttccccagaaaggtctgcttaagaaagacctagctaagtagaacccccaaaaaagttcagcctcaattacgttgttgcactgtctttaaagtgcttaccaccgcccccaaagtattttatttttttcttttattgtttctcttctcccattagaatgtaagctttattgtataaaagattctatctgtcttgttgcccaccgaatcctcaggcaccaagtgtaatacctggtgtgtcataaacatcaaatgactgatgaatgaaaggaagaaatggttatataaggcactgtgtttataatattttgtaggatcagtttcttttaaattataaatatacagtagataagtttgcacacatagcaaaataacgtctaataagtattttatattgcaaattgcttttaacagaaattcatggccaa

SEQ ID NO: 3124 - DNA, 1138 bp, Homo sapiens
ttcactacctttgtcagctactgagttgcttctggggagggaagtacttccttgcccctccccaacccccctacctcaccatatcctatcatatcttgatagtcatggggaagaggatgtgcacacagacatacaaatttcctcaaagctggagagaccaggctacatgtgagctcatagatgctgctgaggctcatcctgagggctggatggttggccagggtttcagaatgagggtaagggatgagcactgccacccagaacttgataagccaagagaaggcaggagccaaaatggcatcgccaagctctcatctttgttgaaacaagtgagaaacgattatattaatctgaagttctattgcttgagaagagttcaaaacacttctctttgctagtacccagtttgcagcaagatctcttcagctttaagtgctgagagactttgaagtggaaatggagagatgtgtaagcatggcacagtgtttgtctttttagaggatcatcattgctggtctggtctcaaacctctgccttggaagaactgtgctatacaggaaaaagtgaacaaggtggaggaataggggttattctgcacagaagtcccatgaaaggaaaagcttattcaagctcaagacataaagatggaccctttgatatatcttctctccattcttagtctgccttcaccttatctaacaaaaaacaacatgcagctactgagttgtatgtagagacatactcttggtgggccagggaaggtaaaaacagggaccagcaatgtcaagtttttgaactagaaaagtgggatgtttttagttttgtctataacctgtagctgggccaacccttgagaggacttgtgcaaagcatgtgtgcccagacccatcagactcctcagatatggcctcaaatacctagagatgtagaagtaccgtggagggcctcaataagagggcaagcacacagatggctagaagcctgtatggcttctggtcaggatgaacccttggccaagttcttgaggaaaccaggtctatattcctgaagggacagttcagtttgggactctattaggtttcagtagtaatataggctgcttgcatcattttaacattcatagggaaaatctctttga

SEQ ID NO: 3125 - DNA, 1192 bp, Homo sapiens
aaaaagacacttagttgtttaatttacatctctggaggagccaaaaataacaggacaaaaccagacttaaactctacacatcagttttgaaacctaggtctccctctcttctgcaacacgaagtgattgttgtttatttcctttgggtttgtcttgtctaaccctgctaattataaatttgagagaaattaggaaactaactttgggatttgatatatacaccttttgggaataagacatgttggaagacagttgttaaagacttctatgtagattgaaagctggagaaaaatctgatctctaaaagcattccttaaaattcatgacattggctcacgcctgtaatcccagcactttgggaggccaaggcaggtggatcacaaggtcaggagatcgagaccatcctggctaacacggtgaaaccccgtctctactaaaaacacaaaaaaattagccgggcgcgatggtgggcgcctatagtcccagctactcgggaggctgaggcaggagaatggcgcaaacccaggaggtggagcttgcagtgagcagagatcgcggcactgcactccagcctgggcgacagagtaagactccgtctcaaaaaaaaaaaaaaaaataaataaaattcatgacattgtaccataatacattatcaaaggttattccaaaccagtgtacttgtaccagacctacaaccattttgttgttattaatacttaatatccatttagattcatttgtagcattgctgtaatcatagctatggaagcttggtgtatcccaatgaagcatatatatgggaaaaatatatttgataaagcctttacttagaagttagtttcaaatgttaggtatcaaatcaagaactttggtcagtcaattaatattgtacctcttttagaggtataatttaggggcaaaattagtgatttttagatctctttcaactcgtcagtattttctttctttctttctttttgggggggggttgctggcaatattttttatttttttattttattttattattattatactttaagttttagggtacatgtgcacaatgtgcaggttagttacatatgtattcatgtgccatgctggtgtgctgcacccattaactcgtcatttagcattaggtatatctcctaatgctatccctcccccctccccccaccccacaacagtcccc

SEQ ID NO: 3126 - DNA, 1175 bp, Homo sapiens
agggggtgagcaagcacagggccgccgccctggggaggggggcactggctctccccttgggtggtgatgaaggcctggggccaggaaatggggcctctcttcctgcgagctaactctgtgtgtttcccctgcaggcagggactctgcacagtcccccaagctgttcacccataagaggacctacagcgatgaggccaaccagatgcgagtggctcctcctcgggcccttctggaccttcagggccacctggatgctgcctcccgctcttcgctctgtgtcaatgggagccacatttacaatgaggagccccagggccctgtgcggcaccgcagctccatctcgggctcgcttccatcctctggctccttgcaagctgtctcttcccggttctccgaggaggggcctcgttccacagatgacacctggcccagaggcagtcgtagcaacagcagctcagaggcagtgcttggacaggaggagctgagtgctcaggctaaagtcctggcccctggggccagccaccctggagaggaggagggggcccggctaccagagggcaagccagtccaggttgccacacccatagtggcctcctctgaggctgtggcagagaaggagggagcccggaaggaggaacgcaagccccggatgggtctcttccaccaccaccaccaaggcctaagtcggagcgagttgggtcgccgaagctctctgggggaaaaggggggtcccatcctgggggcctccccacatcactcatccagtggggaggaaaaggccaagagtagctggtttggcttgagagaagccaaggacccgactcagaaacccaggtaagtcgttggcaagaccaactttgctccttggggaggatgctggggtgtgtgctgcctggaccctggggcagggaggaaggagtagatatggacctcaggcaggctgctggggctctggctttgcatggtttagtggggtgtctccctaagccaaggttcgttctgtgctcacggacacaggtgagttacgagggcatagtgctctgagagtcctatggattgaggggtccgacttctcagccctaggccttgctgcatgagttggcatgcccaccccctgagctggagggaagcaggaaagtccatttgtgtgaattctttgcttcctgacctccacc

SEQ ID NO: 3127 - DNA, 1210 bp, Homo sapiens
agctgactgcctaggcatctctaggacaacacctcaagctcttggcatcttgcattttgcatcagtgtcccatctgcttctctaagattgagctgtaacacagacaagtggatgttttgctgcggaatgaacacttagcagggtctgcctcttcctcctgtgttgtgacccaattcctcagcacagggagtaaggtcagaagttgaaaaggccatggtcattcagctgggtactggagaactcatgattttttcttttagattaggtcagtgcttctcaaaccattttcctgtctagcatacctgcagggtaggctaaatttgatagtgtctctggaggtagaggctggttggggaatggatgtggtagacagttgggggaatgtggtttaagaagacctctagataattctgttaagggagagatgggagcattttcccctttcccctgccagtctcattataatagatgattattaaaagcagttaatttctttcttttctagcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagaggtaagtctacagagttcctcaggcctgtgtgcaggaaaggaggctcctgagggggtgtttgggactagcataggttggtatcagaaatcccactgcttttaagatcgttgaaagatgactcactctgaagcagttccaattcttatattgtcctgactgctgagcccgtgtgggactatatgagagaacctaggctcaggagcctgttgcctcatagggagacgtggcctagaaacatgaaatagaaccatctggagtttcctgtgttcacttccattgttatcaagatgagaaaattcctgtttatatcttggtatattaattgatgtgtgagggtatcaactgtggtaagaatatctaagtggttacttttatttaaaaaatcttttctgtatccagttgacctgtattaattgctcttcaaggaaaattgggagtctgtggtctgcaaaagcttgtgattttagaccctttgtgtacagagctaattctgtatagaaagatcagataggtatcctttcccttcagccctgccgtgatcccctctgccc

SEQ ID NO: 3128 - DNA, 1102 bp, Homo sapiens
ttttttttttttttaaagagacggagccttgctgtattgcccaggctagtcttgaactactggctcaagtgatctcccacctgcgactcccaaagtgctgggattacaggtgtgagtcaccgtgtcaggcctttgtcagaaccttgactgacttcctgtggccaaattggatgcagaagcatgctgcaatccctctatgtgcctggggctgtttggctcctgccagacccttggctgtgtcccagcccacagagcacaaaagaagctgtcgactgtagtttaaaagctgccacatatgagatctttgactgcagtcaccatctgtcactgataatctgccctaaagatacaaaaggtgaagttggagagggctgagtttagagactggaagggaactacctccacactgtagtagaatcagataagagggatttggttttcaagacctgatgcagattctgcccttgtgtcccagggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggtaagcctgctgtggccttcctagacagctcttgctttcatattgacccttcagacagcttcatatggcagaggggtactcattacaggaataaagagaatgcatgttaggcaggaagtcagacttacattgtactttccatactgccattagaggctgttactagatgaacttggtaacctctgtggatattatttgtcagcagagtagaaaattggactgtatgattttcagaatctcaggttctctgtgtcagtgggtggtggaggggtagtaggactagctcaaatcatcaatgacctcccaattaatacatctgagagggatttttcagttcactgcttactcctaagtgatactgttaagcttgcccttctttcattcatttatcttgaatagatgatacatatttcaaactgtgaaggggcctaaagttaaaagtgtttcatgcacta

SEQ ID NO: 3129 - DNA, 1215 bp, Homo sapiens
cagccaaatttgtctttcattcttcagattgtgaataaagtgatttttacagggcttccagcaaagtttttcctttcatctaaggcttgtagaaccctagcttatatagctgcttacatgagaaatgcaaaatctgtattcaccatgactttagtaacaaaggtaaagttttttagtagtgccaaggcaagaggaacaatcttggtggtagtactaagttttgtcaatattgtggtttcctgattgtattgttggctttctctctgagcattgaggtatactagaagtagagcttctcaaacataatatcattacctcataagcattaacaaatcaggcccaaagagcgtaagtcctagaaatttgttttaaagcagccctagtcatggtgctggtgctaccgccttgttttaggagcctgcctcctgtcagtatgaaaccctcacctgaaaaatgccagcctggacaccaaacactgagccccttcaacaggcacattatttccccctgagatccataagggaatttagtttctactattgtagagttctgaaaagaggtaaaatagtagtcctttggtcatcctatttttgctttcaattttgatatttcagactgtaaaaggccttgggggatgatagtacatgtggtagcagtaatttttttgaagcaactgcactgacattcatttgagttttctctcattatcagattctgttccaaacaagtattctgtagatccaaatggattaccagtgtgctacagacttcttattatagaacagcattctattctacatcaaaaatagtttgtgtaagttagttttggttaccatctaaaatatttttaaatgttctttacataaaaatttatgttgtgttttaaaatccttaggggctttatctatttttctaagtcagttaactgtacttctaaaaaaagtattttgtatctacttttgtaacttcgtcagaataaaatatattgaaagcaagaaatgactgattaaagtatgtatatcaacacacatttctatttaaatatagaaacttgagagttttgcagattctgtggatttttgagtacagcttaaatttggaaagttatctttgcatatcatttagtagctaaaatgttttcttagccgttaaaaaaggaagttcctaaatgaactaagtatcatactactgggaccgaacccctaagaaacaaac

SEQ ID NO: 3130 - DNA, 1217 bp, Homo sapiens
tccatgccatctgagaacagttggagaaccggggcttattcagcctcttatgaatatgagagttatgagagaaggactgtcatgtcacaaaggagctgtgttcaccctctgaaaccacaggatgtagagctgaatgaggaacagggagcagaagctccaggaagccagatgctggctgaatttaggaaagaacctacaatggtgggcgttaaccaccatgggagttctcggcccccttggttggtagcaagttacttggacactctctggatgtccatctgccaaggatattgtaaaaaggatccctgtacagatggggtcaacctggtaacacccagtgccactcctgtggagttactttctggccaaaacacctgtcatctgtaaattagggcttcccatagcatctgagcctcctccatagtcatgatcatgcccctaagagctttcagtgggatgtgcccagagtgcccagggtgctgcagagcaggagcaggaggtctatgcacacatctccaagcaccaaggctggactcacagagagcaaactgaggtccagagaccacccaaggtcatgccaagcctcagtttccctggctgtaaaagaggggtctcaatgcgggccctggtggtctcctgggactcctgtggggtttccaaatctataccccgattgagttgaaggaaataagtggatagtgggttcagccccttaatacattactacgggtaaaaaaaatcataagtcaatcgaaaatatttgctgcacaattattgtatgccctactttaggccttgtggaagataaagatgtcctgccttcagagagttcagttttgattataaccccttctctctgtgactgcactgattttgtaaagaagtccagacttttttctttctttttttctgtcattaattttgagttattccactaaaatctaatgacaggtgatgctaccctttgttctgagccaaggcatgttgcttgcccagaggggatcctacctgcaggcaggcccttttcattctgccctggagcaaatcctgcctctgtggggaagccccatcagggccctcctacgtgcttgtatcttatagactgtagattcagtgttgcattgacgtaaattttacacaaacatagcttctagaagcacacatccttgatctcttttagaaaaaatccaaattctgtttatttttattttatttat

SEQ ID NO: 3131 - DNA, 1175 bp, Homo sapiens
aggaggcacaattgtgtgcctctgaaagggtgaggcctaagaaaaccatttgaaacacagaggagacaagtgacagtggaaggggaaacaggattctgtaggatcacccactgaattgcctgtcttcccagctcagactcctgagtcagggcattgggttgtggggagcctggtctaaactgagttatttgcttgatcttatttcccctcctgagaagagaattaaggagacagtgctcctgagaaagcagccatgtggtgacattcacagactggtcaatgaattctgatttgttataaaaaatataaacttaaaaattctagcagattccagaggaatttggagaaatcttagaatatcattggcattttttcaaaggggaatttgggggtccacccaattctgtaaatggggtttaagaaaatgactctggttgtttttcagtccagcatcttggctgaggcatttcttatacataagaatgccacctttgatctgaggcctctaactgtctgtgtttacctgtgtctttcagacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccaggtattcacgcccttcttttgtgtctgtgcatgtgtgcacatgtctgtcgcatgtgcagctgatgtgttggtacttcgttttcctgagcatgggcataagcctctggttgggagagtggaaggtagtgggggagggaagattgaagatgcatccttagggaagctgccctgtactcttggtttgcttggagcctggggaggggcccatattacagccgtccttgatctggctatattgaaactattgatctggctatattgaatctggcctcagatccaggtatttgaagatggagcagatactacttccccagagacacctgattcttctgcttcaaaagtcctcaaaagaggtaacaaccacccacttaaagttgcctccccatagccagga

SEQ ID NO: 3132 - DNA, 1188 bp, Homo sapiens
actgcctcccttcccctcctgccctgtatacaggaccatagcaggggagaaagggaagggttgatcttgcctttcccttcaggattgtgtggctgacatggtgacggcagatgactcaggcttgctgtgtgtctggcggtcagggccagaattcacattattgacccgcattccaggatttgggtaggtgaggcagaaagggtagagggcttcctgagatagcttcaggctggggagtaggatttgatctgggcaaaacaaagttgggtgtcacccttgcagagttccgtgcccctctgtgcagctgtggcaggggatcatagcagcaggctatgggaacggacaagtgcatctatatgaggccactacaggaaatctacatgtccagatcaatgcccatgcccgggccatctgcgccctggacctggcttctgaggtgggcaaggtaagtctcctcctctgtacctacataccctttttcctggcagtggaatgttgagagaacaccacaggcttgtctttgcaactcagtgtagccccctcccctggggcacctggactggggattccagcttatagctgtcccgtcagggcattctgactccccctcttcctcctccacagctactctctgcaggtgaggacacctttgtgcatatctggaagctgagcagaaacccagagagtggctacattgaggtatgtgtcatggggtgggtggaatgggggggcccaagcatggggcagcaggccctgacgagccctctgctcccccaggtggaacactgtcatggtgagtgtgtcgccgacacccagctgtgtggtgctcgattttgtgattcctcaggcaactcctttgctgtgactggctatgaccttgcggagatccggagattcagcagtgtgtgagaagagcagccttcctttgtccctgtggtattcataaagtacccgctccacccagcctttgtctgattactcagtatcacagtcatgtttcacagctggtgaactatgctccagggatgatgtgaggcaggtctagaccaggcagagagaggcaccctgtcctcaggagccaggtgaaggctgctgttaaataactttaatggttgatgtgggagtcacaagggaggtatgtttgctccaagggttcttcagtgccatcctcaaagctggttagtgcag

SEQ ID NO: 3133 - DNA, 1194 bp, Homo sapiens
tctgtctttatcaggttatttggaaatcgttccttctgccatgagcggttgggtcagccagcgtgggccctggctgatgcccaggtggcccttaccctacggcctggctggccccggggcctcttccgcctgggcaaggccttgatgggactacaggtaataggtctggggctggaaacaggagagatttgagtgggatggagtggggagagggtctatgttgactttctagataagcttctagtaccaaagtgtcacaatggttgtggtactaggagcaggggccagttttagaaagggtacttttaagcaccttgacacctaatcttttctttctgatccctctgggaccaaagcgcttcagagaggcagctgctgtgtttcaggaaactctgagaggtgggtcccagcctgacgcagcccgagagctccgctcttgccttctccacctcacactggtaagggggccaggcacactgtcatgctgaggcgggtatcagggagaattggctgggactgcaataccaagcctcaggtggctaaggagggggcggggaaggatgggtggaatgagaggcatgggctctcctgcttaaaagaaggatctggtgcccttctctctcccttctcagcagggtcagcgaggaggaatctgtgcaccacctctgtcacctggggccctccagccacttccccatgctgagctggcaccctcaggcctaccttccctcaggtgccctcgaagcactgctttgaggtcccctggcctgtctccactcttgcattatccttcatgtcaccgaagccaccccaaccagcccctctcccagactcagagtagaaggccccatcctctcaagccccaggacccttcaaagggctgggacatcctgggacttgggctccagcatctgtctcaggccagatgagggggcaccggtccctcatagggcagggccatgtatatatcccttggtgggggacatagtgtggtgacagttcactgcatattttgagaccttattctctagatccatagttaatgatgccctggcagtcattcctcttgccatggggaagcttctgatgagagaaaggagccccacatccactgaaacatcctttggttctcaagcttcttctggaggcagtaaggaaaaataaaacccaccaaggctcaagaagggaactata

SEQ ID NO: 3134 - DNA, 1196 bp, Homo sapiens
actcgcgtccggcggagaccacaattcccggcattcgtggggcagggaggagtcggcctcccggaatcctggtcccggcgtgcacttctgaaggacttcaggtaccggcgtgccccgcgtcctactgtccgcctgctcgcgtcctgggtgccgcctctgagtagggcgggcgaggaggcagccaaggcggagctgatggctgcgccgagggcggggcggggtgcaggctggagccttcgggcatggcgggctttggggggcattcgctgggggaggagaccccgtttgacccctgacctccgggccctgctgacgtcaggaacttctgacccccgggcccgagtgacttatgggacccccagtctctgggcccggttgtctgttggggtcactgaaccccgagcatgcctgacgtctgggaccccgggtccccgggcacaactgactgcggtgaccccagataccaggacccgggaggcctcagagaactctggaacccgttcgcgcgcgtggctggcggtggcgctgggcgctgggggggcagtgctgttgttgttgtggggcgggggtcggggtcctccggccgtcctcgccgccgtccctagcccgccgcccgcttctccccggagtcagtacaacttcatcgcagatgtggtggagaagacagcacctgccgtggtctatatcgagatcctggaccggtaatggtgggggtagaccgggaggcactgaagccacaggctggagggcgggcgggtaggaggggtcagagcctcctcttatctgtgctttccctccatttcaggcaccctttcttgggccgcgaggtccctatctcgaacggctcaggattcgtggtggctgccgatgggctcattgtcaccaacgcccatgtggtggctgatcggcgcagagtccgtgtgagactgctaagcggcgacacgtatgaggccgtggtcacagctgtggatcccgtggcagacatcgcaacgctgaggattcagactaaggtgggggctggggtaggccaggtctggttggagctgcttatttgctcgcatcttcagatgacaggtctcttttacccattctcccttaggagcctctccccacgctgcctctgggacgctcagctgatgtccggcaaggggagtttgttgttgccatgggaagtccctttgcactgcagaacacga

SEQ ID NO: 3135 - DNA, 1071 bp, Homo sapiens
tatagatttgagttactgtctagtgcccttccatttcggcccaaaggattcccttatgcatttcttgcagggcaagtctaattgtaataaactccctcagcttttgttttatctgagaatgtcttgatttctcccttatttttgatggataattttgccagatacatgaatttttggtaacagtatttttctttcagcactttaaatatgtcatcccactaccttctgacttcatggtttctcatgagatattagatgttataaaatttgaggattcctcattcttgatgagtcagttctgtcttattgcttttcggatttgctcagcttttgtcttttgacagtttgattataacgcggctcagtgtgggtctctgagtttatcccacttagagtttgttgagtttcttggagtcatagatttatgtcttttatcaaattttggacatatttggctattatttcttcaatttttttcactgcttctttcttttccttctgaaatattcttaatgtatatgttggtctgtttgatgctgtctcaccagtttcttaggctgtgttctcttttgttcctcagacttgattattgcagttgcccttctttttatttttttcaagtttgttgattcttctccctgttcagatcaactgttgaactcctctagtgaatttatttcagttactgtacttttcagctccaagatttatctttggttcctttttataacgtctgtgtctttattgatattctcattttgttcatatgtctctttcttcctttagttctttgtccatgttttcctttagctctttgggcttatttaagacaattgtttaaagtctttgcatagtaagtccaatgtctgtgtttcttcagggatggttttcattattttgttttcaatgagccatactttcctgtgtctttgtatgctgtctttttgttgttgaaaactgtatgtttgaacatcataacgtggtggccctgaaaatcagatattccccccttcctgagagttagttttatttttattattgaagattgtagcagtctattgctacatgtgc

SEQ ID NO: 3136 - DNA, 1275 bp, Homo sapiens
ttttttttggtcaaaaacaattattgcaaatgatgagtcttttgaacctaattttttcatgcatatttctgcttctattttttcccttgtcataactgttattaaaaatttaccttttaaaccctaaaataaattgtattaaactgataacaattttatatcatattaaaacatcaagttataaaattataacctctgttcgaaatccactcccttcacatgctttagtggtaccactttgcagccaaatgttctacccttgtgtaccctcaaggtaacactttggattattcttgttatggttgtcttgaggcttacttttccttttacaatatgatttttcacatatagcttgatttcttataagtaaacaatctctattgacaccatgctgtgaataacggaaaatctgtcctatacacgaccttctacctttctaaaattttagatagatgatgatgataatattgatgcaggacaggcaagccccataattgaggcttagcttcggagagttcttggattcatctaggaaacaattcggatgtgagggcgatctggctgcgacatctgttaccccattgatcgccagggttgattcggctgatctggctggctaggcgggtgtccccttcctccctcaccgctccatgtgcgtccctcccgaagctgcgcgctcggtcgaagaggacgaccatccccgatagaggaggaccggacttcggtcaagggtacacgagtagctgcgctcccctgctagaacctccgaacaagctctcaaggaaagaattcgagggcgagctggtggtgttaaacagcaacttttattgaagcggcaatgcacacagtaggagcagaggtgctgctccttgtgagcagggatccctcataggcgatgtgcccagaatggcagcttagaggcagttctgcactcatacttatactcacttttaattatatgcaaagtaaggagtggtttatgcagaaatgtctaggatgaggatgataacttccaggtcattgggtcattgccatggaaagaggaagtaacttccagacgttgccaaggaaatggtaaactgacatggcacactagtagacatgtcttatggaaagctatttccaccccagaactattttagctagtcctcaatttggtctggtgtcccagtcctgcctcttacttcaatattatagatatagatttagatatagatagataaatagttttaataaattaccaaaacatttatgtcttgatccaacaattttaga

SEQ ID NO: 3137 - DNA, 1367 bp, Homo sapiens
gattttcttttctttattttctttctttatttttttgtgagaccaagtctttttctgttgcccaggctgaagtgcagtggcacaatctcggctcactgcagcttccacatcacaggttcaagtgattctcctgcctcagcctcccaagtagctgaggcatgcaccaccacacctggatattttttgtttttagaaagattttcctattagccctttggctgacacctgacaccttgtgataattacatgatctctgaaattctttgccaatatacaaagtgaaatttttattaacaacttgcattcacttgaatatttagattttgaggcatatttttccacttttctccaatttcaacattagggtggaagataatttatatcattatcctgtgacctatgaatctattgctgatttatatcaaataagttcatgtcaacacactcttaaagtcattactatttctgttttctattaaagcataagagcagcagtgattgtttttatatttcgtacgtaagatattgaacattgctgccagaataaaaatacatatcctcggaatcagcggggaaagaagaccctgttgagcttgagcttgactctagtctggcacggtgaagagacgtgagaggtgtagaataagtgggaggcccccggcgccccactgtccccgggagggggcggggcggggtctgcccgccttgagggctgccggtgtaataccactactctgatcgtttttttttcactgacctggtgaggccgggggggcggggggcgagccccgaggggctctagcttctggtgccaagcgcctggccacgcgcagcattcttatacaccaacaacagacaaacagaaagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcagtgccatccccatcaagctaccaatgactttcttcaccgaattggaaaaagatactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagacatatagatcaatggaacagaacagagccctcagaaataacgccgcatatctacaactatctgatctttg

SEQ ID NO: 3138 - DNA, 1195 bp, Homo sapiens
ggttaacctatctatatagattaatctcttgcctttctatttcccctcagtttcagtcttttaataattttctttttgctactttactttagttgttttatgttttattcatatatcttcagctgtttcctctttaatttttttgtttctgcttcatgtcttttttatttttttgagatcattattttatttatgcgtatgctgtttattttactgtctttaattctcatactgttttttctaattacaattcctttgagatgataaattgtatgtccttaggttgaaagactaaactgtggcacccctgggatgtttgggttatgtacacaagctccccaaggcagagatcctctagcatttaaaccaccttcttaattactaggttcaagcatctccctacttttttttctaataggtagctttgtctcccagataatgcatctgaatttccaccacagacactgctcttttctgaaaactgccctcactgaccttgtacatctcaccccaggatatggaaagatgggcaagagggaatacccagagcccaggctaactgttgcaagcattgttgttgactgtcctttccagccaggtccaagtgttgcaccctcctagtttgctcccaccatttttagctgatattggtctagaaatacacaatttacatcccgcaacattgaaaggataaactgatctgcaatgcatgatatgagtaagaaacagaagggacagaggcagaagctgttaagtctgttaagctttttgcctaccatggataccattttccccatagtggggcctaattaatttacttttctcaaagttcctattagaaatttctcagggttttcttaggtttttgttctctctaactccttctcatttgaggggaaactccagattttttttttcagtgtcccatcttagaagaagagcttagaatgtcatcaggttaattttcatttatcctttatttcaggagaggtgaaacttcctgtggaaagccctccctcagctccccaaaacctgatgtaaattatgtgatccaccattttctttcttagctcctatagaaataattttcatagatgtgacttgtagaattgaatatcttttgatttactctttcgtatcaattagttttttaaacatttccctaaacattttaacttttagactccaggaaaac

SEQ ID NO: 3139 - DNA, 1256 bp, Homo sapiens
tttaatctgatataagatgccaagggtatttgataaaaattcttcttccatgccatgtcaggagttaatacaaatgaagaaattccgtgggttcccctgggataagtgagggtagtgtcttggacaacactattgtttgaaggtttatcttttctaatcatgctctaccgcattgtagagagcctaaagagagttgtttctgagctgatctcagggaaatacaaataacttgggagatgagggaaataagatgaattctgtgctgtcaaggcagtaagtctgaagaaaggaccatgcttcttatattatcttccaccttgcttaaaacagcccatagctttgagttgacattttcattcttggcggatagcctactttatgaaggtaaggaatgaactcctacccttcttgggtcattctctgtactgatgcgttagtcttataatactttgcaccaacctgaggaatcttctaggcttctctagcatcccctaagactgtggctatttcacgtctctctccctgcctgccttccttttcccttcctttcccctcctcatgttttctggttgtgcccatctgtaccagctcctttccatccaccttcgtatgcacccagatttttctgttcccatctgtcctatttgttattcatcccgctgctcaacttctccagtatgttgcttcccttaagttgccattcattctcttcatgacttttactaactcacttcggtctctgtctgtcaactaaacttttctaaaggttaccagttatccaatcaccaaatccatggctttttctcaaagcttagtcttgtccttggcagaactggacactattgaccatccaaatggaaattcccctttcttggtgtctctgacaaatggtcctttgccttatcttgtgctggtggtgaagaggccctcaaagccaggcctctctattcctttgactgtctcctcagccattaacccattcttcatcctcggagtgagtgattcccaagtctttgtcttggcttaatccctaaagaacccagttctgctggtatcgaatagttcagcttggttgtcattgaaaggaatttctctcttctgtccatcagcctgtccctcccaactgtctaggacagtcttcggtcacctaaattcctaactgcagacttttgccctttttctctctcatcaccaaagtcccatccatttttttttaataaaagatcctcagctacagtctttccattttccttgct

SEQ ID NO: 3140 - DNA, 1112 bp, Homo sapiens
ataccatctctactaaaaatacaaaaattagctgggcatggtaatcccagctactactgaggaagccgaggtgggagaatcgcttgaacttcggaggcagaggttgcagtgagccaagatcatgccactgcactccagcctgggcaacagagcaagactccgtctcaaaaaagaagaaaaccaccaccaacaaaaaacacatgtaaataattcacaacagtacagaacagtatgaagcagaagccaggattcctctctctccatcaagtgtatatctttctagtgttaggtttcatttcaaactttaaaaatcattttgtgtgctattttaattaattgctgtttctgtggtggtgggtcagtatgtcttaattctgaatgttttccctgcacctcctaaaagatcttttttcccctaagtcctaacagaatggtatattcctctggaaaaagatgaacgtcaccaatggattgtgctgctctcgtttcagctttgatttttttgtccttgagaaccttgtcctccctgctgatttgtttctaaatcaaaagaaatgaagaaaaaagtactgtgacctgagagacaccctcctctagaatttagtggcgggtctgggctggcagaggtagggggctgctttgggctttgcacctgcactttggtgacattgttcttctgtgttccctttatttatgctggtggcttccatccgttcctcctctgagggtgagtggaggggtatatggaaacacggctatgaccaaagggagatcccagcctgggcaggctgcgctgctgaccaccctccctggggcccgggctctgtaggaaagttggtccttgactgtggcattgcactctgcactgtttctctctgcagacctaggggaaaactgcaggtggaagtgcttttctactaaggcctcttactttgggggggatgtgccctacagaagacatagaagatggggaaatgccaatgggcaaagagctactttgaatacataattctcttcaaagacttcagcagcaaaccaaaacagcaggttaaaaaaaaagatgcttttttgggtgcaagtctaacctgtctagcatgagatcttcttgattt

SEQ ID NO: 3141 - DNA, 1199 bp, Homo sapiens
gctcggcctcccctctctcagactctcaggagctgaaggggtgaggcagagatggcccaggggcagagcagggaggtcgggcttggtgcacaggcagactctgcctttgctacttcctacctttctctctgtgaccctgacctcccttctcccctgtcccaggacctctgggaactgacactgtcctggccaggcagccctgctacagtcatctgtccctcccgcccccctctcactgtctggttacaattttcccttgtctatgaattttcctcctgaacacgatctgaaggcctcaaaaatatttagttaaatgaaggaagcagagtggccaggggcccggcatgcctcaggcaggtgccagagctggcaccccaaggctctcctgggagcaaggagtggccgtctccggccatggtccacacaggcaccaaccactccccctggcaggtgtgaagcagcaactggggacggtgcggcccggcttaggcatgacctctgttttcatctgcctgcgaggcaccaaggaagacctgcatctgccgtccaccaactactatgtttactatgacacggacatggaccaggcgtaaggtgcacgtgtgtgtgtatgtgtgtggcccgtgcctccctgcttgactcagagaatgagcagaggttatggaatgggaggaagtaggcaatttctaatttgctcctggaagtttgtcacgccaaggctgtggctcagcttcacccctgtggggagtccctagggataagcagtccttgcagtggttctggggttttgaggacaaaaacctggagatcccaccacactcttgtcacatgcaggatggagcgctacgtctccatgcccagggaagaggctgcggaacacatccctcttctcttcttcgctttcccatcagccaaagatccgacctgggaggaccgattcccaggtggggctgcacgtcccgggtgagggggtggagggagaggccgggcagtagtaatatcagctctgatccccaggccggtccaccatgatcatgctcatacccactgcctacgagtggtttgaggagtggcaggcggagctgaagggaaagcggggcagtgactatgagaccttcaaaaactcctttgtggaagcctctatgtcagtggtcctgaaactgttcccacagctggaggggaaggtagggggtaaagta

SEQ ID NO: 3142 - DNA, 1171 bp, Homo sapiens
gacctatatctagcctgagcctctcttcagctccttgggcccagtgaatagtatcagccattgcctatattgctaactaatcagttaattccctattggctataacagaggtgtatggttgggggttcctatacagggtgtaagaagggaaaagtggaaattaggaaaggcccttaaacaaactggttgcatgctcttatgtgggtacccaccccaggcagtgacttgccccctcgtagatgagagcatttagggatcacctcgtggggcagatccgccccatacccaccacagaggctgacctagcaagactgaatagcctcgtccaaaaagagagtcctcttcgccgacaatgccagcctcttgaaagaagattggttgtagctgtaagtgtctgatgttcaactggaagccagtgcttggcttggaagtgacaagtaggagggcctcagtaaatgtttgttgacagaatgactcctataaatcctggcatgtcttccgttttgccacagggagccaagctagctcagagcagcctgggcagctaatctccttcagtgaggccctgcagcacttccagactgtggacctttcccccttcaaggtatgagggtagcagggtttggagtctcaagcaaagtgccttttccctaggagccaagcctctatcccaccaggacagggcattgggcaagcaaatctcccctaagatcttggtgcccaggatcatgggtggcctaggacccatgcttcatttggggccttggtagcttttgtgggactatgcccttacagctcctgtagccctgtcattcaggggcctgtatagctgtttatctactcttcccttttagggatggggacatctagagtcaagtactaggtagatccttgcagaggcaaggcaaactgttcagggagctgagtgattcatggccagtggaggaaaaccttccattccctcaaggaaccagaagctatttaggaatttaagaaagatataagctggaaaaagaaggaatatttgggggaataaacgctaggggtggggtgggtgctgggcatagtggctcacacatgtaataccagctctttcggaggaggctgaggtgaggggtcacttgaacccaggagttcaaggctgcagtaagctatgatcacacctgggcaa

SEQ ID NO: 3143 - DNA, 1212 bp, Homo sapiens
aaagaaactgagccaggaatttctcttttccagataagatttgtgaccaaatcagtgatgctgtccttgatgcccaccttcagcaggatcctgatgccaaagtagcttgtggtaggttcagaatgtgcttatcaactggtggaaagatagcataaaaattatttttatagaagtgatgtttgagttgaatgtctctttttattagaaactgttgctaaaactggaatgatccttcttgctggggaaattacatccagagctgctgttgactaccagaaagtggttcgtgaagctgttaaacacattggatatgatgattcttccaaaggtgtgttttaatgattttgctcatttttttctaggtaacagctgtgaggtttgaagaaactcctagaatgttcctgctaatcctaaactccagttgtatcttactatacactaagccctattctgttcattctctaaaaggtccgatggtttaggtatatttgatttcttcagcagtgtttagaattccagataattgctgtaaacagcaggtatttctaggacgtaaacaagatgttgtgttttttgcttataggttttgactacaagacttgtaacgtgctggtagccttggagcaacagtcaccagatattgctcaaggtgttcatcttgacagaaatgaagaagacattggtgctggagaccaggtatcttggtgtagaggctgttttaatctcttctaacattaaattctggagcttgatcacattggtgacttttctttctttagggcttaatgtttggctatgccactgatgaaactgaggagtgtatgcctttaaccattgtcttggcacacaagctaaatgccaaactggcagaactacgccgtaatggcactttgccttggttacgccctgattctaaaactcaagtaagtgatgatcataaagcttggttgtctcatttattacatcagcacagaagatccataattttgataatagctaactggaaaaaatagcatttgttttcctatattgtaacttcaggtagagaaacaaatacaaagttattgtttggtgtgatgttctgatgacctgtgttgccttcaaggttactgtgcagtatatgcaggatcgaggtgctgtgcttcccatcagagtccacacaattgttatatctgttcagcatgatgaagaggtttgtcttgatgaaatgag

SEQ ID NO: 3144 - DNA, 1725 bp, Homo sapiens
gtgtgtgtgtatatacttaaggctgaggaggtgaaggtgtgaaggaagactcctcaaatgggaatatattttaattcctggaacagttttgaactgctgccttagtgaagacttagttatttgagaaatttaaaattacggtgctccatggcttaggctaaccactctagagaatgttccagatttgatatttgagctttgtgctcttctacttaagggtgttaagaaaatagagataaagtgggttgctcaaggtttgttgcaatgtaaaaaccatggtagggtgtgggcggcgggaccttggtaagtattgtgtgatctcaggtgagctttttgacaattgaaatttctcagaataatgacaagttttcgtatttgttgagccagggacggaaaaacaactatagttactaataaggactgtgcaaggagtttggacaccagggaagtaacacttttgccacaaatttttttcctagcatatcccagagaactcatttgccagagctcttgaaaatgagtcttgctgattgttttgctttattttaatttaatgctacatattaagttacggacttgtatattccagggatctggatctgaagaagccaatttatcagaggactgcagcctatggccactttggtagggacagcttcccatgggaagtgcccaaaaagcttaaatattgaaagtgttagccttttttccccagacttgttggcgtaggctacagagaagccttcaagctctgagggaaagggccctccttcctaaattttcctgtcctctttcagctcctgaccagttgcagtcactctagtcaatgacatgaattttagcttttgtgggggactgtaagttgggcttgctattctgtccctaggtgttttgttcaccattataatgaatttagtgagcataggtgatccatgtaactgcctagaaacaacactgtagtaaataatgctttgaaattgaacctttgtgccctatcacccaacgctccaaagtcataattgcattgactttccccaccagatgctgaaaatgtccttgtgatgtgcacgtaaagtacttgtagttccacttatagcctctgtctggcaatgccacagccctgtcagcatgaatttgtaatgtcttgagctctattatgaatgtgaagccttccccttatcctccctgtaacttgatccatttctaattatgtagctctttgtcagggagtgttccctatccaatcaatcttgcatgtaacgcaagttcccagttggagctccagcctgacatcaaaaaaggcagttaccattaaaccatctccctggtgcttatgctcttaattgccacctctaacagcaccaaatcaaaatctctccactttcagctgtcttttggaggacgtacgtaataaggttttaatttagtaaaccaatcctatgcatggtttcagcactagccaaacctcaccaactcctagttctagaaaaacaggcacttggcagccttgtgatgtcatacagagaagtcacagggcagtacctgagggtctgtaggttgcacactttggtaccagataacttttttttttctttataagaaagcctgagtactccacactgcacaataactcctcccagggttttaactttgttttattttcaaaaccaggtccaatgagctttctgaacagctggtgtagctacagagaaaccagcttccttc

SEQ ID NO: 3145 - DNA, 1256 bp, Homo sapiens
gaaaatggtttggtcatttgggttattgaagtatttttggatgcttctcccatcccactctccagcttaaaatgtgggctgtgtacttagacttctggaagctggcatttacgcacattaactaaacttggccttgaccacaacccgtccttgattggtgccactgtgttctggttatgtttttatcagcacttcattcacatactaatttttagtgtttgtgaatgggaaccttatgcatattcatgtttccaaaaatgagcaaaaggatcttttgtaggggtagtgacaggtggttttcctgtattttgttttgtatataaatgtgtgttctaaaagtcattagtggggggtgcttgtgcatggctccttgtacaagaaagtagctttatttgaacatctgattgctagtcagctatctccaggaaaagatgatgaaggcttgtctttgaggtgtggctcacacgtgtctctctagcaactatgctgctagtgacagagacgtatgacatttgcatttggttgttagcgcaggcagtttggcacacacttgatacaaccaggctgtgatgattggcgcaggggtacggacctcagctgagtcatgggagctgaatgtatgtgtttctcctttgtcctgcatgtggcaggctgatggggagcacttacatgagactgttgcctcaatctgagcctgcacttcataacagaattctaagacagactgaacccctgctgtactttaagagagggaaacagcaggttctgttctatgcctcttttccagctgtgcacaggatggattccctccttagaaggacagtggtgatcctctacaagaggacaaatacagttggagtatcccttttccaaaatgcttaagaccagaagtgtatggggttttagattttggagcatttttggattaggaatattcaacctgtaccagcaaatcttgacattggcagcatatcagatttacctgtgaaaactgcagtgtagattcgtttggggagtttaagcacctgcggtgattctcatgtacacacagggctgggagctagtagagcccacagatgtgtgtctttgggagcttacagtatagttaagaaaagggcatttagtctctgatttcagagagaagacagctatagtgtctgattgccttgtttttctaatagtattcataatctttttcctttcttgagcaggaaaatgttggggcttttcaggaagcataataagattcctaggta

SEQ ID NO: 3146 - DNA, 1256 bp, Homo sapiens; identical to SEQ ID NO: 3145

SEQ ID NO: 3147 - DNA, 2449 bp, Homo sapiens
aagctgcacatggccactctgaaagccaagaatatggagattaaagtaaaggactacatctcagctaagcctctggaaatgagtagtgaagccaaggccaccagccagtcctctgagcgaaagaacgagggcagctgtggccctgctcggattgagtatgcttgacaggctttgggataagaagggacaaggtgcttctagccctgtctcagtccgttatcactctgctgtagaagggggacatgccacatgtattagaaggcatctgctgtaacttccagtgcaagataattcaataactgatgtcccatttcattcagagcccttattgctcttatcaaaacagaagaaggctacatttgtgggagtgttgtcatattctcaggccaactgttttgaaattcggtatctcactgagctaatctggaacaaacctctcacctcaggccagaaggggatgacctccatttgcttctctgagtagtttcctctgctgacattccaaatcccaccatcgattgtgcagcgctttggatttccttcagttctccaggtccacctggaaagtatagttggccagttgagtctctcaaatgaggggctactgggagtgctcttggtaacaatcatgatgtgaatgggtgtgaacgatacttggctatgttaagtgccttgtccgcaccttgcttttatctctagagacatgaagttattattaattttttttttttttaagtagagatggagtttcactctgtttcccaggctggtcttgaactcctgggccatgcctggccagggacatgaatttgtacaaagaaatttccctccctgcctgcacaatatcacccattgactcaccttatccaaagcaagtttcctgtgaatcggccagttcttctatattcattggatcattgcctccttcctaaccttccccatttaccaagaacactgggagactaatccttttagatagtagctttttgatgctcaaaacatcacatttaaatttagtttaaaaattttttaacttttgtgtcaaataggagttgaggaattgagcaggattctaccctagtccgattgtatagaaaacaccattttgattcaggtattatttttcatatttcaggtttgacttgttcttttcagaaggctaaagtcagaggaatgggggctgggccactcccttggagctctcagatctacagacaagctgtgtgaatgcatagatgtaatcttgtctcaaatactaatacagtggagatttggtttatgttaccattaagttcctctaaaaagtttttcttcctctcttcagagccaaaataaaagtgaactacactgttcagataaggtcacaatctgatgctgtcagtttgaccgagctggttttgcttatggtcatgctgcaatttgttagaataatagggatcaagttttaaatcctcctccttcccttttttctggagtcttgagggccagagtttttgtttttgtttttgtttttgttttcctgcttgctactgttttgtggtgttgaaaagtggtttaaacctgagactaacttaaacacttccttgaccttcttgttgcctgttcatttttgtgccaaggaagtagctgccccagtgtatgtcttgccttctccgcgtcattgttggaagaggagagatgcatcgagcagtcccagctgcttttcatttattacttcttctttccaggacctgacagaagtcagggaagagtccctgggttatgtccaaacttagcacctgcaattgttgggatgtggatggatgtgtgcataagagagagagagaatatgtgtgtgtgtgtgtgcgtctgcgagcgcacacacatgcacaagtgcgaaggagttgcggttgctccatgttctgacttagggcaatttgattctgcacttggggtctgtctgtacagttactcatgtcattgtaatgatttcactcctaactgtgacatttttatcaaatgtgtgaataaatacataaagattggtacaaaaaaaagtgtttgtctttggacaaatggtggtggaaaaatcttgcatattggacttaccatttctttctgatcacaaagttgaaaagaattttactctgagagttgggaggtggaagtggcagggcttgttcattcttggtagatagtggctgacacagtttgcctagaccacgagccctttccaagtgacctgcttggcaactgaaaataaaccacctatgtccacttccctagcttgatatactgacccatatcctttccctttaaaaaaagatcactttggagggagcagtgctagagcttagcagacggtagaaatcaggagggacagaagcaggcctgaggtctagggttgaggttgaggagagggtcaagtcagcgctcttggcggaggggcagtcctgctggcatgctctga

SEQ ID NO: 3148 - DNA, 1256 bp, Homo sapiens
ccaggtcgcgcccaatcacggcccaggtggcggagaaaaagtagggtgcgcgcgcgccgcgcgtgtggcagtcgcggaaggcgcgggagcttgcgtgctgctgggcctgagctgtctgtctcgtttctgtccgcgcgccctgcatcccggccccgggcgcccgctggaggtcgccgaggagccacagggctgactggtctgctgcccgggcccaggagtgcctggtgtagcagtcgcggagccatcccggcgtctgctgccatgaccgactctcccctcagaggagactcttcctcagcggtggctgcagagacagatgagcggcggctcctggccgcgggaccgtgagacgggttcgtggccggccatttagggggacgctgcgaccaccgcctgcgcccctccggactggttccttgggccccggaagctcgcggcgggccctgcgggaggcggcatgctcccgcggaggctgctggccgcctggctggcggggacgcggggcgggggcctgctggcgcttctggccaatcagtgccgcttcgtcacgggcctgcgcgtgcggcgcgcgcagcagatcgcgcagctctacggccgcctctactccgagagctcacgccgcgttctcctcggccgcctctggcgccggctgcacggccgtcctggccatgcctctgccttgatggcggcgttagccggcgtcttcgtttgggacgaggagaggatccaggaggaggagttgcagaggtgggcgctgcggcgagctctttctgggccgtggggtgggggggcttgtgaaccctggggcctgccctgtggtcgttggcccttgtttacccggtggtcttttaattggcaatacagtcgattgaacctgcttcagcaaaccgcgttgttatttgtctctgtgtgtcaatttgcatttgtcgggttataaaatagaactgaaagtgtgtaggctggtgtgtaggagggagactttgagtggggcgagcaagacagtaaagaaacaacactgtagaaatcaattagatagcgaaggcatggaggcccttgttcatgtaatctgtaatctttaacacaaccagaaaggtgcaaattcaaaacaaattttaaatttggcctaagggtggtgggctgctatttgcaaaatgacttcaatccagatgggactcaggcctgtgagaaaagccaggagagccctctgtcatcgtgactcgtggcaaaattgagagcctggaagcgattttgtccag

SEQ ID NO: 3149 - DNA, 1211 bp, Homo sapiens
cctatcaattactgaatacccattgtggtttgtttctcaatcatctgggaggagccatctatagtcctgtcctgaagggagttcctcctagatctggtcggacctttgtatggtaattgagatttaaatcccctattaggaaatctgctgggttaagggaatttttagtggttaatgttaaatcacctttttctaacagaatagccccatactttaagatttttgagttagtgagctacctttttgcttttttgacttagaataattctgaactggtgaggtgtgctcacagtgaggtttcctctaaaagttacttttctactttcttctgttagcaaagcagtttctgctacagaatgaatgcatttgggccatccgtgggttcctgggttaaggatttttgataggaaggctactggttgtcagtggtctcagtgttttcagactatgcccttgtttacactgacaacaagttagtattggagtgttatagggtcacaaagaagaccttcaattatcaattataggctttaaatttaccctggcttttaaaggaatagggcacactgtttttttctttactacttctgtctctttttttccctgtctccctctcttctctcttttctctctctgtctctctctatctcttctctccttgacttactcaatttgctttcattctgatctattatgttgtcgtagacccagttccaattgttaaagtactgggtcatcagttctaaggccctggccaaggagccaaggcttagagattgcattgcagaggggtaagctgggtagaaatcgggggaggagagcatcttacacaatggaagagcaatcctcctaggcatttacaaacttggggccttggcaagggtggtagggaatgggtcccacataactgcccatgtcaagagctgtatgcctaaattgggagggacaccagggacaaaactccctgggttcatagcctagatgcctaaggacacagcatagagcttccttagatccctttggagatacaacttgctctaatacttgggaaaggaaatgaaagtctgaaccattagtacctaggaggcagggatcagaggaagtagattcagaggtaaggagaatttgggggctacactttcaagaaagtcatggtcgggacccaggacgtatgggtcagaaggaaaggtaggggtacacgcatgggcaac

SEQ ID NO: 3150 - DNA, 1285 bp, Homo sapiens
tcaaggaccagagtgaaggggactacatctcccagcccttcaccttttaaatatgagtggttttaaaaggaaaaaaatgaaaccaggcaacagcaacaatattctgtttttaaaatagggacaagactgttgtcactttttagacatgtatcccattccttttggctctgcaatatttggggctgtagctccttccaagcccatggtagtccctccccgagtctctcccagtagaatgcagcctcccttccctggccccttccctctcagtgacggtgactccctggggccttctcgtggaacccagaggggctgaggactgtggcctggctggcgggccagcgtggtgctcctcaggactgcagcactgagatggaacctggcctcagtttaggaacaggggccacaacagggcaggaacccaccaccctccacataggaatacaaccagtggggccacatcatgtgaggcatcagacccacactgtcagcccagcaggccgggctgtgtccttcagacccagtgctgccctagactctgactcgggactccagcttgccacgtgccctctcccctcttgaatgtactctggtcttgcagtgtgctgctgggactttcttgctcagccatcactctggtcaccttgtttgctctgggtctggctgaattttctgccctgagatctgggcataaagtggatgaaacttgaaagaccttcagtgtagatccagatggccaacctgtccttgttaagttacttgcttcttgggaatcagtgtcccctgctgagctgaaaaggaaatggattccaatctcttccaacctttaaggtgatagatagtttgagcaagactggagaatggacaacactatgaagctgtggctagaaagggactgtcatgtcccatcctttggccagattgactggggatgtccggacagatgcctgcatgggtggtgagggccacatctgcacacgagccagtggctgcttgcagttcactgctgtgatgccagagtgtgttcaaaggtgactctcctgctcttctggactcttctctcaggcaagaaaggctgcaggctgcctgctatgtgatgcctgagcacaaagccaaggaactgaactaagtctttctgttaagtcctgagtttgtcattggcaggtttacttgtggccagctctctctgcccttgggtgtctgagcaggcagaccagaagaccaggcactggacctgcatgccaaagggactggtcatctcctgaggacctgtaaatgaccctgt

SEQ ID NO: 3151 - DNA, 1155 bp, Homo sapiens
atggtagagtcaggcctgataaggaatgggggtggctgccctcaattcccaagcactcccccagggttgcagaggactgcatagggtatgccttctctaaaatccctgatttatggggatgggatggggtggggggatggagtcttaccaagcaatgtcataaatggtccttgagtggaagccggacaaagtacagatacatttccaactggggtcagagccgctgcatgccacccctgcaagacagacttctcttgcccttaaacgttcctatgtcctgggcacctcaaaggagaacctaacttaccttccctcaccctcatcttcaactgattatgagtctgtgtctccgttcgtgtccccatccctgcttatctgccttacacactatagccagactggcgtttctcaagcagaattccgaggaaacatccctgttctgttgcagactgtatgtaactactttgcgtgcctgtgaaggccacccaccagccgacccaacccactttattcctctccaaaccccagacgtcctatgccccatttaaatgcattaccacccctcagtctaagcattcccgccattgttatctttactcacactgttgagttttcacttgaattctcacgtgaaattctcatgttaaaatcctacatacccttttaaattcagatgaaacaacccattctacaaaactttcctgattcttccagcactctatccagagccctcttgtagcacatcttaccttttacccccatttgctctgactcatgtacgtgtcttagcagactgtgaaccccttgagagatgggtcttctttagctctactaatggacctcaccttgttcattgcctggtagatactgacgccagatacgcacagtacggtcatcactacaagacgccaggcgctggccactcgggtcaaaggccaagctccacacagtggattcatggccctcaagggtggcacagcatacccagtcatcctcttcctcccggtacagcttcactgtgtcatcatagctggcagaagctaagagctgggggaagagtgaaaggaaacccaacatgtgtctgtgtggcccaggaagcaaaggacaggtcagttccaggtatctgcttttattttattttattatttatttgag

SEQ ID NO: 3152 - DNA, 1155 bp, Homo sapiens
gtttcctcggaattctgcttgagaaacgccagtctggctatagtgtgtaaggcagataagcagggatggggacacgaacggagacacagactcataatcagttgaagatgagggtgagggaaggtaagttaggttctcctttgaggtgcccaggacataggaacgtttaagggcaagagaagtctgtcttgcaggggtggcatgcagcggctctgaccccagttggaaatgtatctgtactttgtccggcttccactcaaggaccatttatgacattgcttggtaagactccatccccccaccccatcccatccccataaatcagggattttagagaaggcataccctatgcagtcctctgcaaccctgggggagtgcttgggaattgagggcagccacccccattccttatcaggcctgactctaccatgctggtttacagctggctgggctggcattcacaggagcagagaacagtcccaggctgtgagggtagcaccagcgctagaggttcgcacagctcgtgctgtccagaagttattattgaatctgcattcgtggctgagggtttttttttgtttttttgttttttgagacagagtctcactctgcagcccaggctggagtgcggtggcgtgatctcatctcactgcaagctccgtctcccgggttcacaccattctcctgcctcagcctcccaagtagctgggattacaggcgcccgccaccatgcctggctaattttttatttttagtagagacggggtttcaccgcgttagccaggatggtctcgatctcctgacctcatgatccgcccaccttggcctcccaaagtgctgggattacaggcatgagccaccgcacctggcagtggctggggtttttataggtaacactgactctggccttgtggaagctggaaaagctgcaccattcatataggagagtaggttagagggtagttctggccctgagaattgatccctaggaaatccaaaacagtgaaaaaaactgagcacttaagcttgctttatattagcaaacatttgggaatcacctattcaacaaaagtgaacttaagtaaattatggtagaactcagcttgttgtatcactgtttaaagaaaggggttaagaatactttatgatggggcc

SEQ ID NO: 3153 - DNA, 1099 bp, Homo sapiens
tcccaacactttgggaggccaaggtgggtggatcacaaggtcaggagttcaagaccagcctggccaatatggtgaaagtccgtctctactaaaattacaaaaattagccgggcgtggtggcagatcccttgtagtcccagctactcgggaggctgaggcaggagaatagcttgaacccgggaggtggaggttgcagtgagtcgagatcgtgccactggactccagcctgggtgacagagcgagactccatttcaaaaaaaaaaaaaaaaaaaaaaaatcacttgtagtcttggtgtggtatcaaagaatagccacaattagctgaaaaggctattttaaaaacttttccaactgcgtatctgtgtgaagtcaacttacttcaacaaaaaagtttggatgtagaagcagctgtaagaattcaactgtttattataacaagatactaaagagactgtaaaatgccacccttctccttggattgttttggaagttattcttcataaaaaatgttaacgtgggctgggcatggtggctcatgcctgtaatcccagcactctgggaggctgaggtgggcggatcacttgagctcaggaattcaaggtcagcctgggcaacatggctaaactctgtctctattaagaaaaaaaatgttaacattatgatttaaaagtgcattaaccttaatctagataataaaagctttttggggcaacctccagaactgtgaaaaataaatttgttatttaaaaagaaaaaaaaaaaaacaaaaacctgagtttcttagtttttagtagtgtaaagaggtcctaagaccaaatcatttgaaaactgctaccctgaggaaactgcccttcagaatcatctttcaattttgtgtgcatttaatctaaagaacagaaggtaagaatttgaagacagtcggaagatctggattagaaaacctgtttattaagactgggtcacatccagctagtacatttcagtgccctttctggtgctgcctcccaggagcagacactgcaaatttcagaacccccatctagagaaacccctaacctgtgatctagcttccgaggctcagtgttggttcttgtggtag

SEQ ID NO: 3154 - DNA, 1181 bp, Homo sapiens
aatttagggtgacttgagggagaggttctgtggtgatgcaggatcagctccagatcatggttgagttggggtcatttccacaggaaggtgatgaagacgtatacggggaggttcgagaagaggcatctgatgatgacatggaaggggacgaggctgtcgtgcgctgcaccctctcggctaatgtaagttcagtttgctcttcctcattgctacaaggttacttctgggtgttagtgcttcttccccatgcctaggtcctgttacatttattgagccactttttgctggagtgaactataataaacacttagtgtctagagtttcttaaaatttctgtcggttttcttccttcccaaagatgtatgttgatgaaatcttagtctggtgtgcttctgaactcaatattccagagttttttcctctggaaagtcctcacaagaaggtgggctatggattgtcaagtagaacttggttgcagggtggtggcaaagtgatcgaggctggcagagacctggtgagctaaatgcctggttacttttatagctcgtagcctcaggtgaactgatgagttccaagaagaaggatttgcaccctcgggatattgatgcattttggctgcagcggcagctcagtcgtttctatgatgatgccatcgtgtcgcagaagaaggcagatgaagtattggagattttgaaggtatggccaagatgacaatagttgtatatttagtgtatcttagcacatggggacagcgtatgaagtggcagatggctttggccttaatggtggtgttacctgctctctgcagacggccagtgatgatcgggaatgtgaaaatcagctggttctgctgcttggtttcaacacctttgatttcattaaagtgttgcggcagcacaggatgatgagtgagtatatggtggggtcttcctgcagagtgagtacatatgtgtgcatgtgtgacatagagattctgttgttttcacagcctaagtgcttgtttcttttatttttcttctttctaccctgaggatggttttttgccttatttcctcctcctcacttcctttgttccttttgttgtgggtagttttatactgtaccttgctggccagtgcacaaagtgaagctgaaaaggaaaggattatgggaaagatggaagctgacccagagctatccaa

SEQ ID NO: 3155 - DNA, 1198 bp, Homo sapiens
gactccagcatagtataagcataacttttaaatttgtgtgactggaagtgcctgtattaaacactggacatttggctagggacacctgagagtgtgcccagaggagagtattctaaatgaagatgcagttagaagttgtgtcatatgaagaacagtggaagaaaatggggcgtttcttaattcaagtatttattgtttagtagtagttttggatttgttacaagcacattgtgggtttatttgagttgtttttgaggcacagaattatattaaaatattcagtgtgctcttgtaaactgtgcacatctccagtcacatttctcctacttcagagatttatatatcaagtagaaatcactggtctaaggaaggacctgcaaatatttgaaagactgtgatccataggcactcgtaaaagaggagcctcattccacgaggctctggaatacagaatgaggatgatggatgtaattagagggaagagctggatgtctctccttgttgccatgtagggaacagtggtttccattcaggaatgagacaggctgttaattaaggtaatgggttttcctttttttttttaaagacagggtctcaggctggagtgcagtggtatgagtatggctcagtgcagcctcaacccctgggctcaaatgatcctcctgcctcagcctcctgagtagctgagaccacaggcacacagcaccatgccatctttttttgtagagatggggtctcactgtgttgcccaacgctagtctcaaaattcctaggctcaagcagttctcccacctcagcctctcaaaatgctgggattacaggtgtgagtcaccgtgcctggctggtaatgggttttctgtcaaaattgttcaagtgcaacaaggtgactttcagaaagctggagggtagattttccaacttttgtttttagtgaaggaaccctttttcaggtaaaactgtgcagaaggcctaattgccagtcacacagaaatagagctgctctggtttatttgggattggtagagatgctgagccctgctactccaggtttgcactgtatagtggaaaagtctgttagacttagatgacttgtgagggcccttctgactctaaaattgtataattctaggaggagattgggcataggaattaagatttacttctctaacctagttcagtagcttttaacaaaatagct

SEQ ID NO: 3156 - DNA, 1275 bp, Homo sapiens
gcactcgcattgctgtagtttgttgagttttggcatggccccatgaggcagatagtactattcagttttagatgcttctacagactgactccgtggcagagtcaggttgccatgcagtaatttcagaaggagcccctattggccattttctacaaccttttttcttattccctctctttttctcccttctctggctggctgtgattctgtaattctttctgattcattccagcacagtttgctgcttttctgaaacaaaatatgctggtgaggaaagctcttcctcctggcacctcctcctgtctctttggtgagtattactctttcttgcctgctcgtccactacattctgctcctcaaccccttatttattttccatctctgcctctcatctgcctcagtttggtttcctcctgttcttttctctctctttctttgtattcttttgttttgctgaccccttttgcttactctgtagtctttgccctttttccattcttttgtttgcttctcatggtgttttcttttttgtctcttagtgtggttctttctttcactacggtcttggctctgctgcttttttgtatgtctgtggcattgcctgagtctcagtttccttgtgtgtttttctccctgcctcctgtcctgtgtttatctggtggctacaagcctaccagccacatatcagcatagaacctgaaactcctttcccctacaccctccttcctactctgattttagccagtgcatttgtcccctaagcaatccttctagctggttatgtcctgactgttgcctcatgccaggacccctcctccctcctcatgtgactgctaccttcctccccacaccagtctttgcttccctgtgctacaagaggactagggtggacttctgggtttaaagaggagggaatctttgaggaagcttgaaagataacctaagagtccaaaaagcttggctgtatacatgatgagcctgtttgattcagtggaagtggaagcccatgtgtgaacagatggcctttgtctgtactagtacacatgacctggggactaggttgtgacatgggccagtgttgccctgttacttttgggtgggagccgtgaggttgcctggttgaggtactctctctcctagtagctactcatagccagcttttagtcctggtgacactcctcttcattgcctccatttggcaagtggatcctcaactgtgggctcttagggcagggtgggactcttgagagcctttggaaaactctactttttaga

SEQ ID NO: 3157 - DNA, 1175 bp, Homo sapiens
ctctcagatcgggagcacccccctgcacgtggcagtgcgcacccggcaccccgactgcctggagcacctcatcgagtgtggcgcccacctgaacgcacaggataaggtaaggcaggcgcttggtcttttccggctcggacagctccagaggagcagggactgaggagccccagccaggaccagaggtgctgtctgctcggtgacagcagccctgaccttcctgcatgaggagggcagcacgcggaggcagaagcttgactgcctgcgttctcagcaggaaggggacacggctctgcacgaggccgtgcggcacggcagctacaaagccatgaagctactgctgctctatggggccgagctgggggtgcggaacgcggtgagtgtgggcgcagccctggctcctgacccgagggcgggtggagcgcctgcaagggactgacccacaccgttgctcccaggcctccgtgaccccggtgcagctggctcgagactggcagcgcggcatccgggaggccctgcaggcccacgtggcgcatccccgcacccggtgctgaccgcagcaccgccccccgccgcgcctttcgcactgccaccattccatcctgtgccccgcccccgcgtctgcacctctgtggttcctgccctcagccctggttcctccctctctggcctgtgccgcctcagcagccctggcagaactgaagagcggcaccgggcccagcaggcaaagagagaggcctccctggcttcgagtgtcaggggagccgcgttccctcccagggctggagcagaggaccacaaggcagcagaaagcgcgggtccagatgagggccaggaaggggaggagagtgagggccaagaacgagccttaagggagcagtcccaagctggagccacccagggctgggtctgggagtcctcagtgtccacttgtcccaggttagggggcttgccttgctctctccagggccagtctgtgtgtgtggggactcagcccgtggccggcagatgccatccaggatgtacaaggtgcagccaaggcaggccatgcaggggccgggcctgtctgcagctggtggatgcctgtgggcatggctttctctggggaccccattcctgtcagtagcaaccctggcagtgtccggagcggctctagacaactttggtcataggaa

SEQ ID NO: 3158 - DNA, 1154 bp, Homo sapiens
tggagctgccccacggccttgtgccctctcatttacaccttctcctctgcaccccccaggagacggctggctgctcaaggctgtgagcctggggccctgggttcacctgattgaggagctgcagctgtttgaccaggagcccatgagaagcctggtgctatctcagagcaaggtagtaagttgggccctatctgccactgtccccagcactatcccatctcactctctccatctggctgcttctcccagttgggcctatgtgcttggccagtgcagagttaggaacacacacacatgtggatgcacaccttgcctaacttggggtgggttcctggaaacgagaatgaaaacagaatggaatctgcactgcacagggccattatatatagccaggtcacggggctgcgctcccagcatcaagccttggcaactgctcccatgtttctttcagaccctccaagctgtgctgtggttctggctctggcctcttccctgaccatgcccctgtgaccagacctcccaggctgtgagatgtttatgatgccctcaccatggtggttttccttccagcccccatttccgtgactgtttccctgaagtgcttgcattatacccttgtgcaatactctttttggtttttttttgagatggagtctcactctgtcacccaggctagagtgcagtgacgcgatctcagctcactgcaacctccacctcccaggttgaagctattcttatgcctcagcctcctgagtagctgggattacaggtgcctgccactatgcccagctaaaggttttttgtttttgtttttgttttctttgagatggagtctcactctgtcgcccaggctggagtgcggtggcatgatctctgctcactgcaacctccacctcccgggttcaagcaattctgcctcggcctcccaagtaactgggactacaggcacgtgccaccatgcccagctaatttttttttttttttttttttttgagatggagtctcgctctgtcacccaggctggagtgcagtggcgcaatctcggctcactgcaagctctgcctcccaggttcacaccattctcctgcctcagccttccatgtagctgggactacaggctcccatcaccacgcctggctaattttttgtatttt

SEQ ID NO: 3159 - DNA, 1106 bp, Homo sapiens
aagtcagggacaggctgctgaggagttgcccccatagtgtgctggctttattctcacgtgtgtggcacagctttctaagaaactcgagttggaagaacgggcagtgtgggttgggacctgggattagcctcctctgggggagctctgtccaactccccaccccagactgcctgcccaggtgtgggagggggagagccttctgcctcgccctctccacgcctcgcttcttgaattgtcactggcgctgggagcctaaagagaaactggaaccgggataaatataaactggaggctctctcccctggctccccaggcccccctaagacctcctactgccctgtacacatcatacactctggtggccctggaagtgtgtgtgtatgtgcacatgctcgcatggttgccggggcacagcggggacccagcagtgctccctgtgcacacacccgtgtgaaaggtgatgtcaggtgtttgtatcagccgtgcgctctggggacctgggatgagctcacctcccacaggctccactcgggtgccagtgaagccctgccatgccggtctgtgtctggatccattgttgcctgcaaagactaaggctggtttggggggaccctgaggacaggtcggcagccatatttggcagctgatgtaggaatcacgtgactgtataaatgtcgtagtgccctgcatgccgggtggcagcaagacttcccaggccccagccccatctccgctctctgagcctctggtttctccggacctccctggcctggctcacagcccagctcccctcctgccatccccacctgtcctagtggcctgctgtgctcgcatctctggcagcctggattggggtcctgctggagtgaagggtttcctgaggcagggagtactcatagccgtctgtgcctcctgctctgctggactctgatagaggcagtgggcagcagggcaaagaaggaagcagccgccgaggaagcgaaggtggggtgggggtgcccagccctgcggccggaggtgccattgaccctgagagcaagagccatcagtctgatggcttcctctggccggaagctgtggctgagatatccttccttcctcccagc

SEQ ID NO: 3160 - DNA, 1177 bp, Homo sapiens
ccttaccagtaagtgtgggctgaagagagagacactggctttaacctcagataaaagctgttccattctcactgccttgtagcctctcatactcagaagggaaggtgaggctcggtcctgtgactattcattcttccagactgtgaaagtttttgatgatgactcagagaaatgtcctctgtttactaaaatataatatctattaacagtctgctgcaaaagagataggccctgtcttgtctcagtcctctcaaactgtgcccatatgttccactcctctggcccttactgaaccatgatgcctgccagaatcactctgaaattcttctgcccctctgtcagtcttctggcccagttctcagaacacaggtccctgtctgtccgctttccagtgatctgtccatgcccttcaaattcacaacataagaagagttgatcattaaaatatcccagaatgggaaataggggttgcctgttctgtctgagaccagcaatgcagatgcaggattctaagggaggaggagaaagcaaaagttggtgcccttgaaactgctcagtcacatccttgtgacatctaaaaggataaaaggtactcagggttaaataattggaacagaaggaggacagtcaagttcaggcatatatggagaaagagagcttctgtcagtgcctgacaccaagtaaaactctttctttaacggaatgcacccataaatgtgtcagaaaaataacccttggtgaggaaaagcaaagttgtagagaacaagggataaagaagacagcaagcaacatttcctgcagatttcaaaataattcttgagtgcttacatttcctggaattgccgtgaggctactgagtattatcacccactatgaaaaagtcagctgagagtaatatggtatcatggttaagagtaatgtcttgaagttaaattgcctgggtttgattcccaaactcactgctcataagcctccttcccagaacaaagtgcccttctcaaagccttgtgtgtgggtgtggggtgtatgggtgtgttaggcatatttttatataatatagtagttgtatattcacagtaattgtgtgtgtgtgtttgtgtgtgtgtgtgtgtgtgtatatatatatatatatatatatatatatatatatatatatatatgtgctgggattataggt

SEQ ID NO: 3161 - DNA, 1183 bp, Homo sapiens
ggtaaccaacagcctgaattaacgtttttacttttaagtcactgcaatgcacattaaaaatactttacaagatacttgcactttcataggtaatatgtggaatctgtttccaagtatcaagtcttctatacgatttcacacagtgtacataatagctgcaactcggcttttgtaatcagtggaatatatttcagatctgtccaggttgacacagtttggtcatctttgatttgttttatgactgcaccacatatttgatttgttttatgactgcaccacaattaattaaaatctcttcatgctgatacaaaatgaacataaatatgatgacataccaacatagatttgcttatgtggttgcctttattgatttgtactataaagaaattaaatagaagtatttcagataccccgagtatagctgtatacactgccatagctgaaaaactccagtgtatgcttttcagagaatgacattggaaagaagaaatggccaaagtatcatttggtaccttggcttccttacatagatgatgaactccaggaatgatcaaatcacagtttagaacccctttgttgggccctataaagggtttccaggtgtcaaatgatagtctccagataaagaaatgctctataatgcctcaccgctgtgttttcctgtattttgtgcttttctgaaaactttaaatacatgaatttttggtagaaatgaaaatctttctgttttatatatttgtttctgtccatggcactctgatctctttgaatctggtaaggatctagccttgtcttatttataccagcaagcagtgttgtcacttaatgctctcatttttcatgtaaatgactgacattttcccaagtcttcacaagtgatttctgaagatgttgctgcattgagcagagactatgtcattgtaattgcagaagttttaaaattaaatatgtttaataaaattttagagttctgtttatctggaacacataacacataatggtgtaatgtgtatttaaccataaattagcttcacaaaaagtttgtgtacataaaagtgtttatatccaaagaaattcttatttactgctcagtaatctcttgtgtagaagaaaatatgtaacatagtttgctgagtctttgataataaccctcatgtaaaataaagccgtaaagataaaatga

SEQ ID NO: 3162 - DNA, 1117 bp, Homo sapiens
gaaaactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgattgtctcgggtgtcagcttaacattccatagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgcactctgtaacatctttggttgtggtagtcctgttttcctaataactttgttactgtgctgtgaaagattacaaatttgaatatgtagtgtacgtgctattgagttgtgaactggtgggctgtatgtaacagctgaccaacatgtgaagatactggtacttgatagcctcttaaggaaaatttgcttccaaattttaagctggaaagtcactggaataactttaaaaaataattacaatacatggctttttagaatttcgttatgtatgttaagatttgtgtacaaattgaaatgtctgtacgatcctcaaccaatgaaatctcaattatgaaaaaaaaaaagtgtaacatatattatcctaacttctaatcttatggaaatcagacatagggtctgtgcccctcaaagctcaagtgtctcagcacagggccatacaactaacacccctacttatagggttagagatggccactgctacaggaaccagaatagcaggtttatctacatcattatcctactaccacaaactctcaaaggatttctcagacagtttgcaagaaataatgaaatctatccttactctacaatcc

SEQ ID NO: 3163 - DNA, 1176 bp, Homo sapiens
ggaatcacggagagcgaaggccactccgtgcggcgggcgccgcgaggtcccggctcgggacggtacccgaccgcccaactttgcgccggagccccggccgcggcccttcctcccggcccagccctcccggcctccgcgagagcggggtgacagccccgccgcagggacgccgccgggggacacccaccttccttctcggcccgcgccgcagccactacgagggtcatcaccaggtgcagcgcgcctaggaggccggcggccgcgctccgcgggcccccgctacgggcggccgcaggttccagcccggccccggcggacgtggagacggcggcggtggtggctccggttgctcctcctcccgcccgcttccccatccctgccggccgggggccgccgcgctcgaggtccggcgcggcccttctcggcgaggcggcggcggcgcggaagccgtggtccgggctctggccgcggcgccgggagcgacaacggttgcgagcccggggctcgatctccgagcgtgggcctgggtccgtgcgtgcgtgtgagcgagagtgtcagtcacggtctttgcctgggcatcgcctacaagcagtcggagcggagaggccgcgggtcaggcgcggcgggcggccatactggaaacgggcacggcccgcgagccctgagcgctggcctgcgaggggcggggcgcggctctgggcaccgcccacgctgtgccgacacctgggctgtccggcggtcagtctgtccgccccggagccccctgggccccacctcctcgtcccgctctcggaggcctgcggcttcacggccagacagaaccaggacagaacaaccccagcccgttaccgctacctggcgcaggagaaggagggaggcaggcccaggtccagctgccaggacttatgatggcggcttctgcttcgcggaggcggtgtcggcaatcacgtggagacggggcggcctcgccgcgcagccgccgcgttgcgtgggcggggcaggggcggagttgcggggcgctaacctcttctccggcgcctgggcaatcctccgtgctctgtcctacagtggtagagccttccaggggtgtgagtgcgcatacagaccgcgagacgagcgcggaaggtccgttccagtgactcttcctggtggcacccccacctctcgaccgctttg

SEQ ID NO: 3164 - DNA, 1163 bp, Homo sapiens
gccattctactgggtatgaagtggtatctacttgagattttgactttcatttctctaacgactaatgatgtctgagcatgttttcatgtgcttattggccatttgtatgtctttagagaaatgtctattcaagtccttagtccagttttcagttcggttctttttattgttgtaacagttttttgtatgttgtagatacaagtcacctaaagataagtgattcacagattctcccaatttgtggtttgtctcttcactttcttgatggtatcctttgaagtataatttctaattttggtgaattacaatttatttttttcttttggtgtatctaagaaaccattgcctaatctaagcttaatggaaatttattgttttatcttcatttaagagttttacatttttacctcttacatgtgagtctgattcattttaaaaataatttttcaggcttttatttgcaatatatttttaaaattttaaatgtaagatacatataaaatttactatcttaaccatttttaagtgtacagttcaacagtgttgagtgcactcacaattatgcaaccaatctccagaactccccttcacccccaccacccctccaactctccaccttgacagtcaccattctactttatgtctacagtaagtgcctcgtgtggaatcataccacatttgtctttgactggcatatttcacttagcatatgttctcaaggttcatccatgttgtagtatgtatcaaaatttccttccttttttaaggccaaataatattcagttgtatgtatatagcacattttgtttacctatctgtcagtggacacttgggttgcttgtgcctttgggtaactgtgaataatgctgctgtgaatatgggtatacagatacctctgtgaccctgctttcagttcttgtgggtatatacccataagtggaattgctggagcacacagttattctaattttttcaggatcagccgtactgttttccacagcagccatactagtctacagtaacagcacacaaggatttcaacttttccacattcttgcctatacttgttattttttatttttttttaaatagtggccatcctaataggtgtgaagtatctcagtgtggttttaatttgcatcttcctaatgattagtggtgaa

SEQ ID NO: 3165 - DNA, 1295 bp, Homo sapiens
atatgattttctaaccaagatgaggggttggcgtgtgaatccgtcttcagttcagcaggtttagatatttattgcattcagagcagtttctcttaagtaatgttttaagtataagaaagatgtaaaaagtgcacaaatcataagtgtacagctctatgagttgtcacaaaggggcacacctgtgtaacaaactccagaagtacaacatttcagcatttacctgtctttcctgtattttggtgcacatattggtacacaactatttcagttgtcgggtcagcagctttttaaaaaggagtctttctcatggtgcatctctgaaggacccagacaagtgatgagaatcagtagtgttactcatgcattcatggaggtgtgaacacagtgctatgatagcactggggtaaaaacagcacattcagatgagggattctggaaaggattctcacaagaagcggtgttggagttggtctgaaaagaagataggaatttaatgggggagaaaggtattcgctgtgttaatagggaaggtggatgttggattgaaccaaggagtgggcacgtgtagtgtttggtctgatgaatacaggtccagatgcacgaaggatggagaagagtggaggagactgagggaatgaggaggggacagggactgttagagctgggagcagggatggtagcagtaaaggtgacgagagatctgaagggctcggcaggaatttctggtgaagagtgtcattatgttactactttatcctaaattttacttgctataaaatatcctgctgtgtgtggtgactcatgcccataatcccaacactttgggaagttgaggcaggaggatcccttgaaatgagcctgggcaacaaagtaagactccatctctacaaaaaatgtaaaaattagccgagtgtgatggcttttgtctgtggtcccagctactgaggaagctgaggcaggaggattgcttgaggactgggaggttgaggctgcagtgagccatgattgaggctaacgtggtacttatgcacgtgtgaacacatgtctttttttctcttgtaagttacttaagtggttagctgattttttttttgaacttcaaacacctcaatcaatataaaaacaagcacaaatattgtaaaactaccatatttatatttaaacttattattaattagcaatactatgggctttttcattaatttcttcatctctaaaccttcctaaagttaatagtaattctcatttttatacctttctgggattttagaaatctcatcaagctggaaaataaa

SEQ ID NO: 3166 - DNA, 1169 bp, Homo sapiens
tcgagaccagcctggccaacatggagaaaccccatctctactaaaaataaaaaaaattagcctggtgtggtggcacacgcctataatcccagctactcaggaggctgaggcaggagaattgcttgaaccctggaggcagaggttgcggtgagctgagatcacgccagttcactccagcctgggcaacagagtgagactctgtctcaaaaaaacagcttaagtttcagggctccggggttgagtgtcctcttctaaggccctctacttaatttcaaacccataattttgcttttttctttaaagatagcattatagcttttaagggcccagataacctgcctctgcccctgggaaggcgttatgcgggtgcttgtgatgtttttactcctttcatataaatctgtcatagtgagaacacatgttggagatggcatgtgtcaacatgattcaaaaacaatggcacaggtacctctgctaataaatatatttcaaatggattattcataacaccttaaaaggacttggattgaaacctattgcctttctttacaagattcagatctgttagaaatctgtgtggagtcagtccccatggcacaggcctgtagttcagctgctcaggagactgactgaaggattgcttggtcccaggagtttgaggctgcagtgagctatgatctcgcctgtgaatagccactgtactccagcctggacagcacagtgagaccacatctataaaatttaaaaaaaaaatctgtctagaatataagaaaaagaaagaattgataaatcagtgcttttatttctaggcaacatgtctgtcctcctcctaggttttaagcctaaaaataaatttttaaaggtttaaagcatacagctacatcattatttttatggcagtcaaattaattcttccgtccaccacttgaagccaatggagattgacggtcctgttttcttactttaatgatgtaaacctcattgaaaatgaagattctggaggataaaaaatggtgctgtgactgctattgattaagtgtcttgttgccgtcattgttcatccctccttggcctcttgggcagaaggaggcccaagaataacattgctgacatttccttgaaaagatgcagtgcttgacaaagacagctgcatgcttaaaaaaaaaaag

SEQ ID NO: 3167 - DNA, 1465 bp, Homo sapiens
cagctattttcctgcctcagcctcccaagtagctgggattacaggcagccgccaccacgcctggctcttagttttgcatttttagtagagaggggttttaccatgttggccagggtgatctcgaactcctgacctcagatgatgcacccacctcagcctcccaaagtgctggggttacaggggcaagccaccatgccgtttcttcatattttaatgtaacagaaaaatcacgtaacaaagtttctggtgatagacaaaagactaacacatttggaccatttggacccagatatctgcttaggattaaccggttgggtatcaatggtggctaccttaacatgtcttcaaacaagcatccctcctgtggtaacagcatttaatgttcacctgggggttatgtttcattttccagggaactgtaagttctaggttggtcagagtagagcaaaggacagcattagaagcaggcatatgagatatgtgaatacagctagtggctgcttggttgaaaggaggcattgacttcagcaacacaattatgtttttattaggaatgtgccataccgaatccgtgtgcggctgtccagaaaacgtaatgaggatgaagattcaccaaataagctatatactttggttacctatgtacctgttaccactttcaaaagtaagttctccatcccataaagccatttaaattcattagaaaaatgtccttacctcttaaaatgtgaattcatctgttaagctaggggtgacacacgtcattgtaccctttttaaattgttggtgtgggaagatgctaaagaatgcaaaactgatccatatctgggatgtaaaaaggttgtggaaaatagaatgcccagacccgtctacaaaaggtttttagagttgaaatatgaaatgtgatgtgggtatggaaattgactgttacttcctttacagatctacagacagtcaatgtggatgagaactaatcgctgatcgtcagatcaaataaagttataaaattgccttcatgtttttgttctttttagttgcaacataatgtacttgtataccctatcctaattatgggatcatttgaagagcttttcccaaattgatggcctgtgctgccttctccccatcccctggggttttaaagtgatttcaaactgcaacctagttttagaaccactgttctgggtagttgggatactgaaggcatattgttaattattctacttgtatgttttgctaattctaagataagcatttttccagaaaccaggatgtagaatccagttgccattgacatcttaacattttaggaaacaactttaaaatgatatactatctatctatctatctgtagcatcttaaaggtaatgaaattaatgtggcagtaggtcttttaagcttctgcctacatccatattgagtatagttgttgtcttctaaaataattaattgatttttggtgaga

SEQ ID NO: 3168 - DNA, 1172 bp, Homo sapiens
cttaaccaactgcaaattggaattattcaaaaggtttctccttttaactcaacttcttgacagaactcatcctttagacagcagatgtacttggttatgtataagacctcagaaggaaacttctattccttcacagaaagctgaacacaaagactggagcagcttcaattttattaatcaacattttaaggacatcctttaatgtggattcaggctggcaggcaaacatttcagagagcctatctgtgaataaaatagcatattccctgaatctcagagttcgcagaaggaactcatgatgtgaggggtcctcataggtttgctcagtatacaaacttacagaaaaacctccaaattgtctcatttgtgtgtgtccattttcaatataactttctcagcagtttgttatgtttctttccaaggaaaataaagttctcccaggaagttctcctctgaaagtccaattagtataattaactaagcaaaatggccaatatccgtaggtttatcaatctgcagtgaaaactgttgatgtcctaatcttctggaatgctcttcgtctgtgtgttacctgacatggtaccaaatcatctgtaatatttctgtgctagtttctgtgctaaacagtgttacagtcgccaagagcccataaagggagccctcctggaagtggatgaggccttgggtctcggctcttcattgcttcctgagctgcagcagatgcctttacaaccaagctcaccgaggacgtctgtctcccatattaccctggcagagggccaggcctgttctacacggccggggtttcaacaaggtactgatgtcttctgcccttgcctcttcgacaggcaagtaataagacttaagtgaagagaattctttaggcacacaaattcacatttgatgtaatctcattatacttcctgatctgtgattgaaaactttcatttcgtaactagtatgtctgtcccacctttaaaaagtttttcattatgaaagtaagtatttgttagaattaagtctatttaaatgaaaaaaacttagatatgagtctgcatggcctcaggaaaatgatgttttaaaatagagattttaggttgtctgcactctagcttttttgtcgttttcttaaggcttttttaactgcatcaaaaattcagatacgaaacata

SEQ ID NO: 3169 - DNA, 1174 bp, Homo sapiens
taggacacccctgtactgtcttgtctggggtaaatgctggtaggaaactaactccactcagtatgtttctcagcttagatgtatttagtattttgttagaaataatactgtcaggattcaaaaaatatctatttccagaaggactatacagattaaaagtcatttcaaatcccagcactttgggaggccaaggtgggcggatcacatggtcaggagatcgagaccatcctagctaacacggtgaaaccccgtctctactaaaaatacaaaaaatttgccgggtgtggtggcgggcgcctgtagtcccagctactcgagaggctgaggcaggagaatggcgtgaacccgggaggcggagcttgcagtgagccgagatcatgccactgcactccagcttgggcgagagtgcgagactccgtctcaaaaacgtggtggctcacgcctgtaatcccagcactttgggaggctggggtgggcggatcattggaggtcaggagttcgactccagcctgaccaacatggtgaaactccgtctctactaaaaatacaaaaattagctgggcgtggtggcacacgcctgtaatcccagctacttgggaggctgaggcagtagaatcacttgaacctgggaggcggaggttgtgatgagccgagatcgcgccattgcactccagcctgggcgacaaaagccaaactgtctcaaaaaaaaaaaaaaaaaaaagaattagcctagtgatgaatggtttagaaagcttctgggctttcttgcttgaaaaacagtgtttgcttgacagaaacactttaaaaaggcgtaaagagcattgcgcagcctcagatggagatgtaggtattttacccaccatgggagcatagagagttaaatgggttctgagtatctgttatattgctgttttgttattataattaaaaataaatgtgaaacgtaagcaaggcattaagattgcttacagaatgtatagctcgtgatcattcatcatcaaggattcagccatggcaagggtttggctggagtgaagggtcagactagatcttcgtaaatccagtgtcccaaaattgtatgtatgcacaagtgtgcatactcgtgtgtttttattttaacctgtagcttcctttagatttttgaggtaaaggaaggctttgatgctcacttagg

SEQ ID NO: 3170 - DNA, 1174 bp, Homo sapiens
gttggccaggctggtctcaaattcctaacctcaagtgatctacataccttggcctcacaaagtgctgggattataggcgtaagccaccatgcctaaaagttattttttgaatagctaatatgtgcacatggtacagaattcttactgtgcaaataagaccccccagcctgtcctgcatcccgaagcgcctctccccagaaacagtcatggtctccagtctctggggtaaccttccagagggtagtatgtgttgatgggagcatataggtctttgggttttcgttgttttttgttttttggggtttttttgtttgtttgtttttaaggactgcatgctgtccacacagtttacatgttgtgtgttttctatcttgagtactgtcagtacttacagagctgctacttcagccttcatacacatactgtaatttatataccttttttcctttcgatggacgtttagattgtgatagcaaaaacttaggaaagaacattggcaataaatcttttttatttatttaattttattattattatttttgagacagtgtcttgctctgttgcccaggctggagtacagtagcgtgatctcagctcactgcaacctctgcctcctaggctcaggtgatcctcctgcctcagcctccctagtagctgggactacagacatgcaccaccacacccagctaatttttgtatttcttttaagtagagatagggttttgccatgatggccaagctggtctcaaactcctgatccatccgccttggccccccaaagtgttgggattacaggtgtgagccaccgtgcctggccaacagtaaatctttatagatacctcattggttacatctgtgcaattaagttcctgggcacagaattgctgggccaaagagatatggacttttagaattttttgaatgccattgcctttcgtagaagagtgtaataatttattcacccccttgtccagcagtgtgcgagagtgctcattcgtgcctatttttgccagtatagtgtatcagactttttgatctttgccaatcttacaggaaatgttttcatttgttaccaaggaagacttttcatgtgtttaaaatcccttttgcagggagagagtgactgccagtggacacagggtttctttctagggtaatgaaaacattatggaat

SEQ ID NO: 3171 - DNA, 1197 bp, Homo sapiens
caaatacttagcatagtgccaggcacatagtagtaagcatttgctcagtagcagtttctgaaatacttatattaataataatggtcctggttattcttgttgacgtcagttcctcttttcctgatgtgtgcttctttttttccttttttaaattctttgtctgtctttgctgtatttctatttccctttatttctttctcttaatgtatttttcttctgacttaagggtcctgcataaccctgttaatgatatccacgaataaagaattttctgtcccctaattgctgtggtgcagtgagcagtggggaataattgttatcaaaatgaaactaaaccctataaggattcacagagtcacaatacttttgaccagcattcatgaagaagcccttacttatgggtccgaggggcagtgtggaaataattggccagtagatatggggcccatgaacctcacctcattagtgtccacctggcactgactgatcagcacactataacatcatgagaaagatggcgggaagatccctggtaattatacatttttacttacgtagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggttagttcacagataacatagcaggcatacacttgtgaagtttgttactttgcagagctgggggatttttagaaagtatacacacatgtgatgcatacacacatgtacacacatacacatatacttagaacttcagatgtatgaacgtggtgaaacacagttggaatgacaccaataaattcagtctcttgtcttaaaaagggtttataaatcattacactttaggaacctgttgaaaccagttaagtggtctctaaatagtataatacctgaaagatgtctgcatgtatcttctcaggcttggcttaaatgctgtagaccccaaatatatgggtgataattaacttttaaaaaaaaaatgaaattaaaaaccaacagtaagaaatttcttaggagaaatatttgaatatccagtggctaagtgaatactgtaatatatatcagcatgtaattctgtatatacacagcacattaaaa

SEQ ID NO: 3172 - DNA, 1336 bp, Homo sapiens
ttccttctgattctcttcccccctctcgtccctccctcccttttatctcccctttcttccccccgcccagacctattgcgaacgcccagagccgccgagggaacgccaacgtctgggccggacactaagagttaagatgtggcggagggggcggcgggggaggggcggggaggggaaagtggtgagggggagggaggctggaggacgacagatttccagcttctacgacgctctgcctaaattaaaaagcaaccaatcggaacggccggaaggggggcctcgcgtcctgagccagtcattccgagcctgccaatcacccagcgggtagccaatcagcgggggccctggtgctcgacttccttgtatttgggaaagtgtggtggtgggtgcgcgctcgcggcggagggtaaacattcgacagtccccgctctgagagggagggacagagagcgaactgtcagatcggagcgagagcgggcgcccgagagagggagagagagagagggagggagaggaaaagtgagagagggaaagagagcgcgaacgagggcgcagagcgagctcctgctgcaactctgctccagcacggccagcgccagcgcccgccgtcggtgcactctacgagccgtgcagcgtgcccactggagttgttgtgtatcaaggatcgatcccctatatgcacacacacacctccacctccaccaatgcactcttcttcctcctccttctccagacaactgctgggaaaaaaataaaacaccaaccccaaccgtcagcaacaaggtaacagagcgattcgacatcattttttttcctgttcaattttttccttgttatatttgtttcctaatttctgcccaaaaggaaagatgtcgcatcagactgtgactgttgcgaggagaatgaaaaaggactcttgtttcagaggcaaccaagagctccggcaatagcaacttcagagaaatgcaccatcgcaagaagttttcctaggacagaacaaaacttgaaacgagaggaccagagggggagagcaggagccagcctcccctctccgcactcgcgagcagccagcagcaccacgccttcaaggacgaaaaagttttactactctaagggaaaacgagtgaaatgtgttcctgaggaggagaggagaggagaggagagagcggacaagagaaggagcgggccggttgctggtcatccgtaatttggctaaggaagaaaggagcagcttctttctttgttatctcccgtgaaaccttcacttagcaggtggacggagccccgcgaccgggcagagtccgggctcgcccgaggacaggaggaggagcgggag

SEQ ID NO: 3173 - DNA, 1179 bp, Homo sapiens
gtttaaggaaaactgactgaaaagcgtgagttgcaaatagcatcctgagaaagctgctaagcaatacatatttcataccactcctgaacgtggtcagatataaatagcagcacagacatttaagagctattctcgctgaaaaaaaaagtaattaattggtgttatacacaaaggacttctctatttatttatttattttttgggtaaccagcacagctttaattacaagtaattgttctcaaaatcaggcggctcgtaagttctgcattctagacagtgattatgcatcaataccctaatctatcactttcattattttagtcatttgggtatgtaaatttgtatttaattcagacaacaaactccgcagttcccactgttactttctatgaacatacgcctttttaaggcacaatagggttggatgatttagatttacattcatttacttttacctaggaaaataatggtacattcttgtgggttttgctgacttctaggtaaatacagtggcattagatgtacaaggaggcaggtttgtccctagttaattaggaattttagtaggtgtctctatagaactgcatttgttactgcatcataatgagctggagtttgcagaaattcccctgcagaaatctcctagtgaagtaataggagcctattctttacctcattcagaatttgtacatttcttctctcccaagttagacactagaaatgtcgcctggattactcaactccagtacactgtttactctctgcccgggctttgtatatctgagtaaatttcaaaacaaaactcaaaagccttcccaggacatctgatgggaacacattcgctccaccttgtctttgtggatgacaccactattttgtttctgatctcctatacaggcagatattctttatttcctatgaaatatgtgtccttgaatgcaaaacaaatggtgaatgccctttgttccctttctaacttgctttttggtgtgatggtctaattgctatgccacagagttttaaatgaaaaaaaatttgaattaaaaattctatccatacttacaaaaaacaaaacaataaaatgatacctttggtaatcacttatttggttgaataactctcataaaacacacacacccacaaatgttttaaactactcaaatataaaattttgtggag

SEQ ID NO: 3174 - DNA, 1169 bp, Homo sapiens
atttaatttgttttataattttataaaatatttacatagctcaaaagtcaaatcagtaaaacaaagtatattcaaagaagtctaaactcagtttctctccttcactctgttcactgcctccccccttttactgtctggtctgttttatttgcatatattctttctctctctctctccctccttctccctctccccctcccacctttctacccgcctcgttctttctttcccttcccactgtccctctgtgtctctctctctgcctcccttcttctctgccttttgatgtgaatgtttgtgttgtattttttgttttaatgattaccttgatattattcatcttataaaattcctttatgttctcttttttgggagggtttctattgtctgttgcttccccacttggagctgtgtttgaaattagccagtaacatcttcgtcactcttcccctgtgttcctcagcatctgctttggaggaatagccctcaattcccagctgatacccggaaggcagtcagcaagcatcttgtcttttttgtataatctctcattcttccctattttttgatggttatattgtctgtactttttcagagcatcgagccttccacatgctatttggtttcttagttctgtggacaaatatgtgtggaatgctcaccattgaattttctgttgatgtctttccagtcattttggttttctaaagcagtcctatggtagatatttcacaatgggaatatggggacactgtctcttgagtttgtgcttgttgatgacagtgacagttcattgcagcctttatacttgagggccagtttggctggagacaaaatcctccactcatctttcagtgaggaacttaaatatgttctaccatgatagaattgcagtgaaaaatctgatgacaatctggatttctttcccttgtagtgacttgatctttttgcttagaggctcaaagcatacaaatttcttttatgtcaaatttctccatgttggcacacatggcaaactggagcctgcaaaatcacctcccacttcccactgtatgcccacccattccctccgcacccggcccaggcaatccccacttccacttctgtctctatgaatttgactactctaggaatctcacataagtgaagtcatacaatatttgtccttc

SEQ ID NO: 3175 - DNA, 1240 bp, Homo sapiens
accctcatttatatagatgaggaaactgattctcagagggtaaattgcccagggccacacagtaggtggcagagctgttagagtttcaaatttgagtctgtaaaacccaaaccctactctttccagtgtatcatgctgctgttgtcgtaaaatgccaacataaaatttaccatcttaaacatttttttttttgagatggagtttcgctcttgtcacccaggctggagtgcagtggcatgatctcagcttactgcaacctctgcctcctgggttcaagcgattctcctgcctcggcctcccgagtagctgggattacagatgcccagcaccatgcccagctaatttttgtatttttagtagagatggggtttcgccatgttggccaggctggtctcaaactcctgacctcaggtgatgctcccgcctcagccttccaacgtgctgggattacaggtgtgagctactgcacctggcccatcgtaacactttttaagtgtgtagttcagtggtgttaagtatgtttatattgttgtgaaatagctctccagaactttttcatcttgcagaactgaaactctatatccattgaatagcaactcctgctttatccccagctcctggcaaccactgttctactttcaatgtctataaatttgaatacagcagattctcaaataatgttgttttattcaacatgattttgttataatgttgatgagaacaaaaaattgattcccagttgggaccagtgtctgtgtggggtttacgtgtttctcccatgtctgcttgggttttctcctggtactacagtttcctcccgcatcccaaagatgtacatgttaggttaattgatgttaaaatcgtcgcagtgtgagtgggtgtggctgtatgccctgtgacgggatggagtctcgtccagggttggttcccatcttgctccctgagctgctgggataggctccagccacctgcaaccctgaactagaataagcagggtggaaaatgaatgaataaatggacacacattattgtaaaataaaaatttgtaaagtatatgatcatcatacaataaatgatgatcaataaaacacgacagtaaacgatgtggtacaaaagcactcaatgaagatgccctgttttccttttctttgcttgttttttgttttttgagatggagtctcgctctgtcatccaggctggagtgcaatgtcgtgatcttggcttactacaacctctgctt

SEQ ID NO: 3176 - DNA, 1138 bp, Homo sapiens
ttagatactttgaagcattctttaaagattttctttaataacttgaaggcactgttacacctttcctgtatcagattttttttttttggaattgaaatccatgagatttataactgtcatgcaaagtaattccatttctcctaaaatttaaggcttgctaaggtaaacagtttctgacatttgtttaatgaatgagagtattactgttgagaaggctttttctctcaagtatgagatagaactttttaaaaagcactcatagtggtttttaaaaatatttttaacatagagtcaaagactagggcttttgcaatagggagaggccagggtttcatccatctcatccagaagaggagaaattgataaaggagagaggggaatgaaatacagagtagtaatgggcggcttggtcttgagagttggggaaagacgagtttaagtaggtaaggtaaaatggaatttatatgtgatagcatcaggtttctcagtgaaggatgaatctaggttataagttgaaagtgagggtcaaaggaaggtatggggaagttgaggaaataggaggtgtgaagtgtcagagtggagaaagtgagtattagtactaaaatggtattttgttttaggcagcaccagtttgatggttgagataatgcaaatgaaatcagttagcttggggttatgatttcccaaatctaagcacacagaaaccagtttgggggttcttctgaggaaaagagggaattagttgaagggatctgtaagcaaacagtaattatggatataagggattatagcattttttgcctgacagaagaaagtgtgtatatttatatgtgtttacaggtgtttaaaacttgatgatgttattgtcttgaagggaacttgtcatgtggtggagaagtatatttctgaaagtaagggtatgtaggccctcagtgaggtagaagaataacaagggtggtatggtggtttcggtggtatgaccaaaatacagattttgaagacctgtgtcagtggcaagtggatggttgaggttcgagtggaggataacatcactggagatgaggtgattaaggaactgagtagtcagcctgggcaacacagcaagaccccatctctacagaacgttaaaaaaaaatta

SEQ ID NO: 3177 - DNA, 1047 bp, Homo sapiens
ttagagacagcaaacaagaatcatgagacagatggaggaagtgcccatggggatgatgatgatgacggtcctcactttgagcctgtagtacctcttcctgataagattgaagtaaaaactggtgaggaagatgaagaagaattcttttgcaaccgcgcgaaattgtttcgtttcgatgtagaatccaaagaatggaaagaacgtgggattggcaatgtaaaaatactgaggcataaaacatctggtaaaattcgccttctaatgagacgagagcaagtattgaaaatctgtgcaaatcattacatcagtccagatatgaaattgacaccaaatgctggatcagacagatcttttgtatggcatgcccttgattatgcagatgagttgccaaaaccagaacaacttgctattaggttcaaaactcctgaggaagcagcactttttaaatgcaagtttgaagaagcccagagcattttaaaagccccaggaacaaatgtagccatggcgtcaaatcaggctgtcagaattgtaaaagaacccacaagtcatgataacaaggatatttgcaaatctgatgctggaaacctgaattttgaatttcaggttgcaaagaaagaagggtcttggtggcattgtaacagctgctcattaaagaatgcttcaactgctaagaaatgtgtatcatgccaaaatctaaacccaagcaataaagagctcgttggcccaccattagctgaaactgtttttactcctaaaaccagcccagagaatgttcaagatcgatttgcattggtgactccaaagaaagaaggtcactgggattgtagtatttgtttagtaagaaatgaacctactgtatctaggtgcattgcgtgtcagaatacaaaatctgctaacaaaagtggatcttcatttgttcatcaagcttcatttaaatttggccagggagatcttcctaaacctattaacagtgatttcagatctgttttttctacaaaggaaggacagtgggattgcagtgcatgtttggtacaaaatgaggggagc

SEQ ID NO: 3178 - DNA, 1178 bp, Homo sapiens
gatcagaagaccgagattgttaaatgcagtcaaaacaaaaatccatttgctctaagactttttctgtaaccttcaacctagccagcaaattattttctttcagaagtcccccgccccttttttaaaggtaaagcagatattcctggtcctgttttgacttactaaagattaatgtgctttaatgaactggatgttttactattacagtgcatttaggtcattttactagagaaatgtggttggtgttagaatatgaaatgtttaccttgggcgagcctactagacatattttggaagaaaggttctgaaatagggatttgtccctctgctataagacatgagagacattcaaacttcagaattattattttttttagttttaaaaataagcaatgcgtttatatgactaaaagaagatttagaacagtatttaccgagaactcctgtacctgactactgtcccactctgtcacatgtaaccgtttttctagtttctttttggaaatataaatatttacattattataatatattaaatgtctgcacgtttgtatacattttttgcctttaccacacataaaatataacagtatatatatacgctgctcttttgcctaacaatatccctggagatctctaccaatacataaagttctttcttattctttttttacagctgtgtaatacttcatgtaccctaattgatctaagcagtcaacacaggttgttgacaatctgtttcaaatagtggcacggtgaaaaatcttgtacataacattttgcggatacacatgtgtatgtgtcttctagatctgcagaagcggtttgttggatcaaaagcaaatcagtccagttttggtagataattcccttggcaggaattgagcacatgcccacctacaagcaagatgcgacagagagcctgtttcttattgctgcacctacacaatcttttcacatgttttttagttttgccaatctgatgagtgaagaattgtttctcagcgaagtgaatttctgttatgagagactgaacatttttcatgtttgtgagccatgtatctttttctgtgaaataatttattatgccctttgctcattaaaaaaaaataggttaatagtttttttctcagcttctaaaagctcattgtttttccagtttatcatttctcttttga

SEQ ID NO: 3179 - DNA, 1149 bp, Homo sapiens
ggctgcagtgagccatgactgcaccactgcattgcagcctgggcgacagagagaccctgtctcaaaagtaaaaaatgtaagcagctagcctgtgctcaggtgggtgggagatgccatgagagtgttaaagttcattactgccagagagacccgtatgacaagctgagtaagcaggatcctatgatgtggcgacccagaagttcagagcctcctgaggcaggaaggagtcagagaaggcatcttagacatggggggtctggagctggggtgcaagaaaagagggttccgctgcaccaaaggttggtggggagagtcttccaaaagaggtgcagcgtcctgtgggctctcaccctgtcccgggctctgcaggtctgggagatgcccagaggaacagaagctcctgagaacctgctctccggaacttctgcttctctcgggagaaggctggttgtagcatgagcgtcatggagtcattaaggaggaaggaaggtaagagaggaccttctgtggaaggccttacgtgtcagggaaagtcactcggactcaattctcttgtgctgagggttcttctgaagatcctctttcatgatgtcaagaccctttcgtggttcccatctacatcttgaagaaattgagtgatttttcaaaatgtttaagagaaagtcccgtacctgcaagggacgatgtcaacacaccaaagttgttctttacttagaagctaggcctttgccattgcctgatggttacgacaggcatgattgcatgattccatcttgttcatcagtctctgcagccgataagtgcttatcaggtgctgcctacctggccaggctctgtatgaggccatgggttcacagtggggagcaaagagagacacaggccctacctttcgtggggagagactgtgagcagacagataccaggcagatgtcaattacaagcgaggacaagtgcttcaatggagaacaaaggatgttgaaaggtaacgtaactgagccaagggcccacgatgggaagtgatgttggaactgagatctgaaggccaaacgcaagttagatgggctaagggcggaataaggcagggatccgcaccttccctcaccaaatcaacagtggtgtgcccagtctcacccactgtcctttcctatc

SEQ ID NO: 3180 - DNA, 1090 bp, Homo sapiens
cttaggaacttatttcctttttaaaaaatattttttaaatttttaaaatttgattttaaatttcaaataaatttaaataaattttaaataaattttaaataaaattttacagagacgtggtctcactgtgttgcccaggctggattgcagtggctattcgcagttgtaatcatagcacactgcagcctcgaatttctgggcttgagcagtcctcccgtctcagcctcctgagtagctgagactacaggtgcacaccaccaagcctggctttatgtatttatttctgttcatgcggaatgattggttcagaactgttcctttcccttccatgatgtccttgacacagaaggttatgcctggctcccagtcaggcttcatacttttggtccatgtaagtgctacccgttgctgggggaggagtcatggtttatttggaaatgtcagttgcaatcatggttctgtcatttgactgcacagtatcagaggagcctgttaacctctctgtgccttagtttcttagcccatgaaagagatcattgcctgacccagggactacctcaagggcttttgatgaggacaagtgacagtaggaagatgcaagagcctttagtaccaaggttctcaacactgactacatgctggaatgactgtgaagcttttaaaaaatgttagtgcccactcttcccctgtacccccggacagttaaatcagaacctcagacagcaatatgccttgagatgccttgaaccatgcttgagaaggaaggacaaacacattattatcttggaagaattgcataaggcttatgacttaaaaaaaaaaattctttttggaaacacaagcatttctttaaggatgaccggatgttgccgtatgtatttatggcacaagcaggtgttgtctaagcagtttctctgtttgcttgtcatagcagcatttggaaactcaaacatgctttcatttacataaatagtttatgaagctttgacaacaaatgtaaacagacacgaaattataaatctgctaaatatgtattaagggtattaattattgaaagtccctttccccaaaactcaactcctatggcaat

SEQ ID NO: 3181 - DNA, 1158 bp, Homo sapiens
gattggattttcaaattgccttcattttcccagcttaacctgttgtaaaccagctttcttggactttgtcttgtccaggggtctggggctccttgtccaaacagtctcaggtgtctgtttgccagaataccactggcacttcaataacctgtttccttggtctgcttctcttctaggtgggctctgttgtgtctgttggctggctccggtccaagaaggctgttgactggcgtctctttcgtaacatttttatggcctggtttgtcacagtccccatttctggagttatcagtgctgccatcatggcaatcttcagatatgtcatcctcagaatgtgaagctgtttgagattaaaatttgtgtcaatgtttgggaccatcttaggtattcctgctcccctgaagaatgattacagtgttaacagaagactgacaagagtctttttatttgggagccagaggagggaagtgttacttgtgctataactgcttttgtgctaaatatgaattgtctcaaaattagctgtgtaaaatagcccgggttccactggctcctgctgaggtcccctttccttctgggctgtgaattcctgtacatatttctctactttttgtatcaggcttcaattccattatgttttaatgttgtctctgaagatgacttgtgatttttttttcttttttttaaaccatgaagagccgtttgacagagcatgctctgcgttgttggtttcaccagcttctgccctcacatgcacagggatttaacaacaaaaatataactacaacttcccttgtagtctcttatataagtagagtccttggtactctgccctcctgtcagtagtggcaggatctattggcatattcgggagcttcttagagggatgaggttctttgaacacagtgaaaatttaaattagtaacttttttgcaagcagtttattgactgttattgctaagaagaagtaagaaagaaaaagcctgttggcaatcttggttatttctttaagatttctggcagtgtgggatggatgaatgaagtggaatgtgaactttgggcaagttaagtgggacagccttccatgttcatttgtctacctcttaactgaataaaaaagcctacagtttttagaaaatttgttctcatggttttctt

SEQ ID NO: 3182 - DNA, 1190 bp, Homo sapiens
caaaaaagagaaaaaccttacattatgttctactagttaagttttcaaggacagtgttcactagtctaccatagaccctagaagagttacccaacacatagtagcactcaaatatttgttgaatgaattataaaaatgactacttgtactgttaattttgtgtattctagtgaattaaatctcttcggcatcatttactcccttaggtatttgactttgtgtcaaatgttttggcaaggataaaattataacagactttcttgaacaaccaaaatataatctattaaggattttccttcacttttgataaaataagaaaaaaggaaattaaaaccttgcatcctaatgtaaaatagaattatatggtgtttaatatcagtgtccctttagctattatattaaactactatagttaataaattttatcattattttgtatgttggtttttaaaaatttcataaagctataaaaagatacttggtcagataaagtttcctctgcttttaattttaataaagtattattatgtatatgatttctttttacctattatatatatgcatctattgttttctcactggtaaatatgggacggacattttgttagaaggttagaagtgagttaaattttcacattcctaagggtacttttgtcttgggttgttgaatatattttaaagtgtttataataatcacttcaaaatatttaggtaattaactgtaaatgatgttttggtattctccagggacaatggccttagagctattgagaatttgatgcaaaagaaggggaaatttgattacatactgttagagaccactggattggcagacccaggtaagaagtgaggttgttaataaccagaatatagttctgtgatatactgtaaatagatgtattagaggaatatctaacatgaggattaaagcttttgttagtattaaaccaaaaactttttttggtttaaaagaggaaaagtactcggttgtcattttctttggcagttgaatgaatgaacggagtatttcttggtacttttaagctgttaatagaatttgaagttttattgattgacttaggattatttgtaagaacagaagttgttaaaaataaggacatgtaggaagagcagagacgttctacctctaagtacagttgtcccttggcatccatggggtattagttccg

SEQ ID NO: 3183 - DNA, 1189 bp, Homo sapiens
aggggctgcatgcatgttcaacaaccggatcttgtaagaattcactcactaccacaagaacagcaccaacaagatggtgctaaaccatttctgagaaaaatccgcccccatgacccaatcacctcccaccagtcctgacttccaacattggggattacagttcaacatgagatttgggtggggacacagatccaaactatatcaatatcaaactgtaatcttccccagagtcgcatcccctgtatctaaatactacttggcatctgtacttgggtgtctaattagcatctcataccaaactgtatattatgatcatctttcagtgtaaatgaatatacatttagaatcctgttgctctttcctctgcctcatactctctccccctatcctttgccttcatttcctgcccctattcctagaccagcccccagtacattaggtcccttgatgatttcataacacctaatagttttctctctgagtaattatcccacttatagtcaattagtcagattatgtcttttacgtcaaacttccttctttggcctctatgatccctgaagccagaaatttgctgcattgtttactgtatcctcaaggctcaacacagtactttacacatatttggagctcaatacatttttttgttttataagaaagaataaagaggcctgtgaggtagctcatgcctgtaatcccagcactttgggaggcccaggtgggtggatcatttgaggtcagggatttgtgaccagactggccaacatggtgaaaccctgtctgtactaaaaatacaaaaattagccagttgtggtggtgcatacctctaatcccagctacttgggaagctgaggcaggagaattgcttgaacccgggaggtggaggctgcaatgagctgagatcacgccactgcagtctagcctaggtgacagagtgaaactctgtctcagaaaaaaaaaaaaaaaaaaaaaaaaaagaataaagaaatggatactctctacataacttttaacagttacatagcattggtttagggatatactataatttagtaaataaatttgtctctttgtatatctaggttgttttctatttttcactattataatcacttctacaatgaacatccatgtagctaaatctttggctcatatttactcatgtgcttaagtaaatcactagaaatag

SEQ ID NO: 3184 - DNA, 1208 bp, Homo sapiens
gtatactctcacagcgttatatgaaagtttccatttacccagatttttgccagctcatagtatatgtatgactttacatgtttgctattctgatagttataaaatggtatatatcatcataattttgagttttctctgatttcagtgtcttcaatctgaatctgttagagaccagtattagtggtttctaaaaggccttttgtttttgaactgaaaactttgtttaaccttttattgtgatatttgtcagtagtgatatgatctctattatatatccaacttatttttcagtttgctaatccagactttacacaacctatctcagaagttgtagatgaagtaattcagaattgtcctattgatgtcagacgtcctctctacaaggtatttatagcaaaattgttattcaaggtcttactttaaaaaaacttaaacacctctcataaaaaggatataatagcatttcagtactatatattatatctttaaacttttctctttttaaatattatatttattttctctccactagaatattgtcctctctggaggttcaaccatgttcagggactttggacgtcgcttgcaaagagatttgaaaagaactgtagatgcccggctgaaattaagtgaggaattgagtggtggtagattgaaggttggttttcccaattattggtgagaaggttgagggtgccttccttgattaggatgagaaatatttgccagcattcactctgatttagaaaaataagaggaacctgtcaggtattctaatggaaatggttaatgttatagatttatgtctgtgatattctggatcatttgattcttctaggatattgtctgtatttctggaaaataattcttagtaatacctgtggaaagactttttttttaaatacctctctcatagataattaatatagtagatttctttgcatacaccaacaatcaaattaattatggatccacaaaatgttttatactatagaaggacagcaaagctgagttgagattgatgccattgttgagtagtcaagcctgctctcaaaaactgactttagctcccacatagcaacctcaaagtgtgcagtcaaatcggtggtttaataaagtaacctttgtattacatgtcctggacctttaggcttgaggttaaaaaaaatcaaaattaatttaaaattcttagatgtctactttctata

SEQ ID NO: 3185 - DNA, 1182 bp, Homo sapiens
gagatgtgtatatagtctgtggataaaatggttaggatgaaatagattacagtgctcatggggaatgctgacttaatgagtgactttatttactttcctatacttttcagttttccaatttgtctgaaatgtgtatatgttacttacaagaaatgaattggcagttggtgagtattcttttaatttaaggttctcccacatcttctatggaggaaatatacatgaagagactttgtactaaactccctgttttcactgactgttcagcaatcttgctcataagttacactatgcagtggttcttaacttagttgcccattcggaacaaagacggcttttagaaaatatggcagaggtctcccatccaagtactagccaggcccgaccttgcttagcttccgagatcagaagagattgggcacgttcagagtagtgtggccataaaaggtgaaccagcccagatcttcctggagtcaggttgcttgggaatgcagcccagtgcagttaattggtggtaaactccaattaaagctaaagaccggcacaagaccaatagtcaaccagtgccacaagagaaagttggaaagaactttgaagagagagttcaagagggcgtgaaaccttaagggtaaacaggtgggatctgtgcagccttccagaggattgaactgggcagcgagtctggccctgatgacagtcctgcagatctttcctgctccttcacatcccccactttctgaactcagaaataaagccgaatacttacaggcaacttttttttcaacaaagcaaacaaaacaaagtgtggaaaggacaccatattcaataaatagtgctgagatgattggcaagtcacatgtaggagaacgaaactggatcctcatctctcaccttatacaaaaatcaactcaagttggattagacctaaatctaagacctgaaaccataaagatcctagaagataacttcagaaaacccttctagacattggcttaggcaaagacttcatgaccaggaacccaaaagccaatgcaacaaaaccaaagataaatagatggaacttaaactaaaaagcttctgcacagcaaaagaaataatcagtagagttcacagacaacccacagagtgagaaaaaaatcttcacaatctatacatccgacaaaggactaatatccagaatct

SEQ ID NO: 3186 - DNA, 1212 bp, Homo sapiens
tgtctagaagggttttctgaagttatcttctaggatctttatggtttcaggtcttagatttaggtctaatccaacttgagttgatttttgtataaggtgagagatgaggatccagtttcgttctcctacatgtgacttgccaatcatctcagcactatttattgaatatggtgtcctttccacactttgttttgtttgctttgttgaaaaaaaagttgcctgtaagtattcggctttatttctgagttcagaaagtgggggatgtgaaggagcaggaaagatctgcaggactgtcatcagggccagactcgctgcccagttcaatcctctggaaggctgcacagatcccacctgtttacccttaaggtttcacgccctcttgaactctctcttcaaagttctttccaactttctcttgtggcactggttgactattggtcttgtgccggtctttagctttaattggagtttaccaccaattaactgcactgggctgcattcccaagcaacctgactccaggaagatctgggctggttcaccttttatggccacactactctgaacgtgcccaatctcttctgatctcggaagctaagcaaggtcgggcctggctagtacttggatgggagacctctgccatattttctaaaagccgtctttgttccgaatgggcaactaagttaagaaccactgcatagtgtaacttatgagcaagattgctgaacagtcagtgaaaacagggagtttagtacaaagtctcttcatgtatatttcctccatagaagatgtgggagaaccttaaattaaaagaatactcaccaactgccaattcatttcttgtaagtaacatatacacatttcagacaaattggaaaactgaaaagtataggaaagtaaataaagtcactcattaagtcagcattccccatgagcactgtaatctatttcatcctaaccattttatccacagactatatacacatctcccaactgtcggtttgtaacaaaattggttttatttttgtgtactattttaacatacctctttctactaatatagaatatgtattttacatgttacttttttctaaaatatgatattaaggaatatccattattaaatgggtataaaaattgtttagctaaaacctatttctgtaggtttttccattataattaatgccaccataaatattggtacatagggtttt

SEQ ID NO: 3187 - DNA, 1221 bp, Homo sapiens
acttccaggattaggttatataagatactggtgcttccatcattgttactatgtcagaggtctctaaaactggctccagatttgcttattcagtagaagaactcacaggactcagtatacagttgtatttatggctaagatttatcaaagcaaaataacacgcagcaaaattagtaaagaaaaaaaggccatgggatgaaggcttaaagaaaccaggtgcaaattttcaagagttgtctcctagtagagtcacacaggacatacttacttcttcctgcaatgaactgtgacaacacatgagtgttcactacgaggaaagattcagtatgtaaggttttcattgtaggctggggacacaggcagtctctaactaacacctaaattccagatatccagaaggaaagcaggtgttcagcataaaccatactgtttacacaaacagttttaggcacaataagctaccggtacttatcattttctctttctttattttccttttgggaaacactcttctaagtttctcacttcatttggttctagaggtgctgatcctatcccctggctctagggcatatgaccaaggtgggccagctacggccataccaccctgaacgtgcccgatctggtctagtacttatcatttatgtaaaaagtcatcgtagtatagagaactgattagcagtcacatttccaaatgccagccatggaccaaaacttccaggcaggcctttctaaggattgcagtcttagaactgctatgttaaatcttctgcaaagtcatcctttctcttcaatcaatcacttgaggggaagccagctgtcatgttgtacgcagagctatgtcctgcctatggtgagaaacagatgtctgccaacaactgtgtgtgagtttggaagtggattagtaaagttatagatgaaggcaaccttggctgacagctggactgcaccctcatgagatactgtgccagatcgacccagctaagcttcgtctagattcctgaccatcagaaaatatatgtgatagtgaatagttttgttttaagctgctaagtttttgcataaattattatatagtgttgagagattaataatttccccactcaaagatgtccacattctaatctctggaatctttgaatacgttacttcatgcggaatttgcagatgcaataaagatttttttttttttttttttttagatggagtttcgctcttgtt

SEQ ID NO: 3188 - DNA, 1156 bp, Homo sapiens
tcagaatgtctctgactgggtcagcagcttctctctgagaatttaaaaatgctgtgttttcattttcatgttcgtctaaaaacacatttaaacatgttctaggccatctgcagagccttgagccccaagaggaatttcaatatacttgggtctgcatttctttctaatccgtggtgccagggctaagcagtaaagttttcatggtcttgggaaattgaagaaagaagcagccagatgccatcaggatgcagggagtgagcttggctccttgagaacttcagaagagcagagcagggggaaacttgccctagcatgcagagctgaaccggaagaactttctgccagcagctaggagtatttccacttcattgtggcaatttcatacccaccagcttcctctccagacatcttgaaggggggctgttcatgtctggcagcagcgaggctgggaagaaacactgggtgggcagtgaggggacacgtttggacagcactcatttgtgaaggagactgagggtggtagcggggtctctggaatagatgagcacccccgccaccctcccgcaacagcttgaccacatgaggactttgaggactgggtgctaatccttcaacaacctggcaagggaagtagtgctatttccacttagcaaacaaagacaggttcagagaggttaagtaagctgctcaaaaccacacagcattgtaaccagctctgtcctagacagccaggcctcttcccagccccggctcagtgtcctccccagagacgcttgtatcctgggttgggagcccacctcctgggacttctcagggccaggcaagaggctgaggcatttgccctaccttacttctgccagcgtgtcgggcagcccagctcatacttaggtaattaagtcttcgagtaaacactgaagaagtccaacctgtttttatgtcatttcaggaaaacaaagtcctaggagctttccagaaagttcagagagtaaacagggacaagtagcttgagccccgtccctccccactctgccacccccttccctggctccttagctcatcagttaccaaatcagcgtgtcatttgttctccaaagagtgcttggcctgagactgggttggtgacagcagcctgttccctgggggctttgttgccggg

SEQ ID NO: 3189 - DNA, 1187 bp, Homo sapiens
tggggcggggggtgttgtttgtatttcccagacttacaaaccatttgagtgctgggccttccctgggacacagttaagtatctcccttcctccagacccagcccaaacctgtaattaagcaaagcccctgatgtgattacgctttgctgactcggctgggtttggagccattccctctaggaaacagggtgaactcttgctcttcccagaggtttcctgggcagcttgtggtgcacctctattgtacacatgtccgcctgtccccctcctttggctctcttcctctcccttcagctatccgtccgtcctttctgtctttttctttctccttcccctttctctctcttctgtcctgcccccaccccctcttctctctgggtctctcctttctctccctctccgttctctctccccttctcctttcttctctttccctccgtttccccctcctccgtttcctccgccttctctctccctctcttttctgtcttttctcatcttttcccatctttccctcccgttccctccgcctcctccccgcccccgccgtctggaccttcctctccctccgcgccggcttttccgccacgcggagcgctggctggcgaggccgcgtgtccgagcggcgccgaccgtgccgcggccgggggacattccgtgccccgagcgccccgggcccgcggctgcggccctcccacctgcgcgccggcctggtttgcagctcccaaacaatggccacattgtcgcagccgcacaccggccgccgccggcgagtggcgggaggccggactctgctcgtggcgagtcgggaagaaagccaacgggccaggtccccacagccgcgcccggagcgcgcgagcggctcccacccgggaagggcgcgggttccgaggggcgccccgggtcttcctcgaccccgtttcccattggcctgccctcttgcccgcttccccaggaggggcttccagttgcctttacagctggcgaagtgaatgagagcactccacgggagccgggaagagagaggccccgtgaccaaacttttggtggcgtctgaaactttttctgtaaggcatctgcagacagtaatcactaaggccgccttctgcccttgtccactcccggcgacaggaaaggaagggcggtcctctcttccattcgtcttgacctgtagggattcgaaacct

SEQ ID NO: 3190 - DNA, 1206 bp, Homo sapiens
tggaggatgaggtcagaaatgggcgtgatggtcctggagatcccctgagtgtatcctcaaagacaagggccagtgtcctgtcctgtcctgtcctgttgatgccagcgtccacgggcctgagacagggagaggtcgatggttctcccagctaagccttttagaatggaggagaccccagaccctgagccccagggatgagcctgatctataaccagtcattgaaaatacatacagtgaaatggaagtttctgccattgagcaggctcttgctgaccgctgtaaagataagtaacggcagttttcaggccacttaaacccttacctttggggtattaaggggtctctgcagacagtaagtctttatcgggaagtgtttactcataaaaaaacacagtgaagccggggagagaaagcacctcagcctttatggcgccacaacccatctgtaacaggagctgcaaatcacctgtgggctgcagacgattctgcccaaaagttgggggcggaagtgagagtaaaagctgacttgctaccatgcagacagcattgcctgccccgccagccccctccctccaccgatagagggactgtgctgccgtgtgtgtggctcagccgtcttgctgtggctcccaagtaccacgggattgagcctgagctctgtggtcacgtgccccctggcccacctctctagcctctgtgcctgcgcacctctgacggtgctccctgcttccagagtgccttcccctgcttttctacccctgggagggctacccaaatgccctccccataccagttagagtccgatcagtggagtagaatcaccgtgagagacttggaaccagggtggtgataggatcagctcctgcccagtcgtgggagcagtgatatctctacaaagccacggtctctgcctctggtgctgggctgaagtcattgtaggtcagtggcattggcgatctgagggggtgttaggtgtgacgtgggggagaacaaggacaagctggaacccaccaggatggttagagttcacgcctgccttcctgtacttccagcttcatgatggataggtggatgcacatggggttggaggtgggttgtatgaccctcccccttggaactatatccactcctggctctatgggagaaagagctggctccaaccctctttgccccacagatcagtgatgatgtttggggactgaggga

SEQ ID NO: 3191 - DNA, 1199 bp, Homo sapiens
caagttacttagtgtcctgttttgtcttctgtaaaatgagcataacagccccttctttatgggacagtcgtgaagattaaattacttaacactttaaagtttgaaggagtcctagcgcatgcgatgatagcattgagtaagtgctgtgtttaggtgactgtgaatctgttctttctcaacacatcctgtctgtgccatgggtcagcccttggcacctcccactgggctcatggctgtgccacctgtattcgagtgttggggatggtcaggtgggaaaaaggatttgggctcctaatgcatggtgagaaagacaggagcaagcagataaccacacagtggatgaaagctcacccccacccttgtttggagagagaggcctgagcatagggaagatctgcccaactccaggaggtcagggaaggcatcccaagggaggtgatgactcggctgaggtctgagcaggcagaggaagctgcacgtgcaagtccctgagcaggtgttatggaggaggggctggaaggagacctggtggctggagtgaggagattccacagggccaccgcctaggccttctttgtaacagcagtggggatttttggaaagttttggggagagggcagggacatgatcttatttccaagttgaaaatctgtctttgcagtgagcactgtggattggacagctgttagctgagggccccagaatgatccaagcaagtggtgggctgtgctaggggtggagtttgaaaggagagattttgagaggcgttcacgagcccacacgtaagtgggctccattgtggtggaggggaggagggaaggccgactcccgggtctcccgctttgccactgcgcaagtagcaggcacgtgctgtaggaagagctggtccaggcacagggcaggagtgtggggctggctgtgccaaactggagctgccttgcagacaggaggagaggacgaggaggcagctggctctgagaaggctcactcttcagagccactgaaagtgggaggtcgaaaagtgtttgtgggacgggacgtccgcctggccctgggcctctgctgacctctctgaagatggacagagaagacacagagtcattagaaagtccagacatcagggcttctttggacctgggttcaaatcctgcctctgtagctctgtgaccttgagcaagtcactgacctctcaagcatag

SEQ ID NO: 3192 - DNA, 1205 bp, Homo sapiens
cgtgaaaagcaatagctacacaatagtgagtaggtgtttttattggctcattttataatagtatttgttgactgctagatagtgaataagaatactatagaattagggcaagaggatttgttgttgtttaagaaagaaaagccttcaggattaaacacagaaaagttaatttctctctgtactgctttttaaagacttacattgatggaggagagaatatttcattggtttgtagccttttcaggttttcttaaaaaaacgcatgaaaatggtattaattcactgccaactaacatggaatttgttttgttgcatggcctcgtttgcggtggaattcacaacagagagtaagttccatttctttttcctttatctgttttctgcactacattttccttctgtactatgaacagttgttaacagtgttaacctaagttacaagagtctgggcaaagcacgtatgggcatttttaatgttttgtagactttggaggagatcgtgaattcaatatgtgaactacttggttttcatttgtgtctaggttttcagtatgtttttggagactcttgtggattttataataattcataaggatgatttacaagactggctttttgttcttctcacacaattacttaagaaaatgggagcagatttacttggatctgtgcaagcaaaagttcaaaaggctctagatgtcacaaggtaagtgtttaagggttaggtccattttgatgttacaggatacttgtaagtgactttttgccattctcttttgttacccatggcctttgtcacccccttgaatatctcttttactcagttctcactttctgttgttgacatacttgttgacatgtcccaccagtccatgaaatgaaataccatatcttccttgtgttgatattacttttgtgagtatttaagacatatataataaacaaatgtaaaactttggaaattgattctcttctcattaaaaaacatttaaagggaacatttagaatatttgtttacatttctctgaagaccttagtatttttattacttcaacttacaagtcttactagaaatttttctatcggtgtatgatgtagagtttccattggtccaggaaaattctctaaattaatagtacactggctagagattaatagcacatttgcagtagttgtgacccttctggctgttatgagaaaagaaa

SEQ ID NO: 3193 - DNA, 1265 bp, Homo sapiens
gcagcgggaaacaccgggagcctgttagcagccggcctgcggggcagcgctcccgcccacccgctccggggaggcctagacatttccggcccagacgcagtccgagagtccagacgcatgccgactggaggaccaaagagattagcacgaagaaggatgatcttccacaaaaagagctatgtacagctataatggaaaatactcggtgaggagaaacgaaataaaaggcaatacagcgtagccaaacccgggttagctgcgggtggagttcaagagcgcgccgcggtcccgcccccgccagccccgccccggcgagaaaagcgtatgcaaattttcgagcggccgacgcgcggtcttctgggtaaaaccgagccgccgcttttgcgacccttcgggagcctcagaaaacaaagaattggggtgtcgtcgaaagctgtggaggctggaggtaagctagctaccagaccgactagggcgaggctcacgaattaattaccacaaccctaccaggtattggcgcttcctgcttgcagcccagggactttctattataaccatccttttcttggggttgcgctactgtccaatgagcgcatagtgagggcagtactgctaacgcctgaacaacacacccgcatcaactagagcttttgctttattttggtgcaatttttggaaaaatgaaaacctgttttcatagacttatcagttcaaacagcagtaattcgtaaataaactagtactttgtggttaaaccagtagagggtgcacaagacgcgtggttttagtgtcgcaagtaaagttctttcagtttttgcggtgattaaacgggaaggatttcaacagaacttcacccctttaactttacgccgatcatcaactgttctgtaacttccttatgctgagtcagcccagtagtctaggtcaagtttcaataggagacgaagtttcagtaggtctttgcacctcacataaaatgtaatccaggtcgggcgcggtggctcacgcctgcaatcccagcactttgggaggccgaggggggcggatcacgaggtcaggagatcgagaccatcctggctaacacagtgaaactccgtctctcctaaaaatacaaaaaattagccgggcgaggtggccggcgcctgtagtcccagctgctcgggaggctgaggcaggagaatggcgtgaatccgggggggtggagcctgcagtgagcagagatcgcgccactgcactccagcctgggcgacagcgagactccatct

SEQ ID NO: 3194 - DNA, 1174 bp, Homo sapiens
tcaaagttacaccagtagtaagtggcagaatctagtccagagtctgcactcttaaccactatgtgctattgtcacatcagcacagtttacaaacaaggttggccatggtgagcctccagtgcacacagcattccaagtaatctttttttttttgagacagagtctccctctttgccaggctggagtgcagtgctgcaatcttggctcactgcagccttggcctcctgggttcaagcgattctcctgcctcagcctcccgagtagctgggactacaggcacgcaccaccacgccctgctaactttttatatcccatttcatcatgttggtcaggctggtctcaaactcctgatctcaggtgatttgccctccttggcctcccaaagtgctgggattacaggtgtgagccaccacgtccggccgtaagaaatcttttaacatcataaattgggttctatcacttgtcagcctaaccttctccagtgtcttcccattacacttaaaataaaattaaaacatttactttaaagggttaatgaccttgtgccgaaggcctagccctagctgtctcttggccttgttctcattcctgctgtcttttactgtcctccagccgccctgatctctgtctctagattgtgcttcagagggctttctaatggttagttggctttctcccgatctctgtgttatgagctatatcctatcatttgggtctcagcttaaactcactgtttagaaaccttctgtgacgtccctagctaaaatagtctctaccctcagtcaattactttgccactatttgaaattccttctacttgaatgtaagattcttgaggcagagacctcttatggcagtttaggaagacaggcaaagtcattagcgtctctattgcctaaaacagtgcttgggacatggtggccactcaataaatatttattgagtaaattaacataatgagggattgaacatttatatctccggaaggcacatggctttcctgagagcaacttttacatccctctggcttaacagatatatgacaccagctcaggacagccagaggctaccctatcaattctattcctccaaactattcctgccacctccctaactaaaacttgtggagaagtttgtctccccagtgtctcagcagtaagtgaaggtaggggaa

SEQ ID NO: 3195 - DNA, 1154 bp, Homo sapiens
tcttttctttgttgtagggaggaggagatggaggctaccacttactccattgtaaagtagtgtgatgtaggtgctgcccttgactttgtttaatgtgaccaagccagccactttggtcaacagtgttttctatagagccttcctcatttcccatacttggtttttttttagaagactgagagtaaggcagtaagctgcagtacctacagtgattcagacacagagtggtgttagatttctggtgggaaatagaattgaagttacaaataaatatgctagctaaagcagaagattgctttcctgtctggtgcatttacaagctgggaaattctggaaaacatcaacctgccaactgtgtggctcattggctcttctttgggcttcgatgttcttcctgataaaaataataattatgttatttcgatatggttgccaagccgttcatgcttctcgctctgcttgtgattataaatgattctgcagcatgaattgctttgtctttgatttaatgtttcataacatttgggtgttatgttatctgtgctaatttgtcgttctcttctcttacttttcagaatggactgctgaattatgaagtatttcagacccagtagtagaacatcactctgccactcactcctttatctcctactagttatttaaattggacttttaatatcctaccagctgctcttcagacacacatggtgcattgttgccattccccagattgcatctttgaaacacaggctcttagtaaccttcagcgaacaaagaggcaacctcccagatacgtctgctgggagggagtcatcgtgactgccctctagcttttgctggatctggatttgaattccactatggagcctcgcatggagtcctgcctggcgcaggtgttgcagaaggatgtggggaaacgattgcaggttggccaagaactgatagactatttctcagacaaacagaagtctgctgaccttgagcatgaccagaccatgttagataaacttgtggatggacttgctacctcttgggtgaactctagcaattacaaggtaagctgtgctttagaaggcacttttggaggtggctgggctgcactggtagatcaaaattggcccttataaaaatcccttgtgagcagtcagcatgct

SEQ ID NO: 3196 - DNA, 1115 bp, Homo sapiens
tgcgctgagaaggagccatgttgtaacaagcccctgttttctctttcctggtacagtcgaggctgtctgtcaacagcgtgactgctggagactactcccgacccctccacatctccaccttcatcaatgagctggattccggttttcgccttctcaacctgaaaaatgactccctgaggaagcgctacgacggattgaaatatgacgtgaagaaagtagaggaagtggtctatgatctctccatccggggctttaataaggagacggcagcagcttgtgttgaaaaataggaggctctccttgctcctggccttgctgacctcagcggttgccaggaaggggtgagcacagagtgcctcttacggtagttaggatgctcagttgctaaacactgcgctttattttcttaaccagttgtggtgtgagtatcagaattgaaacacttttttgggggtaaaaaatatagcctttacatggacagaattttttttgttgtttcagtgaatatgcctgtaattcagtgtatttcagttccgtcagaaagtgtaaatgttagtttcttggtaaagtccttttcttgcttaccttgactgttgatgtactgattgagaagttcattgtctcgtttgtgattcttccagatgtgatgcttgatattttctatatgcgagttagccatccacacccaggcatagcctggatacagtataaaaatagataattaaaaagatggttgccaagcaaggaaaacttattttatattttcccttccttattttaagcattgtgagtaaatcagatgttgaattcttttgccaagggaattatagctgcaggttctctctcactgccatcaaactgtaaaagattaaactgcgaagtcaagctcaacagattattttggaaagtttttgtattaagggatttagtaacatcattttgttttccaccaggcagggagtagggcttagtgttttaaaacacctctgctttctgatgttgccttaatattctgctattgcagcaattaaaaattgtcttcatgtacatttggaactaacacgtgatgtgatatattcctaaactatgaaacctttttcctagtagtcagctag

SEQ ID NO: 3197 - DNA, 1206 bp, Homo sapiens
ataggttagttaatctctctgtgtctcagtttcctcttctttcaggtgtggattatagtagttttgaggattagaggagataatgcatgtaaaatgcttagaacaatgcctgagacagtaagcgatctgtaaacattattaaaaatgatgtattaaatttatgtaagtcttataaaatttgctgtgattataagtattataaaaggagtatcttttcttctggagactaacatgggctggttcccccttcccggcaggcatctcggcgctttggcaccatgagttctatgtctggggccgacgacactgtgtacatggagtaccactcatcgcggagcaaggcgcccagcaaacatgtacacccgctcttcaagcgctttaggaaatgatgcttaggcagggtacttcgttcaagaccggcgcttggcacccttgttggaaagggattttcagcataacattttccttccacctctttgaccttccctccagcgttggccaaattgtgctgaggaagatgcatcaagggcttggctgtgccttcataggtcatctagggttttataaaggaggaggagacaatattttttcaaactttttggggagtggggtcatttctgtatataaaaaatgttaatatttaaggtgtatttatgttaccgttctgaataaacagaatggaccattgaaccagtcttcattgtacaagtgtttttatgcttcgtcctgggcatgggttatgtctggatgaccaacctccatcaaggccctactttgtagcaagcacagatgagtaagatggagcccatccccagggagctaccagagagatgtaccctgagatagaagaaacgttggcaggaaaggcctggggaacggggagggtgatccagccagagggaagagcctgggtagttgactgtggtccctgctcacagcttagcctggtggattcagactggggcttcaaccgcacagcttcctgctgttctggtggtcacagctgttcctacagcctcgtccgaggtagacacccacgtcatgaaggccttccaggttggctcctggtgcctcatcttctctgagagagtgacctcttgtttctccctcaaagtacgtttttagaaattgctgagaggctagattcctcttctaatagcagtttagtgcccttgggtgttttaattgctacttcctttattttta

SEQ ID NO: 3198 - DNA, 1184 bp, Homo sapiens
tggctgtgcgttttccttcccttgaaaactggtaggatcttctctctttttggaaatttgaaagtgatattcttaatgtttttctttcatcgtgatgggcactcagtatatcctttccatctggaaactcgtgtccttcagttctgagaatttctgtttttttgttgttaatcactttctctatgtagtcccttcttggaattttgattcatcagatgttagatcctctgaacagcttctccagtttgcttatcttttttctacttttttatctctttgtcttctaacccttgtattgagacttgttaatttctgagagttctttcctggtaactgttcttgttttgtttgtgaatagagtgtcttctcggaggctttgaaaacttttgaagcttccgtctgtttcctgccatgtctcttttcttcatttttttgtcttaattgtttttacctgtcttttgagtctttctgagttttggtaatccttgactgtattttattggtttaaagtcactgaaaacctggcaggcctttctgtgtggcttagtgggtttgccagcttgtggacctcaccagagtggctgggcagggcctggctatttcttcaggaggttgccaaatgccagtatctctaggacttttctcttgggctggacggtttcttcagtgaggaatttttcagtcccctgggcaccaccgtgtgttaggggaagaggagggcttgtggaatctttgcattcagtcttgccttttccctcatctctgccgggcatccctggagaataagcctccagtgccccaccagtggaggtggcctgcctgctgccggccggacccaactgctcctcacactcacacactgccagtcctcctgtgcacctccccaccttctcaggcaactggtgactagttcctgagccctcctgcgtgctgcagaggacacagaggcggcgggttttgtatcggtcttccctcctgccggctccagcttctgctttctctagtctgttagctcaggtactgtgcctgcatctgtctgcttttcagcttctgaaatgttacccacttctctcatctgctgttatttcttctcctgttttcttggtgggtttgtgttctgtcacattagtgccaatttgagcagggcaatgagacagttcctatatttactttgccttatttaa

SEQ ID NO: 3199 - DNA, 1202 bp, Homo sapiens
aaaaaaattctgaaacttgagccacaaattaagaggcagacggcttttctccttgcaaatgacctgccacacagtccgtcactgcctctgctagctctgctacccttgggccctgtccacagcccacgtgggagaccttttcacgggatctactcggatgtctgggatctggccactaccgcaggctcgagacaacccaggtgcgtatgcgccgcgcacacggaacagcacaggctgccccggggcaggggcgggggcggggccgaggccggggcggagccaggactgggaatccccgcgccgtccggccggtgggggcggtggcctgtgtgtgggcgtggcgggcctctgcgcaggcgccgacccactcccctgggccgggcgcgcgcccgcggcgggttccgctaccgccgggcggaggggtgcgcgcgcacgagcgagcggccgtgacgtgcgccgcgctacgcccgacgtcacgggtccgtgtgtagtggctgccgggctgcctgccctcagcggcggcgcctgacgagggtgccgcggccgctgggcgcagcgttcgggggttgcacggcccgcggcggcgacgaaaacaacgaccaggacgctcggcgcccctgtccgcagagtcgccactcccgcctcttctccggtctctagcgacgcgggcccgcggcttcctcctttcctgcccagttcccgcgggcctcggggttgcagcggctagaagtgccgaggagcgccaggaggacccggccggctgcgaggattcacgcgcccgccaccccgcccggcccgggcttcatgtgaaagagggacgggcctggccccaaggcccgcgcccgactcctcgcgcgcccctccggtccccgggggccctgcggcagcccccgacctggggccgcggtgacaggccgcgctggggcggaggggcgggctcggcgggggcggcccctccttgggcctgcggctctctacgtccctgcggagcagccggtacgtgcgtgtgtgcgtgcgcgcgcgcttgtgtgtgtgtgtgtgtgtgtgtgcgcgcgtgtgtgtcgggggccgcgggctgggcgccgggaggggggctggcggcggcctaagcgccgctccaggggcggagatttcgctgggtgattgcctagctgcgggagggcggaccttgggccccctgcatccagtcctaaagcccaggt

SEQ ID NO: 3200 - DNA, 1201 bp, Homo sapiens
tattttataatttttcatattctttttgaatttgtagacacagcatacttgggttagtaaaagtttgggttttatgagaacattttcaagccatttatcttgtcattgacaagaataatcttgtcacttaactgtttcatagcatgatgttgggcatatatattattaaaggctctttggtccttgaaaattggtctgtggtaggttcacatagcttaagtcatatatctaacaagaaatatttggctcagtaaatttttaagagggtatactcaaacacggaaatactttcactttttaagctagaatattattgccatgttatttaaagttgagctaccagatgggagaaaaaattcaccggatcctaaaatacttgttagtattttggcatgtttaattttgtatatttttctctgcattttaaagccatagctataatatgcacatatcaagtttgtaccccagggcatgttttcagagtaattatttcaagtaacattatgtgttggtatagttagatgaatcatgttctccctaaaacttaagctttcttgtttctagggttactagacacaggaccgtgactactgtaagcctcaattttgttatcatgagaagtaccattatgaggagtaaatgaactaacaggagagagcctgttgtggtattggctcttagtgggtacttaggaaatgttaacttctcctttctttgtttgcttaaattatcttgggagaaggtgcccatatgttatttgaccctttaaataaaattaaattttatagttcttttcccttaaataatcttaaccttataaaacccaagaatgttcctgtgtaaaagaacttggttacatgtttgcttgtatttctttgaaaaatagagttatttatttttatttatttatttttatttttgacagtctcactctgtcacccaggctggagtgcgatggtgcaatctcagctcactgcaacctccgcctcccaggttcaagtgattctcctgcctcagcctccctagtagctgggattacaggtgtccaccaccacgcccagctaatttttgtatttttaatagagacagggtttcaccatgttggccgggctggtctcgaactcctgacctcaggtgatccaccacctcggcctcccaaaaggtgtgagccaccttgtccagcctagagttatatttttac

SEQ ID NO: 3201 - DNA, 1137 bp, Homo sapiens
gggaggctgaggcaggagaatggtgggaatccggaaggcggagcttgcagtgagccgagattgcgccactgcactccagcctgggcgacagagcaagactccgtttggtaggctgagacaggagaatcacttgaaccctggaggtggaggttttggtgagccgagatcatgccacttcactctagcctaagaggcaagagcgaaactccatctcaaaaaaaagaaaaaaaaaaacctctaagtcaagtggggctaactgtaaaggtatattttttataccttttatcttttatatgtttgaaatattttgtaatgttttatcaggaaaagtggaaaagaaatccagatgaaaggtaaaggtgttagagatgtgggcagtagattagcacgcctcaaagaagagtgcggggaaattgccagtcgccaaatcactcatttcttttcattttcttgtagcttggagggacggtttgaagatgaggagctgcagcagattcttgatgatatccagacaaagcgcagctttcagtattaatctccaaacatcactgctgctcggagaaaccacatccccaggcataacaccaccttcccactgtctggggctgacttgcacagaaattctgttgaagacagttgagaattcctttggagaaaacagcccagcttggcgtggggttaggttgctgtttcaaataactcacaggcccaggtgacatggaatcttggagcagccttgtgcagtggcagccagtggcttcctgaacgtgcctctgcgaagtgtgagatgaggggtcacataaccacactgttgactacctcattcctggtttttggcctccacatcatcttttttcttaatatttcatgttttaatttcagggtgtttatactttttgaaactagaccagaagatagtagactttatagagaaagaccagttttacctagatactaaaggaagaattaaaccgctgttagtttgaaatgctttttttttttttttttaaatggagatagggtcttaactcttgtccaggctggaggagtgcagtcgtacagtcatggctcactgaagtcttgaccccgctgcctcagcctcccaaataactggggccacaggtgtgcaccacaact

SEQ ID NO: 3202 - DNA, 1104 bp, Homo sapiens
aggcacatatctgaggggacctctaacggtggaagacagaaaccacaataaatacatgcccaaagcaccttggaagatgtagaggcctggcagggagaataaaacacaaaacaaatgagcaaggataagcaaacagtatccgtgatgccttcagaaagacaaaagaaaaggttgcatccacaaaacagtaacacagtgctatgcaaaaagaacattcagaggagaaaagaaccggtcctgaaataagatagcagaaattgaaagatcagtagaagagttggaagataaaattgaagaaatctcaaacgtggaacaaaaagacaagaaaattggagaaaacgataggagaaaatttaaaacaacaataaaaagaaccaggtcaggaaatccagcctccaggtaatgggtttcaacaagagagatcagagaaaaggaacagggattacaaagtaaggagtttgttataatattgtaatctcagttcaaaagttaactgcaaatataaaacccaatgatttctatatagtaaattgaactgtaaaggtaacttgtgtgtgattctgaatacatagataaatgtttaaaaaaaaaaaaaaaaaaaaaaacaacaaagtaatagaaaattaccaaaactgaaagaaatgagtttcctggttacagaaatgccctgcacagtattcaatggatgcaataaactcaggccagtattttgaaatttggcagcactggagacaaagagatgtgcctgcttctcccgtacttcctcccaaagacccttgtactgtgccctctaattcacagcctgtcatcacatgacactccaacctccaccccagtgcccttgtctcttctttctccacgccttcttgctttaaacctgggactcaacttgccctgcagctgtctaaagtggtccctgcctctcttccacatccctactgtcactcagcctggaggtaggcagggtgtccttgtcatgcctcactgccattttcagaccatttctcctcaaaagcacttgatctgtatttagatttcataaaatgtacagttgaaaaagtagtttcacatagccaagttattccagacaataaaaagtttctc

SEQ ID NO: 3203 - DNA, 1141 bp, Homo sapiens
atggcatttttaattttattttgaatgaggaggagaactatctgagactttttttttttttttttttttaatgagacggagtcttactctgtcatccaggctggagtgcagtggtgtgatcttggctcagtgcaacctccacctcccgagttcaagcgattctcctgccacagccttgcgagtagctggaattacaggcgcccaccaccatgcctggctaatcttttgtatttttagtagagacagagtttcactctgttggccaggctggtctcgaactcctgatctcgtggtccgcccgctttggctttccaaagtgctgggattacaggcatgagccactgcgcccggcctgagacttttaagagagatattatttgctacttattgaacatgactgatgttaatgctgctttttaagttcaaaaatatctacaatatgactcccgtttcccattttgtgaacagaaatccagtaacaatgttagaataagcatgatcaataatcctgccaaagagataagctatgagaacactcagatctccagagcaatctgggcagctctccaaactcagacttccaacgctgctaagaacttcatcaccaaaatggccaaggagggggctgcagaggccctggctgcaggagctgacattgcggagttctctgttggggtaaggctctgagcctctcatgaggctgccccattttgtctgccacggaagctcacccactgcagcttacgtgtccggttcatgatcacgatttgtcattttagtcctgagtctcagggaatttttttttttaatttggaagtttccctttattacttttaaccttgcctagctttcatgtggtgcatgatttgagtttttgtgtgttttaagtatggagccatttgttatgcacagtttttaagagagacaatatggcttatttatagagcaaaaaacggagatttgaaccacttataggttcaaggcttatatgttcttgatgtgtttccagaataagcctgtgtttattcatttatattttatgttacttatttttttgacacagttttgtagtttttaaattttttacagaatgatgagtatatactatttgacgtttgagttaggaaaacaggctgtcact

SEQ ID NO: 3204 - DNA, 1201 bp, Homo sapiens
ccttcccaggccctcacccctccttctccacccaggagtcgttcacgcctactgaggagcatgtgttggtggtgcgcctgctgctgaagcacctgcacgcctttgccaacagcctgaagccagagcaggcctcaccctccgcccactcccacgccaccagccccctggaggagttcaaacggtgggtggcccttgcggcttcccaccactgccgtctcccccactttcccctcctaaggtgtcgcccacagcgacctctccccagggcatggagggcagggtgaggggagtccctttctgttcacagagcacgtgaggcctctccaggcctaggcaggtgtcctctcaccccgcccagttggctcccagagcctctctctccagactggccagagaggccccattgtgctgccatctcttgcatctcatattcttcaaccctgtcagaagagttggggtggccctgactgccaggcccaccagggccagcagagtgggctgtttgtatgggacggagggtgaggtgtgtgcaggagttgtgctgactcggccgcctgcgtgctgtgtgtccttgggatgttccctaacctctctgaaccttgatttcttcctctgaagaatggggctgaacctcccggaggtgcccagtgctctcccccggcggagccaaccctcactgatgggagccctggggtcatctgtgagcagggcctccttactgggcaagcagcaggtgaccctccccatcccctgcagggctgctgtcccgaggttcgtccagcagaaactctacctcttcttgcagcattgctttggccactggcccctggacgcatcgttcagagctgtgagtgttggccccgtcacacgtgtgcctgtgtcctctgtgtgccttgaggtgggaggtcctttggggcagataaaggaggagagcaagtgttatcacagaggccttggcaaggagggggtcttggagggccacattgttctttctgtttgagtttccaaagccagccctcaggaaagccctgccctgtcccacctgtctggtgcagggcaggttcctacccttacctgaccagggagtactctgccccctgggctgggaaaagcccaccctggcttctggagggccagcaagagccaaacctcacagggctgtgcatgtctctcctgcgccctctggaggaagtgagaagag

SEQ ID NO: 3205 - DNA, 1216 bp, Homo sapiens
ccggcgccccaaggtactttctccccagcaaggaatccgcgtgcgcgtaagcagtattgttgattagtgccccccccttccccccgcccgccccgaaaagcgacccctagtggtgcaccggtgcggaccagaaaattgcacgctttcttgaaagaggcatttaccgagcgcccaatgtatgcctggcactgggctgggtgctgccacctaagcgagcacgaccaatgcagtctatcagggaggcccagatcgccaagcagcggacccctgcggtccgccatgccactcccggctcctagagcgccgctcagcacaccgtgagcgcccaataactgttgggcttcaatgacgccgcggaggcggccccgtccccgcgctcccgcccctcccgccagggcagcccgggaggccagacgttgacgctgcagggagagggtggtgggcgcagccgctagggggcgcggcggggcggagcgcacctttccgcgggccgcggggatggcggcgcagggcgtagggcctgggccggggtcggcggcgcccccggggctggaggcggcccggcagaagctggcgctgcggcggaagaaggtgctgagcaccgaggagatggagctgtacgagctggcgcaggcggcgggcggcgctatcgaccccgacgtgttcaagtgagcggggcgggtgggggccgcatgctagccagacaccccccgacctctgctttccgggtacgcccggcccgctggtcgggaggagcccccgcccccgtccttgtcgggtcttcagggaggtggccgcgccgggcggagagggctcaccggccccgcgtctgtccccgccaggatcctggtggacctgctgaagctgaacgtggcccccctcgccgtcttccagatgctcaagtccatgtgtgccgggcagaggctagcgagcgagccccaggaccctgcggccgtgtctctgcccacgtcgagcgtgcccgagacccgaggtcagagctgggcccgctgtccctgccccagtggcgggggtggcgggcggggagggggcaggcgcggcacagcggcggcgtggccctgagtggccaggcctgtctgtcggtctaggcccagcacctgcagggcccatccgtgggctctgctcctgggcttcgctgccagccttaggaggcacgtccaggtcaggtggacgcagagtgcgtaccccagggtggtcc

SEQ ID NO: 3206 - DNA, 1158 bp, Homo sapiens
cacaaggttccagttagtgagattctgaagccaaagtaaggaaaaaaataagtcaattttgctggggccacaaattcttccaggaggaggtgcgaccccgtggagcacgcccttcgctgctgattgtgggcggacactggggtgggcacgtgcctcccactgctggcttggggctggactcacaggtggccatcctcctatcagggcgaggccatgggctctgcaaatagggttggatgaagacagcaaatctttagcaaagcatccttaacttgctgccctgaccttctgccctaactccagctcttggggagaccgccaggaaaggggattctggcttctgtggggaagtggcttgtcccaccagggctaagtcgagagactgggttcatgcagcgagtctggcacggctgcagtcatacgagtttctacagggacagcaggagctcagtgctgcgcagtggtagttgggaggcgctggcggtgaagctgacgcatgtcacgtatacagacacggtggcgtcacctttcagcagttcccatatggtctagcggttaggattcctggttttcacccaggtggcccgggttcgactcccggtatgggaacaaaagtggcttttttttttttttttgcgggtgtatatttttttctttcaacttgaaaatgttcgccagaagaactttgacttttcgccactagaacgctccaggccagattgggtatttcctcttcacttgaacttggagaaacaggcccagggagatccgggccccatcgctgtgtgttttgatggcagtgaccattttcatcatgacattagctagttgttttgaccatcaatagcttactgagtatattagatgctatatacatcgcagatgtgaatattagaagtagtgaaatgcccgataacattgaaaatattcaaaatgtgttgctgtggaacccccagcagaaggcagatccccactggcctccatcacgctccagcgcacttgctcaggttggcaggagccacctcgggtccgtgagctgcctctgcaaggcagggataggaagtcctaggaagtctactgggagcatagcactctggaaaaatttacctttctctcttgctgctgctttgttttgtccagtagtcagggttcccgttt

SEQ ID NO: 3207 - DNA, 1198 bp, Homo sapiens
agtggcatcatgtggtatttgttttgtgtctggcttatttctattaacataatgttctccaggttcctccatgttattgcaaatgataggatttctttccttgtaaaaaataacatgccacattttcttaccaatccgtccaccaatagacacttaggtcgttttcatagtttggcagttgtggaaatgctgcagtaaacatgggagtatagctatcttttgaagataatgatttcatctcttttttatatgtatacccagaagtgggattgctgcatcaaatggtggttctatttttaattttttgaggaaccgccatactgttttccataaaggctgtactaatttccattctcaccaacagttcactagggttcccttttctccacattgttgccaacattctttatcttgtgttttttaataacagctatcctaacaggtatgaggtgatctctctcattgcggttttgatttgcatttccctaacggttggtgatactgagcatttttgcatacaccgggtcatttgttctttgttgttgacttgagtcccttatatagtttggatactgctgtggcctgaatgtttgtgtcccccaaaaattcgtatattgaactctcatccctaaggtcaacagtttagggaagcgattaggtcctgaggactctgccctcttgcatagaattagtgctcttataaaagatgcccgagggagctcttttgcccctcctgccatgtgaggacacagctagaagctaccatctgtgaaccaggaagcccccctcaccagacactgaatctgctggagccaccatcttggacttcccagcctccagagctgtgagaaataaatgcctgttgtttaagctacccagtctgtggtattttgttagaacagcccaagttgagacagatagtaaccctttaccagatacatggtttgcaaatagtttttcccactctgtagatatagccattgagaagctcctcaagatagacattaaatacaaagaagcatggtgtgaaacgccatgtgtgatatgctgtcagtgtgcaaaagaggcagggagggccctgcacttgcatgtatgtgctgcatcatccccagaaggctgaactccttgctggtgcactgggtacccagggaggagggaggttctttactgtaatgttagcaggtgaacattgtatcca

SEQ ID NO: 3208 - DNA, 1199 bp, Homo sapiens
cctgctaggataaaacattaagcggctgttaaaagaaataaaaggaggacacgtctctgtgcactggtgtggacaaatctccaagtcactgcaaaatggaaaaagtataagatgctctttccctgaacctcaagggtcccgcccctctcactttcaggtctctggacctctgactgacactgtgcctgcccaggtccctgtatgcactgccacagtgccctgggccccatgtccacccctgtcctgcccttctctgggatagggctggccttcctctgcctctgcctggctgcatccatggtcgatctcaagtgccttggcatgaactccactctcctgcagccttcaatcaaggaatgatggggatgtgtacataccccaccccaccccttggcagggtgatgctgaggtgtggatttttaacagttcccagactttcccaggaggcttgggtttgggtgcccacagtgggagctggtgtgatatcataccttcgccggccgcctttccttcctgttctctgtgcccctactcccactctagagctgccccgtttctctgttttcgtgaaagagctgaccctgtgctgcctcccactctcccaatgcccctgccactcctgtgagcctgctgctggtgaggtcggtgctgacctctgtgttgctggataatgagtcatctatctctggaggagaagaaaggcaggtcctccacagccctgataaaatctccaagtctcccagtttcgggtccctctcctgggatgcagacccactgcctgcccagctggtacgatccacatgccctcttcttgggaataggggcatgggaaagtgactaaagatactgttctggctgctgtgttcactgtgagtaataaactgtccatttctccgattcagaggtctgtttttcctttttttcttccccaaagatggagtcttgctctgtcgcccaggctggagtacaatgtcgcaatcttggctcactacaacctctgtctccgcctcccaggttcaagcaattcttctgcctcagcctctcaagtagctgggattaaacgcgtgtaccactatgcccagctaatatttgtatttttagtagagatggggtttcaccacgttggcaaggctggtctcgaactcctgacctcgtgatctacctgcccctgcctcacgaagtgctgggattactggcgt

SEQ ID NO: 3209 - DNA, 1102 bp, Homo sapiens
ttatgtctctcgtgagccatctgttaagaacgttcttcttggtgtggtttgtaggcctacctgtcgctattctgggaaaccttcttgagtgctatgcaaatgtgttcacaggcaatgggggtggtcctgagccttggggtgggcacctggtcagtgagtgtcttgcccttccccagctgggcatacagtaccttgctctttctggtggcatcatctggctgtgatgaatgaggtctaggaaataatttgcatgtgtcttgggggacacaacagtaacgagaggaaatacattattacagcaacttgcgacgtactaatacctgtcagtgttggcccccgtaaggtatgtaaggcacctgtgagtgccagtgagtgctggtgaaaggccaacatgtactagttatgtaagtattggtgtctgctttaaaaaaggagacccagacttcacctgtcctttttaaacatttgagaacagtgttactctgagcagttgggccaccttcaccttatccgacagctgactgttggatgtgtccattgtcgccagtttggctgttgcccggacaggacaggacctccattgggcgcagcagcaggtggcaggggtgtggcttgaggtgggtggcagcgtctggtcctcctctctggtgctttctgagagggtctctaaagcagagtgtggttggcctgggggaaggcagagcacgtatttctcccctctagtacctctgcatttgtgagtgttccctctggctttctgaagggcagcagactcttgagtatactgcagaggacatgctttatcagtaggtcctgagggctccaggggctcaactgaccaagtaacacagaagttggggtatgtggcctatttgggtcggaaactgcatgtttcagaaagtttgtctctttttcctactcattatttgaagaagagagagcctgtggggatagccttatcttggtccacaggactgaagtgaagtcacttgggaaggggagacagaggatgagcggcgtctgtgtagggacccccccccgggcctgcagaagggtggtgtgctcccaggactggcatgacaggtgtctcctcctcaccaca

SEQ ID NO: 3210 - DNA, 1206 bp, Homo sapiens
acttctaatattaaccattgaaattaatgtgagccatacatacatgtaagattaataaagacaagtaaaataattacctagttatttcagttcatggcccatgggtggctggaccctctcccagcagctcagggcttaaggtgggaatccaccatggataggatgctatctcattgcagggcacactcacccacaccccctctcactctgggacagtttagatacgccgattcacctaaggggcacatctttgggatgggaaggaactgaactatcccaagaaaaccatgcaaacatggaaaaaaccttcacactccacacaggcggtgccccagaggggaatccattcttttcttcttatcaatgttataatgaaactacattaaatgaaacagtgttatttgaggacctcctgtacttcctccatataaaatattttctccttataatcatgcattgtatttctagtcttgtttttaaattatatgtattgaatcccaagtgctatgtaatactcctaagtatttttagtaattgcctattatcatattgggtgatgtattattaaaccttccagtattggctgtttttttcctctctttttttttgctattgtagatacttctttgaacatctttaatcattttcctttttgttcttattgaatatgcattagaatatgtttctttttttttcttttttttttttgagatggagtttcactcttgttgcccaggctgttgtgcaatgtcatgatcttggctcactgcaacctctgcctcctgggttcaagagattctcctgcttcagcctcccaagtagcatgtgccaccacacctggctaactttgtatttttagtagagatggtttcaccctgttggccaggctggtctcaaactcatgacctcaggtgatccatctgccttgacctcccaaagtgctgggattacaggtgtgagccaccgtgcctggcctagaatctagttctttttttctcccccccaactagactctatctctatatgcaggcaggccccaactcaggatggtttgacttaatgattttttgactttccgatggtgcgaaaacaatgtacatttagtagaaaccgtacttcaggtactcctacccccattctgtttttcactttcagtatagtactcattcagttacatgagatcttcaacacttgattataataggc

SEQ ID NO: 3211 - DNA, 1139 bp, Homo sapiens
gagggcaccgaggccccatggggatagagtggaacctgaggaggaggtggaggggaatggggcagacgtgtgctgctgagtgagaggcagaggccacagatggaatgctgagagctctctgaggcccacatattacagcttctgaccacacagagctccagctgccctggtaatggcagaatctggggtggaggattctgtcaccccatatggcaggggggttgtcggagtaatccggggggaggggcatggaggccataggtttcccacaggactcgggtgttgagttctccaggctatgggccaggccctctcgagcttgcctctgtgagctgcagcaggcaccctgggtcctctggatgcctgtcccccagccatgcagacggcctgtgggaacaaccaccaccagattcactcatacccacagggaaggggaaatagaaaaccccagaagcacagagggtcgatgcttgtcttggtgagagtctggagtcattgagggaaaaataaattcagtcaagcgttatatttaagtttagggaaactatacgttttaaaagttgtccagagcatgcgtgtaagatgacgtttggagtgtggaagccgtgagtctcacctgagctgtgctgcctgatacaggaacttcgagccacacatggctggcgtggtcattgcactgcgtgtggtatgcgcagcagatgccaaaggaccggtacaaaagggaatgcaaaaaacccaccacaccttgggaggccgaggctgctggatctcttgagctcagcagttcaggactagccagggcaacacagggagacccaatctctacaaaacatacaaaaattagcagggcatggtggcacacatctgtagttccaactacttgggaggctgaggttggaggattgcttgagcctgggaggttgaggttgcagtgagctgtgactgcaccactgcactccagcctgggtgagagagtgagaccctgtctcaaaaataaacaaaaaaccccaaagtgaatgaggctgggcattggttcacacctgtaatcccaacatttttggaggctgaggcaggagcatcacttgaagctcggagtttgagaccagcctgggcaacatagcaagaccccacccatttct

SEQ ID NO: 3212 - DNA, 1185 bp, Homo sapiens
tgcctcctgtggggaagcagagcaactggctcggtgcgggatgtggtcagacctggaggccgagtgctatgggtgccgcgctccttcccaggccctcacccctccttctccacccaggagtcgttcacgcctactgaggagcatgtgttggtggtgcgcctgctgctgaagcacctgcacgcctttgccaacagcctgaagccagagcaggcctcaccctccgcccactcccacgccaccagccccctggaggagttcaaacggtgggtggcccttgcggcttcccaccactgccgtctcccccactttcccctcctaaggtgtcacccacagcgacctctccccagggcatggagggcagggtgaggggagtccctttctgttcacagagcacgtgaggcctctccaggcctaggcaggtgtcctctcaccccgcccagttggctcccagagcctctctctccagactggccagagaggccccattgtgctgccatctcttgcatctcatattcttcaaccctgtcagaagagctggggtggccctgactgccagggccagcggagtgggctgtttgtatgggactgagggtgaggtgtgtgcaggagctgcactgactcggccgcctgcgtgctgtgtgtccttgggatgttccctagcctctctgaaccttggtttcttcctctgaagaatggggctgaacctcccggaggtgcccagtgctctcccacggtggagccaaccctcactaatgggagccctgggatcatctgtgagcagggcctccttactgggcaagcagcaggtgaccctccccatcccctgcagggccgctgtcccgaggttcatccagcagaaactctacctcttcttggagcattgctttggccactggcccctggacgcatcgttcagagctgtgagtgttggccccgtcacacgtgtgcctgtgtcctctgtgtgccttgaggtgggaggtcctttggggcagataaaggaggagagcaagtgttatcacagaggccttggcaaggagggggtcttggagggccacattgttctttctgtttgagtttccaaagccaaccctcaggaaagccttgccctgtcccacctgtctggtgcagggcaggttcctacccttacctgactagggagtactctgacccctgggctgggaaaag

SEQ ID NO: 3213 - DNA, 2089 bp, Homo sapiens
atcgcccgccctgccgcgcccaatctcgcaactgggacgccgggctcatcctcgcgagtcccagaggccgctttctacctacctggttgatcctatcagaaccatatgcttgtctcaaagattaagccatacatgtctaagtacgcagggctggtacagtaaaactgcgaatggctcattaaatcagttatggttcttttggtcgctggctcctctcctacttggaaaactgtggtaattctagagctattacatgctgaagggcactgacccccttcacagggaagatgcgtgcatttatcagatcaaaaccaacccagtcagcccctctccgtccccggccggggggtcgggtgccgccagctttggtgcttctggataacctcgggccaatcgcacgccccccgtggcagcgatgacccattcgaatgtctgccctatcaactttctatggtagtcgctgtgcctatcatggtgaccacgggtgacagggaatcagggttcaattctggagaaggagcctgagaaatggctaccacattcaaggaaggcagcagacactcaaattacccactcctgacacggggaggtagtgacgaaaaataacaatacaggactctttctaggccctgtaattggaatgagtgcactttaaatcttttaatgaggatcaattggagggcaagtctggtgccagcagccgtggtaattccagctccaatagcgtatattaaagttgttgcagttaaaaagctcgtagttgaatcttgggagcgggtgggctagcgagccacagcccgtccctgcttcttgcctctcggtgccccctggatgctcttagctgagtgtcctgtggcccgaagcacttactttgaaaaaattagagtgttcaaagcaggcccaagccgcctggatactgcagcttggaataatggaataggaccacagttctattttgttggttttcggaactgaggccatgattaagagggacggccgggggcattcatattgcaccgctagaggtgaaattcttggactggcagtttagaccagagcgaaagcatttgccaagaatgttttcattaatcaagaacgaaagtcggaggttcgaagacgatcagataccgttgtaattccgaccataaacgatgccaactggcgatgtggcggtgttattcccatgacccgctgggcagcttccaagaaaccagtctttgggtttttgggttccgaggggagtatggttgcaaagctgaaacttaaaggaattgacagaagggcaccaccaggagtggagcctgcagcttaatttgactcaacatgggaaaactcacccagcctggacacggacaggattgacagattgatagctctttctcgattccacgggtggtggtgcatggccttagttgctggagtgatttgtctggctaattccaataacgaacgagactctggcatgccaactagttatgtgaccctggagcggtcggcatcccccaacttcttagagggacaagtggcgttcagccacctgagattgagcaataacaggtctgtgatgcccttaaatgtccagggctgcacgcgcgctacactgactggctcagcgtgtgcctaccctatgtggcagatgtgggtaacctgttgaacctcattggcgatggtgatcagggattgcaatttttccccatgaatgaggaattcccagtaagtgctggtcataagcttgcatgaagtccctgccctttgtacacactgcagtcgctactcctgattggatggtttagtgaggccctcggatcagcccgctgggtcagcccactgccctggcggaacgctgagaagacagtcgaacttgactatctagaggaagtaaaagtcgtaacaaagtttcggtaggtgaacctgcggagggatcattaacagagaagagcgaagccacggagacgccgccatgtccttcctccttggctgaccgtgttcccctgtggcgcatgcatgggcggagtcgtgccctttgttcgttgcatggccccacctgccccgagagccagagaactcgggagggagagagggggtagaa

SEQ ID NO: 3214 - DNA, 1063 bp, Homo sapiens
gcctatcttctgtcttactctctttctctgcctgtctgtctgtctcccattctctgtctgtctccctctctctgtctgtctccctccctccctgtctgtctgcttctctctgtctctgtctctctctctttctgtttctgtctgtctctctctctccatctctgctttctctctctgtctctttctctgtctgtctctccctctgtctctctctgcctgtctctctcactgtatctgtcttctgtcttactctctttctctgcctatctgtctgtcagtctctctgtctctgtctctctccctccctttctgtttctctctctctctctttctgtttctgtctctctctgtccgtctctttctctctctttctttgtctttgtctctgtctctctctctctctgcctgtctctctcactgtgtcttctgtcttactctttttctctgcctttctgtctctctccctccatgtctctctctctctcactcactctccatctctctctctttctgtctgtttctctctatctctctctgtccgtctctgtctttctatgtctgtctctttctgtgtcagtctgtcagacacctcatgacggggagggctctgccccttccacgaaagtgagaagtgcatgcttaggtgcttagagaggctgagaagaatctagacagacgggccttgctgggcttccccactcggtgtatgatttcgggaggtcgaggccgggtccccacttggatgcaaggggcattttcagacttttctgtctgtcacgtgtggcgtctgtacttctcatatttccctgataagttcctcaacttaaaagtaaacggttaaggccgggcgtggtggctcacatctgtcatcccagcactttgggacgccgaggcgggtggatcacctgaggttgggagttcgagaccaaccttgccaacacagcgaaaccccgtctctactaaaaatacaaaactgagtcaggagcggtggggcaggtgcctgtaatgccagctacttgggaggctgaggctggagaatcgcttgaacctgggaggcggaggc

SEQ ID NO: 3215 - DNA, 2008 bp, Homo sapiens
tcagaatgacgtgtcctccctgccataggttgactccttgagtcccctatgccattgcactctagcctgggcagcaagagcgaaactccgtccccccaccttcccgcgcaaaaaataaataaataaataaataaaatctctaggtgtgttcccaagagtgatgtctaagaaatggcactgtacactgaacgcagtggctcacgtctgtcatcccgaggtcaggagttggagaccagcctcgccaacattgtgaaaccctgtctctactgaaaatacgaaactgagtcaggcacggtggggcaggcacctgaaatcccagctacatgggaggctgtggcagaagaatcgcttgaacttggcaggcggaggttgcagtgacccaaggttgcgccactgcactacagcctgggcgacagagcgagactcagtctccaaataaataaataaataaataaatgaaagaaagaaaaaaagaaaagaaaagaaagagaaaataaaagaaaaggcactgtatcgctactgggctaggaccttctctctttctatctgtttctctctgtctctctctgttcgtctctgtctttctctctgtgtctctttctctgtctgtctgtctctttctttctctctgtctctgtctctctgtctctctgtctctctctctctctgcctctctcactgtgtctgtcttctgccttactcactttctctgcccgtctgtctctctctctccctcgctgtctgtttctctgtgtctctctctgtctctgtttttctctgtctgtctctttctctgtctgtctgcttctctctttatttctctgtgtctctgtctgtctctctctctctgtctcttgctctctgtgcctatcttctgtcttactttctctgcctgtctctgtctctccctccctttctgtttctctctctctctctctcactttctctctgtctgtttctctctgtctctctctctttctgtttctcagtgtctctctctgtccatccctgtctttctctgtctctttctgtctctgtctctctgtctctctgcctgtctctctcactatgtctgtcttctgtcttactctcctctgcctgtccatctgtctgtctctctctctccctccctttctgtttctctctgtttctctgtttcctgtttctctctgtttctctgtttcctgtttctctctctctctgtctgtctctctctgtctctttgtctgtctgtctctctctctctctctgcctgtctcactgtgtctgacttctgtctttctctctctctctgcctgtctcactgtgtctgtcttctgtcttactctctttctctgcccatctgtctgtctctctctgtctgtttctctctgtctctctctgtccatctctgtttttctctgtctgtgtctttctctgtctgcctctctctttctttttctgtgtctctctgtctgtctctctctctctctctgtgcctatcttctgtcttactctctttctctgcctgtctgtctgtctctctttctctgtctgtctccctccctccctctctgtttctctctgtctgtctctctctctttctgtttctgtctgtctctctttgtccatctctgtctttctctctctgtctctttctctgtccctccctttctttctctgtctgtctctctgtctctgtctctctcactgtgtctgtcttctgtcttactctctttctctgcctatctgtcagtctctctctctctgtctgtctgtccccctccctttctgtttctctctctgtctctctttctctttgtctctctctgtccgtctctttctctctctttgtctttctctctgtctctgtctctctctctctgcctgtctctctcactgtgtctctcttctgtgttactctctttctttgtttatctgtctctctctccctccctgcctttctgtttctctctctctgtctctctcaatttctgtctgtttctctctgtctctctctatctctgtt

SEQ ID NO: 3216 - DNA, 1154 bp, Homo sapiens
tttgtctcgtacatccaaagtcatgttaaatactttgaaaggaatagaagagttttaaataacatcactaagagttgaaatagatatgtacattcttctccggaatttaaaatccctggtttaatgggttctgactctactttcttgttctcaatttctacctaaattctgtgctcagacacgaatgcttttcctattagacgttttgaccctgaaccgagttcttaaccaagtaaaagcagaatatggtctctctgttaaaacaaatataacctgtgaataaaatggtgccctggaaaagcaccttctcttactacaggtgagctggttattgccaatgtatgtacccgctgtttccccagctcatctcagcagagagccagcctttattttgaatacccaatattgtttcaggtcaggaggttctgtggctaccatccaaaagatgttgccctttagtaagtgtgcagcttgagcaaatacttggggcattctagatcattaaccaggtatatcagttatttcctggtctaagaaacaaatgaatttgaacagagcaaaatcacgatgatatcagtccttgaactttgaccttacttttattcacttgtggctaaaaaactgtcttttgtttttttagaacttggcttattaatgctttgtgaaatggagagaaaataggctgtgacaggaaatatagttttggaatgaggaaatagttaagaaagaagtggaacaggcctgctggaaaaaaacatacactttcattactgagatctctgctatatggtaaccttttagctatattgtccttattgattttgtctgcacggcgagcacagcatggcgatgaagagaaattgccaggtgtggggtgaaaggaaaatggtctggccaggggtctgctgttggcatttaagccattgcaagattcaggtgttaattggcctgacaggcatatctgaggaggcagaaccacaacctttgtggcttagaagcttgttcctgggccctctggagcagtttctgggtctagaaaggtggccatcttcccctttacagctttcggttgtaagacaagggattgggctgtgatggattggggttcacaacccacctgggcctcaacccagaacagttccatagagtctccg

SEQ ID NO: 3217 - DNA, 1204 bp, Homo sapiens
cccaaatggatccccccaaagagcttttagagttttattcttaccccttctcttcccctttatctgcccttcactgtctgaatctgggctgtctcacatgataaccactaggcacatgtggctattgagctcttgaaatgctgcgaatctgaattgaggtagactataaatgtaaaatacacaccaaattctaaatatgaagaaaagaatgtaaactatttcatacatgtttcaatgttgattacatgttttacatggtgatattttgtgtatattacgttacataaaatacattttaaaaattaagtttacctgtttctatttatcttttatgtggctaccagaacatttaaaattacatctgtggcttgcattacatttcttctggagaacactggtctaaattcgtgtgtgtgtgtgtgtgtgtgtgtgtgtgtgtgtgtggtccctgtattcccaacatagtgtcctgtaaaaggccccaggattcatccatcccttcccttctcgcttcccttcctctttttttttcttcccttctctttgcttgcaatgtgtctgctaagtgaatctctggaggagagaatgttaaagcatttgaacggtgacaagattgctcagacagaaggtttctagtgctttataccagtccaaagagttaagacggttgtgttttctctgattacaagtgaacagcaaacatctgtcgaggagtttttacagggtatttgtactttcacatgatctaattttactatcttcataagtagtatgaggctgggcatggtggctaacgcctgcaatcccagtaccttgggaggcttttgggaggctgaggcaggtggattacttgaggccaggagtttgagaccagcctggccaacatggggaaaccctgtatctactaaaaattagttgagcatggtggcacagcctatagtcccagctgctgcccctctccactcccgccccagaggtggaggttgcagtgagtggagactgtgctggaaaggcattgcctcaatagtgggggtatgataaggactcctagaagttaagcactactttagctcctcttctctccttactccctagaagattcagttgctggcgtggcatatctctttaaaagttccttatgggattctaacatccttttcccaagtctgccctgaaaatgagctctctggagaagggtggtggt

SEQ ID NO: 3218 - DNA, 1127 bp, Homo sapiens
ggttagttctgcatgtttccatcaaattaaaggttattccctggccgcctcctggagaaaaccaaccccaccctgccagctgggggcaatggggcagggattttggcctctcagaacagctcctagaggctgctcatgactgaatgttttcccaaatcacctaaatatcggtttgctttttgttttgggggagaggatttagcctcttacttccctgatggattcaaagttttatctatctccttatctcctgccctgtcttggcacaactctggatagattgcaggtgtggaatttgctggagtttggtgacttcgtcaaattcctttggattctgttccgccaaatcagcagtctcgtcctgtggatgcagtgactggaatttcccatctgcaaagcatctctgtagcccagattttgtggagccttaagacactccctcaatgccaccctgaccccacggctggagaaccctgtgcttatgtggtgggcagggccactgttgatggaggatggcggggacggggtggtgctcaaaggatctgtggtgctggaggtctacacgcctctcaggacagcgtgtcaggaacctcagagcagcttcacatctgccaaagctgagagggagcgaacttgggaagcattttgctcattgtcctacccaagtattaatagcataatagttgatgccaaaggagatggtgacgtcccttccactgtagttgctgtcacaaccttgacgtctttaagctaatggccgtttgcatctgtgtcttcaaacagatcctggttacagccattttgtgtgattcacttcgggggttaagtaatgcaggattctgcaaacaaggtgtcgccgtccaaatgtactgtcctggcatagagagcactgctttgttttccactgttgtagagaaaactagggagaactttatttttcaataaacttttcttgtgtgacaggtggaagtgatttttgggggggcgggtgcatgcagggtcacctccagaacaaagctgagctgctgtctaggcgcgtccccagcacacagcttcccccagctgtatttcacggtttgcagcacactgttgaaacggctggtaggaagacaggaaggtatacttaa

SEQ ID NO: 3219 - DNA, 1271 bp, Homo sapiens
gagtgcagtggcgtgatctcggctcactgcaagctccgcctcccgggttcacgccattctcctgcctcagcctcccgagtagctgggactgcaggtgcccgccaccatgcccggctaattttttttttttttttgtatttttagtagagacggggtttcaccatggtctcgatctcctgacctcgtgatccgcccgcctcagcctcccaaagtgctgggattacaggtatgagccactgtgcccggccgtgtctggcatttttaaaaataaattacttttttttattttttattttttttgagacggagtctcgctctgtagcccaggctggagtgcagtaacgtgatcttggctcactgcaagctccgcctcccgggctcacggcattctcctgcctcagcctcccaagtagctgggactataggcgcccaccaccatgcctggctaatttttaaaatagttttagtagagatggggtttcacagtgttagccaggatggtctcgatctcctgacctcgtgatccacctgccccggcctcccaaagtgctgggattacaggtgtgagccatcgtgcctggccttaaaaacaaatttctattagcagatgcagggatacctgcatatagtgatggttcatgtttgtttcactgtagactgcatgctgatagaatctagtgtgcctttaaattatggaaaataaattttcttcatttcataataactaagtcacccaatgttttgggatcattttagtgtgtatgtatttttggagatagcgtgcattgaaaatagattagtaggaaatgcgtaaaaagtttacaattatttctgaaatggtaggattttgggtaattttttttcttgattttttactatgtttttaaatgtttttatgataataatgctttatatttgagggaaaaaagcaaattctagttcttagaagcatttgtttgattattggaagcatctacattgatgagtatctcttactaatcttataaattctctctcccatccctgaccactcagctcccttctctggagggaaccaaatcaagaaaatatatttatgtttgttttccttccatgttttacaaaaatagtattaatagcattttgacatacttttctatacctttttcttttcttttttttgagacagagtctcacattgtaccctgagctggagtgcaatggcatgatctcggctcactgcaacctccgcctcctgggttcatgcagttctcctgtgtcagcctcccgag

SEQ ID NO: 3220 - DNA, 1159 bp, Homo sapiens
tccctgcaactcccagcaacagtagatacttagaggtatctaatggataaaaaggaattttaggaggaggaaaataaggcatctattgagtttgtgccccttttaggaatattttgtacataagcataatactgacaatttcattcctgctggtttaacttcataattttattttggcaatcttttaccagcacatattagatcaactttggttttttattaatttcccatattcaattgtgtataccacagcttgattctttagactcctgttgagtgacatttggttcattttcagtgttttgtattacaaacaaaattgtagtaagcatccttgaacgcaacatccttttatatttggctataagagaaatttctaacaaattgatgtcttcaatggtgtgcacatcataccaccaaaatcacataggagttcctgtttatgtgaaaaagggtatgtcattattttggtttgtgtttagttaattatgggtgagattgaacatgttgttatatatttattggctgatgtctatttaaatctgttaagattctttcttttgtggtcaggctactctgaacgcccggacgtccattttggcagcagcaaacccaatcagtggacactatgacagatcaaaatcattgaaacagaatataaatttgtcagctcccatcatgtcccgattcgatctcttctttatccttgtggatgaatgtaatgaggtaaccccatgagcttccttttttatttccagttggagtaatcgagtgagacaaggctggaagatacactgctcaacagctggtgcatgtatgtgcaccagcctttgatttccctcagggtggcacaggatcggacaaagggtttagtaagcaactcaaaataaagtcatttgaattgcctcttccacttaattgtgttcaagaattaagttttcaggttttgttactatttatttctcaaaaggaaacaagttacagttaacttccaaccacactttttatttttttaaacagcctctcactggagactgggctggagtgcagtggcacagtcttggcctactgcaacctccacttccaaggttcaagcgattcttgagtctgagcctcccaagtagctgggattacaggcatgtaacaccatgcgtggcta

SEQ ID NO: 3221 - DNA, 1219 bp, Homo sapiens
accgattttgataaaatgacacagacacacatggagtggttttaaggagcagagagtttaataagaaagaaggaggaagctcccccatacagagacagagggaggggaactccaaagctgaaagaggaaactctgtgtgctgtggaaaagtggctgcttatctaaggaggctggaggaggaagtgactgatttgtatagggctcaggatattggtttgactaggcatggtagccggcaaaaaaatctggccctcccactctagctttttaatatgtaaatgcaggccaccatgatgttctacccacgtggggatatatgggggcagccatgttgccaggcacatgttgggccaagggcaagaagaatgcaggaatcaccatgtttgggtggacccagtttctaatggccagcatggcccatctaagagctggggctttcctgctagacaacaaacatttctggagctgctttaaaagaaacaaaaacttcccaaggaacccttttcctctctatctgccaaaagtaacttcttaataactcctataacagtaccatagatgcaatgtccatgcttctagctgatgtgagtgtctctacttgtgcaccaagtcccaactcctctgtgctgtctgaagacatcacggcagcaattatcccctctttttcccaaaccatgattttctcttctctattaagtctttttcaccaacataataacttgctttttattcttctaccttctttttacctctacttcattctcgagccactatttatttctgcctttccctttacagaaaatttcctggaaagtgttttctatatttgctgggattcattttctttcataattcttccttgattccaccccatgttttctccacaccactccattaatgttgctcttggcagccccatcagtctgctcttggcagacctcagatccagtggtaagtccttggtgctcaacttattccatctactagcagtattttacatgttctatcttgaaacacattcttcaattgactttcaggacacccccacccctgatgttttgcctcacacctcatttgccactactttttaaacttctttttgagtttttcctcatctccctgacctcttaatggtggagtaccaaggacttcattttggaatttttattttcctgtttatgctcactttcattctcttggggctttacatactgcttaa

SEQ ID NO: 3222 - DNA, 1225 bp, Homo sapiens
gcctttcactaaactaactcagttacttaaactaatctctttgagtggaaatccttacacctgagataggcttgagactatctgatcaccttagcacagctcaacacagagaaaatacagcagaatctactcttaacttgtaagagctttactaatcaaaagtgttctgagctcacaaacctaggtcttcctgggtaattccacttctttgtttcttagctgtagacttattgatgtttcaagtcacttgagcacaggtttccctccctgtgctttaagctcagtgttgatgacagatacacttactataacattgcaagtgttatgcaactatatacctcttctccatacctttgttttggaattctgcatgctgaaattccactctatagtatgattttatattttaatgaaatttttaaaatgaggctatgacaagattaattaagtaaaattaaaaacaacaataaagagctgcaaattcatttttcttcttcagtagctttactaaattccttccttccttccttccttccttccttccttccttccttcctttccttccttcctccctccctcccttcctttcctccctcccttcctttcctccgtcccttcctttcctctctcccttcctttcctcctttcttcttttcctttttccatagtagtagctggaataggatttttaacaaaataacagcacagataaatttttcctttctggaaaataaaaaaaaaatggagttctgtaaaacctctaggttaatttctttttagaaaatttggaatacatataagattaagtaagaagtttaaagaattactaattttcccatggtgaatcattacagaaaataaaggctaccatttagcttggtccattttgagaatgcctctaagttctaaatcacccccaggattttttttagcacttttcataagagtttcgttttatggatagaaatataaaagtaaaaaaccagctacataaatttttaattaacagaagttatcatctaaattaaatacattagaattattgacaatagattatgagtggattaagaaaaaatgcaattgcatatattaggaaagttattttccaactggaaagtaaagtaaaataatcaaatgtaatttaaaagtctgaatatgcattattttaaggagttggttgttatataaggggatctttttcttttttagtttactgatcaaatat

SEQ ID NO: 3223 - DNA, 1209 bp, Homo sapiens
ggctaattcttttattttttttgtacagacagggtctcaccatgttgcccaggctggtctcaaactcctaggcttcagcagtcctcctgtcagcctgtcagtgctgggaattacaagcatgagcccccatacctagcatcttttaaatatttattcctgtgaaatctttctccttattaaattgaagatcctatgatttctaagaatttgtaacaagtgccttaaaaattaactttcctggaattatttaaaaacaaatgtttagtgtcattataactaagttatacatgaagatttctaacgtaccattaacctgattttaagtgtgttcttttacatgggtttgtttttttttgtttgtttgtttgtttttttgagacggggtcttgttctattgcccaggctggagtgcagtggcatgattgtggctcctgcagccttcaccttctgggctgaagcaaacctcccacctcagcctcccatgatgcttggcttttttttttttttttttttttttttttgtgagtggggactgggtggggggcagattcaaagacagaattttgccacattgctcagactggtctcaaactctggagctcaagcaatctgcttggcttcacctcccaaaacactggaattacaggcatgagccactacaccttggcctcttttattaagaatgcttttcacacacagttagatccattttcttggatgtattacagacaaactatcatctttagtattttaaggtggaaaggtaatttttatgtagttattataagagtatgaaaaaattgcattataatatctgtaattaccatagctgagaattcaaaacagttacagcaatctagaccacttacaagactatcaagaatgtgaacaacatcatttactcaatgttatttgggaaaattagtatataatataaagatagttaatatcatacttattattaaacataatatcgaatcacataatatctttacagaagcaatacaactttcccagaacagtgtttatttcataagatcttgttcttattttcaaatacaaattacttttacgtctgagctacttcacctgacaaacttatatgtaagtgcattaaataaaacaaatttatagtatttcaaataaaattaaaattggatttatgagtttcaacttccaagtaaaacaatattaattgaatcatttgtt

SEQ ID NO: 3224 - DNA, 1226 bp, Homo sapiens
ctgaggcaggcaggtcatgaggtcaggagttagagaccagcctggccaacatggtgacaccccatctctactaaaaaaaaaaaaaaaaaaaaaaattagctgggcatggtggcaggcacctgtaattctagctactagggaggctgaggcaggagattcagttgaatccaggaggcggaggttgcagtgagccaagatcacaccactgtactctagccggggcaacaagagtgaaactccgtctcaaaacaaaagaaaaaaaaggacagataataataatagttaatgtttactgagcactcagtatgtgaaaacaactctgttttgtgactttacattgtctgatttaatctatattatatcacaatgagatagatatcattgttttgcccattttataagtcagagcactgagatataaagggagatcaatggtggcttgctcaggatcccacggccactcctttgggctaaagataacatgacctatacttggaataatcatacattatataattaataactaggtctgtggctttttttgtttttttttagacagggtctcagttctgtcacccaggctggagtacagttgacgtgatactggttctgtggcatttttaaagtaacattttattaaactaaaaaggcactattttaaggtagtaacccacctagatgagtcccaatgatcataaatttttctgttacaaattttctgagttccaattggcattacattaaacattaatgttcccaaattgggaaagttaattgtcatattaattagaacacattgaaaataaacactatttatatacatttgattttcaagtgaatttggctgtcctccctttttgtgtgggtggggtaagcaacttcgtatatcatattgcatgaactcaagggagctaattagggctcattttccccacagttctcaaagtgtatgaagttgtgtgtgtgtgtgtgtgtgtgtctgtgtgtgttcatatttatgacagagagagaaaaagaagagggagagacagaaaaactccagttaaaaagcaaatgcccttgagacggatctagttagctgaaagtcacatgaagctgtatgtgtctgtggatggagtgtgttgtaactggaggaaagttgaactgaaccatatgtccctatcagggtaggaagatccaaagggaaatcagaaaactgtgagtaggactttagtgcctgagagtaa

SEQ ID NO: 3225 - DNA, 1176 bp, Homo sapiens
aatgctaaaaatcgctgatttttttcctggacaattggttgataagcatttatcaggacatcactgattgaattaaataatagaatacatttttatattgttgggggagtattgtagtactggtgaagaatcagagtgtcataaaatcccaaagggaaatagctctcccacccatccaaaaacattttatttctacacaaaatttcattttaaaaaagaatcatactgccaaaaaaaatgtttaaaactactactttttaacatctctgaaaagtgattccctatccccattgtttgacattttcctataattgacacatttggataaatgacttttaaaacattcttcttttttttatattgtctcatagtgttagtatttatatgatttattaatatttatttattaatatgttttcattacattgcatttggaaatccacttgttcttttgtttatatgcaaattatctagtatggggaagagagattaattctaggtttataatctttaatttctagaaatattgtgaagcatgaccaaagacagtgacttgggaaaagaaataccaggagggacataatagaagttttaaatgatagaagtaggaatagtataaaataatcaatttaggtaaataatagactgtaacaagtggtagcaatgtagcatagtgaaaatatcagtgacctttggaatcagagacatctgggttgaaaaacaaatatctttatatactagctgtgtgattgtaatcaagttttttaacctccctgaggttcaatttcctatctatacaatggaaacaatacctagaacagtaggttgtttctaggacaaaataaaaggatatatgaaaagtatgtagtattggcatgtaataatggaataaccattttaaaagttttaaaagaggcgaaaccccatctttactaaaaatacaaaaattagctgggcgtggtggtgggcgcctataattccagctacttgggaggctgaggcagcagaatcgcttgaacctgggcagaggttgcagtgagctgagattgctccacttcatgccagcctggacagaaaagcgaaaccctgtctcaaaaaaaaaaaaaaaaaagtttttattttgaacatatttgtctataatcacattacattttgataatgcagtatatctttttt

SEQ ID NO: 3226 - DNA, 1206 bp, Homo sapiens
ttcagatatgagttataggtatttcttagtcatttgtatgtatgtataaaatgtaaataaaccaatatctacttttttaaagtttttattgtggtaaaatataacataaaatttaccatcttaactacttttagccgtacaattcagtgacgtaagtatattcatattgtacgaacacatcactatgcatttccagaaattttttataacatctacttttaaagatgaaaaaacataataagaatttagggcctcagatgtttagctcttaattttagatatgaacatttacttttccctgagaaagaagcccatattacttatgtctacataatctccatcattctctaatattcttaatatgtgatcatttattctttacacacaagaaatgaaatatctacttagtttttctgttttcataattgtaaaatattcctggaacttcatatcaaagctatattcctttcaattcagaaaaagcaattctaatttattagagttgcaaatcattttggggattcattgaggtgaaacatatttgctatacagaataatatgttctgtattttagacaatttcaaactgaagcttaattgcttcaatctgtagagctaaaaaatattggcagcatctaatgaattgaatgataatgacaaaatgttacacaggtaaatacatcaacatagaagaactcaaaattctcatcacatttttacctctctcatctaatttatcctaaagaaaaaaaaaatgaaagaattgtgctaaagggaaaatttgtgctttttatttcattatttataacatcacgtctaactgatgtgaatatggaaaagataccccccccaaaaaaataaaaattctcgtctgtttgaaaggaatttgacattttcattgtttccttgaaattgttctttataatttgaagacaaaagtgttgaaatcatattaccattgctaaaccgaaatataaaatagtgaccctctttgatggtaatgtgctggcacaaaattgcaaagttttcaagctcctttgcatccttgaagtgaaaataggttattttccaactttccactgcctaaattcaaactactgacctgatttgctactcctctaaatattaaccttagaatgctatttcaaattcatttaactatatgctatattggcatttttaaacaaagagcattttgtttctccat

SEQ ID NO: 3227 - DNA, 1151 bp, Homo sapiens
ttttgcaaaaattattgtacaaatttgatattaaataaagctaacaaacacttttatagaaataaaaaattttgctttgtgaatagaaacaccacatagcatgaagcaggagcagatacaaatatttccataatgcaatagcactttaactttcaattttgttttgtttctgttatctgatactgtggagagaattctagccatcttgcccttaatacccagcagccagctatggagtaaaagtccagagtattagtaggaaaagagatttgaatccaagggtcccgagagttgccactattgtcccttgtcccctactatcgtataaatcaatatattccaatctgactacgttttcacctgaagatttcagagaatcaatactgccctactatttcttttgtatttttctatttaggaccattcagaagctaggccaagtacccagagggagagaagagaggaaatttctgtgcatattcaaatatgccttttaaaaactacaacataacaaagtattccagcttcatttttaaaattttgtcctatttatatcattttagacacttaagtgagctgctgaaaagaactgctctccatggagagagtaactctgtccttattatcggaccccgaggatcaggaaaaactatggtaaaagctgttgatttctggtgtttgttggcatgtgatgattcttattttatataagaataaataaattcatatataaatcttattttatgtaatactgaaaatacttttcattattttgtaatgttttacttttttgtttttttcttttttaatcacagaagacatgtaaaactttataaacttagggtggtatatttgagtgtagcagacctttttcccccttatttgtcctcctagtgaaaaattgtcaattgatgtttgttccaacatggtcttttgtccttaaagaagtagagatttccagtggaaaaagaaaatagcatgtattgagcatgtactatgtgtctttttattgtgttctctcatttattctttacatcaacactgcacggtagggtttttccctttgttataggttagggaactatcatatcatgcattctttttatttttcctacatcattactatttgtttaaccctaacttacacagtt

SEQ ID NO: 3228 - DNA, 1202 bp, Homo sapiens
gtgaccgggcggcggcgggagaggcgcacgctcccgggcgcgggcgaacttgcgcacctggcacctgccacacagcgaaagcaccggccagcgagcggaggggcgccgcccccgccccctctccccggagcggaccgagaccgagcacgctcccgcgggccggcagcgccgcggagagagtgggtgggcaggcgagggaggggaagggagaggaaggagggagggagggagagggcgaggcgcgttcccgcgacgggggcgcgctctcgcgcgggctgccgggatcgctcgccgccgctgtggtaatgtccgccatgttggccatggcgcagggagcggatcgggcgggcgagcggcggatctagtgtgtggaggcggccgcgggcgcggggggctgttttcgggcggggtgggcgcccatgctgtggccgggggcagtgaggaggaggaggagcgggccggccgcgctgcactgaggaaggaggtggaggaggcggcgggagtcctccccccctccccgcccgccccgccgccgccgcccgggctgttcctgtaaggcggggagacaatgagtaaactctccttccgagcgcgggcgctggacgccgccaagccgctgcctatctaccgcggcaaggacatgcctgatctcaacgactgcgtctccatcaaccgggccgtgccccagatgcccaccgggatggagaaggaggaggaatcggtagggactcgagtgtttattacccccccttccctcctcccccctcccctttgtcagtcgggcctcgccattcacagagcgctttacgctcgctggagggcgccgctgccgctctaacgcacgggactctacgccggcggagtagcgtaaaccctctcggccggcgtagcgcccgcccgcggccgccatgttgttgcgtcccagtgttgtgattagctcgcagcgctgcttacgctgccgtaagggggccttgccgtaagcggcggccgggaatggcgcaggggatgcgctggccgctcttggcgtacggtctctgtttacctttccacctccctctctcaggcgcggggctaattaatggcgtggtattatttggctaggcaagattattattttttccacttttaactttggctttgtattgagttctctttgaaatgactgtggaagggtgctttcaaaacaaacatcttcctcccag

SEQ ID NO: 3229 - DNA, 1132 bp, Homo sapiens
ccactggaggacaggaacctctacttgcacccatgtgtgatctttgagtgggatacaccactggctgaagttcaacagaaagtagcatctccatgtagtgatcaggagtcccccaagtgcacaggtcccaggaatcttcctgagcttgggaccacagactctatgatgtgctctgctggcagatcaggggactttgagtacctctcctgacttttcctcaacagtctgctaagtggattctcttggctagaaacatgagaattttcaaccatttcacttgtcttggtgtcttagtccaagagtgtgtaaatacaagagtgtgctcaatacaccatggataaagtaagttgataaatcacttcctgtttctaattccaactcctcttccatgcccatacaggatgttatgagttgaattgtgcccttcctctccatgtgttaaagatacaaagttataacttctgataccatagaatgtaaatttattttggaaaagtgtcgcattccccttggtctagtggttaggattcaacactctcaccgccgcagcccgggtttgattcccaggcagggaagccttccttctttggctctgcctgccaactgccaggccccttcacacctccccttttggccgggcacggtagctcacgcctgtaatcccagcactttgggaggctgaggcaggcaaaccacaaggtcaggagttcgagaccagcctggccaacatggtgaaacgccatctataaaaaaaatacaaaaaattagctgggcatgctggcaggcacttgtaatcccagctacttgggaggctgaggcaggagaatcgcttgaacctgggaggcggaggttgcagtgagccgagattgtgccacggcactccagcgtgggtgatagggagagactctgtctaaaaaaaagaaaaaagaaaaaatgtcctacgtgtccttgtagatgtcattaattaaggtgaggtccttagggtgggccctaattcaataggacttataaaaaggggaaatttggacatgaagacaagcccacatacagggagaaagccatgtgaatgtgatgatggcaatccacaagccaaggagagaggcctggcacagatcctttcctcatagccttc

SEQ ID NO: 3230 - DNA, 1178 bp, Homo sapiens
gattacggtatgtttgacatttcatattttgggctttttagaatcacccttccattatacagtctgttaaactgctgaaatgtctgtaggtcttccctttattaattttaaaatttattgtagatttattgtatgatttccttttaactcccattcagatactagcagaatatcagcagacactagtcagtgtgtgtgtgtgtgtgtgtataaaataaatgtacttggcttttcttgaatatttacaattaggaacacaaactgttaggtatctaccactaactttggaatagttgccatatattgaatgtcagtgattatctttgggttaccgaagttttacactaaagttttcccagaaagtcaaactcgtttgctggttattaatctgtgtgtgtatatatatgtatatatttctgtgcaggaggagcaaatggacagtgacattgtcattcctcaagatgtcacggaagactgtggtatggctgaacatcttgaaaagtcctccctttcgaataatgagtgtggttctcttgacaaaaccagtccagaaatgtcaaacagtaataatgatgaaagaaaaaaagctttaatttcatcaaggaaaacatcaactgaatgtgcatctagtacagaaaattctttcgttgtcagcagtagttcagtttctaataccactgttgctggaactcccccataccctacaagtcggaggcaaacctttattactttggagaagtttgatggttcagaaaatagaccttttagtccatcccccttgaataatatttcatcaactgttacagtgaaaaataaccaggaaaccatgattaaaacagattttctaccaaaagcaaagcaaagagaagggactttttcaaaatctgattctgaaaaaatagtgaatggaactaagagatcaagccggagagctggtaaagctgaacaaacagggaataaaaggtctaagcccttaatgagatctgagccggagaaaaatactgaggaatctgttgaaggcattgtagtcttagaaaataacccacctggtttgcttaatcaaacagaatgtgtgtcagataatcaggttcatctttctgaatctacaatggagcatgacaatacaaagcttaaagcagcaacagtggaaaatgctgtattattggaaactaatactg

SEQ ID NO: 3231 - DNA, 1216 bp, Homo sapiens
agaatgtttttcatctggtgtctctccttggggaattggactgaaatcaaatttcaggctgtgagcacatgtcacaccaggatttatggcacaggacaccagaatttactcagattttgttttctaaaggactcagaatcaccgtccttcagagtcataatattccttccataaggatctattgaagagattgatgaaattgtattgatgaaatttcatcactgaaatttgtatgaaatttgatgaaattataagagagaaacagcttatatccctgggacggtgttttcttttttctttctctcctccccatgggacatgctggccctgctttccaccccattgtaccaggtgccttgtgccctgctggagccctggggtgctcaggacacaccctgaagctctgatctttctctgctggttgtccatcagaatgtatctgtcatgtggctcacgttctcagaattttgctaaattgatgatctcattatatattgttaaggaatgctaatggtttaaagtgcatccaacagccttctgataacatttgcatctcagtaacaacctttagtggagtgagtaatgtaggattttgaggccccttagggtgactagccatcagggtttgcctgggactgtcctgtgtcctgggaaacactgaagtcccaggcaaaccaggaaggttggtcactgaagcctcattgggagcctttttttttttttgcgacagagttttactcttgttgcccgggctggagtgcaatggcgcaatcttggctcactgcaacctccacctcccgggttcaagtgattctcctgcctcagccttctgagtggctgggattacagccacccaccaccatgcctggctaatttttgtatttttagtagagacagggtttcgccatgttggccaggctggtcttgaactcctgacctcatgtgatctaccagccttcgcctcccaaagtgctaggattacagccgtgagccaccgcacctggccttgggaggcattttattataataataataataacaacaacaatagtagcagcagcagtagtaataataatagctaacatttatgtagtgctttgtgccagtgctgttctaacttctttgtatatacacacacgcgcacacacacatgtaattcttttttttttttttttttaaagacagggtcatcttgctccatcacacaggctgaagt

SEQ ID NO: 3232 - DNA, 1283 bp, Homo sapiens
acctttcaaacagatattagcaaggttttgaatgggcttatctgtcatcttattaaactaatttttgaatattctctcattccttgggagagtctctgcctacagacatctctttctttctaaggtaatcaactgactgcttccttgtcctgtttgctcactcagttgaaattgtgacttctggtcagagttgtgcccatggtgtattagatagaatcagaaggtaaaagggatcagaatgtgttcactgatcatgagattaatcccagaatttgcagaactctttgttaaaagattggggggcactttctatgtcacaggcactatggtaattgttaaggaagcaacagtgcacaagacccggtccctgttcctcctggagctcacattgttgcctgagtgaggagggcgaaccgtgggaaatgctgtgatgtggtggcacctgagagaccccacagcagggatgtgtaatctctaactggagagggttgtgcttttggtagggaagtgaggagatgtctgggctgacttttgaataaccagtaggaggaagttatgcacagggaattaggtggtgagatagtttttgaggagcaaggttcaatgtgctcagaagcctaggacaagaagtgcaagaatttgatacaatgagatatggctggagcatgtgtgaggaaattatggcaagagatgaggctgggcacaccagaagtggcttgtaattttttcctgaaagaattcaaattttatcttaaagaaagggaggtgtcatggatgttgtgtcaacagagtcatctgattggacttgtagaatattttggtattcaaatggaaagatatatgggacttgaggggtgggcacagttggatgcagaagactggtaaggaggctgtcacagggaacaaattgggagagcctcaactgtagagactgaaaaaagaggagaggttcaaaagttgttagggggaataccaacagaacataaagtcagtggagagggggaagggaagcatcaaggatgattcctagatttccaaattggacaactgggtgggtagtcactctgttttagaatataaggacttgattttcgaaggagatggaggtgagttcactattgcacatgttgagtctaatatatgtggaccatgggacatctgaggagaggtatctggtaggcagttgaatatgtggttgttgaacttcagacctgtatttgaactggatgtgtttatttatgaatcatcagaagatggaacgtagttgaagctaagggagagga

SEQ ID NO: 3233 - DNA, 1150 bp, Homo sapiens
ccacaagactaggcagcaagggaaactcgtgatccgggcagccaacgattgtgcctgcctgcgggttttcttttcttcttttgttttcatgaaaacttagaactttggcagaggactcgagttctagatcaaaaatcggttttctgaggtgtgctcagctacaggacgttcaaattgcctgccttcaggccttgaaaaaggaatggtttggtatgggaagtgatgttctggatggcaggttagctgtgtgctctttgggagaactgagctctctctcccgccacctggaaactctggtgtggccgtcggggagacagatgaggttgcttgtgttgctttgcatctcctgtgatctcccacagctgctcccaccgttgtgcaagatgggacactgaaatgaaacggcctaggcataactctcaaggcggcctgggtgcatacttgacctgcttttccagagacaaacgtttttcttcaaaaccctcttcctactagacatatggttcttacctcctggctctggctttttttcctcctggctctggcttttttgtttttccatccatgctgtggtgctctgtgtgtgtgtgtgtgtgtgtgtgtgtgtgtgtctgaatacttgtggtggaggagccagtgacacagggaaaccagtgcagcagccataataataacaataatgcaattaagttctgcttgactaggatagcatttttttttgcttgagctttcatttaccctgctgattaataacacatggtgtgaattaatctttagaaaaataatgtcccatcattaacatggtggatttgtgttcttgttaaggctagcagttgcaaatatagtatttagacaattatgattgtacatcccaagcttcttggggcagggttgttgtggctacttttacactactgtgtgtcgcagttactgggtgcaattccttttaaaattgtttacaatattctaagcctctcaatcaagaaacaaaaacaataccaggctgaccttttattgagtagagacaaagcttttgggggaccaggtcagcttgggaaccctcttcctagggacgcatttggaccattgatgcgttccttgtcccaggtcagctccacttgctctttgacaatctgtgagaggagttgaa

SEQ ID NO: 3234 - DNA, 1182 bp, Homo sapiens
tgggggcagagtttgaatccaggcctgcctgagacagcctgcttctttctactgcactacactattatgttttctgagttagctctaagatgtcattaaatgtatgcttcttgttcgttcttcacataccctctgtactaaactcattatttcatacaatagctgctttgaatgagtccaacttgtgttatatgctgcaaaatctgaccttaatctcaagggactcaggatgtagctggggaaacaagcaacaataagcaacccagagagcttcataatcagtgtagatgtagatatgctaagggtttggagggaaggtgccttttctgaattctgagtgttcagaaaatgtttccttggaataggaagtaggtgagattctagctcagtcccaaccactgctgggctgcacttttcattctacattgtgcatttttgctcctttggtgcttatatgctttattcagacagtccaaaaaatatttcttgagcgtttactgtgtgccaggcagtgttgtaggcactggaggatgctgtactgaggtgggatcgattgaacgtctgctcccaaggaatttacattttaatgggagggcgtagagggggaagccagacctgaaggggatgcacaggtacagaaatggagcgtttagatggtggaaagtgccatgaggagaataaaatgggatatgtgaagtggtgtcatcccgataaggtctgagtgaggaggagcaggcagctagtgtgatcaggtaagagccctcgggagggaggagtagccagagtacgatttgtttctccgtttgctggttcaggagcagtttccagggaccctggagcaagtgaagggtcattccacagcatatgggatatactcagcccagacagcttcagaccttgcccatgggacagcctcaaggtggaggctcaggagtctgtcccctcactctgttgtcggtaacagagccatttcttataggtggttttgtgtagtcagagttctgcctcttgttaaattcaggtgattttcaaagaaatgagtatttcagaattgccattgttctagacccatgggacagactgtttgagaatggactgtttgatcagtgtgagctgtgccctaaatgcaggcactctgaaggccagtacttagaatggctttctttgtctgcttgaagctat

SEQ ID NO: 3235 - DNA, 1409 bp, Homo sapiens
cttccctaagtactctttctgagttaaccaattgctttttaaattatagctttatcagctacccctctaaaaatcatgcttcagtagatttttttatagggtgtacagttctatactttgaaaagctcctggaataattatgatattgcaaacagattttatcataacacttttcattagttttgccatatgcacgtcctttgttttatcctatgacatgtttcagaatgtcttttattgagttctttgtgaaattttccttaaaactttcctatgcagatgatcacaaatcatatttgagtttaaatacaagtttgtttgtttgtttgtttgtttagagacggggtcttgctgtgttgcccaggctagtcttgaactcctgggctcaagcaatcctcccacctcagccttccaaagtgttgagattacaggcatgagccaccacaccctagcctaactacaagtatttttgacaggtgattttgaaattttgggggagctaatgcaagtaaactactttacttgttgacatttgacactctaaattttaactggcaaatactttagatatggacaaagaagatgcattaatttgctttgaagaacacattcgggctttagaaaaggaggaagaagaagaaaaacagaagagtttgctgagagaaaggagacgacagcgaaaaaatagggaatctttccaggtaaaagaaaaagctctctttttaacttagttttatattatatttactgaactttgacagtgatacaaagagttttgagacaactgttcccagatcatagacttaggctttgtgaggactcatacacatttaactctttaagttcttcagatgaacattggtaaatgaggtttcggttgggaaaaacaacaggagagatgactggaaacaagatatgtgtggtgagtcagtagtagatgatatttagtctctggaggacaaagggactgctaaggtatagtttggggatgggccataatttcttaaacactaagaaaaggacctgggattgcatgttttttaggtagtagttcgttttcatcttcaagtatcatttttattttcagtgatagaaaatatcatggagcaatgaattttttgcatttcatatctcacctatttcaataattataatagctaatattctttgattgcttactgtcaatacaatttacatttgtaatctcaatttttatgacagtcttaccttataagggtacttactgtttttgttatataagtttatataactaaggaaatggagaggtgaagtgacttgcccaagttcaacagctgctgaatagtgaagccagaatttgaatccatgcagttttgattacagggtctcttccattaaccattgtattaggataaatgctaggttacaat

SEQ ID NO: 3236 - DNA, 1196 bp, Homo sapiens
tggacctgaaggaggggcgcaaggggttagagtggagggcaccgcagcaggctccccttgccgggtccgagggcgctgcgctgctgcgaacctgagcgcactgaggctgctactctggacagcgaaagctgcgcaagcccctcccgcatacccgattctttgactatggttagttgaatttccaggaggagagtctgcctccccaacctttatagccagctgcagaagaacggacagtgagcaggcaaacatagatgctttggggttcagggaaactaacctcgaaagggtgggagctttcttcaggcaaaggtgttgctagcagaggagaggagctttggggactgaggtatgcctgccttaaactaccatgcattcattgcttaggaaagcggtttccttggagagatcgtggtcagccttccctgaaacaacataacaacatagaggttttattcgcaaggctaaaggcacttggctgccaaagcccccttgaaatttctggtatccttgaatattttcagctttatgtgaaagctgcctttcctcagagtctcagtccgtctctctctctttctctctctctctttttctgtgtctctctctctcgctgtctccctgtctctctctctctgtctcgtttgcgttcatgccctctagtgttaaagaaacctgctggttcgagaatattgaaaagtaaggtcaacctattggttatttacttttggacctctcaccttccgggataattctccttgtattacacgcatcctttccttttcctcaaagaatgacttttgcattacattactaatctttctttccccccgcacccccctcccgcaatctctgttttttttttttttttctttccccacgtctcctgcagaataagaaccttcatattgaaaccctgttcgtttgatttgggaattggataggtctggagaatttgcgtagcctaaggcagactttgaacattaaaaagatgcatttctctgcactgtttgccataaaccaggatttcacatctctcctttagcccctatccaccttcaattccatggagaattttcctggctgcttctgcttgtttaaataaatgcttttatttcaccatttctgtgatgcttatcccattccagggcttaaggtacttgcttaagtaggggcactgtgtctcggatccgctttgg

SEQ ID NO: 3237 - DNA, 1180 bp, Homo sapiens
gttgagtatttagcaaaatgctttcaaaaattaataatctttaaaaaatggaaataaaagctatagaaaacaaaatttacaagcttgaagatcaaattttcaattccacaaatacttgattgattagagagtgggtaacaaaactgtttaccaaattgtccaccaataaaatgggaatggacagattttatctctactcagtagaaattattgtaattaaagggccatgttgtacagagacaactggctataatagaattttgtccacttctatcttcatcacctaaaacagtgcctggcttatagtgggtgctcacttaacaattgctgattgaataacgaatgcatgataagtttggtaccgttttcatgatcatagagtagccagtttatatatatgattaagaaacttgatgtaacttcattatcatggcccaaataggcttaaaaaattgtttaccttacacacaacccaagtgtaaaatattttcttgtgtctcttcttggcccatataatttgatttatagcccaaattgggcacatttatagcctggagatgatattttttccttcagaacctgccttatgttacattgtatatactttcactttctccacgatatacagaggttttcataagatcattgcatatttacattgtagtagtcaataagtcaagagagtaaagcgagttctagatggaatagacgtatcatgtggagtatgtggaatgaatcagtacatggaggactcagcaggagcactcatgaaaataagattgaggaactttgaaaaagatggagataggtggtatgtttgacttatgtgtaaaaagcagctaataaatggagacaatagcaaatgaaaataataaagtaataatggaaagttttaagagtgagaaattcaatcagaaaggaaaacaactgagagtaaggtgattacattgtagaacagaactcatggtttagccaataagtaaaactccatgtaagtatagctttgggaataattaaggaacttatttccaaaatcatctttattaaggtatattataaaaagctccattttaattttacagtttcatgagtttggacaaatggatctcagatttaatctcacaatcatgactccctctgcacaatgtccctcatacctctaggcagcccattcctccac

SEQ ID NO: 3238 - DNA, 1163 bp, Homo sapiens
ttctccaaagaggaggagcattgttgtctttatgtgccactataaatcctattagtagtggcattaattctattaattaggacagaggtctcactatctaaacacctaaaagtcttcacctccctatacctccatactgggaaacatttagaccatagcatatggatggagtacaattatctttattcttgcactggctggtggacatttaggtcgtttccatcttttcattattatgaataaagctgctacattcatacacaagtctttgtgtggacatatgttttcacaactcttgggaaaataccaaaggatggaagtgctgagtcatatgccaagtgtatgtttaattttgtgagatactgccagtctgttttcccaagttgttagactattttctattcccatcagcaatgtaggaaatatctagttacttcacatccttgccaacacatcatagccagaattttaaattttagccattttactgagttaattgtggtatctcattgtgattttgacttggatttcgtgataactattgatactgagcatcaatttctctctctctctgtctctccgtctctctctctctctctctctgtgtgtgtgtgtgtgtgtgtgtgtgtgtgtgtgtgtgtgtgtgtgtgtgtttggccagacttgttttatgaactatctgttcaatcttttgttcatttttaaaattggattgcctgtggcttgcctttttacttttctaaatgaggtctatgaaagagcagaaatttttaactctgatgaaatctaacgtatttttttatgcttcttttattgttctagctaagaaatattttccaatgccaaggccatgaaaattctttctggaagatttatggttttagattttaagatttgatttaattttggtgtagagggtgaggagggttaaagttccttttttttcccccccaaaagaaaccctccattcattcaaaaatatatgccccttgaagataagaaaggcatgagttttagaaataagaacagcatttttggccgggtcctagtgactcatgcctgtaatcccagcactttgggaggccaaggcaagggaattgattgagctcaggagtttgagaccaacctgggcaacatggcgaaaagccatctctacaaaaaat

SEQ ID NO: 3239 - DNA, 1195 bp, Homo sapiens
ctgggtgacagagtgagactgtgtctcaaatatatatatatatcctccaaaataaacctgaaaacataattgcacagtatctctttagaaatactgcataaataaatgtgccaaatatttatctgagttcaatctcatactctccttgtgttatgaggggctagaattttaaattatatttcttggactcccttgtgaactgtttgctggttagattctgccaaaagaaggcacttgttttggactgaaattttataaaaagtataggccatattgtttctgcatagcagaatactggaggtagccatttgctccaacaatggggaaagccagcagcatctgtgggagagtggacttcaggctcctgcagtatcatggtgtgcactcatagctgcctgctaggaagccactctgatggcaaggaagccacaaaaagagctgtgagtaacactactttctatttcactctctaaacctcctaacacttttatagccaattcatctattaactattttttcactggaaatacctagagtggtttcttttccccagtgtggactgatataacacaagataaaaaggaatttgaagacttagggagttatataaaacagatgtgaaatctgaataaactatgacatacagtgttgttaaggccttgagaattactctcaaacagaacttactgcagatagctgttagttttaggagatgtcttagtctattttctgttgctatagcagaatacctgagatagggtaatttataagagaagagtattttttttttcttatagttctaggggctggaaaatccaagatcaggcagccacatctggtaggcttccggtaagggtcttgtgctgtgtcataacatgatgagaggcatcacagggtgagaaggcaggaggctgccacttcagttttctcttcctttacttataaagccatcagtcccatcatgggagccccaccttgatgactttatctaaccctaattatctcctaaaggcctcaccttttaacatcattataatggggattaagtttcccacacatgaaatttggggtgcatattcaagccatagcaggaattacaataattggaatttctaactccctgtatataggcttttcttatactttttctattatataacaaattggtttgggacagccctagtaagttatcaca

SEQ ID NO: 3240 - DNA, 1190 bp, Homo sapiens
ccatttgtctctacagatatttcctgtaattgaggaaaattatattaacaagttcaaatattttgggttttcccctttcattacaattctgctagatactagaaaaatacattaattgcttgactgtgtaatatatgtaccaaaagagtgggttaatgagagttatcacacatgaggtgaaatagttcggttatttcaataagagcaatgacttttttttttaagcatcaaagttcaaaaataaactgttcagtaaattcatgtttgaggcagaaagtttcaatttacataacttgcctgtcttttctgcaactctaaggtaatattttgcataaaacctgagttcatttttggtgcttttgtagtgatgagagtccttaggactgtgtaatctgggacttgatcctcctcagtatgtgcctccctatcagactgcactaaacccaaggccctggactgtctgcctgcttctgtcctcaccacccttgcagattctctttgagttctttcacaggatcaaactcacactcttttcacactaaatactaaatttttgtacgtctgaactcctccttttcttttctttttttttttttttttctattctatttaaagacagggtcttgctctgtcatccaggctggaatgcagtggtgtgatcatagtgaccttgaactcctgggctcaactaatcttcccacctgaccctccccagtagctgggactataggtgcatgccaccgtacctcgctaatttttttattttttggagagatgatgtcttgctattttgtccaggctggtctcacactcctgggctcaagtaatccttctacctcagcctcccaaaatgctggaattacaggcataatccatcacatctggtcacctcctcctacttctgcagaccatgctgctaaataaatatctgcgtgttgaccctatctccgtagaacgaatgtttaggtcctagggactctctctctcaaaaaatcatttgtgtaaaccttaattctacttaaatacatctataaagtttttttttttcctaaggaatgtataaagccagaaatacactggctaccaggctacttctggtcccttattccttaagcctatagtgttatttcagaacttttgtaccttcttggctgggcgcagcagctcgtgcctataatcccagcactttg

SEQ ID NO: 3241 - DNA, 1170 bp, Homo sapiens
ctgttaaagttacatattgccttccctagaaacctcccctgatgcttcctgccttctctttccttcaggggtaagtaatcccttagcgccttgtccttatttttatcatttttgtttgtgttagaatgcttctctctaagccattagttttttaaaggcagaaaccagtaagtgattcatctttgtttacccatggtctaatacagtaggtgcccacaaatgtttgttgagtaaatgaaaactcactgcatatttgagtttccatattgcctttgtttggtgaaatctaaattatatattttttgcttctttcttttaacagtgcaggaaatttttctgatgaagtagtagatgagtgcagaaaaaaactgatgtccatgtagttatttaggatgggaaacagacttcatcctgtgttcttttccttctactgagtgacttttactgcttgatttatccagtgattttgctcactattgccattgttttttggtgaattgtaatcattaacgttttcagtggtacaccaaagaaatgcaaacaaatgtgattttctggttgtttaattgggcattttctggtgcccacttagaattgtgggattggggtatggagcattctagaatgttggtgaaaagtctagtcctttaggtttcttcaaatgttggtcttcttgggccaggcgcggtggctcacatctataaccgtagcactttgggaggctgaggtgggcagatcacctgaggtcaggagtttgagaccagtctggccaatatgacgaaaccttgtctctacaaaaatacaaaaactagtcgcatgtggtggcgcacaactgtaatcccagcttctctggaggctgaggtgggagaattgcttgaacttggaaggtggaggttgcagagatcacaccactgcgctccagcctgggcaacggagtgcgactctgtctcaaaaaaaaaaaaagttggtcttcttgatcctacatgaactaattaattctgtattccaaagaattaagataatgcaaatcagatggcagcagaatgaatcaagtaagagtgggaagggcaaatgtgaaatgagggggcaggagtgagtcactcttttgtgtagatggatagggaatgctggaaaggggagggtgaaggtgggttgggggctgtgggagag

SEQ ID NO: 3242 - DNA, 1177 bp, Homo sapiens
ctggtaataccttgaatgagagctccatattttccccaccccaaacatcaaggccagggtcgtatgttccaagttcaaaaaagtaacttttgtcaatagaaaacaatccaccagccatgacagggcacctacaaaaagaaaagtttgttttttaaacttgcatctcatgaaagctcgacttttagagttgttcctctgtacatctgtacgggaggtaggaggcttttcagaatagctacctgatgcagggaagccctgggatggagtcacaaatagggcttaagtgatgcgatccctggatcatggtggcagagctagattaggttcagcaaagatgcatcctggaactagtattatttgtcctttatactgtgacacaaactgtccaggaatgttatttttaacacttattcagggctaagggagtatcaggcactattgtaagtattatatatatattccagcccagacttcacaaaaaatcttgtgtgtgcaattattaagaatctgcaacactggatgtgagggcgatctggctgcaacatctgtcagcccattgattgccagggttgattcggctgatctagctggctaggcggctgtctccttcccccctcaccgctccatgtgcgtccctcccgaaagctgcgcgctctgtggaagaggacgaccatccctgatagaggagggccggtcttccggtcttctggtcttccggtcttccggtcttccggtcttccgtcaagggtatatgagtagctgcgctctctactagaacctccaagcaagcgctcaggaattggcaacacggagaaggtaagaaactttcccaaggacagtagacaccttgggtttgctctgggcagtctgaggggacgctgtgccactcactccactgtactgcctctcagccgttactggaaggaaggccgtgagagtgagttgtccaggttctgggtattttgaacaaagagttgaacaaaacacactaacaaaggaacgaaacacatgaacgaagcggcacaagcagggattcgttaaagcgggaaagcgctccacagggtgggagtgggccggagcaaacggttcaagggccgggttaccaagttttctgggtttcaagtactcctttcgaggtccctaccagctgccccttatctggatggaggatttggtt

SEQ ID NO: 3243 - DNA, 1255 bp, Homo sapiens
tgtcgatgcaagaggatttagagcttttgttgtccatctttcctgctaagctctggtacctccctgataacagacctggtcaccaaattgatttaaaaaaaaaaaaaaaagacggcaaacaaatgtgatatttacaagaaaaaaaatactagaatattttagggggttaaaagatgcataagtaaagtcgatgaatttttcttagattttcaaaaagcttgtaacaaatttccacttgttatttttaaaagaatgctgttgagttgtaaatggtaagaatagctaatttgtcatagaggattgaagtttagaaaggggaaatagcaagttgggataagcaggcatttttctggaggaagaagtacaaataggattcctcaggagtcaatgtggacaataattttaaacattgatttaatctgtcttaaggagggcatgagtctctgtaggtttacagtagcaaatcccctggaagactgatctgaccacctcctgtttattctccttggctctggattctctcttttgtgttcacattgctggtctttattttggagaaattctttagttggatgttagggagggttgagctgttcatgtatctccattgatggcatttgtcaggaccaggtcagtgttttatttctttatccccatcttctacatctacctcccacggccgtaggcatttctaatgtgtttagtgtttttgtttgtgtgtactcttgtataatatgtatgttgcattatgtaaatcattacataaatgttgttattctcattcagttaatatttttcacttagtttattttaaagatatgtgtccctgggtggtgtctgtgttagcttgttgattctgactgcagttgagtatttcatgatatatatccatccagttttatctctcccctccttctgtgatggttatttagattgcattcacctcctcaccatcgtaaaaaggggtgcgtgatcccttgggacctgtgtgacagtttctgtgggaaatatgcctagcaccagaattgctgcatcatagactatcagtactcttactttgcctgagctgtgcggtgctgatactctctagaatggctgcatccatctatatgtctccacaacccaacacttagcgtggttcagtctgccaggtgtaaatcaactcattttcagtttgtatttctctgactacttatgaacttgataatgtcttcatctgcttgttatctttttttgggtatcctcttctgtaaat

SEQ ID NO: 3244 - DNA, 1199 bp, Homo sapiens
ggtacagctgagcacagaccccgcaacacgccgttcatgggcatcatggataagactgcgaggttccaacagcagagcaatcctccaagccgcagctggcactgtccggcaccagaggggctgctgacaaacacgtcttctgcagctggcctgcagtctgctaacactgagaagccctctctcatgcaagtgggaggatataataaccaagccaaaacctgttctgtttctaccctgagtgcaagtgtccacaatggggcacaagtgaaggagctagaagaaagcaagtgccaaattccagtccactctcaagagaacaggataactaagactgtttctcatctgtaccaggaaagtatctccaaacagcagcctcatattagtaatgaagcccacaggagccacctcactgcagccaaaccaaagcgatcatttatagagtcaaatgtgtgaaccttaagaaatccccatttgtggaatttggaaacgtgtgttgactcctggtggtaaattaaatagtttttttcatcagaaaaattattttttagccattttttttctttggggtggatctgatgccattgatatatctaaaatgtgggataaaacttctttaatagctagaaatcaccataaataagaatgctaaacagaattgaaaattatatcaacttaaaattttaagacagcccagaagacattaatgactctcacttatgaaattgtttggcttttgccactttcttccttgcctttgctatatggtagaatcacagaacttacttagagaataaatatgtctattgttcaagagtaacaggtttaactcatgaccaagtgatgtacatccaagtgatgtattctggaaacgatggaattttacagttacagttccattgagtcaaatcccattttatatatacataaaaattaagttctgagtgagttctagctaaatataagtgcgactgtaaacgcagccaatttttttaagcagaatatgagaacacctaagtattctcttcatagcagttcctataaagggattaaacacttatttctgtgttatggttcttattcatatatttttatagcacttttggaacctatatttgtgcttgaaggtgtttttgatatttggaaacagtataagccatttggagtcatgattggtggtcaagtggattcaagctaaaata

SEQ ID NO: 3245 - DNA, 1167 bp, Homo sapiens
gtgacaggcattgaaagtaaccatcagttccagagtctgcatttatcagtctaccatcagtgatgagcataacctttttcaaacacatatctctttaaaacaagaaacagattacaaagctctgtagtgtttcacaccaaatctacaaaagcatttgtcttttatttttctcttccagatgtacagaaaggtgttcttacatgaagaagggtgtgaaggctgaacaatcatggatttttctgatcaattgtgctttaggaaattattgacagttttgcacaggttcttgaaaacgttatttataatgaaatcaactaaaactatttttgctataagttctataaggtgcataaaacccttaaattcatctagtagctgttcccccgaacaggtttattttagtaaaaaaaaaaaaacaaaaaacaaaaacaaaagatttttatcaaatgttatgatgcaaaaaaagaaaaagaaaaaaaaaaagaaaagaaaacttcaattttctgggtatgcacaaagaccatgaagacttatccaagtgcatgaccggatttttgtggttttgttcattttgtgtttaatttgtgttttttttttccagctgtatgaaatgggctttctgaagtttaaatagtccgacttcacccatggtgttctgtgcttgcagtgcgagtgttgctgtaattcagtgttgccgtcagtgtctcttttcttagctttctgtctttctttcaacgtagtgtgaagtgtcttatccttttctatgaattccaatttgccttaactcttttgatgctgtagctgtttcagtaaaagttagttcaaactaatgatgtagaatgctttgaccaaatgagctggtctattatgccttgtaaaacagcagcatagggcttttaaaaggtagtcaataaaagttgctgaaattttggcttttttaaatatgtagtaggtgtttttaatgatttttcacataatgtgtaaggtagtgaaatgcaagaagggaaaaatgttttgtgtgaaacacattttctgactggggaacttttattagggtaaattgtttgtaaggctgtacgccaacagtttcctctgatagtttgactgatttaggatatctgctgtatgatgcaatgtaaagtcttttttgccttttttcaggaaaaa

SEQ ID NO: 3246 - DNA, 1153 bp, Homo sapiens
cactttttagacaagttaggatttttcattatcatggcagatgagcctttccaggaaggtattaagagaccagaaaccaaggaagaactctgtagtatttactgcagcgatagtattctgtaaaagtcaccgtggaacaggccaatgtgaaggatggcaagcccgtcccagtggcttatccagagaccgcaggctctgtcagtccgggctgctgtggaggccttctgcactgcacaggttcggggcttcatacgtccacggaaaggtggtcgagaaaagggacggcttgagcagccgtaggtcatttacatcgggaaacaaagggaagtccctcctccctttgtctcttttttgccgagtttctgtgtcctaagaaaacacatttgtgtcgcatctaataattaacataaggaaggattacactgttccaggttttagggagaaaggtttaccaaaccggtggccttaaatgattttcgctccttgatattatcatcttgaaggaaagctggtaaactctggcttagggataaaacaaaactttaccgatcgtatttgggtgaggggctggggagtggagagctgtttcctctgctaaaattttagcgtgtgaatcgggggatggagatttgcagaggtttgacgggagggtcgtgtgttcgttgaagtaggggtgattgtccacaccttttcttgaagagtggcgcggggggcctagttcgaaaggtgaagaagagagggaagaccgaggtgccagagtggtccccgaagcgacgaccttaaaaggggcttcgagccggggtgcaaagctgccgctggtgcttaggaaagaaccgagggggaaaaagaacagaggaggggggttggctactccgaggaatgtgcggcatgcggggagccagacccaaccattgcaccagagcgggggcgccggctgctccccgggccgcccggccccggctccggccccgatcccgggagggagagcgcgggggccgggcgggcgatggggcggcaggcgccgcgcccagcgggcgggcggggaggcgcgggtgggcctgggcgcggcgcgaggcggtgcgctgccgcctccccgcccccggccggcgcgctctcagggcggtggttgaggccgcggtaggtggggacgcgg

SEQ ID NO: 3247 - DNA, 1220 bp, Homo sapiens
tcagtttaagataaaaattatgttcttcaggccaaagtgtagtgactcaaggggatgggaaagagaagtccacctatacctttttggcatgatcaggatcatctgggagctttctaaaatgattggtatggtagtgtgtcattgttgctggtgaaggtggtcttatcacttagcttatactagggcagaaagaaggttgcagagtagtatcacagaatggcccctttggcccttttatgagttgttctagaatttctatccttcatgatttgtctctgtctacattcatcttttgctctgaccttctcatatctcaaagtagccatattatactctgtaagtcctcaagtttcccataccattctgctcatccattatattactttttgtagggtgttctctgtaaaggaaagccctttgcccccattgtgtattaatgaatttactactttctttctagactgcttaaatgatcccttaccctcctctttcccctggaagtcttctatggtgtgctagtcaggaaaggttgattatgtttcaggaataacctccaaatctcaatggtttaaaaccagaaagctttctttttcactcatactgtatgtctacatgggtcgtctgggtgctctgttccgtggtatcattactgtgggactcaagctgatacagcgctatcattgaacactgactccttaaaaagctttgattgaaagtgacatggccactctgcttacattttattggctgaagagggtcacatgttcatacctaacctcaagaggttagggaagtgcagtcgtactatgtgcctgagagagcggaaccagaaatatttcagggagagcagcaattagtgtctctagcctgattagtctctctacttcatatatctatgataatttgtaaacctctgtatctcactaaattgaaattataataaacgctgtagtaattcagaatttgatgcatttggtgattggctcaagacctctgaaattcctagacaactggctggacaaactaaccatagccatttcattaacctcacaataatgaaatccttgttttataagtttatatcagtgattttcaaccttggctgtactttagaataacttggggagctaaataaaaaaagattcctgagcctcaatccagagcaattaaatcagagtctctgagggtgggcccaggcatcagaattttttaagctctcc

SEQ ID NO: 3248 - DNA, 1220 bp, Homo sapiens
actacccgttttcttctgtctctattttttaaacaaatatgttaccatgctgtatatatcatttgaaatcattatgtttaatggagcaaaatatcccatttgaattatataataataaatttagccaatctacctatagttagttagatgtgaaaatatcccctccatttttttcatcttttataatgtatgtttgaatatgcttctctctatatctctatatattactttattctgcacatgcacacacacacacacacacacacacacacacgccaaaaactatgtatatgcagttgtctacatcactgtttcaaagcattcattttgctgaaggaaataaatactgcaaagttggaacttccttccaaattgacttatatctattgttattgctatttttaaatttattagcaattccaatacaagtgccattgtagaatttttttaaaaaaactgattaaataaacctaaatttcatttggataaattaatggataaaaaatattttgaaaacaaaaacataattgaagatgaatactggtgacagcaggttttagaaggtattgtaaaacaaaaataattaaaacagcgtggttttatagtaaggattgacagataaaggaaagaaattcctaggaaatattgtctagcacacttaaaaatttagtatatggttaaaggcagtatcacaaataagtagtgacactaatgaatgttcaataaccagtgcgaaaatatcattaactctgtggaaagcaataaacaaaaacaaaaacgcaaatcccatttaagttattgagataattagaataaaagatgtatggtgccatctagtggttaaacgtgtaattgcatacatactgttctatgtagagtctaatggcagaaatttaaacctgatggagaattgaagggaggtaaattattcattaataaaaaggtttacatctcacacttcagcactaatttaagaaaatatttttaaatactgactgtttccgagaatattataaacggtagcctatatagtgatcctgcatgaacatacaagaaattgcagttccagacattcacataaacaagcatgccaacctgtcagacttttttttagtaacacaatgaaacaaaagaacaatttgagtaaaagcatgctgattggaaattcatacatgagagcagagcctgccagcagttatagttttgaataaagaacacca

SEQ ID NO: 3249 - DNA, 1177 bp, Homo sapiens
cgctaatatactaacattactaaagctatgaagttttagtagatatatggaaatcacatagaactgttaccctcaggccctctgaattttttcagtcagctcaagatttacacaaggcaattcttcatttttgataaacttctgaaggctcccgcagtagccgcttaaggttcattaaaatgtaattaattaatgatttgctgctgaatagctgctgactgcggttttcttttcacttgtcggacagcatgagtcacacagttgccaagccgacaaggaaactatttgcagactatagcacctattgatgagtgtttcaatctgcagtcatttgcataggaaagatgctggtaggggtgtagaccatgttttcagtatgaatgtgagtgacacctacaatttaaaagtgcctcagacggtcataatagtaacattgggctcacgatgattgtttttaaaatagccttaaattttaactcgacataacagactgataaattcctgcattcagaaaggcaattttatttagatttttacaaaaatgtaaaaacatatatctaggaattaaagatttagttcgtgtgtgtgtgtgtgtgtgtgtgtgtgtgtgtgtgtgtgtgtgtgtgtgatttcttttgtggagttaccttgttaaggaaatctccatttttcctatttactttgaggggacttcaagacttccttctctgaaaccccaagctaaaggtaaaaatgactagcatcctcagtgtttggaattcctggccccccaggccatgagcacagcctgtatatttaactctaaggaattcacataaaatactgacatgtttttattgtggatatagggcaactattccgaacttataaaattaactgctttcaaatatttacagggagaggaaatacggtttaacctcttctccatttgcgatcttcactggtgtttttgctctactaggattttatggaatttacttattcacaatgttatgctttaaaataaaaattaaaaccccaacatattgtttatataagcagattttatgattccgtctctgtctaccacatttcagagacatggaatctgacaactaggaatttagtttacattgcatctgaaaagtggtgcacaggcattttgtactttaaatcagaaataggacaaatgcattag

SEQ ID NO: 3250 - DNA, 1208 bp, Homo sapiens
ggaaagtactgtttattgtttgaatatgtaactgtaggttatctcattattctagacattattgtagagtgtttgtttcagtgaattatggtacaactatggctttaatatgtgtttcagaaaactgtgagagtagtgattaattttaagaaaacacagaagaccatagtgagagtgagtccacatgcatcgcttcaagagcttgcccctattatatgtagcaaatgtgagtttgatccgttgcatacactattgttgaaagattatcaatcgcaggagcctcttgacttgacaaaatctcttaatgacctgggactaagagaattatatgcgatggatgtcaacagaggtaagtaagacttttattttatttatttagtgggatgtgtatatttgtatatgtttgtgcattgtgtttgtgtgaaggtgttctcaagttcataatggcagttaatgggtcctatagataaaagtaattacttggcattaggaataagaaaacaaaatgttaataaatataaatcaagttaaatataacaacttaatttcagttattgaaattggaattaaaacttgtctttttagccatcatccacaatttatattttttctttgatttttttttttttggtaggatttaacttaattcttcatggctttgaggcttaaacagaaaataaaaatttacatataaagtcattgttattctaatcaagtgtgaattactgtggactcactatgattttgtctgagtcttaattatcattcaagtttggaagtttcttgccaaatttttcctaaggtcaacaccaaaataagttggcttatgaaatgtatcagtctaattcaaaaaatttttgaaatagctcccagttttaatctatagaaatgatgtattaaaatttggagatcttagataatgctggtttgtatgatgtctagtagacaaatgcaaacatttattcaacatgaatctgtttcactaagagaaataaaagtttagtgaagctgacaattatttacatactctttgcatagagacttcaaaatttatcctgaggtggtggctttatgtaatccatagactactttttcaactcagtgatgttttatacttgaacaaacatcatcttcacagtcaatttaccctcttttatacccctccttctgtagccacttctgttactgtcttcagtaagtcatcttta

SEQ ID NO: 3251 - DNA, 1178 bp, Homo sapiens
actgtaatttgaggtcaaggtgacctgcacttacaaatatcatgggtttttttttttttcaccatgttagttttatcgagaatttgctcccttttaaatgtaccaatctgtaatttcttattcattagagtcattaatgactatgtgtatacaatgcaaatcttctaagttttttgctaacaaaagagaagggaataagacaataaagaatagtgtgagtctgcatggaggatttattatcttaaggcacaattatactgcagaccattttcggttgtacagcaaaatctttcctacttataaataggaattttaaaatatttattcaggtattttgttataaaactgacctctgaccctaatgaaaatatgagacaagtttcagtagcaaaaaggaaaaagacaaggccctttccttaatataggctccatgaagaacatgaaccttccattactctatctcgacataatgggatatgaatcttcatttcattgtttaaatcattacatttctggagtttatcttcataagttcttccccttcaatgaagtgttgcttctccactagcgttgcaaacattcttggatttatgaatgaaatctatgttttcaagaaaattgtgtgaagcttttattatttcacacgtgttaagtcttcatagtaatagacttctttctttcaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagtaagaattattgttatgtacatttccttaaaaagtagaattggattgtttgtaacacaaaggataaatacttgaggggctggatatcccattttacatgatgtgattagcacacattgcaggcctgtatcaaaacatctcatgtaccccatatatagaaacacctaccatgtacccacaaaaattaaaatttaaaatttaaaactaatgaaataaataaaacac

SEQ ID NO: 3252 - DNA, 1187 bp, Homo sapiens
ggttgtgcaaccggtgtggcccccatggcccagggttctttgcccagcagacagttgtggggtctgcgcagctcacgctcccccaaccaggtctctttccggggtctgccccagtagctggaccaaaccagctagttttgtcccaagcattctgcacccggatcactgggttaattgttcccatctgtggggctccctcaggcagagctcgcaagcaggctacacccttcccgggctggtcttgtggagggaggcacacccagctccggcgccggcccttgagcatatatgcctctctcagtgctctgagagtgggggctcctcctccgcttgagcttcagcgacagatttcagctccatattccttagctgtgtgctcaaatgtttgggtattgggaccaggcccattgatcgccagggttgatttggctgatctcgctggctaggcaggtgtccccttcctccttcaccgccccaggtgcgaacctcccaaagctgcccgctctgccgaagaggatgaccatctccaacagaaggatagaggagaaccagtcttcggtcaaggatatacaagtagctgcgctcccctgctaggacctccaaacaagctttccaatgcctgtaggggtcgtgggatctcttgtagctaggatttcagaggtcagtggcgggagtgttctttcacttccttaggacctggaagcctagaacacttaggacctggaagtgttctttcacttccttaggacctggtcctttcacttcattaggaccagttaagggctgggagccggttctgacatttggcaactccgtgcagggtcccagcttcctccctcttccacctcgttgtctgcatcgcctctctatttactttcagtgttttctctcaaaagatctgttcaaagtgcgatggcttatttcatattttgatttctcttgctgggagcgtagcttcccggctcaatctagttggccatcttctcccctctagttggccatattctcccctcaatccgctctggattttaattcataggttctatattctttacacataactttcaatgtgtcctcctaaaacttacccatccagaaagcactcatttccttaagttgctagttcgtttcaagcatgtgctgaactgtagaagttagagtgccagctgagaaatccagtagacagt

SEQ ID NO: 3253 - DNA, 1219 bp, Homo sapiens
caggaaggcagggatggaaggagggagggagaggaaagaaggaagggagggagggagggaaagaggtaaagaaaggcatagagtaattagagtatcgaaaactgcaaagttatatagctgaaataattctaagtattttggtagtcttcataaatgtaaatgtcccaactcttcagtggaaagacaagattgtcaggttggaattttagaaaaagttaggcatatacaacacaaaatagacacttgtaaaatattgaaatattaaccaaaagaaagtcaatatggctattttattctcagaaaggaaatagacttaaatggaaaaaaataccacgtaacaatagaaataaagaataatcttttaagaaagtaaaggaaatccactgagactgagaacaaagtgaaagtacaattttagggaggtaagcaagcccagaaactgttagttcccatactaatctaggatggtagaactttgaaaaatcagatagatgaaagcatgcaattgattcaggatactaggccctgggctcatctaggatgggaagctagatcactgatgccttaggaagctgaataccacaatggactgtacacataggagtgaaaggctaaactaaaaatatgcttacttcaatctggtctgagtggatggaaaataattttatctcccaggaattcctaactcaagaattagggactctcaccccaacctaattcaagtttgagacccaaattcacatatttgtgagatcctgaaagcttcaaacctgtaacttaatttatacttaattcactatgcagatagcggaagcaaaatataaatgctttctggaagcacatgctttcaactggggtctcaaaaaagtcccatagataaagttccagtgagaatgagctcacaatcaaaaatcacaataaacataagaaacaagactatataaaaatcaacaagtgtaggaaggcagaattatgcccatgtaaacatcaatgaagaatttgaaagtgaactctgcatactctgggcatttagtttatgacatatgtggcaattcaggtcagttggaaatggatagactagtcggtgaattagtacttaggcaatagtctgtcattagaagaaaaattcgatcttgtctttcattatatacacaatttattccaaatggtttaaaagctacatataaaaatccccaactcaaaactacaagaaatattg

SEQ ID NO: 3254 - DNA, 1190 bp, Homo sapiens
tctacttttaaaatatagatacttattagtaattgtttcccattttgttgtttcttagctatttatcagtctacacaaagtctataaaccggaagatgcagtagatgtagtattttatttatttataaatttatttatttatggtatatattgattttttcttaaatcagtagttggcctataataacttttacagttctaaacatttccctcaagggcccatatcctgaaatgtgtcatgaatttaacccaataggcccagccaattgtaatttcagtttgtagccacagttgagatcgagttttacctggaaatctctacctcaaacagttgggttatggtgcaaacaacagaacttctgcagttcccattcagctgtccgaggattacatgccctccttacctaccctgcccctcttccatggagggggtcagggtgtggacaagccagggctggttagagcaagatcagaatgttggacaataccagtattacttgagggctggttcaaaactgcagtgggatgtaaagttgttcttcaattttaactgaaaaataagcttcactccagcagagccaaaggatatatttttttttgtggcttcctataatgcaggtacttactaggggatataaggtaatatgctgtgaggatttcagtatataaaattatttctggagagagaatatccgtctgtcttcctttgccactctctccaaatgcgtgctcacacacacacactctcacaccatacacacacatgcacacgcacacacacccacacacaccacaataaaacttttccccaaatactttggctttctgaggaaatatctgtccagctgggtttcctgtataatttattttctagcaacaactttagcatttgggatgtataattaaatctttcagactgctgaaatagatttgtgtattcatttgctaactgtcatgctaacagttaaaaaaaaaacacacaacaaagaatgcacctttagtttcaagtgtcttttccttgagcagtttcttttttctagagacagtgttgttagttgtgtagttgctgcacaggatatctgcatttaaattctgagctttaggtacttacagccatgtaaaactaatatccctttgtatccagtggctttttagcacttactgtgtaaaaggcactgaaaagtagattg

SEQ ID NO: 3255 - DNA, 1201 bp, Homo sapiens
tttattggcaacaaaaggaattttctatccagaagcctatttctcctttcattgttgttatttctgttataatactttaattgtacatctgacaatactgcctcttttatgttgtatttagaaattaatatacttataaaattaagatttattagccaaacttgaattctagttttaaaactgactgtgaattttatttttcatatatttatgcattacacaccttagctataagaaaaaaagggttttgattatatgcttcttgcagttaatctcgttatttaaacaaaaagttttgggtctgtctttggagtatttgtaacttctaaattttgaaatgactgaattaggaatttggatgcttattcttttagtctgtttgcctaaaaaccaatttacaatctgactgtctcttgggagagggaggtgccttgcaaactttcacattaagaatgtgcctgaggctgctttactctggaatagtctcagatctaaaatttcctctatataaggtggcatatgttaagttttgcttcattggaccgtttagaatgctatgtaaaatgttgccattctgttagattgctaactatatacccatctctgatttggctctccttaagtgataggatttgttattctaaaggtgataaacttgaaaatatcagaatctgagttttacttgaaattttgcagaatacccaggtggagtgaaaattggaagggttttgtgcaatgactaaaaggtaaaacgctgttaaggttcaagaatcaatactttcaacccaagtagccctctgcttgactgtatattatggaactagtaaaccttaggattttgaaaattggagtctaatctttcaaggaggtgggctcccaggatggtaccattgctctttcctagctaaccctagatatggcagctctttaatgtacttcaaaaagcaaatatatattactaaggaaaaaaagttatttataattgccttgtcataattgttaaggtgttctagagccatttgcatacaatttaatgtaatttcattccattctattgtttacacaacgattactcgaagatgactgcaaaggtaaaaggaaaataaaagtgtattgcacaatgagattgttttgcattgtttctttcctcctttagatatcatctgcattactgcaatggcatttagcactttcataaaat

SEQ ID NO: 3256 - DNA, 2311 bp, Homo sapiens
acatttcatgtggtatttcaggtcttcaggttctgattagcttacttttttcctttgtctttggctgatttctgctttgtagataaataataatagccctgagatgtttctaacatttaaataagaaaaaaatcaaatcgaagtcagcctgctggaaaagtgatcacatggcagttgcagtaacttgtatggaaagagaaaatgcaatgagcccagttactgcacttgccactaccatgctgtccatggaaggaataatcagcagttcagttgtcacaagccgcccttgaagaaaacgcagcaaaatattttaaaatgaagatattgcagtccccagagccagtgaaggtttcttttggtaaaatgaaattgtgccattgtcaaagtaccccgtagtgatgagcactgactggttcactggccacattttagttcttcataataataggccacaaaagggctctgtggtttgcctccatgtgcactggcccctccccacccctagggggcactcagtagctgctgagaaggcctgtccacgaggctgttggaacccctccaataaatacttagaggtagtgtatctgatgcttgttttcgtggagaaaattgtattggagaacttaaaacatcacgaatatttttaataggatccgcagacacccaaaggagaagcttggtcttttccaggtatttccaacttgagttcaacccaaagcctttgaaaggaatgcattaccacatgaccacatgctgagaccccatggggtctaacacgggacctaagaaagtctctgcagccagatagtacatggtgtctccacaaaactaggcattctggagattgcccagaaagggatgtgaggggaccgttaagatctgtcttgcttatctcatgcactcacattccttcagcctcctggagttcctgataaaaggaagccagggtgtggacattttttagctattgatttcccaatagcttgtggatcagttgtacacccacacttccttctctgcctaattccgtttttctggaaaaagtagtatgcccatgtatgtgtgtttttcttaacacaggtccatgaaagtttggcttcctggtttgatgtctgttgcgtggcctggaaaccagggagcagcaactattgagatggtttctgtgttcagtgaaaaattctatttcattgagacaattttttctttatccacagtaattttttgacactgtcatcatgaaactacccttaggaaaataagattacctgcaaaaaaaaaaaagaaatgagttatggaataggaacagttatgtgatgattctgaaactttaacttagagcttcattactttaagaatggaaaacaacctctgagtttgatttcccaaagtttcataaagcccctaagctcatgattttcatcaactctttgcccacatagtcatttacctccacagccgtttgttgtcatagaaggggtggtggtgtttggatttgatttttttcaacttgcagtgagaaataggataggtgacaaaaccttacttgttttcttaagacaattcagtgcttgagcatctctgtcagaaatggaatgaaatactgttagccaattagaattattttatgtattgttattgtgttttgctgatttttatatgaaaatataattattcattcttgatctctggaagcaatcattattatgaggatcattttactttggaaacactttcataataaagataagtattaagagtgcagtgtaagtgccctttactgtaaatgctaaccagctcgtgtgggtaaaacatcacatctcacctgatgaggttaataaaggctcacatcatcccagtagattgttacaagcctcgtcaactcccagtatcattgtgatcattgagaaagtaatgttacgttaacttggatagactgtagtatctctttgaaaattaagattaaaacctcaatgctaaattttatgtagcactttattctggaaaacatggtttatagagatcatctgaaatatatcaggttatgcttatttttaaaaaaattttaaaagaggcacctaggataaacacccaaagcacaacacaaaacttcccttctctgtgtatgcacccctcatcggagtttggcccacatcatcttctcttggtttgtacctcactttgctagaacttctctccatctttctctgtctttcctgtgaaatacctctctcaatctgctcttctgctctaagcttaggtcttctagtactcaaaagccgtaaaaatagcactgaaattcaaccagacaccc

SEQ ID NO: 3257 - DNA, 1149 bp, Homo sapiens
agggtttactgcagtgcctgatctaaccacctctgccttctaccgtcttgttgcctgatcagaggtccagggaggtcagctttggctgtacttctaatcctatggaggacatgaccagtgggcttgttctccatatcggagaagagtgacacccctaatctggagcttgaaatcctgaataaaatatggcagaggacccagggaaacgctatcagaattctttctgcaggttttggtaattaataatcagttcctagaacactacaattaagaatatcaagaggggagcagaggccaaaatctttgaggcttgacccagaaggacaaataatttgccccaatatagcaaaggggcaacgtgcttgggctctcaccagggacactgaccagttttcagcaaaaacacccacagtagaatcactcaagtaccctcaaaataagcctccgataatctggtccaaggttttcaagagaagggaccatgaaaaatactgatagtgactcccacttcctagaacccatgcctttgggtgatcttccctcacacccacctttgagtatgggctgcacttactgacttgcttctagcaaatagaatatgatgagatgtcacttctgagattagcttacaagagattataatttcttgggcactctggctctgtctgtcttgatcactcattttgcggggagtaggctgagacatggagagacccacatggcaagaaaatgatatctccaaccaacagcagcgaggactggaggcctgccaacagccctgtgagtcagcttggaagtgagtcttctggaggaagagcctggagatgtctgcagcccaacctgataccttgattgcagccttgggaggggttcagagacacctggctaagacacaactgaattcctgacccacataaactatgagataatacatgtttgttttaagccattattttggtgggggtggggagcggtaatttgttgcacagcaatttgtgcagacaaccaatttaagcaccacgtgatatacagtgattaattataggtcattgaaacatgtctgcctggcactacttttatagaagaccgaatatgaagattctgtttaaaaccctgcttgactttctttacttctagaaaataccaaag

SEQ ID NO: 3258 - DNA, 1099 bp, Homo sapiens
attaactccttttctatcttttctacattttcttagtcataaatcactattcttaaaggacattattctcggtctctaagttctccctcgtcagtaaattgacataatctattaacaagaattcaaacaaataatgatttcaaattgtattgccagcttccctaaggctccaacgtcgtgtttcatttaaagaaactgcttagaatataaagtataagtaggctttgcaaccaacagagaactgaaaacaagataatcaatttattgtgaatgatgtaacttaaatgctgcatccatgggttctaggtggcatctgggaagtatgtctgtcttttattcacataggaagaaaagtaattgcctggagagatatgactggcaaatgctgcaaaggaaacacccaataaatagcaaatgtgtggtgtccctgtcgtttggctacaaaatgtatcttgattttccattggctctgggagccatgtccttgtcgtggataatattctttctcccataacgttactctttctcactaacccttccgtttccagatctctgcattagcgctaacattcaaacatggtttctaactggacacataaagaaggttgaggctggagactttcttctttaataatgttgtggtttacattataaagccactacgtaatacctttccatgttaagtaaaactctgtgacacaaagaaggggatctcactctttagactggctgtaaaaagcttttctgagaagtaagtgagaccagcactaagctgggagtcagctgacctaggttctagaatttgcacttacttacactaagttgagagaggaggtcacttcacattcctgaatgtctagcttctaaaaaataaaaaggtggggtacatctctaatcactttccatcactgacattctaccctagtgtgcactgtgattaggagcatgactgtgtttccaagttcaaatcttgtgttgccacagcctgtgacattagccaaagcacctaaccttcctgtgtatcagtctcctctgctatgaaatgggaataccaataaaaccctccaagggtttcatgaatattaaattggacaatagg

SEQ ID NO: 3259 - DNA, 1208 bp, Homo sapiens
ctgaaccctctgggccctgtagtatgcttttacattcctgtgtctgttttctatcttttaaggcttcatatttctttctggtgaatttctccagtggcaagctaagagcggcagagagggattgtagtttgactgttagttctgttgcctggtggatggccagagaggcctggcaaaggtggagattaacagggaagacatattgaagtgcccagtaaatgctgaatgactgagctaagtagtagctctggaaaaccccagaaaatggccctgaggattgatgcttgacggaaacccaagttaaggctattatttaggccaaggaagctgcaccagtaaatagagctccagcatgaagctgaggctacttttctgctttagaaatttgatgggtgctaattgagaaaagtatcttggaatttatactacagttctaacctgctaccaacaccattgttagcacaactgactatatgccacattaccgcacctctttataatattggttggttcatatatgtttggaaaatagggaaaatatgtcattataatgtggaagttgttgattcatatgtaacatccctggtttaggagagctgggatagtggggtagaatcataacctttagctggagaggaaaaaactctgagttctgctgcaaagacagcaggaaccttttcagcaccatactaagaaaattagaaatgagcacctacactcagggcttcctccccaagaggtgcaccactacttttaccttggttttacaagaggcgggctgccttctttgctcctcttccctctgcattgtcatagttggctggctttctttactctgttgtacagtgttaacatgctctgatctagccttaaaccaccacatgatgtttgcctgggcctgcaaatgatcttcccaggtaccaattactgcttttgttacttctctggttacaaacttgaataggttgtgagtgtccatcccttacccttttttttccccataagccttgttatttttagtgcgaggtttttctaggagagagagagagagatatatatatatatatatatatatgtgtatatatatatatgtatatatatatgtatatatatgtatatatatcattgagcagaatgtatttcctttttggattttttttctaagcatattttaatttgtttttattattatttttaactgtcaactc

SEQ ID NO: 3260 - DNA, 1197 bp, Homo sapiens
tccattgtaccttggacgtgatgtggcaagacttgatattcatttttttttttattttaggcatcagtgggtggaccagaacgttgtcatgacagttggtttcctggcagtaacttagtgtcaaacatgcgacactttataaactatgttagagtaagagttccagagactgctcctgaagtaaagagagactcacctgcaagtactagctctgataacttgggttctttacaagtaagtgtaaatgtaagaaagaaaataagaaaaagctttatgttatgtatgttatgttgggatatactgttcctataatatccaaaagaaaaaaaaatgtggttgtagataactttaaattgtcttttatttcctctgatatatctatgtaacttctaccttaccagtctttttcccttaatctgccagagttcacgacggcctaaagttcttcaaagagaggtagatgtgtatgatattttcattaactagcaacatggctttaactggaaatggggaaaaaccgctttgaagtatttgtgtgtgtatgggtgtttaattaatatggttaaatttaaaagaaggtttcttggatttatgtgtgttttttttttttgacaaagtgatttaagcttaatattaaagaaaatttatattattgagcttaaaaataatactgagtataatagtgtatttttcttattagtgttcgaagtattttggaccaattataggtagcatatttgagtctctttacattcatcattgccactgtattactaacatcttaaaaatgacttggatattttctaaattaaaataaatttaattgctagcagcatgctcatttgcaaataactttttttttgcttctatggcaattaactttgataaaataagcctataaagtcttaaattctgtatattatggctttggactcattttgaaaatcagcgctctcattgcatgtaagttaacttttaaaaagcagtaatgaaaaatcttgaaatgacattgtaagtaagtaaacttaagcagttttagtctccacaacctagattttcgtgagtagagaacattgaatcagacatttcttctagtagagtctatttgtaggagctttcttggtctttgacaacgtgttttcactgtaagcaaaaactggaaactctgtaagaggcttttgcctctaatgctggtag

SEQ ID NO: 3261 - DNA, 1099 bp, Homo sapiens
acttcagtttccttaatgaaatgtaaataaaaatagccctttgacaatgcctgctgtcctttcagtgctgggaggatgtatgatctatgccgtttttgtcctaggtctgccacctcttccttccatgcctccccgaaacttacctggcattgcacctctccccctgccatccgagttcctcccgtcattccccttggttccagagagctcttctgcagcaagctcaggagagctgctgtcttccctcccgcccaccagcaacgcaccctccgaccctgccacaactactgcaaaggcagacgctgcctcctcactcactgtggatgtgacgccccccactgccaaggcccccaccaccgttgaggacagagtcggcgactccaccccagtcagcgagaagcctgtttctgcggctgtggatgccaatgcttctgagtcaccttaactttgaaccattctttggaattggcgtggtatatttaaccacgggagcgtgtctggaaacgcaaactatcattaatttcatactagtttgtaccgtatctgtaggcatcctgtaaataattccaaggggaaaactaaacgaggacgtgggttgtatcctgccaggttgagtggggctcacacgctagggtgagatgtcagaaagcgcttgtattttaaacaaccaaaaagaattgtaagggtggcttgctgccaggcttgcactgccgttcctgggggtgtgcatcttcgggaaaggtggtggcggggcgtccactaggtttcctgtcccctgctgctccttccgtaagaaaatgaaatattctatgcctaatactcacacgcaacatttcttgtactttgtaagtcgtttgcgagaatgcagaccacctcactaaactgtaaacggtaaagagatttttacttttggtctccgtgagtcgcatctctactaaggtttacacaggaattccacctgaagacttgtgttaaagttctacagcgcgcactgttaactgaacgtctttttcttcagcctatacgcggatccttgttttgagctctcagaatcactcagacaacattttgtaactgctgctgttgctttctacataca

SEQ ID NO: 3262 - DNA, 1196 bp, Homo sapiens
aatagctaagatttggaatcaacctaagtgtccatcaacagatgaatggataaagaaaatgtggtacatatacacaagggagtagtagtcagtcataaaaaacaatgagatcctgtcatttgcaacaatatggatggaattggagatcattatgttgagtggaataagccaggcacagaaagacaaacttcacatgttcttacttacttgtgggatctaaaaatcacaacaattgaactcatggacatagatagtagaagaatggctacaaaaataattagaaagaattaataagtctgggcacagtggctcatgcctgtaatcccagcactttgggaggctgaggcagacagatcacttgaggtcaggagtttgagaccagcctggccagcgtggtggaatcgcatctctactaaaaatataaaaattagccaggcatggtggtggatgcctgtagtcccagctactcaggtggctgaggcaggagaattgcttgaacccgggaagtagagattgcagcgagctgagattgtgtccctgcactccaacctgggtgacagagcaagacaggaaagagagaaagagagagagagaaggggagagagagagagagagagagaaagaaggagggagggaaggaaggaaggaaaggaaggaaggaaaggaggaaggaaggaaggaagggagggagggagggaggaaggaaaaataaataaataaaaaagaataagacctgctatttgataacacattaacttaatagcagattttaaaataactgtaaagggtataattggattgtttgtccttaatgcttgaggagatggacaccacattctccataatgtgcttatttcacattgcatgcctgtatcaaaacatctcatgtaccctataaatatatacacctactatgtgcccacaataattaaaaattaaagaaagaaagactccatttcaaaaacaaatcatctctatcttagtagctgtagttcgtttatactgttccatgggaatctacagcttaaacaccatttcgtatccatccttttgttgggggacatttgagttggaaactcaatacattcattatatatgttatgaatatatatgtttttgtgaacatataaatggatttctattggttatacatacagggagtagaatcacagagtatgcctgtatttacctttatt

SEQ ID NO: 3263 - DNA, 1300 bp, Homo sapiens
cagggcgctcgctgcccaccgctagccagcggtttttctctgccttcttttttctcctcttcgaacccctactgccccaagactaggttcctccactaatgctcaggtctttttcctcaaaggtcaaaatctggttccagaaccgccggtccaagttcaagaagatgtggaaaagtggtgagatcccctcggagcagcaccctggggccagcgcttctccaccttgtgcttcgccgccagtctcagcgccggcctcctgggactttggtgtgccgcagcggatggcgggcggcggtggtccgggcagtggcggcagcggcgccggcagctcgggctccagcccgagcagcgcggcctcggcttttctgggcaactacccctggtaccaccagacctcgggatccgcctcacacctgcaggccacggcgccgctgctgcaccccactcagaccccgcagccgcatcaccaccaccaccatcacggcggcgggggcgccccggtgagcgcggggacgattttctaaccccagggagaactcgccagagactgagagcagagaccacttatcctcattgcttaccccgagccggggttccctcctcccggcccgctgccgccacccacctctcctgcaggctgcgacctgcagtggcccgtctcaggccctgctcactcccggggccaccaaacgggcccctctctcgggggaaccggacagcagcttggcaaaggcctccctaaaaggccgcatttctgacctgagccccgggtctcggctgtttcgagccccgcctcggacttgccttccctcccctccgggtgagcctgtctggcgccttcctcgccccgggctgagagctgggtcccgggagatggaagcctcccaggcgcgcgaggcttcccgggcgctctgaggcttctttctcctcgcccgctcccctgggctcagctcggacgctgcagttattgacctcccggtcccgcctgcccgccctcccccacgtggccccttgacccgggcggccccgccgcttctttccttcctgcagttcccagccctcggagcccccatcccttatcttacccccaccgcgctcccccaggagcgctccctcagctctctcctcatccatcaccagtggagtttttttatttgttatttttttaaaagtttaggtgcctttgcggatgacctcattttgacgttgaaaaaatgattttttaatatgtgaacactgcaaaaatgtgtttaaattatcttttttaaaacctattcaggattattagcctggacttgga

SEQ ID NO: 3264 - DNA, 1203 bp, Homo sapiens
gagggcgccctgtatggggcgaggggtcgcccaggctctgaggcacactgatccggtggcctaactgtggatcccagcgcacaggccccataggcaggccacaggtgggtgagcttccaagggcgagagaaacccattccccttagatggtgaaaagctgccacattttagtgtccaggtcctgagagctgcaaatgctgatggagtaaattactccctcttcctttccccaccgcccctgccccctccaggaacaaaagctcagaccgctgagatgttcactctgcactttcagcagcactcacattgagatatgagaagactgcaacaaggtttgttcttacgaaagaaaacaatctcagagaacacatggacacaaggaggggaacggcacacactggggcctgtcagggggcgggggtggggagcagggtagggaaaaacagctaatgtatgctgggcttaacacctaggtgataggttgataggtgcagcaaaccaccttggcacacctttacctatgtaacaaacttgcgcatcctgcacatgtaccccggaacttaaaatttttaaaaaaagtaaaaaaaaaaaaatttccgaggtttcccgcccctgaactgaggaccatttgtgcccggcgttccggggggaccgggagggggctgtgcttggggggcggcggggcgggggactggaagcgagggggtaagtgtagcagggaggggaacgtcgccggggggtcttggacctcgggtcttccgcgtgtccggtgttgattggctccagttgtcaggttgaaaccacaactcctcccctaagagctgcagaggtgagcccacgacgtgccggccctaggtgttctcatcgttgggttgtcagtgcagcatgcttctggaactttcagagcctcacaggccttagacccttttcactttagtgtctattcagcggttaaagcaaaacacacacacacacacacacacacacagacacacacacacacacaccaccgccaccaccatcaccacaaccaacaaacgggagaactaggaaggaaaactctggaacttagaaactacccttggacacaaaattcccttctctttcacagagtctttctttccactctctcattttagaacaaaagggttgtgccacctcctttggatgtgaagaggatgtgctgacacgtgtgctcgggag

SEQ ID NO: 3265 - DNA, 1185 bp, Homo sapiens
tgaggatggtttatttaggtatcataccacttagcttggttatgtctgagttcctgttcatttgtgaatcatgtatgtattgcatgctatggtctttaaattttagaaattaagatttttattttaatgcttggggaaaacctattcatattctgattttccaacgatttttttggtttattaattttgagacttataattatttattttctgtacttaaagttgatttgcttacaaaagtaatacatggcttgatatggaaaacaaaaacattatggaaatatttaatgtagaaagtgaaattttctcttatctcttaggaataagacttagtgtcatatattttaaaatattgtcataattatactgcatatacactttttacaatattgcttaatttttagttttaggaggatgaaaatagaatagtcgccccccttatcagtgagggatagttcaaagacccccagtggatcctgaaacctcagggagtaccaaaccctatatacactatggtttttactatatggtaatgagtgggtagcatgtatagtggataggctggacaaaggaatgattcatgtcccaggtgggatggaatgagacagcatgagatttcttagtgcaaagaatggcatgtaatttaaaacttgcgaagtctttatttctggaatttttaatttcatgttttcagactgtgattgactatgggtaacaaaccattgtggaaagcaaaaccttggataagggtataaggacttcctatacttgctaagtatttaggtcaagaattacatcctatttaattagctattaatatagataaaagtaccctacatgcagaaaaacccagagttagattcattgctgaaaacaagagcctggagtagggctcttttttgttaaaggggagctacaaaaagttgttgctgtttgttatcctgaggtatgacttaaatgaagatttacggagatgagacgatgatgcaggaaaataggaggacatcagcacagtcttacgaccaccacatctgaaccaatctgaaccattgaactgttagctgagtgtttggatttgtgatatagccagtattactgcttacaagagttatatatgagttttggggcttgcagaaatgccagacccaaaattgtaatactgagaaagaaagaaaaaaattgtat

SEQ ID NO: 3266 - DNA, 1193 bp, Homo sapiens
ttattttactcatgtctaatactgagtatagaacttagcaacataaatattttgagctgacctgcctttgagagtgaagcgattattgttagcaaccccccacttttttttccattgtattttccctgatggtatgtatatttatttggccattgaataagtaaataaatctaggggtatgtatatttatttggccatttaataagtaaacaaatctaggtttgccagtgtattatttcaactagaattcttgttgatggccatactgaatctttcttcctttctttccagagatctggttggagttggagggtgagagaaaatgaattctaatttacctgcagagaacttaaccattgcagtcaatatgaccaagactttgcctacagcagtaacgcatggatttaattccactaatgacccaccttcaatgtcaattacaaggctttttccagccttactggaatgctttggcattgtcctttgtggctacatagcaggaagggccaatgtcataacatcaacccaggccaaaggactaggaaattttgtctccagatttgcacttccagctttattattcaaaaacatggttgtacttaatttttccaatgtggactggtccttcctatatagtatcttaattgccaaagcttctgtatttttcattgtatgtgtattaaccttattggttgccagtcctgatagtcgatttagcaaagctggactattccctatttttgctacacaaagtaatgactttgcattgggataccctataggtaagttaatttttatttttcaagtgtttaaaaaattcaattttaatttatttaggcatttgttagtaacagattcttactctcatatctaagaagtttttcatttttttctcaaatatgtcttaggatgaatcatagtttttcctaaacttcagagtttgaggatcctttaaacatctacctaaaataaacggtcatattctaataaccactgtgaacagtcctaattgtatttttttcttcccggtaagcacatatgaaagaagcttaatttttagaaaggatccaattgtgatttaaattatgttaaaaaagtagatttatgtctatataaaaatagttattattaagtgtttgtgaaaggaatttatttttcctaccatctagaatatgtattattttatatcagaa

SEQ ID NO: 3267 - DNA, 1240 bp, Homo sapiens
gggttgcttctgatttttttttttactagtagaaaatgttggtataggttcgcagccgccgccgcgccgccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatggtgtttgtagcatttttatcatacagtagattccatccattcactatacttttctaactgagttgtcctacatgcaagtacatgtttttaatgttgtctgtcttctgtgctgttcctgtaagtttgctattaaaatacattaaactataaaaaaaaaaaaaagaaaatgttggtataaatatatgcatacacatttgtgtgtgggcatgtgtgtttgttgctttggggcagatacttaggtttggaattgccgggtcatacagccaacatcagtggctgtacaatttcacattcttatcca

SEQ ID NO: 3268 - DNA, 1109 bp, Homo sapiens
ttatatatactgggtattaaaattaaaagcaagttatatcagtgaagtaagatccttttgaatgtacaaagacccacactattgagacagcttttagatacttttttgtccattctaaaagtaagcaaacatgattgccttcttgttttctgtatgtataacccgtaaatatccattttgacataggaagaactttggttaagagtaagttctctaattgtgtttgttttaaggaatgaaacttggttaagattttgactacttcattattaaaaattgatagaattttagctcctgagatatttacaactgggagaaatgtctatttaggtgtttacattaagcggtatgaaagttgttaccacataggcactggtacgaattctcaataagaatgcagtggaacagttaagtagaactgtaactacgttggcactggtacgaattctcagtgagaatgcaatgaaacagtcaactgcagtgtttctttttgatgtcttttattttacaactgggccaaaggcacattatgtatataattagtttatatttacacactagcatataggaaatatttctgcacttgaccctatttgaattctgagcattatttataagtataaaatgatgatatataagtgaattttgtgctcttgtttgtattttattaaggaaaatgaaaataatctggcatcagtttcattttgctaaatatctagtcttcttcaaacagtatcttggtgggtgacttggctacctgaaaaatcttaggaggaatagctcacaatacaataaatctgtagattctgcttagagcaaattatggtacttttattcagacttgtttcctttctagttaacagaaatagtgacatttagaggttttaatcagaagttaggtttttctgattcaggaacatcgtaggccagccatttgtaatttttaactttgagaaacaaattttgtgagaataggtagtgggttgctggtagttaattggatttaatatttgtattaaggattaactggaaaaaatgtgtctcagtgctaattcttggacctttaatacagtgtgcttatctgttacggcctccttttatctctcttc

SEQ ID NO: 3269 - DNA, 1195 bp, Homo sapiens
aaagctaattgtcttgccaccaccaaaatgcattctgaattcaaatcccaataagatatctggtgtgatcctactcactttggctgatttttccctaatctactcctaaattcacacaggtggctgttagcaggcatcagttctttgctgagtgtttaccacagacctttcttcctcactgcatggaccttttcatagacttctttgactgttctcatatcatgacagctgtcttctcacagagcttgtaatccaggagagagaaagacaagtgaaagaggaggcccaaaatggaagctgcagtcctttataacttaatcttgaagtgatacactatcacttctgccatgctgttggtggcacagaccaacactggtgagagaggactacacaatggtgtgaataccaagagacagggatcactggtgactacttgcaggttaactccccaaaatagcaaatgctgtatttcagagtgaagaactaattttcatacttatattctgaatttatttccagtacaatcaaatttttttttacaagagatacaatgtatgttttaagatgatgaataatgtttatatacttctttctttctttttttttttttttttgggacagtctttctctgccgcctaggctggagtgcagtggcatgatcttggctcactgcaacctctgcctcctgggttcaagtgattctcctgcctcagcctcccaagtagctgggactacaggcgtgtgccatcacgcctggctagtttttgtatgttcagtagagatggggtttcaccatgttggccaggctggtctcaaactcctgacctcaggagatccacctgccttggcctcccaaagtgctgggattacaggcgtgagccaccgtgcccagccttatgtacttatttctgccaggttctatggagaagaggtattttgctatgtttacattgaatttaggagatgaccctgacaagtttgtgatgaggattattcatttagtttcttttaattctttcaattcatttgatgtcttactaatgcaaggcctaaagaattatccttataaaatctttgggaggagatatttagctaattttactcatcaagtatttatttgaaggtaaggtttttgtttatttttccttcaggtagcttaatctcttagagtagagactgtccctctattgttaaa

SEQ ID NO: 3270 - DNA, 1222 bp, Homo sapiens
accacagtgccaagaacagctagcctggggttcagttcttagtcacaagcaatacagtgaattgcggttcatttttttaaaagaaatttgactaacatagaaaacaataattcagtaggtgaactgaaaataatcacattgtaagattttatattaaatacagtgaaatatttttgtccgtactataggtctatattgtattgaatttttattctgctgtgaaaatataacaaaagcttttgttccttttcaacccaatgaaaatttataatgtaggataattacattgcatctcttatctatcagctgttataaaataaaacaataatgttttgcaagcacatatttttttccttagttcaaactttgcatgaaatttttaagtagccctctagcaaagcactgtttgtgttgaatacatttgtaatgcattcatggtgatatacacttttcttagatattagtgaaaattttttgttacaaaaagacacttttcgattgagttctgtccctatttacacatggatccttttaatggatgttgagagtcttgatttagaacttttaataggctcgtttacattttgcaaatctctacctttgaaataaaaaaaaaaaaaaaaaatgcagtgatccacccatctgcagacaattaagaccagcagccaagtataaaagggtggagaacttttaatgggtgtttatagattggaagcaccgacccccttttgaatggaagaggcctaagaagaaatagtaagtgttaaggataaccatgaaattcatttaaccccccaagcagaagatctgttatcaaagaatttgcaggattctacaccttccaacttaaggttctcagcttaaagtactttaaaaagaaatatcttattagaagtgttttgattataatttcttagctgcttgaaggtcaaaacgcaagccagcaggaagaccaatagtaaggtatgtgatataaaaacaaatatttccataaaatctttgccctagcaaaaagagaaattcttagtaggttcaaggtgggaatttagggaatagtatttttttacaggaaatactggttaggcgttttatatagggggttctgcgtttgtgaagggataatttgctctaaaatatgtgggcaaccagcctaaattctctaattgagtagtttgctcataacccgaggccattaggtgaatgtaaactgttacaggcttag

SEQ ID NO: 3271 - DNA, 1276 bp, Homo sapiens
agcagaggaacacttttattagaatgaagggttacttctttgttattcaaacacacacccacacacatcctctgtagtctccctaatgaaaaacctcaacagatggagagcctgagctcccaagtccgcaggctgagaagatgcacttcactcaagggccagtgggctggtacagactagggaagagaaaagggacaaaggctgctagtataggtaatcactatcttttaatactcctaacacatagaaattcgaaaaatcttgttcagcaatgttagcagcctgtgagcctcggaaactaatttggctgatgtgtctctgatagggagcttggggctgcaccaaggggaaacattctcctcctgtattctctcctctctctcgtttgaaagcctgtacaaagaaatggtacaaatggatggttaacttaatgattccatcagaggcagatttttctctgtcaggtccctggataaggtggaggtctgaaagccaggagacagaatatgtacttaatcgccctttctgacctgcttaccagtgaccaggactactctccaggcctttcttctgccacttccccattcttcctggctagttcagttgggtctcagcacttcaactcctggctggatcctgagtttttcttggttgcagggaaagctctcactgtctgcatctccttccccacccccacctcccgttttgcagctggccattctggctgcctcacagctatcctgccttaattcatatttgattgcctggacagaaccacctagaatgtccagacgactgccacccctcagccatgggcctgagatcctgccctgacccctttcttcagaccccaggaggacccacaatctccctgatccccaccttccccaaagtagtctctaggaaaaaagcagagctggctaaggcctgagacagagccatttcttccccttgggcaaacgaggtagaccctcccagagaccaatgccggagaggcccggatccgagctccctttatatggcctcccccatcacggatcccgtgggaaaacctgacacacaatggcgcggctgctccgggcaccctcaacccagcgccctgcggcaaggcctggagcagcctggtggtcttggtgcgctccctttgccctccccgcaaccctctgcgagcactcgtcccaggagagagaccctggctagggtggaggttgcctcccgcaaagggcgctgttgctggggcctcccctcccccattctcttgtttttctgcttctga

SEQ ID NO: 3272 - DNA, 1193 bp, Homo sapiens
aacatatgtgacactcaaatgctcaattccctgttgaagaaatgaatgatagaccttatctatcatttatttgactcatgtgtacacccatgtatatcacagacatttttatttaattattcaagaattggcacatgagaagcattatctaattcctctgggaccttccactggcaaaaataaatgcaatgactgtggctaccagatgaattttgccctttttcttatatttgaaagtaatgactttattatttctgaatttaattatttaaattttaagcaaaacagaaaatcactacaaagaaaaaaatgtcaacaaaatcttactatgtagaagaaaccgaccccttccctcagctgccgccaagctgctcggtccttccgaggaagctaaggccgcgttggggtaaggccctcacttcatcctgcgactagcaccgcgtccggcagcgcctgccctacactcgcccgtgccatggcctccgtctccaagctcgcctgcatctactcggccctcattctgcacgacgatgaggtgacagtcacggaggataagatcaatgccctcattaaagcagccggtgtaaatgttgaacctttttggcctggcttgtttgcaaaggccctggccaacgtcaacattgggagcctcatctgcaatgtaggggctggtggacctgctccagcagctggtgctgcaccagcaggacgtcctgccccctccactgctgctgctccagctgaggagaagaaagtggaagcaaagaaagaagaatccaaggagtctgatgatgacatgggccttggtctttttgactaaacctcttttataacgtgttcaataaaaagctgaacttaaaaaaaaaaagaagtaaccatcattaatattaggtgaacatctttcttgacagctctatgtagacactcagatattaggagtgatcggtgcataaataacttggtacatagaaataattttataaaactggatacatattatgcatgctatttttaaataaaaatattaaatttacatttacttagacgtaataagagagagaaaccagatgaaactaacagataactgtttcttcttcactaagagagccctctagaagtatgggagaaaaatatttacaagtttggatttttttagcaatccaaatgtgttgttgaactttattaaagtgttc

SEQ ID NO: 3273 - DNA, 1228 bp, Homo sapiens
ttattcaacaggctacagttcttagcaggagagagagcgaggagttgtcaggaaagctgcaggttactttgagacagtcgtcccaaatgcattagaggaactgtaaaaatctgccacagaaggaacgatgatccatagtcagaaaagttactgcagcttaaacaggaaacccttcttgttcaggactgtcatagccacagtttgcaaaaagtgcagctattgattaatgcaatgtagtgtcaattagatgtacattcctgaggtcttttatctgttgtagctttgtctttttctttttcttttcattacatcaggtatattgccctgtaaattgtggtagtggtaccaggaataaaaaattaaggaatttttaacttttcaatatttgtgtagttcagtttttctacattttagtacagaaactttaacaaaatgcagtttcgaaggtgtttccttgtgagttaacaagtaaagaagatcattgttaattactattttgtatgaattttgctaaagttaactgtaaagaaacacctgctgacttgcagtttaaggggaatctattctccccatttccaaaccatgatatgaatgggcgctgacatgtggagagaatagataatttgtgtgtttgcaatgtgtgttttagataaataggattgggtatttaaattagcatttgtgaatttaatagcattaagattaccttcaaatgaaaaaaaatctcaaaatttctatttggtttttgtgcattttcttttaaaatgtaatcatatgattttagtgtgttagacttgctgagtcctagctgtgtttagaacatctctattctacatttaccttggtcaaatttgaactgctgccataggttttgggtgtaaagaatgtttactgccctccatttaaattctgaaaagggatggtggatgttttccctctcctacgttagaaaccattcttaaaaacttttgaaaatatagaaccattaagcctgctatatctgagcaaattagtgggtaccttttttttcttatttaaagcacaagaggcccataaatcttgagttactttaaattcttttttttgatacaagttttcagagcaagagaataaaaatcatgtgttattaaacccctaactggctggcatgctttcctgtttgtattctatacattttgctggatgaaaccaaggatagttcaggtataattgtccaaaataacctaac

SEQ ID NO: 3274 - DNA, 1222 bp, Homo sapiens
tagtttagtggccagtaaacacctgttcctgagtgatacatctttaaggagccggtagatgggtcaacctggctggacttgctttttcaagtctgccttgtctattagaaaggctgagcttactgattttgcctgtcacgtttgagtgttcctgagactttgcccagcctcggtcttatctgcgggtaccccagcctctgcattccttgcccctacaaaatgtgctgccagttccaaaggcacaaatgaaaattagcttggctggagcatggctaggcacacaccagtggttaaagaaatgctgtttgctggctgacacttctggagtggaagtttattcttttttcttttttttttttttttttgcggggtggggcagagttttgctcttgttgcccaggttggagtgcaatggcacgatctcggcttggagcgatcttgggtcaccataacctccgcctcctgggttcaagcgattctcttgcctcagcctctggagtagctgagattataggctcccgctaccacgcccggctaattttttgtatttttagtagagacagggtttcaccatgttggccaggctggtcttgaactcctgaccttacgatccacctgcctcggcctcccaaagtgctgggattacaggcttgagccacggcgcccggcctttattcctttctttggcctcaattttattgttaagagatagtgggaagggcccaattttgaaatgatcctggaattaatgtaggaggccttgtataagcagttaatgtgtatttattgagtgggtaccctgtgccaatatgatacaaggtgtgaaggacacatgagttgggaaaggcatggggaaatgcacgctcacactgctggtgcgagtgtaaaaggtacagtctctatgtagggctatttggcagtatatactctttgacccagcaactccacttttaagtatttatcttagggataccctcacacatttatgaaatgatttatatacaaggatattcattatagcaatatttgtaatggcaaaaagaaacaaaagtcagatgggggactgattaaataattatgttattaagtaatactgtttcagtacatctgtgtaatgaaataatgtccagtcattaaaaatagtgaggcaaagtctgggtgcagtggctcacgcctgtaatcccagcaccttgggaggctgaagccggaggattgcttgaga

SEQ ID NO: 3275 - DNA, 1190 bp, Homo sapiens
ctagcattaaacacagtgccaggcacgaaataggtggtgagaaataagaaaatgatagagctatttgctctaatggttagaggcaatgatggtcagctttgagttactttggtgaccccgcagggaggaagagcacaggtggaacattagaatctctttcaggaaaaggatgccgctggatccatcaggtccagtagcactgcccatttctcctgctccaaggcatctgccctcgaaagcccccaggccacacccgaggacaccacccagggttctaggacacctcgagggcggacgtggtttggctctcggtccagctggaccgggctgggccaaccgggagtcagctcgaactcacctgcttggcaggtgcgcgcttcccgaggcgtgacaagggagcgccggcgcggtgggtggggggcagagaatgtgaagctccagacgcatggcacccgccgccaagtcgccgcggtggctgccgggatgcgccgcagcgaatggtcgcgccgggcgccgctctgagtgacctttcacccgcgcccagcggttccgggcggcagcacaaggcggtagccatggcggaggcggcggctgcagcgggtgggactggcttgggcgcgggcgcgagctacgggtctgcagcggaccgggaccgggacccggacccggaccgcgccgggcggaggctgcgggttctctctggccatctgctgggccggccccgggaggctctgagtaccaatgagtgcaaagcgcggagagccgcgtcggcggccacggcagcgcccacggccactcccgccgcgcaggagtcgggcaccatcccaaagaagcggtgagtagcggtatgtggaaggagttagcgtcgagggaccaggccgggcctgtgctgcaggagggcacaggcgaggtgggaagggaagtgacacgggtgggcggaaggcatcccggtccctgaaagtagggacccacctctctttcgagagagtggactagaccctggattctgtcaggaagggggcgggatgggatggtggattttggtcactatgtgagggtaacaggcttgaagaactctcgttggagaagggtttaaaggattcctttttcctgagcttttagtgccaggaattcattttttatcttgaattaatacttttggtgctgaggtcttggaatgggtagcagag

SEQ ID NO: 3276 - DNA, 1132 bp, Homo sapiens
gcgaggtctgctcagcccagtctcattctcagcaaaaaccctgaattcatactcagtagcttccagcaaacctcctattgtgaattgcttgtccttaatacgttccttattgctcttcttccaggcactgtctccagactgtctatattcaacccagtatccaagaatttctttaccaccatcacattcaggtttctcccactgtagagtgacactatctttggatattgaaagaatctcaagttctcctggttggcttggtttatctgaaatattttaaaataatgaaaagggagtcagctttactggtgaaataaaaggaccaaacatggcttgcttctttaatttaaccccttcttctgaattccttaccaaatggatctttgcaaacaactggttcagaagcagggctggtctcactcaggccaacatcattctgtgcgatgatgcggaactgatactcagcatcgggaacaagccctgtgacagtgtacattgtggtggtgatctgagtcttgttgtgtctgacccacttgtcagtggatgtctctttgcgttcgatgtagtagcctgtgactctagaaccaccatcatctttgggccgggaccaggacaagctaacagaactcttggttacatcgagtacttctggaggattgcttggaggttctggaggatctgtaaatataagtggaaagcacacatgtattagaatacagtcccaagtattataagccaatgactttcatttaaaaacagaaaagtgctgaaataatgtttataattttgtggttgaaagggcacttactcaatggtgtttttggtgtgactggttcctcagatttcaagggtttgcttatgccaaactggttttctgctgaaacacggaaatggtattctacattctctttgaggccttttaccaccagagatgtacctcggactctggaatcaatggtataccaggcggctttaggcacttctcgtctctcgaggatgtagcctaagatgtcagcaccaccatcatcagcaggaggtctccagctgaccctcacagagcggacttggatgtcatcatattccagtggcccttctggactgttgggacttcctatcaccctgaccttgatgt

SEQ ID NO: 3277 - DNA, 1149 bp, Homo sapiens
atacacacataaatatatacttccgatagtctatgtgaacatgaaccttttttattttaataaataaaataatttggcatagaaaaatataagaaatttaaggcagaattatccatttagtgactttgtgctttagaaattagtccccagaaacggaagcatacttacatatgggatctcctgcaacctctggatctgatggttcactgggaggaccaattcctgcagcatttattgccatggctctgaactggtatttaacgccttcaagcaaacgaggaacattaaattccacgcctttcaatcccactttggttattggtgctcggctaacacgtgaccaataaggacttccctcttctcttttctccagccagtagccagtaattggagagccaccattgtccaaaggaggagtccagctcactagcattgatcctttggtgcgtgccaaaacttttggttttcctggaggtccaggaaggcgataaggatcttgaatgactactttatctgatttgcactcatcactgattccatatttattcactgccctgactcggaactcatactgaccattggggataagtttccagatctagaaattagaaaaacagaaatttattgaagagaatatacttatgttggttttcactcatttaaaaattcaacttattttgggagggatgactgtaagaagaaataaatatatagactcaaaacatgggaagacagagaaaaggagaaagctttttttaaaataaaaatatgtagatgtattgtacctgatagtggatctcaattaaaagagtatctgtgtatcaaacgctatgtactaaggagccttatgtgtgtggggctaaacactacaataacaaaataacagcttatcgtgtgtggttttgagtttaattatcaaattccaaggttatattaaaatggcatcaaaccagagtcatgtacttttaatgtgtataagaaaatattcagaagagtttaccccatatcttttctctacagcagtgttggtgacttcctcccattctgctttcttcctacttgcatcacgtttgtcaataacataatgggtgatttcactgccaccattatcaagaggggcatcccatgtcaagtagcaagattcagctt

SEQ ID NO: 3278 - DNA, 1213 bp, Homo sapiens
taaggctcagacttgaagaaacttgccaatggtagttaatagcaacaggaggtacttagttgaaagaaatataattgctgatatttgactttctgatctaagaaaacagcactttcatatggttcaaactaatatctaaatctcctgattgtgagtccagtgtttttcaagtaatagtaaattaataatactaaaaagagagcaattaaagtcaagaatacattttatactacaattatctttaaaagtaaagtggtgaccagagaagttgtgactaacttttttttttccattttggctagaccaaaagtaaatataaagttatttgacagtacaagatgacaggtatacagtcacagaccttagcattttctcgggaaagttcacactcaaatcgagccatttctttttctctaacttgaaggtcggtgagtggtcttaagaattccacatgaggagctgtaagagaatgtcatcagaattcaaaatgaggtttctggaaatttactctgacattaccatagtatacattaagaaaaagtgactcttttttagggattttccatcttaatagactacaactgactttgaaatcacttgaagctgcccatcaggtatgatgctttgctttttagatatctctttagtttacataaaattatgtggcattctatatgttcaactagtgtgcatgtgtgtgtgtacagtatatatactagggagccatctcagttcttttgaataatagctggaggaaaaatcttcatttgcactgcaccagacttgaaagataatgtcaaaggaaacttcagacaccagtggcaaagaaacattgtcttatttaaggcacttagcacaatctttgagaaattagcagaattcaaagatagaacacgtgaagcactatggccagccttgtgtatggctaagaggcatgaggctgtaattgaaacatacatttagctttttaaaaaaatcagctttgaagacgtcacatataagtcaggcataacatctattagtgcaataaagcaatgtgttttgtatgggagggtgattaggattttacatctgttatttcattcatctgtagaattaattcagctggtgtataggattagggagctgcccccttgcccttccttctttcagagctccctgtgagtccttcccaagatgaccattcttgagcaataagattctgagacaaatg

SEQ ID NO: 3279 - DNA, 1199 bp, Homo sapiens
taaaatatatagtccctgccatcagtgacttcattagtgaggaaaacattagtaaacaattaaaatgcaatataggtactattattatagagcttaagggagcataagatgtgtaaaacaacccagttggggaaaagagaaagagttagaaaatacttcttgaaagaagtcatatccaatctgtcatgaaaatgaataggaagccttaggagatcactgtgtatttggggaactggcaatacttcatgaatctgacaaaaagatcaataattgggtcaagtggtgtggggaaatataatatagctggctaaataggtaggcaaagctcaagtcacaggggcctaacttgccaatttgagtttttttcttaatgaaataatgaatttaggttttatatgatgaaaaaattggagagccattgaaggaatttgtcatactcaagagtatctttggaaagataactggtaaaactcagagtggattagaagagggtgagattagaaaggaaaaattacttagaagactgtttccattagtaaaggagtaataggtgatcagaatttgctttttttcttttatttttaaggaaattttgtcaactccatacaaactgcttttgctgctggtattggctggctgatcactttttgttcaaaaggaggaggtaatactattttttaattttgttggaatgagaacatgacatttaaatttttggtgacagttttaagtatgctactgtaattgattattaagtactagaaactacaatttatgcccaggattacaatttttttacttaatgaatattcgcctttttcattattttacacatgaggttattattcattttttaatgtatcctctatgtttttatgttcagtggaccagtttttcagcttagactcatgataaattgtaccttcagatagccacagatgttatttgacaatttgcaaaaataactagttgtttacagctctaacccctcccaaaataataattttttggaaatatggactttgcttcatgcttatatatatctctcaaacatacatagatttgcctcatacaattatatacttgaagatgacagcttcttctaggaacctttccttgaataaattaagttgaaaattcagtactctgcatagcaagccgtaaactgtaaactgtgttcaagcaatgtggttggttaa

SEQ ID NO: 3280 - DNA, 1181 bp, Homo sapiens
acagaatttacagctttccatttcattatagtcggtcttatgtttggttttgcttcctagcttagtctttgattgccaggtagagttgatagtacaaaaaaaaaatatttttgtattgtcttttatttctagtatatcagtgaggaaaatgaaagtgctcaatatattcctgttgattaaataaatttaattgaaaagtagctctttttaaacagtttgatatacattcactgtggcacatttacattttagattaagtaaaaggaaaataatatgtgtctattgctaataagaacaatatagaagttatgccttactggttgtcaataaatgttcccattataaataacttatgatttttgtttataaacaagttataaataacttgttttgatggattttttgaattttacagattgtacaagaatctccattccttacaatggatcttttggaatcttgttttccttatgtcttgctgagaaatgcataccatgctgtctacaaacaaagtgttacatcttctgcataaaattacctacttaatcaagataagcacgcatttttgttgccttggttttacctgtagactgtggaactattttaccttaagacctgaaaaagttttgtggattataaatttctttcatacggttgtattttctgatcattggtttcttaatatggttgtactacagtatacttggttgatttaggttgcacattcactgaattcactgagattattcctataattttaaagtatcatttatttgaaaaacatacattatcaacatgtttttgatatttgataatgaaaaaaatctttgcttgtttatttctgaaaaagaactgtatttagtgattattttagatagtgatattatagtattcatctgtgtgtaaattatttcatatagggaagagttctgatctgtacctatggttcttattgaaaacaacattggatgtgcatttctgtgatgttatgaatacatttctactttattttgaaacatttgccaaactaaatactgtaacactgtataacatttaaaaatgttaaagaactgcttagtattagaagcagatcatttcccaaaattctaagagcagcagcatatgttgttgcttgtataaagcctagcgataatttttagactaacttccatggtgccctg

SEQ ID NO: 3281 - DNA, 1193 bp, Homo sapiens
acaccttagcactataaagacaattttagcagcttccagttcttttgaactagggctcttgtattaaaatgtttaaagtgaatgaggaaaacattttggaaaagacatttaaacataagcttttattttataacacttagaaagaaacatgtctagtactctactgaatatttaattttgtaatattttattagcttcagatgaatacaatcctacctcaaaccaagaattttttttctttttcttttttttaggtttgagctttttccttcactgctgttctgcgctaactgcttcgaaactttccatgcatttttttcagtagaagaacatctctgtactgtctcccattgcatatttcagctgtgacaatccctgcactttgcctattcattttatcacctgctcaccaaaaacaataaatatctctttaatttctaattgcagatttgctatttttgattttagaagaagggtgcatttcacttttttttattactgttgttttataggcatgtggagaccccaaggcaaaaccatcctatcttatcgacaaaaacctggaatctgctgtgaaattcatagtcagaaaattccctgctgtagaaacccgcaacaacaatgtaagttatctaaatttttctattgcttaattttaagcatcttttagagaaacagtggtcaacacagtgcttatagtagctcttatttacctaatttttaacattttgatatacagattatataccttaagggtttttttgagacaatattcttatgtccgagaccggaaaaaaataactcttaacgacattgccactttattacagcaaagatcttagattactatatatttattccctttcaaattgcaacaagagtaaggtaatagatatgtatatattccaaattcttgtgtggatacttgggatatttttgtttcttatagtcataaacttcctgttgaagttagtaaatgtctgcatagagcttctgttgttttaagtagttagctgtatttagttttaaaatgtgtttgtttttctagtattttcataattgacaatgatttctaaagattaaatagtacaagtaaatgattgtgttagggtctttattatctccatattacttttcatatgggaaagttttttcttagtatactgaagaatggtcatgttcagaatcttcct

SEQ ID NO: 3282 - DNA, 1219 bp, Homo sapiens
atgtcaatgtccaccagccagaaataccaggacacaactctagttgaaccaagttgggaacattggtatttgttgaaacaaggttaactgcacaccatggagaaccttgatgcatctctttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcttcccaaagtgctgggattacaggcgtgagccaccgcgcccggccgatgcatctcttgaagagagtataaggggttgttctttcggatttgggattgtgtgaggtgtattttctggatagtttactaaaacattgtttaattctggattggatactgtgataaagaaaagacaattccatattgggtatcttaggactttctatctaggagcaaagagaaacaaagtgggggtagggctgtaattggtggaaaagcagctttcctcataatggctggcagagggagatgttgggtaagaaaaactgtgtttttggtaatgtatgtgctcaaatgtgattgtggagtggacttgttattgttaagctccatcacagtcatagagtgaccttgtctgacattagtgtatcgtgaaactttatatttgacaagagaatactattcctcacttttagatccagacaagctcctacccatcagttattgagagctgctttttcctttctcagatatgaccatgagatggatgattgcaagagaaggtaggaggacaagcttataagagaagattatttcagggacatgagatccaaagctgagaagttttaggaatgaggtgtcaagatggagcaaagagggcttgtgccacatattaccacattagtataaggaatttggaggataaaacatccacctctggagagagatacagggtaaatagtgttttcaggagaaacaggcttcacttagagcaaaaaagaaaagaagtttaacttcagtgaaaagtttgaatctacagaatttttttgataatagacacttacgaattcaaggaggaca

SEQ ID NO: 3283 - DNA, 1183 bp, Homo sapiens
tgaaaaagtacatgccattataaatttgtccaaactcttagaatatacaacaatgaaagtgacccctaatgtaaagtgtggttctaggtgataatgatatgtcagtgtaggttcattaattgtaacatgcaccgttctggtgggggatgtttatatgggggaagccatgcatgtctaggggcagagagattcaggaaatccctataccttctgctcaggtttgctgtgaacctaaaactattttaaaaaatcaattttgttaagaaaaagtaagttgggaaggagcgtttgacagagaaagtgcagaaattgataagtaaatgttatgttggatttgtgggttacaaattaattgtaactgtacattagaattatttggagtaatatgaagtaatatcagtgccaataaggggcctggacaagctttgttttgtttgttccccaaatgatttaaattatcttataagggtgagaaccacattggtatatgactagtccacaaaattatttctttttttttttttgtgggggacctaaaactactagattgcctttttacattaccttctacaaaattactggaattaatgaagacaataaaaaaatactaaaatttaactataatgcacctcatgcctcctaagcttcattatgttttacccagagagggaagaaattttggaatagactctctaattgcactgacggtgaggagaattagtttttaaattcattttatggcattccaggaggtattgtaaactattagtagcatatacttgtaaaagttattattccttaacaaattaaaaatatagttattgaaatattttgaagaggcatatgcaggaagaagcatgcgtgtaagttttgactggtaagtggaaaaccacaaatcaaacttgtaattgtcttatgttgatgttcataaaaggggagggcagtttctacatttttcactataagagatgtgtggttctgagtctgggacagagtagggggtctgtaaatgtttgatgaacaaataaaacatcctagaaaggaagggaaaagtggatggtaggtaactgatatggtttcacttagtgtctcaacccaaatatcatcttaaattgtaatccccctaatccccacatgtccagggaggaaccaggtgggaggtgattggatcatggggccgttt

SEQ ID NO: 3284 - DNA, 1221 bp, Homo sapiens
ttgtaaaaaatatccatgtgtctatacattgaacacattgtctagaaattaagaaacattttaccctttgggagctcatggtcataagggcagaatctagaggagaagacaagcacacaagcattgtggtgatgtgtacaaatataatagaccagagtccaaaggagatacacctaactgagcctgggaggaaagggaggtggtaggacctgggaggagtgggaatgggagctaagtcctggaggcacatgagggcctaagagattattgctcctgcaaatttcaagtggtgttaaattattagtttttatgaggtgatggtggatgaggctggacaggcaagcaaggaccacacatgaaagccatgaagagctgctgaaaagttcagattttgtccttaaagcaattgagagctgttggtgaatttcctaaagacacgaatatgaatagttttgaggtgtagaaagacagctctggcaatagagaatggagagtaagaagatgacagaggaagctaggtaggggccagctgaaagagttgcaataatccaagtgaaaagtattgtaactctgaattaaagcaatgacagtgtggatattggaaaaggaacagattcaggcccatttaagaaggggaattttgagactgattgtggtgagggaatgaaagggaagagaaaatctagatctatttggttcagtctattgagtacaaagtgctatttttccctggaagacagggtagagaaagttgggaggggacttatattatattgattcctgtcactaccaatacctctatttataaaaattgactctataaaatcttctaaggagttaattattgacagctcatgactagaacagtgagaagatgagaacattgattttgcatttttcattagaaatgaacatatacatgagttatttacttatttacatgaagaaaaagtatacaaatacctgtattaacaaagttattacttctacatattaattcatttttattgccataatttctggcattaggaattaccaaataagaaggggtatgacttataatgaggtgttcaataaattgggccaatttagtcatatgaagaattcatgttcaaataaaccaacatgccagagcgtgtaggtttcagttaacatcatgcaattgggggaagtaaataaataaaagttttcaattgtaattttgccctctatgtacatttc

SEQ ID NO: 3285 - DNA, 1150 bp, Homo sapiens
tgcaacaggccattattcaatgggtccaacagtttgagaatgtagtggatggcccagctggatttcagtgtgtactatacctgtgtaattatggggaaaatatctctcacttgagacagaaatttaattccattatttgaagccatgagattagatatttcctatgcatcagttaaaatcgtctaatttctaaaaaaagtatgtagagtatgcaaggatttgcctttacttaagtatttatgactttattttctttgtttttgtagagacagggtcttgctctgttgctcaggctggagtggagtggcgtgatcatagctcaccacagcctccaactcctgggtacaagggatactcccagcctcccaagtagctagaactacaagtgtgtgccaccatgcccagctaatttaaaaatatttttgtagagatgaggtcttgctatgttgcccaggcaggtttggaactcctggcatcaagcaatcctcccacctcagcctcctaaagtgctgggattatacctttgagccatcacgcccagcctatgaccttatttttatcaatacacaatatatttaaaggtcttagacacacacacaaatttacaaaaacacgcaaagaattatgaagaactgtcaaatgttaagtttattaaagtgtggcaagtcagttgatttggcttgaagtatgatcaaaagtgttttttgatagtttctgaagaaatcataatattgtcaacttagggaaataaagaaacttaaatatattagaataactaaacataaactacaattgtttattgagttactaaataatccagaacttctatgggccacaaaagtattattctgacattctaatggttattttattctttgtttagttttggcagctaactatggatccacctacatgtcagtgttaaggcattgactctttccctccctgacctaactcccatacagagttacgcaatattgaaaatctttttctcattgcgatcatatacaattttgtgctcctttacagccaatggttccagcaagggaatgggaaatatgagagcacgaagataatgggtttaggagaaaatttgaaagtaaaataaataggtccttgtggccaaattaaataggacctcgtgaatttt

SEQ ID NO: 3286 - DNA, 1109 bp, Homo sapiens
aaagctgagggagttcagtaccaccagacctatcttacaagaattgctaaatgaaattctcaaagcttaaagaaaaggatgctaattactaccatgaaaacaggaaaatataaaattcactggtaaaagtaaatacacagtctaattcagaatattctaatcctgtaatggtgacatgtaaatcacctgtattttcagtatgaaagctaaaagacaaagctattaaaaagtagtaataactacaataattatttaaggattacacagtgtaaaaggatgtaaattatgacatcaaaaacataaaatgtgagtgatatggtaaaagtgtagcatttctgtatgtagtcaaaattaattttatcagtttaaaatagcctcttttaactgtaaggtgtcttgtgtaagcctgctggcaaccacaaagcaaaacctctagtaaatgcacaaataagaaaaagtagggaatcagaacatactaccagagaaaataatctcaaaggaagacagcaacaaaggaagaaaggaacaaaggatgtacaaaacaactagaaaaatattaacaaaatggcagtaataaatcgtttcctatcaataattaccttgaatgttaatggattaaattctcccatcaaaagacatagagtggatgaatggattaaaaaaaacaagtcccaactatatgctttctacaagaaacttatttaatttttaagtacacacacagattaaaagtaaaaggatgcaaaaagaaattccatgtaaatggaaaccaaaagagagcagaggtagtgctgtgatttgaaaatgtcccccaaatttcatgttgatagctcagtccccaaattcatatgtttactggaggtagggcctttgggaggtaattaagattagatgaggttatcagggtgaggccaatgagatgggactggtgtctttacaagcagcagaagagagaccggagctaacacatttgctctgtcttgccatgtgatgcctcccaccattgtcatgatgtagcaggaaggccctcaccagatgccagcaccatactcttggacatctcagcctctagaactgcgagttaaataaacttctattgtttattattt

SEQ ID NO: 3287 - DNA, 1213 bp, Homo sapiens
gatgactgcttcaaacatagcactctttttgatatttaagttcggtttcgtatgttgaatacgtggatttctgataacagttcacatgtttacgaaaaattcaggttcctaatcttcctgacaggtggttgatcactaggtttgggatgtactttaggaatctgcatttttaatatcgtcccaggtgattctgctcatcactcgtatttggtaacaacttcctgtactcactccatgattcctcacttggaaaagtagttgccaatagctgctagcaaaactttttacccatgattctaaacactgactacacataagaatcacatgaagaacttaataagattctgtgtgctggggcctagtttactgaaaaatttctcagttgtgtctaatatgcaagacaggatggaaaacgactgatctaaagtaaagatcttgtgttgtaatctaaattcttctcataatgagatctattattaatcttcagtacttggcatataatgggcacccagcataagaaaatctggatagctgctacataaaaatgtcagtcaggcttgaaaagatcccctgtgctagctggcttgcttactgcaccactggcctctcatactcaaatacaaaaacatatattatacatatatgtgtaccctttttgtgttatctatgttccacagcccaaaaccagactctctgatagaaaattgaataaatcatgttgcagttacttctctggtttaaaaacaaattagcctttcatttacgtgttatttttgatggtattatttcttgactatgtgtcatatagtcattcaacacctaattgagcacccaccgtgtgctaaatactgttatgattgcacaaaacaaaacacttctaagtcccagtagtaaactgactggattagttaatatgatacagtaagatgaaaggtggtctagagaaaaataaagcaggggagggaaatgagcaacataggaggagtaaatactaaatgagaggaagaagggctgtgcagctgtgttggagaagggaggccggtggaagtgagccagtggagaatagattatatttagcatcgtaggctattggaaggacttttgcttttactctgagtaaaaagaatacccttaaggagatattttttaaagggatataaagagaagaatgtgtcagtattacagaaaaggagattttaccctaatattatgg

SEQ ID NO: 3288 - DNA, 1218 bp, Homo sapiens
cctagcatcaaagggaagttagagtgagcttataaactgtaattctagacaatgtctattggaagttcagggtgaggtagggaggaagtcctctctgtgtgatcaaaagcaagtgtgttttggttaatcaggatgaagcataacattgggggctgtttcatgattttagagtttggagctgttaggaagagaatttcagcttagttttgcaggcagcccaaggagcaaaggaaaggaaggaactaatgactgttcttgatgtgtccaaacaccaaatcattaataaatatttattcagggccagattgtactagattccagggatataactgtgagcagggctgtcttggtccatgtacatacagagcttgcttagagtctattgaggaaaatagatgatatcatttacaccaaaggagataagcactgtgccggggatgtagaggatgctatggaggaagcgtggcatgacctgagccatgcgcacacatgcgtgtgtgtgtgtgtgtgtatgtatgtgtgtgtgtttggcaggaaggctttccagagcctgaagaatgcgtaaacattatccaggtgcagggatatatgggatggggttggagaattgagaggatgtggcaggggaaacagagagaacatgggccatcaaagaaactgaaagtagttcagtcagtcttgtgtgcagatgttttggtggataagaagctgttggggaggagtgaagagagatgagttgaagactaagaggggactaaataatacgtgactttggaaagatctgttgcgaattgtggtctttatccaaagctgggattcttaactagtttttgtgacatggacctctttggcagtctgatgaaacctgtaagtttttcagaaaataatgtttttagttgaataagataagatgcataagattcaaaagaaaaccaattacattgaaatactgatatcgggccaactttgtgatatattaaaaccaactttgtgacatagtaatataaatgattctttttttttcttttttttgagacagagtctcactctgtcacccaggctggagtgaagtggcatgagcacggttggctgcagccaagacctcctgggcgatcctctcacctcagcctccagagtagctgggaccataggtgcataccaccacacctggctaatttaaaaaaaaattctatatatatatatatatatatattctga

SEQ ID NO: 3289 - DNA, 1166 bp, Homo sapiens
agatggagatgaagtttggaaccaggcagcttggctctagagccctcacttttaaccactatcgtataccaccagggctccgtactgctaggcttgtttagttcttaggtctatgtcttataattcttctattttttttcttctgtattattgtgtgtgcttctgatttttcagttaattttgcctgtaaatctggatgaggcctaaaggatgagtcagctgttcctatataataaaatacatggctttgtgataactttcttctttggtttggtttttgagggtgttcatttgctattttttactttcaaatttggtgttactggggtaaaaatttatacttagaaaatacttgtttttcactgagaattctgcagcttccccacccctcccccatcaatgtctcttttctcaggagaaacatcagatggagtgaggaagtcagttcacaaggtctttgcttccatgcttggagagaatgaagatgatgaggaggaagaggaagaagaggaggaggaggaggaggaggaagaaacacctgagcaacccactgcgggcgatgtatttgtattggagatggttctcaatcgtgaaaccaagaaaatgatgaaagtaaatttttacttattttggtatttataaacaatgaagaaagtgacatagtaattgaagtctgtaagttatacctgggaaacaattcaaactgtacgaaaggaaatactatgacacaactattgttatttgtttattatgtttcctattagataatgtttatgtaaaaccttaattatagccgggcatggtggtgtgcctgtagcccagctgctccggaggctgaggtaggatcagctgagcctggggaagtcaaggctgcagcacttcagcctaggtgtcagaacaagaccctgtctcaaaaaattaaatacagtacaacacaataaataaataaagtcaaagcaaagtggctcatttaaaccaattgggccatttattttttaaaaaatgctagaaaggtagaatctaacacacacacagacacacagacaaaaccttaattattgcttatgtcaaaatggactgcgcttttgctattaaaaggtccatactggtgaggcacagtggctcatgtctgtaatggcagcagttcgggaggctgaggcaggagg

SEQ ID NO: 3290 - DNA, 1224 bp, Homo sapiens
cctatgttttctgtaaactggtagttagatctagaatcttgattagattcagattaattttttatagtaagaatgttttataagtagagctgtggatcgcctattttatggtaccaggaggtacataatatctggttttaccacttttagagaaaaagatattggtaggctcagtggtgacagcatgatccatccattataaagtgcccagtcagtctttcacttgatggtttttagtagccattaaatacagtagacagaattttttgagaactataaatttttgatcagtagcattttctttcctgtatactttaggagttagtcaataatccttgaataacttctaaggtttttagtatgatttttgtaattagttcaccttttgacatctaggttatatcaacatggtgttttgatggactttgatggtgttagatactctatctattcaatccattgatgaatgagtcagaattccctatacaccgaagtagtatggaatatcagcaattttcataatgagggttacctttgaggataggccccttcttagtagcggcaaaaaccctttacaaaaatgggttggatctttataggctgctagattttctgtgtccaggctgtgcagatctgttctgttgtcttgcttctttaatgtcacattattgttctgggaagtacaggtaactgatacaggactcacacaagtattttgcctacagagaaacaccacacttttttatttgtttcctgtcagctttcttttatatattcctgaaaaatgtcttaacattttatgtaagctgaatgagagcagagactatgtctgcctgattcatcattttccctgagggcttagtatatcattccttggccatagaatggactttataagtatcagttgaataaaagcattgatttcttggttgtcctatctgtgattcaaaggacaaatttatgtagctatgtgagcagtgcttctcatcctcttatgtcttggtaggatttcactagttagataatcatatctcagaacattgctcttacttccttaaaagttgcagttaagatctcaggtcacactgctgtttttgtttgtttgtttttgttttgttttgttttgttttttgagatggagtctcgctctgtcgcccaggctggagtgcagtggcgcgatctcggctcactgcaagctccgcctcccaggttcatgccattctc

SEQ ID NO: 3291 - DNA, 1202 bp, Homo sapiens
ataatactttaagttctgggatacttgtgctgaacgtgcaggtttgttacataggtatatatgtgccatggtggtttgctgcacctatcaacctgtcatctaggttttaagccctgcatgcattaggtatttgtcctaatgctctccctcccctttccccccactgcctgtaagttaaagatttttaaaagattacttagcaagaaaagtagtgtattgaattaagttacttttcctgattatcattagggtatattgtgccatatggtagaacaattgtgtggtgacaggggagtgagttttgtctcttccattgcagcttaagagcagtgtaattagtaggttcccccccccccaactccccaagggaaataattttgaatcatatctttatgttttcttaattttgttaaggttatgtatgttcttaaaaattgaaataatgtaaccgttcaattattttagggtctgtttcacccagcccggaaagtcagagatgtatattggaaaatttacaactccatctacattggttcccaggacgctctcatagcacattacccaagaatctacaacgatgataagaacacctatattcgttatgaacttgactatatcttataattttattgtttattttgtgtttaatgcacagctacttcacaccttaaacttgctttgatttggtgatgtaaacttttaaacattgcagatcagtgtagaactggtcatagaggaagagctagaaatccagtagcatgatttttaaataacctgtctttgtttttgatgttaaacagtaaatgccagtagtgaccaagaacacagtgattatatacactatactggagggatttcatttttaattcatctttatgaagatttagaactcattccttgtgtttaaagggaatgtttaattgagaaataaacatttgtgtacaaaatgctaatttgtgtgtgttttttgaacatgacttgtaaaatgcggaactttgataaagtattggtttatgtggaataagtggcttaatttcattttctgtcacatggtttatagaaagtagttagctgaataaaaactatataaagtgatggcatctttgtcaaaattccattgttgtgttaataatgacagcaagaagagtagcctcaggggatgttcccctcaaactagcacaaccattccatcatcgtagaaa

SEQ ID NO: 3292 - DNA, 1099 bp, Homo sapiens
tacaggcatgagctaccgagctcagttttgaaaggtagaagtgtatgctacaagggatgtaggacttgagagtcaaggcctatggtcttgtcctggctctaccagtaagtgtgaccttcgatgtttttttctcaagtaaggctggtaataattaccacagttgtgagaattgagaatttggaaatgcagtgaaagagactatactcaagtcttgttctggactaacagtgatcttaaaatctctcatttcaaagaaataaagtattttgatgattctcttgcatggtgtattaataaacttggtataatggcagaaactgtaacctacaacaggtttacgtttaactctttttgtaggtgtttggagaagagggattgaccctgaatcttgaagacgttcagcctcatgacttaggaaaagttggagaggtcattgtgaccaaagacgatgccatgctcttaaaaggaaaaggtgacaaggctcaaattgaaaaacgtattcaagaaatcattgagcagttagatgtcacaactagtgaatatgaaaaggaaaaactgaatgaacggcttgcaaaactttcagatggagtggctgtgctgaaggtaacattcattattatgaataagtttcttgggttctgagtccaagaatgattttgcttctgtagtattccccagtagtaccatagaactaaacgaatacttgaggaattaacttcatagtggaattttgtttgttttgttttgagctcttcgtcacccaggctgggatgcagtggtgcgatctcggcgcactgcaacctccgcctcttgggttcaagcgaatctcctgccttggcctcccgagtagctgggattacaggcacttgccaccatgcctggctaattttgtatttttagtggagacagggcttcaccatgttggtcaggctggtctcaaactcctgacctcaagtgatccactcacctcagcctcccaaagtgctaggattacaggtgtgagccaccacgcccacctcaggattgctttttaagtaaactgcttttaaatgacttggcaattagcatcttgaatgaagaggccatactaactggaatt

SEQ ID NO: 3293 - DNA, 1199 bp, Homo sapiens
ttatgttaatatttaacagttataaagttagctttagttaactaaagttagcttttccagaatattttcttgaacttttacgttggagtcaggttttagtttaagccactgtgtattatttcaaagtgtaactacagtggtatttttgagtgaagatctgtaattctagtatgagtcgtatcacttagccacgaaatatatttttaatataattggatttgagtgaccatgtttcattagttgtagtgatttaaaagttaactgtttatgttgggtgaactagatatctttgctaataaacatccttccttttttaagggtggagagattcaaccagttagcgtgaaagttggagataaagttcttctcccagaatatggaggcaccaaagtagttctagatgacaaggtgtgtaaacttaataattctaaaaagaagtcagatatttgcaattagttgtcttaactaatggtttttttcacttgcaggattatttcctatttagagatggtgacattcttggaaagtacgtagactgaaataagtcactattgaaatggcatcaacatgatgctgcccattccactgaagttctgaaatctttcgtcatgtaaataatttccatatttctcttttataataaactaatgataactaatgacatccagtgtctccaaaattgtttccttgtactgatataaacacttccaaataaaaatatgtaaatgagtggttaatctttagttattttaagatgattttagggttttctagtttatgctttttttctgtttttcaagtaacctgcagagaattttgggaaacaggattttctacgtaggtgcattttcacactgaatttagctttattaatacatgattgatactgataccaagccatggatttactttttttttttttttttctgagacggattctcactctgtcacccaggctggagtgcagtggttcaatcttggcttactgcaacctccgccttctgggttcaagtgattctcctccctcagcctccagagtacctgggattacaggcgtgcaccaccatgcccagctaatttttgtgtttttagtagagacaggttttgccatgttgcccaggctagtctcagactcccaaagtgctgggattacaagcgtgagccaccacagcaacattcagatttcaaatataacaagc

SEQ ID NO: 3294 - DNA, 1155 bp, Homo sapiens
gtgaaatcctgtatctacaaaatatggaaaagttagcccggcgtgatggcgtgtgcctgtagtcccagctcctcaggaggctgaggtgggaggattgcttgagcccaggaggtggatattgcagtgatctgagattgtgccactgtactccagcctgggtgatgcagtgagaccctgtttcaaaaaaaaaaaaaaaaaaaagaaattatggtttgcaattttgatccaagttccagtcctgacaaatacaatatctgcatttatgtagtagattctatccaaatgaagttgaattgaaggataaataagtaagggtaacctactttttttcttagttactgattatgattctatacttggtttcctatttagtgtataacccaagttgaaccacaagagcagttatgtattaacaaattatatgtacttaacataagatttaccaggtgatataatttaattaaccataagaacttctttgtttttagtatattcaacagaacataagagcagattgctccaatattgacaaaattcttgaaccacctgaaggccaagatgaaggtgtgtggaagtatgaacatttaaggtaggaccttacatcaaaatactaatagtacctctcacaaaactagctttcatattaatgataattatgaattgtaaaatttactatgtaactgcagactaagaagccaaattttaaagctttggcattttcagtgtcacaaggttctcagctttcttcactggttgtttccaggtcaaattatgctgcagagtcactcattttgaaaggtggtttatttcagagttgataatttggacctgcctctgcacctctcttcttttcttttcttttttttttttttttttgagatggggtctcactctcttgcccacgttggagtgcagtggtgtaatcactgcttactgtgcctctacctcttaggctcaagtgatcctcccacttcagcttccagagtagctgggactacaggtgtgtgccagcatgcctcactaattttttaattttttgtagagacaggatctgattgtgttgcccaggctagtctcaaactcctggattcaagcaattttcctaccttgtcctcccaaagtattgagccaccctttctacatttattcatttgg

SEQ ID NO: 3295 - DNA, 1155 bp, Homo sapiens; identical to SEQ ID NO: 3294

SEQ ID NO: 3296 - DNA, 1155 bp, Homo sapiens
ctccaaatgctgttcgcactgggaatcgcaccacagtcaggatgtaactgcgtgctgagcccacacacaggaattttcttgtacaattcaaaactgaatcttatatttacttaaggcttacttttttttttgtctatgaaatcagcagtcctgtatatttagcatcagccttaagttagaatgtgaaacaattctggggggaaggaagtatccgtatggttttctaagtaatttaagaaacaggaaaacataaaagaactgattgtctgtgattaaacctcattctttccttcccatcttcctgtatagttaactaactcaattgtcggccagaaagaaatagcttattgcactgggttgtaaaatatctgagtgggccttggatgttgatgattgaatgaccttcttaacattgaacaaacaatgggaaggtttaataaatagcagatatgtgtttattatgtttttcttccctgtgcaggaataatcaagctgggaaggtggaaccctctccccctcagttatgtgacagatgcacccgacgcgacagtggccgacatgctacaagatgtctatcatgttgtgacgttgaaaatccaattacaaaggtgggtgtttctgaacatctgcttttccttactgtcagagctgctccgtcaatcatagattcactgcaaagatcagcatgtcctgtctattaatttctggacattggacaaaatgaaaagaaggagagagagggaaagaaggagagaaggagaagggtggcccttccccaggtgtctttatagtcacattccaactactttatgctttgttttcagaagcagtgaagtggtaacctaggggcggcttgacaaatcattaaaaatctatagcccttaggagtagctttacacagccccttattcaatgggtcctctaggcctgcttaaatgtgtagcacatagtatttgaagaataaacacctctgctgttttcacatttgtgttatgaggggagagttttgttcttgtaggaggtttaccaagaatgtcctgacataggagatctttttcttccctttccaagggccacatcaaaacaaacaaacaaacaaacaaacaaaaacacactttgtggcctgcagagattctggggatgatttctttattt

SEQ ID NO: 3297 - DNA, 1183 bp, Homo sapiens
atattcacataacagcttaggccttaaaatcaataccaccttagtaggaaggagctggaagctttgaaatatatttccagacaagagaaatatattacttttacacgtaaaagtaatatatttaaagagaaatatattacttttacgtgtaaaagtaatatatttattacaactggaagctttgaaatagatttttagacaagagcagatctgatctgaaaatactagtgctgatagttaatgataaaactatagacattaaaagattcgagtgtctgtgtggtcaccttcatctcacctatgtaccaggacacctctaattggtgaaaatgacgggaatctaagggcttctgccactgccctgggcaattctgtaataatagagggggaaaacccacagctttccattagacctatatgactaagaggcttgtttaatctaaaccactgtcgatcacagatgactgacttttataactgttgcttcccttctcatcgtggtgactgagatttgctttttaatgtttgtgttttgctcttgaattttgtcccttcaggtttgatgattcctgtcttttgtgtcgtggagcagttggacggctctcttgaatatgacaacagagaagaacacgccgagtttgtcctggtgcggaaagatgtgctttttagccagctggtggagactgcgctcctggccctggggtattctcacagctctgcggcccaggcccaaggtattaatgcctctcccctctcctcccaagtctcttgtgtgtcataatttgaggaagaatatgttttctgaaatagttctccaaacaaaggttgaaggagaattgtcagatttagcatttcctagtgagcagtagaatatttcttgtagaaggtcttgtttcttgttttgggaagcatttgaccagcacttctggagccacaaaatcaacttgcatttcaaaccgatcatagatttttttgcatttataacactgttattttctctaagttaggaccaatgttgagatatttaactcctgacttatccaaacttataatacatgacttataaagcattcagttttccaaatttatttattgctttgggcctgtggcttctgcactttgcaataagcttttaattaaacagaaaaaaaaatggatgtcttttatccttttgtttctttga

SEQ ID NO: 3298 - DNA, 1194 bp, Homo sapiens
tcatttaacatgaatcttgagtacgtggaccattgcttgcatgttaactttttgttttgttttgttttgttttgttttgcatttttaactccagatatcctaaagctcaattgtttggtctctggttttcatccttagagaagccatggagaacagacttgaaaagtttaggaaatcataatgtggcagaggtggtgggaagaagaaagttgagctttttccccttgagaaacttctgcatttagtttctatctttccaggcaaaacaaatgggtattcttttcatacaaccattttcaaatgaaccttagaaaagtcttaacatttaaggtattttatgcacagaatacacttagattgataggaaagaactcgtaatggagtttgagtaaagaaaatgactgatgtactaaacccagtaaaaattgttgaaaatgttaaaggtcagcatgttctaattgggaatctagatatagcttagatttcctattggcttagagtatttgctataacaaatgaagtgcaatgacaattatatattcctactcggtcatactggactggcttcgttctcttaatatactcagtaatgactcaagcctctggctattaacataccctagttgccgttttttaattgccatgagccaaatacttcttggtatacaattgatccatttattttaatggctgccttttcattttcatcttttcttgctgctacccatctatgtatgtagtcattggggggaaaatgtagccacattttttatgggaagactttgtgttaaaagtgaacattttgaaggtttttaactggtgaaactagcctggaataatgccaccagagactgagtggaaatcgccccttttgaaggtgccattcttatgagccaaaagtttgtcatttaaaagttcattttgagggaataacatgtaatataatttgaaataaaggtatagtaaccttaaaaagaacattataactgattgttgtgaatggggtgaatttgttaaaatgagtaactttgataaagtttttcatgcacaggcaaaatgtattcactagatttctacgtagtgatctgcttttactttgtaatttgtagttctcaaaagacttttttttaaaaaaataaagtccatacttacacttaggctttatacatcagtctttttttttttaaattccat

SEQ ID NO: 3299 - DNA, 1185 bp, Homo sapiens
tataattctggataactggaattagaagagggtctcttttgcacatcttatggtgggttaaagaaggtatgaggggaaaagttttttttttttttttccagtaggtagatatggtcatttcagaagaagaatgatagtgtattataaaaatttatgttaacaaactgttgtattttacctagtcgttttacatgcctaaatattgacagtatactagatatgtttgtggatagttgtacaaaaactggactaaataaagctaaactaacatctattagcatagtagaattctgtgtagattaagatttcccctaaattatttaggggaagtgttgatagtagggccattgacaacctatagcgaacattgcccaagagataaggtcagtgttgttattcacagctgcttcttatttaatttagctattgctgagtctgtctgatttgttttcttaggtgctgagggtgtaaatggaggagaggagtctgtaaacctgaatgatgcagatgaaggattttcatcaggggcttccctcagcagtcagccaattgggaccaaaccatcctcctcttctcagaggggaagcttaaggaaagtagcaactgggcgttcagccaaggataaagaaacagcctctgccatcaaatccagtgagagccctcgagattcagtagttcgcaagcagtatgtacagcaaccaactgatcttagtgtagattcagttgagctgacaccaatgaagaaacacctgagcctgcctgctggccaggtggtgccaaaaatcaatagcttaagtctaatccggacagccagtgcttcctcaagtaaatcatttgactatgtaaatggcagtcaagcaagtaccagcattggggttggcactgagggaggtactaatttagcagccaacaatgctaatcgatactcaactgtcagtctgcaggaagaccggctaggtcaagctggcgaaggtaaagagctcctcagcccaggagcccccttgaccaagcagtctcgatccccaagtttcaatatgcagctaatatcccaggtgtagttttgacatcctccctcatctttctgcttaccttttaaactgaacatttcattgtgcaagaagacacttcatcccacattgtgaaaatattggtcactgttatcagatttcatttagtttaggtatc

SEQ ID NO: 3300 - DNA, 1197 bp, Homo sapiens
caagacccaggaagagtcagtgtttcagtttgagtccaaaggcagtaaaaagccaatgtcccagttcaaatgcattcaggcaggaggaattctcttttacttgggggaagtttagccttcctcttctattcaggccttcaattgattggatgaggtccactcatattagagagtgcaatctgcttcacttagtcgaccgatttaaatgttagtctgatccagaaacaccgtgtgatggttaatattaagtgtcaacttgattggattgaaggatgtctagatagctgataacacagtggtcccaacctttttggcaccagttttgtggtatacagttttaccatggggtgggggatggtttcaggatgaaactgttccatctcagatcaggcattagattctcataaggagcagcacgacctagatcacttgtgtgtgagttcacaatagggttggtgctcctatgagaatttaatgtggccgctgatctgacaggaggcagaactcaggcggtaatgctcacccaccctgctgctcatctgctgtgacgctgggttcccaacaggccactgacccgtatgggtccacagcggggtttggggactcctgtggtaaagtattgtttctgggtgtgtctatgagggtgttgccagaggagattgacgtttgagtcagtggactgggagaggaagacccaccctcaatgtaggtgggcaccatgcagtcagctgccaaacggctagatggcggccagaagagggataaccttgcttgctgagccttgtggatttcatctttcttccatgctggatgcttccttccactcctcctgcccttggacatcagactctaggttctttggccttcggactctgggagttgcacaagggcctcctggggacttttgtgccttcagccacagaccgagggttgcactgttggctttgctgcttttgaggcttttggaattggatggagcaactgctggcttctttcttcctcagctagcagatggcctactgcaggacttcaccttgtgatagtgtgagccaattctccctagtaaactccatttcatatattcattagttctgtccctctggagaaccctaatacacatcctcacagagacactcagaataatgttattttttgtttgtttgagatggagtcttgctccgtcgcccaggctggagt

SEQ ID NO: 3301 - DNA, 1628 bp, Homo sapiens
gagtacggcccttggccaacaatgagcaaggaaatggatttcagtcacataaccacaaggaactgagttctatgagtatcccaaatgagcaaggaaacaaatcctcccctagagccaagaaaggaaggcagctctgtggataccttggttttggcctggtgctgcccatgtcatacttttgacatacagaactgtaagatagcaagtgtatgttgactaagctgctaaattggtggtgattgcttatggcagcaatagaaagctatatatcctagagaataaagaaggctagagctgctgtggaatgcacttgggaaagctggctacattgataatatgtaactgccatgggcatagttgcctttgtattcttccaggtctgggaagtacaacttagacttcagatctcgtaatgacccaggaggcatataaacctgagcagctagtggccctgtacaagtccttcatcagggaaaaacattgagtattccctgattaaggacttgtacagaggactctgttttccctggtgtttctggtgtgtctcaaaaattgtttgactgtgatgacagggaagtttggaagaagttcactgctaatgcatgtctccaggaagcagggaatgatctcacagtgacacttgaggcacattgctgaggccgtcgatgagaattcatgtaactttctccagcttacagtggactagattgacatgcaagctgatccagtccaattggtagggcatcatggtttctcattactcactgacttaaaatacttttattgccatcctggtgaagcactgcactgggtagataacacaggggcaccttgctgatcagagcccttggccaggtacaaagagctcagtttctaaaactctgtcatttcaataatgttataaattgaatcatacagtatgtaattttatgggattcgctttttttctgttgatctctttttttctgagtcatctcagctgttgtgtgtatcaatagttcatttccttttactgttttgtttggtttaactcattgacctattgaaggatatctgggctcattccagtctgtgaataatgctgctgtggacattcatgtgcaagtttttgtgtgaacattaagttttcatttctttaagataaatgcccaggagtgaaactgatgggttgtatgtagttacaaactgccaagctgttttccagagttggcggtaccattctaatttcccatgacaattttttgaagagtccaagctagttgctttagagtgcctcacctacattttttaattgtctgactttttcctaatgacatcacttaatttgttcctcaatctcctgaatttcctatagactggaggttaggtctggtggtttgattagattttttaaaaaaatatgacttcatctgtgatgctgtgtactttatgttgcataacatgaaccctaagaacagagtgagctgctggacagcaagtttcatggggtgcagtaattaacacaccacatagtataaatctgaaataatgacaaatgtgttaagggccttgggatattgggccatgtactctgaggagcacaaggtgaggtgcaggttcctgcccctaaagaactctatcttttgaga

SEQ ID NO: 3302 - DNA, 1123 bp, Homo sapiens
gggattacaggcacccgccatcatgcctggctaatttttgtatttttgtagaaatgggcttcaccatgttggccaggctggtcttgaacttctgacctcaggtgatccacccgccttggcctcccatattgttgggattataggcatgagccactgcgcccagccaagttatagttctaaaataagtcatcatatgatggacggaaggagccctgcattcttaccccctgtcagggagtttcatatcccagaacagtgatgggagtgagtagctgggatagattcagaaaaccaagcaatgctagaaagagcggaacagggagagccaacatctgcagatcagcggccagccatgaagctgacaggatggctgagattatagttcataaaacttagagaagcagtcttttttttttttttttttttttttccccaaatgctgcacgtagcatccaaaagtagtcttttttgagagagtggctagggacattaggtaaagagaaagcaaagatactttattgaggattaatgtcatggtagttggaaggaaaacttttagagaattttcttgggaatactaactttgcatttatatgaatgtatacagcagatctgttcagagtttaaataacctttgaacccttgttctcattatatatgtggtatattttacagggaaattatattttctttcacactttacttgttatttctctaggagaggactgctgttttttcttaaagttcataaaatagatatatttgtgtatatgaaccaaactgaaggcacttctaatgagtgtttctacatttttagggaagcaggaattgaggaacagattctccagccatggattgtggtgaatctcgtggtggctcttctggttggattatcttggctatttttgtcttataggccaggcatggatcttagtgaaggtattaaagaaaaaaaatagcataagaatatcctgaaatcttctataatggttttataaacctccttttaataggtatagcttataatattccaataacaaagacacatttaaattaaaatgatacaagaagagagaaaataaagtggtgtaacagaatgccaagagaagcagggaggagtgtc

SEQ ID NO: 3303 - DNA, 1438 bp, Homo sapiens
gtgaatgtgtctgttttgtcttattttttgcttattttatcttaacatggttatttattttgcctttgaacacttggaatctgtttctataatagcctggatgatggccgttaggagtggattgatgtgaggagtttgtaggatgaggctgaaggaaaggattagcctcctgcactttgtagaaattctcactatagtgcagaatattaaaaagagtcatttttaaaaagatgaattaatgtgaaatactgtgtgcttgaaccagatttctacaactgcttttgaaaatttaaaaagaaaatccaatttggttaaatctataggggactaaaagtttgctgttaaaatttttagttaattcactaacccttttttttttcttttttcttttttttaaccttcagatggtgaggtctacagctttgggactcttccctggagaagtggaccagtggagatttgtccaagtagccccattctagaaaatgccctggttgggcaatatgttattactgtggcaacaggaagcttccatagtggagcagtgacagacaatggtgtcgcgtacatgtggggagagaattctgctggccagtgtgcagtagccaaccagcagtatgtgccggaaccaaatcctgtcagcattgctgattctgaggccagccctttgttagcagtcaggattttacagttggcgtgtggcgaggagcacactctggcattgtcaataagcagagagatttgggcatggggtaccggttgtcagttgggtctcattaccactgccttcccagtgacaaagccgcaaaaggtagaacatcttgctgggcgagtggtgcttcaagttgcctgtggtgctttccacagcttagcccttgtacaatgcctcccttcccaggatctgaagccagtcccagaacgatgcaaccagtgcagccagctcttgattactatgactgacaaagaagaccatgtgattatatcagacagtcattgttgcccattaggtgtgacactgacagaatctcaggcagaaaaccatgccagcactgctctcagcccctccactgaaacccttgacaggcaggaagaagtatttgagaacactcttgtagcaaatgatcagtctgttgctactgaactgaatgcagtaagtgctcagatcacaagcagcgatgccatgtcctctcaacaaaatgtcatgggaacaactgaaatttcctctgccagaaacataccatcataccctgacacccaagcagtcaatgaatacctacggaaactgtcagatcattcagtaagagaggactcagagcatggtgaaaagccagtgccatctcaggtacctgctcaattttataaaataaaagtgtgtctagagttgaactgtatgggcttttctttagaaactttaaaatgagtaaggcttggtagcatt

SEQ ID NO: 3304 - DNA, 1195 bp, Homo sapiens
cccctgtagtcccagctactccagaggctgaggcaggagaatcacttgagcccgggaggcggagattgctgtgagctgagattgcgccactgcgctccagcctgggaaaaaaaaaaaagaaaactgatgttaggcataggtgatgtacccagtacccagggttgtgtagctgctctttcataattgagggctccagtgttttagacaggaatttttactgtttttactcatatgatatttgtgacttaactttattccttatactaggtgattgaaatctctgaatatcgaacccagctctatgaatatctacaaaatcgaatgatggccattgcacccaatgttacagtcatggttggggaattagttggagcacggcttattgctcatgcaggtgatggttttaatgtaatttgtaaatatgagtgtttgaagtattttctggttaggattttgtttacatctttaaactacagctgttaaagaaattttagctgataacacaaaagtagatgatatgtgggagatcactaagggccaagtgttcaatgatgatttctatttgtttgcctgatttccttttggataatgaaggcatctttagtcactacctcttctgagacacttgtggtccattgttagaagtttgttagggttaattagaacaatcggatgaatgcaggaggataaaacagttaacattttcataataaaaactcactagacctagatttgaatacagttttaagaaatcactgtagagaaagaaaaaaaaaagaaatcactgtagaggatttgtgcccttgattgattaccttagtttcactattgagtgtgaggatgtaatatatttgactttcaaaaatattttcaacaactgatttataataaaactttgtatatgtgtatggcagtattataaggatgatatgctataattaaaatgctatgtaattgaatacctacaaatacaatgaagtactgattcatcatttttatgttacttggagacattgttataattcatcaaaaaagattatatcatctgcatcagagtgtttaaaatggcataactcctttttttttgtttgagacagagtttcactctgttgcactggctggagtgcagtggctcactgcaacctctgcctcccaggttcaagcaattctcctgcctcaggctcccaagttgctg

SEQ ID NO: 3305 - DNA, 1195 bp, Homo sapiens; identical to SEQ ID NO: 3304

SEQ ID NO: 3306 - DNA, 1107 bp, Homo sapiens
tacgtggaacattcatatatttggaggtgcattctttgtaacttttttcttttgtaggttctcttttaaatttggccaagcatgcagcttctaccgttcagattcttggagctgaaaaggcacttttcagagccctcaaatctagacgggatacccctaagtatggtctcatttatcatgcttcactcgtgggccagacaagtcccaaacacaaaggaaaggtgtgttatagggttttgctttgtttttgaggttagactttttcattttttacaacccatttttcttctactctgtagtacacattaaatcttctattgtctctttcttgttaaatagggaatggtgagttatttaaataaaaagtgctttgtgtacactgaaggataaggttagaagaaactgttattggttggattaaagccagtttcttccattgtgttagtatttttttcccccctagaatctccctgtggttggcacactgaaaatactatctctggcagcaaaaaaaaaatctaacatttacgaatcataaaaaatagcatatgcattatgctaaaacactttgagagaagtcactaaactttttttttttgagatggagtcccgctctgtcgccaggctagagtgcagtggcttgatctcggctcactgcaacctccagctccctggttcaaacgattctcctgcctccctgcctcagccttctgagtagctgggattacatgcacgtgccaccacgcccggctaatttttgtattttaagtaaagaccagtttcaccatgttggccaggctggtctcaaactcctgacctcctgatccacccacctcggcttcccagagtgctgggattacaggtgtgagcacctgtgcctgtcctaaatcttcagtagccttatgagatgtaggtatctctatcttgcagatgatgaaactgaggcttagacaagttaagtactttcaatgtttttgaaagatgtgtcgtttaacagatctaaactgaaaattgataaaatttagagcagagtggtggaggaaaataaagcgttcaataaaataaaatgttaattagattgaaaaagaacccacgcttttttttgtt

SEQ ID NO: 3307 - DNA, 1192 bp, Homo sapiens
ctgtgtgttctttaatttttctcagcaatgtgctaatagtttttaatagcactgtggtacatatttcactgaatttgttgctaaatatttcatgactttcgatgttattaaaaatgagaatggattttaaatttcactttctaggctgggtgtggtggctcacacctataatcctagcactttggaagtctaggcgaggggaatcacttgaggccaggagtttgagaccaacctgggcaacatagggagactccatctctaccaaaaaaaataaaatttcacttcctaattgtttgctactaatatatagaaatgtgatacttttgttttacattgtctaattcactaattgctgaatttgctcagatctgttgcattagatctagtagatttttaaaagattctttaggattttttgcatacataatcatgtcacctgtgaataaagacatctttgccttttccttttaaatgtggaagtggtgtgagcagtcatctttgcctctttcccaatattaaaggtaaatattcactatttcacagttaaggatgatgttagctctgtgggtttttttgttgttgttttctttttttttttttcgggatggagtcttgctttgtcacccaggctggagtacagtggtgcactctcggctcactgcaaccacctcctcctggaatcaagctattcttctgcctcagcctcctgagtagctgggattacaggagtgcaccaccacgcccggctaatttttgcatttttagtagagacaaggtttcaccatgttggctaggctgctcttgaacccctgacctcaagtgacccgcccgcctcggccttccagagtgctgggattacggatgtgagccaccatgcccggccaaagaggagattttttttttttaaaagacagagtctcaccctgtcgcccaggctgaagtgcagtggtgtgatctcagctcactgcaacctccacctcccggattcaagcaattctcctgcctcagcctcctgagtagctgggattacaggcagatgccaccatacccagctgatttttgtattttttagtagaggcagggtttctctgttggccaggctgatctccaacccctgacctcaggtgatgcacctgcctcagcctcctgaagtgctgggattacaggcatgagcctccatgcccagccacac

SEQ ID NO: 3308 - DNA, 1226 bp, Homo sapiens
aaacatatacggataaccaaaacttgccacatgaggccagtcagaaaattccaaatattaacaaaaacacatttttcactggcccattaatcagagaactttaaaaattacataaaaattaaaattacctccgtataggaatacattttaattcacccagagatccaacacacttaagagagaagaattttactaatttaattttttaaaaaaccactacctattaaactcatgtagcattgctaagagtatctacggaattttcacatcgatgttttcttgcgaaagtggaaatcaaaagcacagagaccctctttaacaatgaaccgctgataagcaaaatataattataataacattccacttacgtgcatttgtgagcattaatttacatcaggctttccaatttaccaacatttatagaatttcttactagtgagagttttacaaaacttttgaagtaattgttaaatttgaaaacatttctgtattttccagaccactgtgcttccaatccagagtgctctcacatttataaggtccatctacagtttgttaccatgtgtctttgaacatgtgttagacaaatgaaggtattctcacactctgtacatttataggaatttttcaaaaatgagttcttttaagtatcaaatgaaacttatgaactaaagaaattactacacatttaaatttataaggcttatctccactgacttcttacatatttcaaggaaaaatggaaaaactgaaggctttgccacatttcttagaattacagggtttttctctattgtgaacccttttatgtccttgaaagaaactggggaaactgaggactttaccagtttttttacattcatttttcccccagtatgagtttttcttagttttcaaagggaactgggaaaattgcatgttttccaatattcctcacaatcccactatgtgttttttcatttgttctaatagaactagaacatctgaagtctttaccacatttcttacattcacatggtttttttccagtatgacttctttcatgctgttgaagggatctgggaaaagtgaaggctttaccactttacttccatccaaagggtttctcttcagtttgagttctttcatgtcgtcaaagggaactggaaaatgtgaatgatttaccgcattttttacattcctaaggcttttctccactgtgagcccttgtatgcttatgaaggaaa

SEQ ID NO: 3309 - DNA, 1320 bp, Homo sapiens
tattcttagcttctgggccatataaaagcaggcagcgggccacattctggcatggagccttagtttgccagcccctgctctaaaatactttttccaaatgtttgagtgttaaattttattatgatgcttgtattattatttaaaatattgtgtgtttctagagggaaccagggggttcttgagaccagatttttgtgcaacttgggcaaaaatactagattccgagagtttgtagagaagattgagttgaaggaatggagggttcagtcaggtcaaagacaagatcacacatttattggaatggcaataagcctcaagagttgtaagggtagagttgtttaggactagtagatactagttatctagggtattgagtttcttttcccattagtattcttttctctattgcctgggtaagaactttaccacctttcagcctcctagccctttcatctattttaacgaaaaagaacgctgagttggcctgaaaaagatcagggcatctaggctttaccctgactcttctgctgacttgtgtgacatttgacttctttgaacttaggttttttcatctgtaaggtaggactgtttagataatttcttaaatgttttccatcttgaattccttatttttgcgattctcacaaatgagcttgattttatttgcttccattctgttctgttggttctgctctttacctcaatctgtgtccactggtctcaaccctctattactttaatgtaactgaactgtttcccaaattactctgaattgtaatccgaggatgggaattccattgactgtactctgtatcggggagaaatacttcaacaaaacaaagtaataacccactctttctaaatgtcaaatgttttcaaaaacaagatattaattgattaggaatatatagtatcagacacttttttgtattaaaaggacaatatagtattaagtagtatactaatttttactacattcatcatatctataaggcagtattagggttggttcttaacatggattatgttatgtattttagggctggtaaattttaaagaaatttcatctctagctttgttgctgttatcctattcattctttggaaggatattattaaaacaaatgaaaatttttatcttcaaactgatagtggagttaaattaacattaaatatttcccctaaatatatacttatcagagcaaacatgtaattttactgaatacttgtacaggtacacatacctttaagtcagtatagtgtaacattattataaggatgaatgttgcttactgtgcccattattttgtgtccttttctg

SEQ ID NO: 3310 - DNA, 1107 bp, Homo sapiens
agttattttcaagtctcctgacagtcactgggagtacaaggtttgctaatgtgctctctggacgttattaatggccagtattagttgctgctgtattactgactcgcttagctgtagaaagggtaatactctcctgattttgtatgattggactcttaagtagctgctgttagtcagaattaaaacccatctcagactaagaatataatgaataagattaataggccaaaatatgtatctaatcacattgataaaaattaatataactgacacaataaaacacatttcccccatctgtacaataaatacagcttcaaattcagtggagtctgtagggcagataactttaatcatcactactgtagtcagtataagaaatgctgaaaaaaatccaggagggcttgtctctttgtgggtggtcactgtgatgttgggccagctcctgttcaggtccagagctgctaacgtgggttctactcagtcccagtgacttggccagaatagagctttgccaggtaactgccctgtgctaggtgaaaggggaaaagcagtagctggatatatttcaaatgaggttttgaacaagttcagaaagtggaacttgattgaaaagtgaacaagtgtagtagtgtgtgagaaaattcagatggtgtcggatgcagaagttaatattccacttaatgttatctgagcattaaaaatcatcagcatttaactgagaccccactatagagtttccttatcaagactttttggttttaaagttgtttttaatgcattgcaagttacaatagctattttgcttttagatttttcccagcactttgtatttattagctttcattaacttgcctccagtatacattccacttcgtgcttttcttaggtcatttctacatcccttattccttgttttcctgcagtgtaatggccctgaatgtcctctgagccttcagctccattatggacccaaactagactatacttggataagttaagctcttcttcgtgtactggtctataattagaaaaactgttttaaattagatgttcccattatttatttaaacagctttttgctgagaaagcttagtggattaatgaggc

SEQ ID NO: 3311 - DNA, 1198 bp, Homo sapiens
agctctccaccacagagagagggccccaaagagggttgctgttttacagttgaatatagaggcttttatgagaaatcagtgaaagctgggcatctcatttgcataaggcatgaatttctggtagctccaccgcatccttctagtgtgcatgcaagcccttagcttgagttactccatagttactccatactgctttgtttcctttaaggtacatgtgtcaggggatggaattttccattgtgagcatgtctgggcaaatctcctgtgtagcctttcttatctatgtggcagtgggcatgtcttaagcaagttcccccgtgcaaattcccttttctgtgcctgcagcttgatttctaagctcgttttttgtttgaaagaattttaccgaggacccaccctaactgcctgcctgaccatttccttcctcctctctcagaatgatttcttcacagttttgatagaagttttactaagattgaaagaaaacaaactttgaataaatagatgcacacaccatgtaactggatgttagtactgaattttatcatgatattaatctgggcaagttggctacctgaccagcaggctgaatctggcatgcatgcgtgtgtgtgtgtgtgtgtgtgtgtgtgtagttaattttttaatttacatttgaaataggcttggacaggacaggcattctgcagctgccagttacctccatattctcttatataaacctcatatttaaattcattccttccctcctccctcctgcgctggctcttagattcatttgagtttttgacagttttgtttaaataaatctaggaaggactgatgcatttttttttgtaattctgattaatattccagtgagactttagagaagggaaggaacaaatttacaggtcatctggatcatttaactcttagagaaaatagttaaatggagatttaccagtgtattttttaaataagcaagatgggatttggttaactgagagaagaaactaccttgcaatatttagctggcttgactgcaggataaaacagaggtcagtacatttgtttcactgagcagatggtgactgcacttgttctcaaagtgtggttgccagaccagcatcagtatcacctgagaggttgtttgaaaaatatttagccccatccaagacctgctgaatcagaaagcctggggttggaggccacagtc

SEQ ID NO: 3312 - DNA, 1197 bp, Homo sapiens
atagttgctgaatgaatgacgggcatgagcaaataagcaaatgaataggtgaatgaatcacctagagctgaggtcaaaaccccctgcctgcagccaggtttggcctagccagggttcattgtgtgctacttagtataacatttttaataagttgccaacatgtagagtctggagattttacttagggatttttgctttcttgttgggggaaggaaagggggaaagatttggaagacctggcctggccacactgggccacctcccctccaggccccagtctgctggagccagtcatggaggccacctttaaaccaggcatgtaagatcccagctttcaccacctcctctctctccaaccttcccctgccctcacaaccacgtctgctttcctcacttacagtaggtgtttggatccaggaaacacttgaacttgccacaccctgacctaaagacatagccccaaatcactttcaccatgtagggtctgagcctctttaaatccatattcccgtccatccagttttgtgcaaacatgagccagagtgtgctttggtccttccttggagtcagcgtcgcctgtagccccctccattattgtctcgtggccttttgtgctaaactcggggcctctgctgtggagtaaagaatgtgggtttgtgtccctacctctgtcactgctggttctgcaacccaggaccattctcattctactatggtgatgcccctgacttcgttgacagcacacagacatgacttcagagttccgtgcacatgtgtgcatcttctttcccttctctagagatgtttggcatcttcctcctgctgggttgcaacacaggctgctacagcattctcttatcttcctttgcccttacacagactccaagcccacggtagagacgctgggacccactgtgaagagcgaagagacaaccaccccctaccccaccgaagaggaggccacagagtgtggggagaactgcagctttgaggatggtaagcacaaattgcctccagatggcatgggtgcggactagtcagagtgggagctggcctgtggctggacagggacctagtggtcccccagatcagagatccaggggatctcaaagaagtggtaagagaggtgggggcacttaggggtttggggcagtggctgtttacaaccaatgtagaagcatttggatagtgtaacaa

SEQ ID NO: 3313 - DNA, 1225 bp, Homo sapiens
aaaaacaacccaggcgagggccaggcgcagtggctcacacctgtaatcccagcactttgggaggccgaggtgggcggatcacgagatcaggagatcgagaccatcctggctaacatggtgaaaccctgtctatactaaaaatacaaaaaattagctaggcatggtggcgggcacctatagtcccagctactcaggaggctaaggcaggagaatggcgtgaaccctggaggtggagcttgcagtgagccaagatcacgccactgcactccagcctgggtgacagagcaagactccgtctcaaaaaaaacaaaaacaaaaaacaacccatgcaaggatgtgacggtggtctggctgcaacatctgtcaccccactgatcaccagggttgattcggctgatctggctggctaggtgggtatgccctcctgagcctcaccactccatgttcatccctcctgaagctgcatgcttggttgaagaagacaaccttccccagtagaaggccaatatttggtcaagggtatataagtagctgcattcccttgctagaacctccaaacaagctctcaaggtccatttgcaggaaaatgttgggtagtgaagcttccaaggctccagacacatccaaatgaggtgctgcatgtggcagtatgttttttgttttttgtttgtttgtttgtttgtttgttttgagacagagtcttgctctgtcacccaggccggagtacagtggcacgatctcgactcactgcaacctccgcctcccaggttcaagcgattctcctgcctcagcctcccaagtagctgggattataggcacccgctgccatacctggctaattttttgtattttagtagagacggagtttcaccgtgttgcccaggctggtctcaaactcctgagctcaggcaattcacccaccttggcctcccaaattgctaggattgcaggcataagccaccacacccagccacttttcttaaaaacacacacacaaacaaacaaaactatgtgatcctccagttctttctcttcagtgaccaacttgaagtccatatgtttaagatggtaggaatgtaagattgaaggagctttgatccctgagtcactgagtgaaggagtccaccaaggaaagccactcaaattatgccagactgtaacatgaatgagaaataggcagtatgcagcccctaagatttggagatttgttactgcagaaaagcct

SEQ ID NO: 3314 - DNA, 1193 bp, Homo sapiens
gttttaaaaccctttttttccctcaagtgacttatgatcattacataaaaatgagactgtacaaactaagaattttttcattttatcaataatcccaccacctagagatattctggtacataaattcctaaattttttctctatatatgtactaaaagttgtcatatgaaaatataataactggccacgcatggtagctcacgcctgtaatcccagcactttgggaggccgaggtgggtggatcacctgaggtcaggaattccagaccaggctggccaacatggcgaaactccatttctactaaaaatacaaaaattagccaagcgtggtggcgggtgcctgtagtccaagctactcaggaggctgaggcaggagaattgcttgaacccgggaggcagaggttgtagtgagccgagatcgcaccattgcactccagcctacacaagaagagtgaaactccatctcaaaaaaaaaaaaaaatatatatatatatatatatatatataaaataactaaaaagtgtgaaataggctggtccatatgcagtggttttacaagtaatttatcacaaccagttagttacagatttctttgctccttctccactcccactgcttcacttgactagccttaaaggaaaagaaattttttaaatgtgtgaaataataaataataaactcaataaagaagctggccttctatcaggaggctgaggctgtagtgacccgtgattacgccactgaattccagcctgggcgacagactgagaccttgtctgaacgacaacaaaaagaatcagaatttgaactctatttccttaaagtaagataatgttttgaaatttttttttttggaaggcagtcccactctgtcgcccaggctagagcacaatggtgtgatctctgctcactgcaacctcctactcccaggctaaagccatcctcccacctcaacgttcctagtagctaggactacaggtgcacgccaccacacctggctaatttttgtattttttagtagagatggggtctcatcacgttgtccaggctaatctcgaattcgtgacctcaagtgatctacccacctcagcctaccaaagtgctgggattacaggtgtgagccactgcacccagccatgttttgaaattttaaaattcaatttagtgctttaaatgtgtatttcagttaaaagt

SEQ ID NO: 3315 - DNA, 1170 bp, Homo sapiens
tatttaacattgtgatctggtgatcattgctttccctgcctcctcctccctatctgtggcatggtaagtagatggaagatagtaggcatgatacttaagcatagtttttcctattctttaattaacatctgaatctctggagagaagttccccaatttttctgggacctgcccatagttattctgaccacaggataatttgctaggctttttattctgaataattacttttagaaaacgtgttttagctgatactcaggcatatttcacagtagcattggcaagatgctttggattaaactaaatctggttgtatatgtgtgtctgtatgttgggctaacaaattgaagacattcatgttacacctaagacttgggacaacctatattatagaggcaaatatggtttggtgttcagcttacttgtaatattttaaaatcaaagttgtttttttttttaaataggtcctaaaggaagctaaaaaaccaatggtggttttaggcagttctgcactccaaagaaatgatggagcagcaattcttgcagctgtttctagcattgcacaaaagattcggatgactagtggtgttactggtgattggaaagttatgaatatccttcataggtttgttgagtaattgctttatatactataaattcaagtaatgttgtgtatatgtatgtgttcctgatacactgttaaatttaatttacaaacaacatttagcaacattatcccagttacacatgtgaaatatagacctttactctgtgtgagaagagcccgagatgataaggaatatttaaaatatttgaaataacagtgagtgttgagaaaaaaagtgaagtactataaaaattgttatattagttacaccttggttcaaaaattgcaacaagttctttaattaaatgataaaaatgtaagctaatatgagaattcagctaaaggatttctttctttctttttttttctttttaattatttggctttttgttttgagacagggtctcagtacagtggcatgatcatagtccactgcagccctgacttcctgagctccagcgatcctcccacccctgcctcccaagtattaaatggctgaagctacaggcgcatgccacatgcccagctaattttttgtttttgtagagataaagtctcactatg

SEQ ID NO: 3316 - DNA, 1489 bp, Homo sapiens
actacaggaagtggagctacagatagtaaagatgatgatgacattgacctctttggatctgatgatgaggaggtatggcgtcttctataaagaacatatcggccaggcgcagtggctcatgcctgtaatcccagcatgttgggaggctgaggcgggtggatcacgaggtcaggagttgaagaccagcctggccaagatggtgaaaccctgtctgtactaaaaatacaaaaaaatgtggcaggcatctgtaatcccagctactcaggcggctaaggcagagaattgcttgaacctaggaagcggaggttgcagtgagccaagatcgtgccactgcatccagcctgggcgacagagcgagactccgtcccaaaaaaaaaaaaaaagaatacatcgatcagcaattgtatcaatgtggttaagccaaattgcctggatttgaatcctggctttaatttatatgcctttttcaaattctgactggttgcatgatgaataaaatcaaatcaccatctttcggctgagttcgtgatggatttgcttttttctgattaagccagtcttttttgtgatgaccccactagctttaagcagaggaacaaccagctttctgaagtggattaattttttttctttacaggaaagtgaagaagcaaagaggctaagggaagaacgtcttgcacaatatgaatcaaagaaagccaaaagtaggtcatttgtttttaacttcatttcatgttaatgtaagtaatctttttcaaagcttgaccttgaagtaatttcctccacattccttgaataggtcaatattttaaaacctgtacaggttcttccacagctactggtctgcagctgttcttatggtagcagttgtggcattcctctgtgggaaagaaactgttaacacaaacacctctttcttagcaaaacagaaagtgggtatatatgtgtgacagacacaagatgtatctgtagttttgtttggctaaggagatagtctcaaaacaaattgagatggatttgtttgtgtcttggagtagggtgaaaaaaatacaattcattatttgaataatgctgtttattgtttttagaacctgcacttgttgccaagtcttccatcttactagatgtgaaaccttgggatgatgagacagatatggcgaaattagaggagtgcgtcagaagcattcaagcagacggcttagtctggggctcatgtgagtttaggctttgcctttttttttttgaaactaacatctggaatttgcctacagtttcaacctttcctacaagacttttctaactaggatttttcttaatgctctttttagctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatcca

SEQ ID NO: 3317 - DNA, 1489 bp, Homo sapiens; identical to SEQ ID NO: 3316

SEQ ID NO: 3318 - DNA, 1489 bp, Homo sapiens; identical to SEQ ID NO: 3316

SEQ ID NO: 3319 - DNA, 1199 bp, Homo sapiens
taagaaatgttaagaaataggccaagtgcggtggctcacgcctataatcctatcactttgggaggcctaggcaggcagatcacctgaggtcaggagttcaagaccagcctggccaacatgacgaaaccccatctctactaaaaagacaaaaaattagctgggcatggtggcatatacctgtaaccccaactacttgggtggctgaggcaggagaattgtttgaacctgggaggcggaggctgcagtgagctgggattacaccattgcattccagcctgggcaacagagcaagactgtctcaaaaaacaaaacgaaacaaaaaaagaaagttattcttagtaaggaacttcttgtttaatagcatttttgtttattttaaaaagtgatcagaagtagtaaactatctttgaggaaatactgtaaccccagaatatttcctcttgacttctttttgtaacaaggataatttagggatttataaagttgtaaggatttcactgtttttggactgcctataataatagcacattaaccttcacataataagaaatctggacaagttcagttacacagtatgatgaatacttgaattaggaacattgtggaaaatttgctttagagaatcaaggcagtagtttggtatttggtgcttattaaaaatgtggtttgttttgaactggaagcaagttgaccaaggacttatgactaatgtgatgctaagttccacttggccccttttaaaaacgtgtatgtgccttttgaagatacacaaaacactgaggattttagttttgaaatcaaagactattaaaggagctgtacagaggtaaaaaaataaatgtggaacattattaacttactttgtgtctaggaacaatggattttgtatctgatttaaaatgccaacactgttttgtctctgttcattttttctgtgaggatacttaaggttattattcctgtctgtttcctgtactcccctagtcatgagcacttgaagtacaaggtgtctccccctaggtgcaattaggttgtttctttgtttttagtttcaattctatgtgcatagcaggaatgctccacaggaatggcttctgacaataatctgtcctgttgattttgttttccttgcccatgacttgaacaactgtgttttaaagtactgtagtctagtaggtaactttgtggcaaaaattttc

SEQ ID NO: 3320 - DNA, 1227 bp, Homo sapiens
acctttggagaactctgagtgtaggagcaatttgatgaagcagacttgcttaatctgaatgtgaagtgctgagatggaggtgtacaggagaagggagtgttaaaagaagaaatctgtattcagttaggaatttccagcagtagtccaggaattaattgattatagcatagagtacatagcaaacatttattgacttgattttcctttccatttgccacacatgtgagtgtcacaaatgatattcacgtgtacttgtatggaaatcttgcacagattttagcatctaagtgccagaaagtaaaaattttgtggcatcatttaacagtattcattggtaggagagatgtaaatatcacagtcaggttaagaattatcagtaaggaaatagacacaatattagcatagttgtccattcataatgaagttattccaatggctgatattgtgagtgtattttccaggcatgtggtggctgcatcatatcagttggaggccagattccaaacaacctggcagttcctctatacaagaatggtgtcaagatcatgggcacaagccccctgcagatcgacagggctgaggatcgctccatcttctcagctgtcttggatgagctgaaggtggctcaggcaccttggaaagctgttaatactttggtaaggagagaaacaagtatctgtttctaatgttctattttgaagagctgcaacctgaatgttgactgaatgttgactattggatatgttaactacagggcagatagaatgcatacacttagtgaatttaaagttgttgtatatccatgattgcagttaatgctgattatgagttgatagcagtattctcattaagattcagacaatgaaaataatttcaaaccagttttgaacaagatttgatatttagaatcagaagctaggaattttatgtatttcagtgtccaatttacatttaatggtgcctttagagaataaagaagctgggctaccactcgagctaatgatacattctgtaattttattgcatattttaaactactcatacatttttattgttgtttctattaattagaatgaagcactggaatttgcaaagtctgtggactacccctgcttgttgaggccttcctatgttttgaggtaacactgtatattgttttccaaaacaatgattcaaaaattgggagatacagaaatgcatgctgtatgctaatagcactagggttct

SEQ ID NO: 3321 - DNA, 1208 bp, Homo sapiens
ggggaaaatttgatgtatttgttcttttaagagcttcttttgtaaaattatagtatgtggcaccttttgtggcttaataaaagatgtggagaaaaaatgaaatttattctaagaacataactatattgttaaatactttgctgttggtaaaatatgtttgatcctgataggtaaggcgttcctggaactatatctaatggactcctacctgtctcttattctcattctcacttttaacttttaatctcttttcaactaccaacattaatgtttacggatgtatattaaaatatactctgggcttggaatcaagagtcttaggtaccagcattaggtatattaccaagtagctaactgaactaaaaacaataatttggcattcctgtgcttcagtctttccatctccgaaatgggaataatgtattctctctagtgctgctgggaaaaacataatgagaaaaaaaaagagagagagagagtgtatgtgtgtgtgtgtgtgtgtgtgtgtccatgcacatgtgttgtgtatagaaagtgtaaaatctggtctatggccataccaccccgaatgcacccgatctcgtctgatctcggaaactaagcagggtcaggcctggttagtacttggatgggagaagtgtaaaatctggattactaaaatcatatgtgtctgtctagagtttatttacagtaaaagttcagaagtactagccgattaaaaactaattttaaaaaacattgaaatatttctataatagctaagaagccttagattgttgatagtaattatgatattgtgtgcatttataaacagcatttatggatattaacaggcctacacatgttcttgaagatacatttccctgtttttttaaatttaaagaacaccaagagtatactggaaaagcgaatgggaacacagactgaggtctaggccatatttaatatttctaagctatataatgttaaacaatcatctctattgtcatttgagaagtgattctcttcctgtattctcttcctgccctagccctttggagaagagattaaaatgacaccaaaagaaaatgagttacattcgataattaaaaatttttcagctgaaaggaaattcttaggaatcaatcagtttaacccagaaatgaaattacacaccttccacacctcatttgtttaccatgtctgaatctaaaatgaactgcaagtgt

SEQ ID NO: 3322 - DNA, 1172 bp, Homo sapiens
ttacaaagaaaggaagcatggaaggtacatgtatcaagatttggcatgtctgaacatgtctgttgtatgcattcacttggttgaaatgctgctaggtgtaaaattctaggttgaaacaaaactttgagaattttgaagtcacagctctatttgggagatggaatggaagaaatcgtccatatttttatcatatgtaaatttacataatacttctattttccccagagtacttctctttccattttgcctgatatccacagtccacagttcttttggtttaagatttcctagaggtaaagggaagaaggagatgtgtagtctaagtgtttcctaaatgtactctgaagcattcccgctgaaaacagttcttcttgctctgtttagggaggtttgtaatactactactcctcagcctttggtgttatacattattgggttgcttctcagtttccccccattaaattaggcttcagattgcttatgtttaccaagttggctaacactgataagccacttcctacttttactattctatctttattgcctcctttctgtgattgttggtgtctgtcttttaaaattaactctttttttgtcagtataatgaagttgaaatgaaagggaagtaatttgtgaattcaatctgccataccatgttaaatggaaactcaatataatttgtgtccttaattttttattttgaaatgtttcaaagttatagaaaatgttcaagagtaatacaatgaacactgtaccttcatatagaaaaaccaactgataatccattgccatatacatattacaccctctatgtgtatgtgcatttgtgtgtatatatatgtatagacacatcaaaaacatagatacgtatacatatattatatatctctctccctccctgtgtgagtaaactatttgaaagtaaatggcagacacaagatagttcatctataaagacttcaggatcttctaagatcaaagaatactactttacatagctgcaataccattaccactctcaaatatttaacattgatataatagtacatgatatatagtccctatttagatttcctcaattatcccaagaatgttttatatatttttttatccaagagccaaagatgcaacattgctctatttctgtaataaatgttagtttgaacatcata

SEQ ID NO: 3323 - DNA, 1093 bp, Homo sapiens
tttcttctccttataaggacacctgtcaggtttgattaggacccaccctaatggcctcattttaacctaatcacctctttaaaggctccaagtacatactccaagtagaatctccaagtacaatcacattctgaggtactggggattagggcttcaatacatgaatttggagggggatatgattcagccagtaatacccactagctgataataatagcccttccctgctccatggagatatgtgtgcaggtcattttccatttgcaccttgcttgctttttatttcaaagtgggatcatatttttactcattagaacacagtgtcaatgcagattatctaaagtcagccttattgcaagtcttgacaatgtgcattttttttattattttacagtctttattttgaatttgtcaccttatttatagtttacttaatatgcttctttatgatgtgtatttcttgaaaacttgtgtcattctaagaatagtaggcaattttataaactcatgacataaatatttgtgttttactgatcatagaactcatgaaagatttgaacgacttaatatcgctttacaattttctaatattaatagggaaaatgtctgatatgaagggaatataatcttaatgtctttgtcttattacttttgagccattcaatatctcttttagttggcacatgttttaaatattttttacgcagaactttctagaatagttgctatatctttccatgttagtattaaagacagcaaaacatttgcttatgttcttggaattcatctcatgcaatatttattccatagtaaacatactaagggaaagagggaaaacctcgtatttttcctcttaaggaaactattcttgtgtaaatggatagctttacactctaaggtcttagcccaaattctttaactaaatagttatgttgtcagctaggaaaattcatttctatattataccacataaagaatatatcacacataattaatcaaaacatgagagcatattggaagtattaatctactttgattatagcactttttgttggaatgccttacactaactaataacttggaagttctttgc

SEQ ID NO: 3324 - DNA, 1198 bp, Homo sapiens
ctccataatctgagacttctgtaagacttgtcatatccatgatatttatctggcttggttatgtgttctattagagtaagctttattagagtaatgtgttatattagagtatgtgttttatttagagtaagttaataattgattcatatgaggctatctgacctatagttaggtttatgttgcaggtcaatatattcctctaacccagacttattacataatcattgacaaatatctttaatcatgtatttattaatctggaaagagaatatcacttcttcttcactcttttttccccatatttatttctaaaaatcttctcagtaatataaaaattaacagacctcttactttcccctttcaatttgggcactatctgctatgattgtgccacagagtaaatcagtgactaaagaaaattttcttgccccaaatcatatgcaattttctttatttgttagtttccaaagccgaggacaaactaataggaacctttctggaggccaagaatggaactgacgccattcttgtcatttatctcacttgtcttatggcactctagttcttcctctttacaaatatgtgtgtgtgtgtgtgtttatatttgtaatattttcagttagactgactcattaaaacttgaagccttctaaaaacatgaatgatatgtggaaaatgatgactttgaaagaaatgaaggcatatgtgtggtgtacacacacacacatcgtttgcttttatgcaagttcacacttggtcacagagaaattatgggaagagatgcacattcactttttagatttttggaggttttgttgttattgttgctatactataatgtgctgttcccttaatctttttgttatttattattcctatatttattttatggatttttaattcatcaccaacttccttcaaagtcaaaatagtcactgttaaggtctttgaaatgttttagccatggatgtaatataatatacagcattattattggtattttaaaaattagccactgaataatgtctatctgcctatttttatgtataaacacgtgtttgcagtaattacatgttttatgtcaaatcacagtagctatatatgtgtgtgtatatatatatatggatatatatggatatatatatggatatatatggatatatatatatggatatatatggatatatatatatggata

SEQ ID NO: 3325 - DNA, 1219 bp, Homo sapiens
cttactaagttttttaaatagttattttaggctaaaataggtgtgtgtatattttgtaggaaaacactttgtaaattatacagagatatgaaaatatagattatcattgtcattctgattctgcttcctcatccattcagcaaagaggtgcgctgtgaccatgactgttcgctttccctttcatttattcatatttgccttcttcagcaaattttaagtaaaatcaaacttaggaagttgtcagggcttaactttagcaattttgattatgccattggtcttggtctcttcatgaaaatttatcattcttgagatggaaaagacctaggaggtcattttgttcaaccctccttttaaaatcgggaaacaagtctagagagaattatataaatgctggactgctaaccaaggtatcttatttcctagcctcctgggctaattcttcaatattgtaattctgtccgcttcactttacatttatttcaagtgtgtggcttggaaaatctcacataggtagatgttggcagaactaggcaagagcagagttttactatcgttgtattataatatttctgattgtctttgactgtcaatttgtactgtgttagtttctaaggggtgtgtgtgtgtgtgtgtgtgtgtgtgtgtgtgtgatgtttccctttctaaatagattgcaaaacctttatgatctttgattaaaacaaatagttttgagtgccgactatatgtaaatcattgttgctgttttcaaaagtcattattaattgaccaccatttgttttgtgggaaagaaacagtttaaactttgtaggtaacaaaacttatttggggtcaataggctcgaagtttcactctagaaaactgacatagttgcttaaaatatataatgtacttctagctatgtcaaattgaattactaattgacagacattggtactcttataattagaactcctttgaaactacgatccatgaaatgtgaaaatgagaataggaaattaaattctttattggttctcaggcagctaaactggcactcccatgttaaaatgtctaagtattaatttcataattgctatgaaaaaaatctgttcttacctgtttacaaatgtataaaacaaaaataatgaacaacaaacaaaacaaatgactgcaaaatgattctaccggaatggaaccatgcttgcaaatatttacttacccataaaaaagagag

SEQ ID NO: 3326 - DNA, 1197 bp, Homo sapiens
taggaaattttatataagtttgacattgttataacatgcaaacacatgacattttttctagtaatttatttttactatatttaaaaagtgttgtagagtagcagtttcaaactaaaacaaactattcctttacgtgtagatagtttgagaagtaccgctctttccaattatatactttctacctctctgcatttgccttcattaagaattacttaaggtaggttttttttttaatatggaactcaaaacatctcaaattgcttaataactttttattatctgtctatttgtaaggagtatgagaagtcaggaagcaatagcaaaaaagaaaagaaaggcttaagagccacgtacatctggattcaaataagctatattactttctagctgtgcaattgggggcaatttatttacatttcttgagcctctatttccctaattgtaaatggagataataacgtctatggtaaaaggttgttgtgccaatatattttaggtttcagtgcattttagcgtcctctctctcctgggtctcttccttttagtaggaaagttgaataataaagaatatttatagatacacattttataatgtactatactcatttattgaacaaaccacaattgagaagcatgaacactattaatttatgttgaacatatttgattgatgacgtgttggattttgcatgattaaatatttaataagttacaactagttataaaatgatagttgatttacaaatggatttcctaatttttattacagaaaatagatgttacttacttaagtatgagagagtttcaagtacttgtgacattgcccctaatttgagtcagaggaggtgacaaacaacaggtgttaaaacctttcattttcttgttaactgactggataatttggtaaatataatctagatttgcttttggctgtcatcaaaacagaaaacaattattattaaatatactatagcagtgttattagcattaacaaattacctgcaaaataatttacatatgcaaaatgtaactttgaatcttctttatgatttttgttccagaactaataacaacagcaataagtgcaaaaaggaatagattatttttagaaagttgtgcgttttcatttatattatagtaacagattttaaaaacaatctggtcttatccactaaaataagctaggttgtttctttg

SEQ ID NO: 3327 - DNA, 1199 bp, Homo sapiens
taaacagttaataatatttcccagttgttaacttcaaatttagcagcccattgtccctggtgatatattgaaacctttaaaaacgtattcggaattaatggaaattgaagtgattggtattcagatataattctttagtggcccttttctttcttctaaatacaggataaaaattgaaagtataaaaagcttcaagatatattgaaatagacaaaacattttatgcaactgttggtaaaaggggcattcattatttttttctgtgcttactgtattgcttgtggccagaattagcacaccatgagccagagaaaaagataagacaaatagaatggcatgtagctaattttgtttggcaaatttagatccgatacatgctatttcactcctacaaactgactcagtcactctttgagaagtacagatgaagtttgtctcccacagtttaacagctttcactcaatatttataggctatataaaaataaatttctataagtaacatatttcttactggcaggatgagctctgtgaaggcagatttattaatgaaaaaaaaggagaaccaaaaatatttcaattgttccagatctgcagaaaataaaatacctgtatgtcaaaatatcagtaatagctttgtttcaaggacatttgtagtggacttttggtattcaagagttttactacttgtgagtcagtcagaaatcccattattttatgataattttgtgatttgaatctggtagaatttcatattctaaaagtagtcattcacctgccagatgagccaacagaatagaatccactgtaataatcaggaagttgcttaaaacaaaacaaacaaaactcaaaaccttatttttgtggaaaagtattatccaacagagtaaactttagtgaaatttcttaatgaggtttaactagtgtgagaaaatgttcaccagatgtgtaacatttgtggaaatgtggttctagagaaaacctggaatttgtacaataatatctatattggggaatgtcaagatgtgttcctaacagccttttgtagcacagtgaattgtagagtattcagagttgtaatgttatttatatatctgttaaggatttgtcatgacttcagactatattctccataatcaagttcactgtagagaataattctcattcatgaattgttcatctcatcatatttccagtggt

SEQ ID NO: 3328 - DNA, 1160 bp, Homo sapiens
aatatataacttatcaattgaatgtttccaaacagaagagttttagcttctgtcaggcattgcatatctccagcatacgtttttgagaacattttgttctgaaaatttcctgttggcatttttctctgtgggtctctaggtttctgaataatgtgttcttatgtttacaaatcatgctgtactttagtcaaccatggtttatctttggaggataactagtacgttaacatttgccagattttttcttttaggctgggtaatcattgagctaactagattgcaaaatatgctactttaaaaaatgtaattagattttaatcatctctatattgtatgtgtggtttgtgtatctgctgctgctttttcaccattgatcacaaggggcagtcatctgattccagggaatagaagatggaggcttgctctggcgtgtgcgtgtgttgttaatgtatgcatggaactaatttcagcttgtagaaaatgaggccccatatgcttaacagatgctcttctctttttctccagggttccgctatggaagtgatatagttcctttctctaaagtggatgaggaacaaatgaaatataaatcggaggggaagtgcttctctgttttgggattttgtaaatcttctcaggtatgattgtgaacaaactaaatgagctttttcctagctgttatttgaaatggtatgcttttgattggtcattttatttataaggtatatttatttcacttttaatttttctaaaatgtagtctgggggttaatgttgccatggtatgtattttatacattgggaaactgaggttcagagccgttaagtaaatctatatgagcatagcaaactaaaaatacaggatggtttttgaatggggaatggaagcggagatgaggggtatttgaattatgtgggcctaaccctcatccctttgaggttcagtcttcttgagctggtattatggtgaaagtgctcataatgtctcaactctagaggtgggagggcataaaaatgcatgagaaacattgcccaatacagcacattgcatgttcttgaaaataaaccgcaggctccagatttcatagatcagacaaagttgatcttggtagataagtgcaggtggttatgattttcagaactcttcaatactcattttct

SEQ ID NO: 3329 - DNA, 1219 bp, Homo sapiens
caccatgttgttgatgtctgggaagctgtgtagtaaatgtcttttgtatctatccttaatgtttggaaacttcccgcctttaagcttcatatgacaactgaccaacaaacactacgtactatgatgtcaatcttttttagagacattctcattactaaaatgagtggatacttgaatgtttaactcctaaaataatgagcggtgaataaatgagcaagtacatgcatgccttccaatgtagagtcattttcattaaaccctctctcaccagagaagcagtggtatgaaattggcctgattcctttctaagtgtgttgttcttgttcacagttggacatgatataggtcgtggatgtatggggaatctaagagagctgccatcgctgtgatgctgggagttctaacaaaacaagttggatgcggccattcaaggggagccaaaatctcaagaaattcccagcaggttacctggaggcggatcatctaattctctgtggaatgaatacacacatatatattacaagggataatttagaccccatacaagtttataaagagtcattgttattttctggttggtgtattattttttctgtggtcttactgatctttgtatattacatacatgctttgaagtttctggaaagtagatcttttcttgacctagtatatcagtgacagttgcagcccttgtgatgtgattagtgtctcatgtggaaccatggcatggttattgatgagtttcttaaccctttccagagtcctcctttgcctgatcctccaacagctgtcacaacttgtgttgagcaagcagtagcatttgcttcctcccaacaagcagctgggttaggaaaaccatgggtaaggacggactcacttctctttttagttgaggccttctagttaccacattactctgcctctgtatataggtggttttctttaagtggggtgggaaggggagcacaatttcccttcatactccttttaagcagtgagttatggtggtggtctcatgaagaaaagaccttttggcccaatctctgccatatcagtgaacctttagaaactcaaaaactgagaaatttactacagtagttagaattatatcacttcactgttctctacttgcaagcctcaaagagagaaagtttcgttatattaaaacacttaggtaacttttcggtctttcccatttctacctaagtcagctttcatc

SEQ ID NO: 3330 - DNA, 1861 bp, Homo sapiens
tgaaaacgcccaaaccatagagctcagttcctagctaggcctctaccagccacttccgctcgtccgcctaataccgcgcctgcgcaccgcgtctcttcctttctgggctcggacctaggtcgcggcgacatggtgagtgtgggtctctgtgcggcctagaactctatctgcctgcatctgtccttgttttcttctcccgcacccatctcctctcctgccttaccccgtgttctctcctgtctccatgcctttgcaggagacaccattgtcggaagctccccaaggcggaggggcgggggcgccttggctgggcctggcgcgctccagccgggttaacgccgggccttcggagcgcgcggccagccctgggcactggtttcgttgggttgaatttagggaaaactaggtcatatgtaattcacatgtcggtcacacgtcagtgaggtggaggaacggtgtgtggaggctccagggcctgcctgggttccaggtctatcactggtttctcccttcactctaaacaggccaaacgtaccaagaaagtcgggatcgtcggtaaatacgggacccgctatggggcctccctccggaaaatggtgaagaaaattgaaatcagccagcacgccaagtacacttgctctttctgtggcaaagtaagtaaggcaaagtctctggtgagaggagagggagggcaggtttcttacccaagtgaggcctgacttcaaggtattttataagccgtgtgctggtgggcagttggaattactcataccgttgattatgagttttaagataaaagtgttgatggtaacttcagattttgtgagacgtttttcatttaaagaaaaccgcttaaacgttaatgggtaaaataatcatttgacagagtgcccccagcctaagccaaacctgctttgtgggaaatgattccatcagttttgtctactgatgtttctgcaccaactcccaagatgtctgtgcatctaataccattctacttgttctgcgagggatttttgtttgataaaggtttgaacgtttatgtgcaaaatactgcattacagcaatccctgttttgtttttgagggagaaagggaggctttcacatccctgacaataaggtgaatccaaatttagacttctggatgcttgtaagagaaaatacttacttggttcatagtgaaaattggttctcttttatagaccaagatgaagagacgagctgtggggatctggcactgtggttcctgcatgaagacagtggctggcggtgcctggacgtacaagtgagtctagttccttgtggtatttggaagtgtgtggaccacataggcccaaattccaggttgctgctggatgggctagttttaacactttctcaggactgagagaataaggatgcctttgtattttcaggattcttccgtggtggtttattttcagttattgaaagagtaaacacaaaactaccaaaatagaagtcggaaatctaattcacagactactttagaatttgatggtcactgggcacattgttgtgaacattgtcatgatactgtgcaggtccattagtggggctgaatctactgaacgttgatttgcactgcaagttttgataaaaataggtgaaggggtcagttagttcaaaactgtatttggaacttgaggccatcaggaccaccacagtttcgtctttctgaacagtattagactgctgcaggtttgtgaatctgcaactcagtatcacctgacagggcgatactacaaacactatactacaaactagcatctagacctgtgttgtccaatacactaagcacatatatggctagtgtaattaaagaattggattttaaagttt

SEQ ID NO: 3331 - DNA, 1118 bp, Homo sapiens
tagtcatttcaatagctgtctttcccaaaggcactttagtgtccgctcttatttccttaatcattgttctcactgtatcatcttgtaatttattcatttcttgtaatctgtccattcccttttaataagtttaggtcagcctcttagaaccatttctttttcatgggatggggtagggggagttaaagcttgcttgtccacaactgagttacttataaaaaaaaaagcaactctggttgagaaatcagatgcatgagattgtatgtctaattctgcaagatcctgaaggcatggctcttaaaggatgccatcatgtagtttagaagccactaatttccgaggagtaatctaatgttggttagatctttggattgactgcagcaaagtattggtagagcagtctatctcagtataattctttctaggaaaatttgggaagcgactttaacacaaaaacgaggcagatttacttatttgccattttctatgttaacatgcttaattatgttggaaactgaatctttctttccagtaccacttccgctgtcacggtaaagtccgccatcagaagactgaaggagttgaaagaccagtagacgctcctctactctttgagacatcactggcctataataaatgggttaatttatgtaacaaaattgccttggcttgttaactttattagacattctgatgtttgcattgtgtaaatactgttgtattggaaaagcatgccaagatggattattgtaattcagtgtcttttttagtagtcaaatggtaaaatgcagcataagaatataagtcttccaagttagatatgagtgttagctttttataagtctgctcctgccagtttgactttgagatacattggagccaactgtaaactttagtttttaaattacagttagtttttttgtttgtttttgaggcggagtctctgttacccaggctggagtgcagtataccagtcttggcccacttcaacctccacttcttaggttcaagcgattctcctgcctcagcctcctgagtagctgggattacaggcacgcaccaccatacctggctaatttttgtattttgagtagagatggagttttcaccacattggc

SEQ ID NO: 3332 - DNA, 1158 bp, Homo sapiens
atgagctttggacctagaagttatgttatccaacttcagctctgccatttactcgcttaaacctcagagaggacaggtgtggtggctcacgcctgtaatcccagcaatttgggaggctgaggcagggggatcacaaggtcaggagttcgagaccagcctgatcaacatggtgaaaccccgtctctactaaaaatacaaaaattagctgggcgtggtggtgcgtgcctgtaatcccagctactcaggaagctgaggcaggagaatcgcttgaacccgggaggcagagtttgcagtgagccgataccacgccattgcactccagcctggacaacagagcaagactctgtctcaaaaacaaacaaaaaacctcagagagtataagaaacagatgcagagtggcatattgcgacagattttggtgattgggagggccaacccaggcatgagacaaagggataaaattaagggaagaacaacagaatggaaaggaaagaatgttttctcttttgtcttttactttatttatttatttatttatttatttatttatttatttatttatttattttttgagacagagccttgctctgtttcccaggctggagtgaagcggtgtgatcatggctcaccacagcctcaacttcctgggctcaaacgatcctcctgcctcagccctcctgagtagctgagacaataggcatataccaccacactcggctgttttataattttttattttttagtagagacaaggtcttactctttcccagtctggtctcgaattcctgatctcaggtgatcctccaccttggtccctgaaagtgttgggattatgggcatgagccactttgcccagcctggaaagaatgtttttgaaagatgatgttaataaagaacaaacaggattccactgattaaattaggacatgtgcacattctgtgccccaaacaggagtatgagtgtgtcactttctatataggaaaatgagtgcagagaatggacagcagagggagcccttgatgagttttgaccatcaaggtaagaagacggagggagtgacattttccctggtgctctcagaccatgagcttatttctccccactctatctttacttctttacaataatggttgtatattatttcctaacagaagtgg

SEQ ID NO: 3333 - DNA, 1200 bp, Homo sapiens
atttcttggaaataagaaaaatattcattaaactttaaaactcaatgaacagattaaatagtagattaggcatagttgagaaacaattagaaaacttggagctaaatgtgggaaagtatctggatggagaccggagatgaaaactctgaaagagatattaggagacatggagaataaaatgagaaagtctaacagatattcaagaggacttccaggagagaaaactgagagaatggggtgaggcaatgtttgaagtgaaggtggctgagaaccgatgaaagataagaacatttagattcaggctgggtgtggtggctcatgtctgtaatcgcagcactatgggtggctatggtgggaggatcgcttgagtctaggagctccagactgcctgggcaacaaaaagagaccccatctttaaaaaaattttaaaaattagctaggcatggtggagtgtgcctgtagtcctagctacttgggatgctgaggtaggaggatcgcttgagctcaggagctgaggttgcagtgagctatgatcatgccactgcactccagcctgtgtgatacagcaagactctgtctcaaaaaaaaaaaaaaaatttagattcaggagtcacaatgatgaaccccaaaatagataaataaaaccaaatgctcttttagatatacactttataaagatacacactctatatattttataaaagaagccagagagaaaagactgagctctactacagtggagcatgccaagggagaagccatggagatcacatgaatgggagtgttcccaggatctgtgacctaggtgtggggcctgcataatgagaaacctgtggccgattgaatgcgacacaggtaggggctcaggcagaggctgagatcaaggatgactttaaaagcagatggaggatttggacttggtacagaaaacttcaaggacctcttgcattgttacaaggatccaatgagacaagataaataggcttgttaactaaaaagcaattttcaaaggatgatttcgcagtgactatggtgtggaaatgaagctattctgagactctttgttttcaacttcaaactgctattttttgtgtgttttgtttgttctttcctttcttaacctctctttaatagcacagagaggttttgcaacaatctgaggtgtttgagaaaagtgttaaattagtttgtgcaaatgct

SEQ ID NO: 3334 - DNA, 2093 bp, Homo sapiens
caataaactcagcttttttgtggggcacagtactggatttgacagtgattccccacgtgtgttcatctgcacccaccgagccaggcagaggccagccctccgtggtgcacacagcacgcgcctcagtccatcccattttagtctttaaaccctcaggaagtcacagtctccggacaccacaccacatgagcccaacaggtccacgatggatccaccagtcccaccccagccttttcctttcatctgaacagaatgtgcatttttggaagcctccctcactctccatgctggcagagcaggagggagactgaagtaagagatggcagagggagatggtggcaaaaaggtttagatgcaggagaacagtaagatggatggttccggccagagtcgatgtggggaggaacagagggctgaagggagagggggctgactgttccattctagctttggcacaaagcagcagaaagggggaaaagccaatagaaatttccttagcttccccaccatatgtattttctaggatttgagaggaaagagaggaaaatgggggaatgggttgcaaaatagaaatgagcttaatccaggccgcagagccagggaaggtgagtaactttaggagggtgctagactttagaagccagataggaagaatcagtctaaactggccatgctttggaagggacaagactatgtgctccgctgcccaccttcagcctgcaatgagggactgaggcccacgagtctttccagctcttcctccattctggccagtccctgcatcctccctggggtggaggatggaaggaaagctgggacaagcagggaacgcatgattcagggatgctgtcactcggcagccagattccgaaactcccattctccaatgacttcctcaaccaatgggtggccttgtgactgttctttaaggctgaagatatccaggaaagggggcttggacactggccaaggagaccccttcgtgctgtggacacagctctcttcactctttgctcatggcatgacacagcggagaccgcctccaacaacgaatttggggctacgaagaggaatagcgaaaaagcaaatctgtttcaactgatgggaaccctatagctatagaacttgggggctatctcctatgcccctggacaggacagttggctggggacaggagaagtgctcaatcttcatgagacaaaggggcccgatagggccagcagccacaaggccttgacctgccgagtcagcatgccccatctctctgcacagctgtcccctaaacccaactcacgtttctgtatgtcttaggccagtatcccaaacctcttccacgtcactgttctttccacccattctccctttgcatcttgagcagttatccaactaggatctgccaagtggatactggggtgccactcccctgagaaaagactgagccaggaactacaagctccccccacattcctcccagcctggacctaattcttgagaggggctctctcttcacggactgtgtctggactttgagcaggcttctgccccttgcgttggctctttgctgccagccatcaggtgggggattagagcctggtgtaagtgcgccagactcttccggtttccaaagttcgtgcctgcgaacccaaacctgtgagtctcttctgcatgcaggagtttctcctgggcagctggtcactccccagagaagctgggccttcatggacacatggaactaagcctcccaaatgggagttctggctgagcccagggtggggagatcctgggaagggaggcactggaggaagacggcacctcttcccccatggcagggtgtgagggaggcaggtttggaatggtgcgagtatggcaatctaagcaggggtctggtctctttgactccaggctggcctttggccgactgtctgctcacccagagaccttggactccggactatccatggctccgaatctaagtgctgcccactcccatgctcacacccacagaaggtcttcccatcccctttagattcgtgcctcactccaccagtgaggaagatgcctctgtctttcccacgactgccaggagataggga

SEQ ID NO: 3335 - DNA, 1127 bp, Homo sapiens
ggtaatgatctgacgttttgttttcttgtggtgtctctttgtatgatgacccagtaatgctgacttcagataatgaggtgagaagtgttccttgctcttgtgttttttggaagggtttctgaagtattggtatcaatttttctttgaatgtttggtgagttttaaacttactaatgcaattgttttacttgttaaagatttattcattatttctatatttcttgaggaattttctgtaatttgtgtcttctaaaaatttatctaattcaggtatattatgtaattcattggtatgtagttgttcataacattcccttataaatttttttttatttatgtaagattggtaatgatgtctcttcttccattctgactttataatttgagccttctttattttttttttttttgattattctagctaaaagtcttgtcaattttattgctccaaactttatacttagttttcctattggattttagccagttttgcatctattagtaaattcacaccaacatttctgtcaccctacatactttgttcttcaaattcttttttgtaacaatattaacaggttactaattctctcattaattaataagttgaatttatacttttatgaaagtgatgtttttaaacttttgaaaattatactttagcaaaagaaaatatgaaaataagagtcagagagtcatggaaaatgagatgagagggaaagacagggcagaccatgacaggccttgaaggccatgctaagaagattagtttcactctgagtgggatgagaagcttttgtcatccccttagacaagtcttgcccctaactgagacctcagctatctgtaatatgtctctatgcctcctcacagggtgactgtgaaaatagaatgagacagaatgaaatcaaaaattacattgttattgttagtgcccaattggctcacctatgaggtcagttttcaggtacaaacaacttggcctaaatttattgttttcaaattcttacctattaccaggatttctgagggaagcagatacagagaattccagaaggctaagccctggattctgagaaaggtaattttgtccaagaaaattctggtgatttgtgcatgggcatgggata

SEQ ID NO: 3336 - DNA, 1194 bp, Homo sapiens
atgaacaccagaactttggggcgacccttccgatcatgaaaaatgacccactctggtagggctgccagtcattctttcatgtcatttcttcaagttcggtgactctgcttatttgtgctgcactaagaacatgggaactttagaggagaatcggcacccattgcatgtgctgtaaatccccctggtgtgcacacccagctatcccctctgagttgtttcatagtaccccaaacactgcttccaaaaagcaggacatgggccattcctcatggtggatgccagaaccgtctgtttgaatagtttaggctttgtttgaagttaagctgaaactgagagccaacttcttttatctgttgtatacgtcactgagggaagaaatattaaggttttgggcatttgtttggaattagagaggagggaaaataatttctttttttgactgcttccttaggaaaaaatattgacgttgaaaatttacaatataccaggacttggactgttactgtatttaatcatctaacacatctagaggaagacagtaacctccagattttacaattacaggaaaagaaacagagactgagaaaggataaggaacttgcctaattaaaaaaaataagtacagaaaagtgaagttacttgccaatgctagagtcaccatgggtctctcgactctgaggccaaggtttatttcctcacatcattatgggtctgtctgacattgctacaaaattgactaaaagaatattcctctaaaactcccattctttagggagcaatacacagttaggttgtgaaactattgacccatttacaaggacagctgtaaaagatctttaatatttggaaaatcaaatttcggcacaagtctgagttttttcattcaaggatttcttttgttgttgcttatgggtatcacttgtataagaaaaatcaagttttgaatccaagattaccacaaacattgagtttcaatccctgcatctcttagacttctcttcctgaagcaaaatgtatactgtattgcaaaaaaagataaaatttgtcttcatgtgcaaaatgatgcttatgttttgatggacatcctttcatgtgcaaaggatttgtcctttagtatatgttctattcttaaagtggtctatggctgaatcaacccagactgatgcatagccttgtgcaacttcagattttcca

SEQ ID NO: 3337 - DNA, 1195 bp, Homo sapiens
agtgtagtggtagcagctagcacttgtcatatttcaggtttggtgtagtttatttttaacctcctgctggtctggagggctacaaaggtcacaccacatagaacaaaccctatagcttgagttgccactcatcttacacccacttctcttctggttgcttttgctttgtcttggcaggagttcaaagaaggacgcagagccagccacacagccccacaggtcctctttagccacagggaacctcctctggagctgaaagacacagacgccgctgtgggtgacaacattggctacattacctttggtgagcagggtgcacttgctgcttttgtgccgctttaatgagttcacacagcagaatacctaaatctgcacagaaccttggttaacattttaaggtaggcaaacgcaggcataccaacttgttcctgttgccattgcagtgactaaaggagggatgtcacagggtattaattacagagcaggccatatgctatttttgtacagtaatcctttcctttttttccccatttttcttaaatcttaaaaataagactgaattctgatatcaagagttaaggtcccttcaatagttcagctggtagagcagaggactatagctacttcctcagtaggagacgtccttaggttgctggttcgattccagcttgaaggagacaagtacagttttggctgggcacggtggttcatggctgtaatcacagcactttgggaggttaaggcaggtggatcacgaggtcaggagatcaagatcatcctggccaatgtggtgaaactctgtctctactaaaatacaaaaaaaaattagctgggcatggtggcgcacgtctgtagtcccaggtactccagaggctgaggcaggagaattgcttgaacccgggaggtggaggttgtaatgagctgagatcgtgccactggactccagcctgggcaacagaacaagactcttgtctccaaaaaaaaaaaaaaagagttgaggctgggtgcggtgtctcacgcctgtaatcctagcactgtgggaggccaacatgggcagatcacctgaggtcaggagttcgagaccagcctgaccaacatggtgaaacactccgtctctaccaaaaaaataacaaagaaattagctgggcgtggtggtgtgcgcctgtaatcccagctactcgggaggctgaggcac

SEQ ID NO: 3338 - DNA, 1266 bp, Homo sapiens
gagcggggaaaagcaggagtcagaggccaggggtgagcgtctcctgtcccatggcctgaggagcggcagttctcacctgggtccggcggaccgggatcaagttctaccacctcgataatctcttcatcaccatggaagcttagggtctccagtgggggggtgtcagcagcagccccgctttccgattcggactccatgcggcgcaagcggcggatccacttctctgggcccaaacgcctcccagagtcagctctgcgcgacgacgcggaactcgagcccctcctcccggcaggaagtaggcgtaggcgactccccagcaggaagagcgacggccgttcggccaatagctacgaaggttggctggccgcctcaccaatcacagagcggcattggaagatggggccggggcgtggcggagagaacccaaactccgccccacctgactccgcccccaactggagggaaacaagcgagcgcgcgcgcctccggggtctcctgggaagagtagttctcctgggtccgctctgcgggcttctgggagatgtagtttctggtctgtaggcaggacggaaggagcgggggaggccccttacgcaaactacaattcccggcggggagcgcggtgaagcgggggtgggatctgaacatggcggcggtggtagctgctacggcgctgaagggccggggggcgagaaatgcccgcgtcctccggggtaaggagagggaccccggggagggcaggactgcagaagatcccttttctttcacgtccagcccgacgatagcaggaggtcagggctcttggttcctccccacacttttctgcaagatcttagagtctgggggtgcagagatgctctttagaggtcacccagtgcatccccccgccttcgggttgctcgacacctccggggtcttgctgcaagagggagctcctaggaagcctgttggactcccgcgctccaggtgtttcacactcaccgcagtgcagaggaaagagccccgggcttctggaggtttgagttccagccccggataattagcagtttgaccttgggcaaagcagtttttctctcagggcttcagtttcctcttccgtacagtgcaagggatggagtagactatctttaaggtcccttccagtgctaacatttgcagtttcaaaaccttttcccggatttccttcatacgtcttatgtgagtcccactgcagtccttcccatgctgtcgtctgaggaagaacagcgaagcttttcgtcctggcac

SEQ ID NO: 3339 - DNA, 1142 bp, Homo sapiens
ttctcttatggatcactgttttgtgctgcctattgtctagtatctgaaaatagctgttttctctattttgtccagttttctcattgtttatagtaggaaggtaattccagactctcaaacttcctcataggcagaagcagaagcagtagttctctcaggtactcaaaattgacatcacccatgggcaacacaggaatatcatgtattcctggatgtgatgcccttagaaggatacagtgtccaccagacatgtggctcacacctataatctcaacactttgggaggtcaaggcaggcagattgcttgagcccaggagttcaaaaccagccttggtaacatgacaaaattctgtctctacaaaaaaatacaaaattagcctggcatggtggtgcgcatttgtaaccccagctactcaggaagctgaggtgggaggatcatctgagtccgggggggtcgaggttgcagggagccaagattgtgccactgtgctccagcctgggcaacagaatgagaccctctcaaaaaaaaaaaaaaaaagattggatgtgagggcgatctgactgtgacatctgtcaccccgttgttcaccagggttgatttggctgatctgactggctaggcgggtatccccttcctccctcaccactccatgtgtgtctgtcgcaaacctgcgtgctcagtcaaagaggatgaccatccccaatagaggaggactggtcttcagccaagagtatacgagtagctgcactcccctgctagaaactccaaacaagctctcaaaaaaaaaaaaaaggcatgacatggtatcactgtttgttcatgtgctcttccagtttaggctgaatctcatcatgaggaaatagcaaacccagtatgagggatgttctattaaaaataaggctaggtcaggtgaagtgcctcacacctgtaatcccagcactctgggaggctgaggcaggtgaatcacttgaggtcaggagttcgagagcagcctggccaacatggggaaacgccgtctctattaaaaatacaggctgggcacggtggctcatgcctgtaatcccaacactttgggaggcaaaggcgggcagatcaggagttcaagacaaacctgatcaacatgatgaaacctctactaaaa

SEQ ID NO: 3340 - DNA, 1181 bp, Homo sapiens
ttcgtaccttcagcatgagagtggccgcatttccactaagtttgaatttgtccccagccctggaaaccattttatctggtaaggtggggagctagggagggctgtgagagtagaaaagaatgatgggagctgggtttgacccattcactcactcagttttgatcgttcttattcaggtatcgggggaaatggattcgggtagaacgaagtcgagagatgcagatgatagacttgcagacggggactccttgggaatctgtcaccttcacggccctgggcactgaccgaaaggttttcttcaacatcctggaggaaggtgtgggatggcacaggcaggctttctagggacattgcagggatggggacatttgacatcagatgagcagtttggagaagtggaataagcaggccggggtgagcccatgggaacagggggccagaaggaagctgtttggcacagctccacctaattgaagaatcagccatggtgaagagaattattggctttatctcatcttctccttcccagctcgagagctagccttgcagcaggaggaagggaagaccgtgatgtacacagctgtgggctctgaatggcgtccctttggctatccacgccgccggcgaccactgaattctgtggttctacaacagggtctggctgaccgaattgtcagagacgtccaggaattcatcgataaccccaagtggtacactgacagaggtgagaagcagctggggtcttggctgtgctgtttttgacatttttagaagggacaggttggtctccagccagatggggtgatataaagctctagtccaattcccagagattaagaggaatgaaaagttgtgtatgagaatgatttatttccgtaccaaggttatcaggcttccagggggcagggctgggaatgaacgtagatatccggggcaaaagacatgatcatcctggctctatccctaggcattccttacagacgtggctacctgctttatgggccccctggttgcggaaagagcagttttatgtgagtattcaaaatttctctcaacttggcaaaacgaagcctttgtggaaacactaggctgatagggttggaaggggaaatgaatctggggatcggggaccaggataaacatgaaacgtgtggaacatcagggtgtgaggtagaagtcag

SEQ ID NO: 3341 - DNA, 1198 bp, Homo sapiens
ttccatttgggttagtggatgtgaacagggctagggaagtccttcccacagcctgcgcttgcctccctgcctcatctctattctcattccactatgccccaagccctggtggtctggccctttctttttcctcctatcctcagggacctgtgctgctctgccctcatgtcccacttggttgtttagttgaggcactttataatttttctcttgtcttgtgttcctttctgctttatttccctgctgtgtcctgtccttagcagctcaaccccatcctttgccagctcctcctatcccgtgggcactggccaagctttagggaggctcctggtctgggaagtaaagagtaaacctggggcagtgggtcaggccagtagttacactcttaggtcactgtagtctgtgtaaccttcactgcatccttgccccattcagcccggcctttcatgatgcaggagagcagggatcccgcagtacatggcgccagcactggagttggtgagcatgtgctctctcttgagattaggagcttccttactgctcctctgggtgatccaagtgtagtgggaccccctactagggtcaggaagtggacactaacatctgtgcaggtgttgacttgaaaaataaagtgttgattggctagaactgctgcctccctgactgtgagctgccttccacaccctgcactgcactgtgttctctcctcacccttaacctgcttcactccagtctgttctggctgtttattaccttgttgcaaaacagggccgaagcaaggattaccttgacaaccctagcttctccttagccatcttccttgacagtgtgatctgtttagtgagatttagcatgtgtgaataaagtatatgcaggaggaaattgctttgtcttcccaatcggtagaaattcgggaccataaaaattgtgttttaccatgtggcctacaaccttaacactgctttcttaagaagtcttcacccatctacatgctaacaactcactcagcctggatttatctttactggggaagccaaacaagcaatagaggacctttacctgtgttagaaatgagttggagccaaggaacactgaagaaatagtatcttaacagttactgagtccattgtatgtgcttggctctgctctgagtgatttatatgtattaagatttttcctcacaggtcagatatatact

SEQ ID NO: 3342 - DNA, 1428 bp, Homo sapiens
accgctgccctgccatcccgtctgcctgccatgggacggctcctctgagtgttccctggccccacgtgtgtggtgtttgtgtgtctgtgcctggccaagggaggtgccaacactgggcttgccacagccccaggagaggaatttggggcctaggaaccgagggcacacgggactctagcctcatccccaggacccccttggctcagagtgtggtgctagaaactggcccccagcccagccccagtactgccacctttacacctacccctgcaagtccccagagggctgcccacgatagaagctgccaagcagggagaacctgtgccaactgtggagtggggaggttgggcctggaccctcaacccctgcaaccttccctagccccctcaatagatgagcaggtcaggctgtggcccttacctcacccgcagttctcgcccagtgctgcagccggctcacctctctccgcttcttgcacatcactggcctgtgtgtgctgcttgctcctgttctgttcgcttgctcccgttccgttcggcttttgctttgcgttagggtgaagaccctagcgtccagctcccctcaacgctatattttgacactaaaaaagaaggtttctaaattgtaggagcaggatggaaatactttgctgcccttgccatcttttaggatgggcccccaggagactgaggtcttcctgggccctcattgctgcttatcgtaccccccatcacctgcacatgggacagaccgggctggagggtgaccttggctgtgtgcgtcccagcaaaagagctctggcccgcatctcgctgtgccctgaagggggatgaagggcgatgcctcgcccgaggctttgggctgctgcactgcatgctgggactgctcctactctctgtcccacccctcacccagctgtggtccggctttgggagagtggtgaattgcgctgcccgaactcggagcggagcagggtagggaccgtgtacagcttgataacccttaataaaaagggagtttgaccagacttcttgttgtctcgcgcggctagaatcctgggaacaagagaaatgggatggggactctgccggggtctagaagaaagtatgtttaggccgtcgctcagatacgctgagcaaggcggctggcggaagggcagcttccgacccacagttccgtggaggtctgtgtcctgccccgagccaggattccgtgaggtctgtttccagccccgagccacgattccgtggaggtttccagctcggcctggtcgtcagatttcccgccctgggcacgtgaccaagccggctctgcttctctaatttgcattcgttgcctgcaccattccccccgctcccccctcggagacatttggccaatgggagccgtgggtaggggctgtgggcggggctacagccgtggagcgcg

SEQ ID NO: 3343 - DNA, 1428 bp, Homo sapiens; identical to SEQ ID NO: 3342

SEQ ID NO: 3344 - DNA, 1264 bp, Homo sapiens
gctcaggccacatgcatgccctggtccttccaggggtcacccgagaggatgctggcgaggtcacctttagcctgggcaactcccgtaccactacgcttctcagagtaaaatgtgagggcaggaaggcctctggacaggcgaggcagggcaggaggttggccagatgccggagctgggttggtgaagtagatttaaggtggaagggctgtggaggcccaagcaaggccggaacacatccctgccttggtctcaggtgtcaagcacagtcccccaggaccccccatattggcagagatgttcaagggccacaagaacacggtcctgttgacctggaagcctcccgagccagctcccgagaccccattcatctaccggctggagcggcaggaagtgggctctgaagactggattcagtgcttcagcatcgagaaagccggagccgtggaggtgccgggcgactgtgtgccctccgagggtgactaccgcttccgcatctgcacagtcagcggacatggccgtagtccccacgtggtgttccacggttctgctcaccttggtgagttggtcctgccagacccacccatcacttctcctcccttccccagccctcagtgctggtcctctcacaggcttgccatccgccagcctctgccctctgccacaccttctagttctgacagctgcactctgtccctgcctcagtgcccacagctcgcctggtggcaggtctggaggatgtgcaggtatacgacggggaagatgccgtcttctccctcgatctctccaccatcatccagggtacctggttccttaatggggaagagctcaagagtaacgagccggagggccaggtggaacctggggccctgcggtaccgtatagagcagaagggtctgcagcacagactcatcctgcatgccgtcaagcaccaggacagcggtgccctggtcggcttcagctgccccggcgtgcaggactcagctgccctcacaatccaaggttggtgccagtggggacctgagtgggcagaaagggtcaagacacagaagtcctgttggcaaaacgaggcagatgctgtttttatttcttgtatctgggccaggagagcaaggagcatccatgatgggctgaggttgagggctcagaggtccggaaggccaatttcaacccacatgcaacatccagggcaccccttgttatcttgatatatgtcagcatcatatcccaattctctggagtgctttgtggtttacagaatcctgtc

SEQ ID NO: 3345 - DNA, 1217 bp, Homo sapiens
tcaatgatgcttactaactgtaggaataatagagggaaggtaagctttgacaaagtcattatttgttagcacacagaggtgaatgggataatgttaaattgtaagatccgattattttggattatgaaagaacattccaggcatttgaaactatattattacacaaatatttaggtgctttaaaagtatatttgataagaaatttgagacttgcagtccttatattggttaattctcatattgatgaataacattcactaccaaaatatgcttgttagcattgctaatatgatttctgcattagtattctgggtgagcctgccgtgagagtatatatgttacttacaagtatgtgcagagataggtgtgactgtatctgttatgggtgattctacacctgcaggttaagaaacgcagtttgaagtgaacatttgatttgatcaatagatgctcctgatggcctggtggctgatgaacttttgcactgaactttctctgctggcctaaaagaaaacatgatggttgacaatctttttcatttcagctgtgtcagatcccagcagcaccgttcacagacctcaaccgcttcctccaagcactgtacaccaaagcacgattccttccaacccagacagcagctctgcctactgcctccccagcaccaggcatggattttccagctatacagacagctttgtgcctccgtcggggccctccaaccccatgaaccccaccattggcaatggcctctcacctcaggtcagtcccgtgtttctagacagacgatttgctgtataccagaaccaaatattcaattccctgaggcagtagtgtaatgaattgccaaatttaaaccataatgtattctttatagaagccacatgatttcagttttctggtttcctttctctccacccttcctactggcttcatcaaaagttgtagcttagacttaaaattcaagtgatttttgatataatcttggagactttgtgttcatatttagctgtgaaggtgtttgccatgttttgtcttctccatcctagttctgggctttggttaagaagcttgcaaacagtggcaggttttttgttttgtttttttgttttaaattgtatttaaaattgataaggtttcaatcaattgataaggttttaaattgatgaggtttcaatcaaaagcacctcataagaaaacactaaagctttgacaaaaca

SEQ ID NO: 3346 - DNA, 1167 bp, Homo sapiens
tttttttttttagatggaatcttgctctgttgctgggctggagtgcagtggcgctatctctgctcactgcaatctccgcctcccaggttcaagcgattctcctgcctcagcctcccgagtagctgggactacaggcgtgtaccatcacgcccagctaatttttgtatttttagtagagacggggtttcactgtgttggccaggatggtctcgatctcctgattttgtgttctgtcctccctggcctcccaaagtactgggcagcctcatcataattgcttaccaccaatgtctgtgttgtttttgacagtgccattaggcatgaacttttccattctttgttctaaatatagtcggtcttagaaattgctaaggggctctgtgttcttacagcctgcttctccagcctgtgcagaacctttgtgccattgttctggagctggggctggggacagcagcttgattttcttatagttatatctgttctgtgagtggtctactaggccatcaatgtacccatcagtcttctctgtttggagcttcttggcctgcatggaacctctgctttacaagaggtgaggcaaagatgatctgtgcttggtgtccttggcctgatgcatctggggtagagcttctgccctaagaatggggactggatgaaagagaaaggattcttcagttctctcatctatctacacttgcctggaatagaatttctgcaacacagagctaggggtaggaggtgaaaaatgctggctgcttgcgtcacttgggaagaaatcgtagtcctggatttggagctgggtagggttaactagttactagttagcttcagttttgtttcttcaagaatgatggccggatgtggtggctaacacctgtaatcccagcactttgggaggctcaggtgggagaattgcttgaagccaggagtttgagaccagctggggcagcatcatgagagcctgtctctacaaaaaaaattttgaaaaattagctgagtgtggtcacacatgcctgtagtcccaactgtttgggaggctgaggagagagaatcgcttgagtccaagagtttgaggctgcagtgagctataatcttgtactgtactctatcctgggtgagatcctgtctttaaaaaaaaaaaaaaaaaggtattattacccacct

SEQ ID NO: 3347 - DNA, 1215 bp, Homo sapiens
ttgtagtgttgcttagcactttgcgcattgtgtaagttgggtaacaaaaatggcaaaagaaatgcagatttcccagttatcttgctctgaagacatttctttagctagtcttatttaattttaaaggtttgataaatatacaaagacccaagcatacaatttgagcatgctgtattctaccacttgcacttactcatcttctagccttatgaccaggaacctttgttttgggctcaagtacacatcctgatttggtttctccctgttgtaatttgagatttcccaaattaagtcttataatgattaggttttgttctgagttatttctagagaaagaaagtattttagtatgtgtaaattgtacaataatttttttgctgttgtactcactgctaatagtggattgtatagggtggtgtttttatttcatttattgtagacaaaaataatgaatttagtatacacatacccactaattcaagtatgtcagagcacaaagttggcagctggttatatttaattcagcccctctgaaaagcacatacagtctatactttgtttataaataccctaggtcctccctgcccctaaatatatattttggtgaagctgtggtgcactattaattttctgtttcaaaatgcaatctaaagatgcaataaatatgatgaccttgatagttttaatgaaatcttcaattcttgcagctgtgttttggaaagtgattaagcaatatttctcaaacctgatgattcttggatatttagctattgtcctccaaagagtcatcgtttcacgttttcaaacatgtgctttgtgctgaagattcttgtcagatatcctgtgcttccagagtatttttatcttcaattttatttaattttgtttcattttgttttcataagacaatgtttcagatatgtaatggggcaaaccactatagatttctgttggatagaaaaatgaaatgttactaataagtttaaattgacccttcgttgactatcagtactgttgatacatttattagaatgtatgtctcagaagatggtttctgtttaaatttatggtcaagttacaacaactgaattctaatatggattaaaaactccacataaatatttttccccatgcgtcttgggttataattttccttttagacttgcaaatatgcttttattgcaattttgtctccatctgtactgtagaattaca

SEQ ID NO: 3348 - DNA, 1192 bp, Homo sapiens
gaatcattgatgctaataagcagttattagatggaaggttaaaattaagtagagaatatctgtaagttttccaactttagctaagtcacaaagcagaaactgattgtagtgtatatagaatgccatgcctatggctccaaagccttctggctgctgacacctcaaatctggggcattgtgagaaggcacaagaaatgtgtctttactcaacaccacgtgtttctctacagtctgttgctaatgttttattagctagcctttttaaagaaatcacctccacaaattagtggagatagttaaaagtatttaattataataatttaaaggaaggtgaacttttatttttgaatattctgtgtgagttcagtaagatggtgtattgtttaatgccacatgacgaatttcaaaagttagtgatttaaaacaaccactaacaatttattatctctcgtttctgtgggttagggattgagaagatactcagttgggtagttctggcttggggttcatgaggttgcatttagatgttgtctggggttctggtcatctgacggtttgactgaagctggagaatacacttccagggtggttcacatggctggcaaatttgttctggatgttgttaagtggccttagtttctctgcacatgggccttttcatgtggctctttgtcctcaaatcttggtggctggttttcccaagagcgagcaatccagaagacccaggcagaacctgcagtgcctttttgatctttccctggaagacatgtagtgtcacttctcattttcttggttgcccaagtcagccctgatagtgagaggaccacacaagattaacatataccagggttattacgtgctgtcatagaagctggctacaacaggtggcattaatttgtagtgtcatatttaatctgtagtagtcaggctgctgctgaggttttttcttttcatgttttttgaatgactaaaggtaagtttattgtgatttagaacagctaaaaataggaaatacatacagtggtagtctgtaccttggactttagtaattagcagtgggtttttgaaagaggtatggataagaactattaatacatatttttgttaatgttctttattttttataattttatgagaatgagtctgaaatttaaaaactacagacaatagcactattaatgtcagaatttaa

SEQ ID NO: 3349 - DNA, 1170 bp, Homo sapiens
tggagtttgtgatttgtatcagaaataatttcgacttgcctacacttaaaaacttgacgtgggttgtacagaaactaaagatatttttggtgctgatccaggagatacgtatttttaaatagcccatatcctggatctttgttgagtattcagcatattgacatgtatctttgtaaggtgaagtaactaagaatttaacttaaaaagcctcgaacattctggtgctattcctgctgtcttctctacattaccatagccagttgctttcattttgaaccagaagcactagcatattattgacttgtagcttcataaattaaaaaaataaaaactagattttgtcttttagaacataggccattttccaggaaagcagctaggttttaatccattaatcttgtatactgtctccaccaccacaattcacataatcctgtagacagtcctgcttcaccctggtcaactgcatgatccttattgtaatagtgaatcagtataacactttagacatgcacacagataacacgctgttgcaagagttcatgatatgtctgctgtccaactagttttatttgcctgatcctactggtttaggcactgcctatagtctcgagttcacagaaatgttgggttttttccctccccaaagtcctcattttttataaactgtagaaaggcaaaatgacaagggaaaaggaattctaagagtgaagggatgattgttatattggggcaagaaccacagagtggctcaggctttggaaaaaatatggtgtggatagtgacaaaaaacataaatataaaaattcaagaaaaactaccagttttgaacaacaaaaacaaagggagagtttatcctttataattttaatatgtaagaaaaaattacataaacttttcccagaggaatattttataaatgtgcattgagtatttttcgtactgtggtataggagtatattttgtactgttgatgtctgctactgacttagaacaaattgattattgggttactatggagaaaggtggtcttaagaacagcaagggctgagcagcagtaggttggggcagagtgtacagtagaaattatttagtgtggggcctttgtcatttaatatctagctgagttacttaggactctctcaaggtcttgcctatagaaagttgaaa

SEQ ID NO: 3350 - DNA, 1173 bp, Homo sapiens
cctcctgctgtcccagcccagtggggcccagcccactaccatcccgctcccgctctccgaacttcccccctcccactccccaccatgtgaccaggaccctcccaaccgccgctccgagctccaccaatcagcaaccacctccacccagaacccgggacctggcgctccactttcaaaaaggcagcttaatcctcccgccctcagccacgccccctttccgcttccccgccccgccggcccctcccacttccttcagttccctgttcccctcctcccctccggtggcgcccaccctctcccgggcttcgccccgcccaccaggggggcagcgcgctcgccctcttctcgcgagatctgagcgtcccccgcggcggccgccgggctccccctcccgtcctcccacctccctcccccggcatctctcactctccggctctcctccctccctcctcccccctccaccctctgggccggatctcgtctcgctcaggcggaggaggagaaggaggaggaggaggacgacgttcggcctgcgcagtgagatgtttgtccgtcgccgccgccgccgccatcgcggaggagcgcgataaagggagccgagccggacgtgagggggaccccgcggagccgccgcgccagcgcagccccccagccgcatcggagtcgccagagtccgagccgccgccgccgccgccgccgcccccgccgccgccgcggctgcccaggggccggccagctccccagccctgcccgggggtcgcgccgccgccgcccccagcgtcgcccctagcctgcctgcccgccttaaatgtgacaccggcgtcgcggagcgcgacctgaagccgccgccggggaggggacgagcaccatgtcgaatctgagcaaaggcacgggcagccggaaggacaccaagatgcggatccgggcctttccggtgagtctctcctcggcgtccgggaccccggggccgggggccgggccgagagccgcacgcgaggcccgggctgaagtcccccaacaggccgcaggcccggcctcccctcccccacgcccgccggccgcggggcgcgagccttcccggcaaccgggcggcgcggggccccggcgcggccgccctcccgggccgttccccgcgccgggagcccgggcctggcgccgcgcccccgtccggga

SEQ ID NO: 3351 - DNA, 1176 bp, Homo sapiens
ggatcccaccttccccaccccacccccacccccgccaatctaatccttccttgatcttccaatataaattgaattttttttttttttttgagacggagtcttgctctgtcacccaggctggagtgcaatggcgtggtctcagctcactgcaacctccgtcccccaggttcaagggattctcctgccttagcctcctgagtagctgggattacagacgcccgccaccacgcccggctaacttttatatttttagtagagacgaggtttcaccatgttggccagacttgtctcgaactgaccaggtgatccacccaccttggactcccagtgtgctgggattataggcatgagccactgcacctggcctaaattgattttttctttctgggcttccttcagtcctccactctgagagctgataggtaaacccaaaaactatggggtggaggggaggatatgcatatttttgtgtgaatatcatttatttacataacatgtgctatatcttatataagacactatatagtctatggccatagtactctgaacatgcccgatttcatctgtttgaggaagctaagcaaggtcgggcctggttagtactcagacagaaggtactgtatacccacatgtacgtgccaggagaatgatccccattcagtagttttccttagacataagcaagatgtagctgggcccgatggctcacgcctgtaatcccagaactttgggaggccaaggagggtagatggatggatcatctgaggtcaagagttcgagaccagcctggccaacatggtgaaacccatctctactaaaaatacaaaaaattagctgagcatggtcgtgggtgcctataatcccagctacttgagaggctgaggcaggagaattgctttaacccaggaggcggaggttgcagtgagccaagattgtgccactgcactccagcctgggcaacagagcgagactctgtgtcaagaaagaaagagagaaagaaagaaggaaagaaagaaagaaggaaggaaagaaagaaagaaagagagagagagacagagaaagagagagagagaaagaaagaaagagagagagagaaggaaggaaggaaggaaggaaagaaagaaagaaagaaagaaagaaaagaaagaaagaaagaaagaaagagaaagaaagaag

SEQ ID NO: 3352 - DNA, 1208 bp, Homo sapiens
cagattcagtcccaaacaggagacccatgtcaacaactgctaatgatcctgcttttcctgttcctatacacacacctccccttggtatttctcttctgggttacttcccttttgtaactcagagaaatcctcatgctcagaaattagcaccaattacaaactttataaaacattttaaataaaagacatatgttatgtgctaaatccccagttatgtgtcagtttgtttgttacaatattgctgctattttgctttaacagtataagcactgtggaacgggtattgtacagcatccacacggccatataggaactcggtgggcattttgtgttggttatatatctacacatataatgtttataaggcatatgatttttcattgtagagtgccttttttttttttttaagaaaaccaaatttgagaatctgcgtggtatatctggggtaaaatcatatgatatttttagtactttccttatgctttctggtttctgtaagaaaagataacatcccaatccaattaaacaaggtaaatcctccagccttggatgtctggatgaaagagagcaggatgggatggtaggcacggaactcagaatccactaaggagtgtgtaacaactcacctgccaaatcaactagcccttacattttttttttaattttgtatagtccatgagatcctgatactgacctatgaaaggtgcagaagcctgaagaaaagaaacaacttgctcaaaatcacatgacacaactgccccacctgtttcaagaggcacctgtggatagacacaaaacccacccaatggcagtggaatccggtgggggggagcacaggctgtggagtcagaatgctgcagttcaaatccaggctctgctagttactaacgagggaccctgggacagtcagatgaacttctctatgcctcaactagttcatctgtgaaatggggctacacctggcacttaaaccgttgagttgccatgaggatgaaatggctctatgccatgaaaagtgcatagatgagtgcttaatgcattaattaacacctgttctttaatgtcagttctgtgttattgtcagttctgtgttattaagacttctatttctttttttttttttttctgagacggagtctcgctctgtcacccaggctggagtgcagtggcacgatctcggctcactgcaagctccacctcccgggttc

SEQ ID NO: 3353 - DNA, 1228 bp, Homo sapiens
acagatttgaaccttctgaaaacctatgtttaatactggacttagtaggaacatattcatactttattttttgaaagcattatatatgacagttgtaattatgacaggctgatattaactgttttcttatctaacctcttagaagctgcagttcatcatctgctgtgatagttccacaaccagaggatccagacagagccaatacttcagaaagacaaaaaacggggcaggtgcctaagaaagacaattctcgaggagtgaagcgcagtgctagtccagactacaacaggaccaattctcctagctctgcaaaaaaaccaaaagcacttcagcatactgaatctccctcagaaacaaataagccacatagtaagtcaaagaagagacatttagaccaggagcaacaactgaaatctgcacaatcaccatcaacaagcaaggctcataccaggaagagtggggccactggcggttcacggagtcagaaaagaaaaaggacagagagttcttgtgtaaagagtggctccgggtctgaatcaactggtgcagaagagagatctgcgaaacctaccaagctggcttcaaaatcagccacctcagccaaagctgggtgtagcaccatcactgattcttcttctgctgcctctacttcctcctcgtcttctgctgtagcctcggcctcctccactgtaccaccaggtgccagagtgaaacaaggaaaagatcagaacaaggccaggcgttcccgttcagcgtccagtcccagccccagaagaagtagcagggaaaaggaacagagtaaaactggtggctcttcaaaatttgattgggctgctcgtttcagccctaaagttagccttcctaaaacaaaactgtctcttccagggtcttctaagtcagagacatcaaaacctggaccttctggattacaggccaaattagcaagtaagtttacaaaaaggtatttttctttaattaaagaaagtttctcttggtttgtcaaaagcaattatgctttaaagttaagggttttttccccccagtcttagataatcttagatgtattactgtctgtgtaattaagtacataacagcatgtagtaagtgctactacatttagttttgttgagacaggtaaggaatactaccttcctattattacgaaaccatcacattttagtgtctgtgtctttattggtcctcgcggcatctcctacttcactgattt

SEQ ID NO: 3354 - DNA, 1135 bp, Homo sapiens
tttggcttctcttaggaaaagacgacttcctagtcataggtgtcctatggggaaatttattttttttaatgtcctgttccttaatgctgcaaattatcagtatttataaagtaactgattttgcaccacttttttgttactgtgaccacggcagaacaatgtcttctagactatatctatgtaaagttattagaatggtatctgttcattttagtgatatgaagatcacaactaacaactgacaaatcagagtttgccagttcaaattcagcatggctgcagctgattaagaaattgatatgattattctttgctagcctctcttactaatggaattatatactggccagtaaaatgggcctcccaattgctgtttcagcaggttttaaaccttcaggaacaccagttaggaaaatagctccagaaaatatagatatattttatttttattaaaatggcagtctacatcataattggcatttctcaagactgtctttaccagaatctgtgtgaaataaggcaatctagtctccttgaaaaaaaaatctcttggatgtttaggaaggaagacttggccgtgatgtggtgtcctggctttgtggtgtagtgctgtgtgtatggagttagtgtaaaaacatggattacaccaagtggaagaaacgtcttcttgccaagctcattcttagaacttacacatctagaacagcttccactttggcagtgaggtcgtagccttttaggtggaagaagtgagggtgcagcgtgtcagacacaacattcatgttactcttacattggaatctgaaggtagttcagacttcgtgggttttgtttttaagcaaaacaatgtgaaaacatttaagtttgaaatgttgcatttgaagttatgatcatttaatatattcatattaccaagactattatactggaagtggtttttgtgttataaaggtttaattttacataaggcagttacttaatgtgatttttaacccttaaaaaagtggagatgtatacatttgttaacaatgccatgaaagcattttctttctcctaaggaaaagtgaatttcttatcagaatatctggctggccctgtaatttaaattaaaataaaattttggagaaacagcatt

SEQ ID NO: 3355 - DNA, 1235 bp, Homo sapiens
tgctctttatgacctcttaagagtgtaagtcattctcatcctcattattatttttgctgcccattttaaagatgaggaaacaggtgcagagaggttaacaccctggaggtcacacagcagggaggtggcagacatgggcaggctgactccagctttcgagctctccccatttctcactgtgctctttgggtgaatctgggtgaatggtgtcacttcctggccctcctgtggctcaggctgaggctggtggtctttgtgactcagccaggatgcagggctcactggggtttttctttttcctcccagggatcaacaagcgtggggccaagaactgcaatgccatccgccacttcgagaacaccttcgtggtggagacgctcatctgcggggtggtgtgaggccctcctcccccagaaccccctgccgtgttcctcttttcttctttccggctgctctctggccctcctccttccccctgcttagcttgtactttggacgcgtttctatagaggtgacatgtctctccattcctctccaaccctgcccacctccctgtaccagagctgtgatctctcggtggggggcccatctctgctgacctgggtgtggcggagggagaggcgatgctgcaaagtgttttctgtgtcccactgtcttgaagctgggcctgccaaagcctgggcccacagctgcaccggcagcccaaggggaaggaccggttgggggagccgggcatgtgaggccctgggcaaggggatggggctgtgggggcggggcggcatgggcttcagaagtatctgcacaattagaaaagtcctcagaagctttttcttggagggtacactttcttcactgtccctattcctagacctggggcttgagctgaggatgggacgatgtgcccagggagggacccaccagagcacaagagaaggtggctacctgggggtgtcccagggactctgtcagtgccttcagcccaccagcaggagcttggagtttggggagtggggatgagtccgtcaagcacaactgttctctgagtggaaccaaagaagcaaggagctaggacccccagtcctgccccccaggagcacaagcagggtcccctcagtcaaggcagtgggatgggcggctgaggaacggggcaggcaaggtcactgctcagtcacgtccacgggggacgagccgtgggttctgctgagtaggtggagctcattgctttctccaagctt

SEQ ID NO: 3356 - DNA, 1177 bp, Homo sapiens
tcacatgaggctattgaacagctgagatgtggcttgtgtgactgaggaactgcatttaaagttttgtttaattttaagtaatgtaaagttaagtttaaatggcacgtgtggctagtggctcccatattggacagcacaggtctagaaggtatgctatcatcattctcttccaaggttgatttatttccatggcctgattaacaacttagtttagattggttttcaggtttagacagtgacaggacaaaggtactggctgtggcagacactgttggttttctgctcattggccactcatgcttactgagccctgattttggtgtaaaagcaatggacccagcctcaggggttgaagcgtgaatagatgaagccaactgttcttcattgctagtgattggtcttgaggtgggcatgctgctcacttctagccagtccaagacaaggagagatttccaggaaagatttccttccctgactagggaagttgacaggcccttttggggccatcaccttccttgcttcacagaatgttgtgtgaagacttgatatttggagctatggcagccatcttgctaccatgagggaaaggccaaaagaattagtatctttctatgaattgttaacgatatttggaaaagctcagtgaacaccttacttctttggtgttgtcagttttcactgctttgagaggaattctgcccttcaaattgtataacccaacatcttccttaaattgttttatattgagataggacataaattattaaataaaatatttaaaataggtcaaataatagattgcctttagaaggaaatccaagctactggtaacaggatggcttctgacaaagggaaatgacaggttaagatttatgggtgggagggacatttaacactgcctatccatttgtttgttttgaattttgttccacaggaatgaactgtctactcaaaaataggtttattaaagttaaggccaggcgcagtggctcatgcctgtagtcccagcactttgggaggccgaggcaggcagatcacttgaggtcagaaattcgagaccagcctggccaacatggtgaaaccccatctctactgaaactacaaaaattagctgggcatagtggtgagctcctgtaatcccatctactcaggaggctgaggcaggagaatcacttga

SEQ ID NO: 3357 - DNA, 2740 bp, Homo sapiens
aacagaagaaactcttcaggaagtatttgagaaagcaacttttatcaaagtaccccagaaccaaaatggcaaatctaaagggtaagataatacctttgtatcatcagttataggctatatatgtcttagaggtctaaaggaacgtaaggtcatgtgatcctgtcagaaaagccaaataattttagctacgtaaatgagtgtaaaataaagatcatcatttaggtaccaacttgagagaaggggcttggcagcatcatgtgacagtgaaggagcatgtgcctggtaacttactctaagcattaactgttcatcctcaggtatgcatttatagagtttgcttcattcgaagacgctaaagaagctttaaattcctgtaataaaagggaaattgagggcagagcaatcaggctggagttgcaaggacccaggggatcacctaatgccagaagccgtaagttcacctggttagggtgctgtggttgggggtagcactctcggtgctttgtttattttttgcacaaattctgtgtttcctgttgctactgagtgaacaataactggatatgatgactgattacctgagaaataattgatgaaatctcaagaaaattcctctagatagtcaagttctgatccagctgtgtcaactcagagtagcaagtttgcccatgatttcctgccccatccactgggccccacctgcttgggttgcttctcccactttccatagaagatctggggcaggatatcaactatgcaatggcaattaaaaaatgtaaacccagaatagcctttactttaattaaggactagttggcttagttgcttttaactgctttttcactataacaagtattcttggctagtagtcatactaggcattgtgcaaattcagtgttacgaactgtgacttcacataaagtcacatttttttttccttcccagagccatccaaaactctgtttgtcaaaggcctgtctgaggataccactgaagagacattaaaggagtcatttgacggctccgttcgggcaaggatagttactgaccgggaaactgggtcctccaaagggtaagggaaggaagcgtgagtgctgcttccacttgaaggggtttttgttctgtgcagaccttgagtctaatgtgtcttctcattgagctcctttctgtctatcagtggcagtttatggattcgcacgagaagaagagagaattcacagaactagcattattttaccttctgtctttacagaggtatatttagctgtattgtgagacattctggggttcaagctgtcacaccagttagttttccatagagagctactctgtcactggtatcttttcccaaataaacaaggctactttctgtgggatggctccccagcatgtacagttaacttgggacatgtgtagtaggtgctttttataatgggcaatttcatttggtgttctaggtttggttttgtagacttcaacagtgaggaggatgccaaagctgccaaggaggccatggaagacggtgaaattgatggaaataaagttaccttggactgggccaaacctaagggtgaaggtggcttcgggggtcgtggtggaggcagaggcggctttggaggacgaggtggtggtagaggaggccgaggaggatttggtggcagaggccggggaggctttggaggtaaggcacgcagagataatgacaccacatagcatgtgctcttcagaccctgtgccctgtcacggttcctaatcactggggaggaggagctttgtacccattcttttaacagtgtcttgccttcctcctgtagggcgaggaggcttccgaggaggcagaggaggaggaggtgaccacaagccacaaggaaagaagacgaagtttgaatagcttctgtccctctgctttcccttttccatttgaaagaaaggactctggggtttttactgttacctgatcaatgacagagccttctgaggacattccaagacagtatacagtcctgtggtctccttggaaatccgtctagttaacatttcaagggcaataccgtgttggttttgactggatattcatataaactttttaaagagttgagtgatagagctaacccttatctgtaagttttgaatttatattgtttcatcccatgtacaaaaccattttttcctacaaatagtttgggttttgttgttgtttcttttttttgttttgtttttgttttttttttttttgcgttcgtggggttgtaaaagaaaagaaagcagaatgttttatcatggtttttgcttcagcggctttaggacaaattaaaagtcaactctggtgccagacgtgttacttcctaaagagtgtttcccctggaatgtcactggagagcatggcaaagccagctctgccacttgcttcacccatcccaatggaaatggcttagtgcgtgtttccagtatcccagccctaactaacttggttgaaatgctggtgaggggacctgctcctgcagccctggtgctgacttgaaggctgctgcagcttctcctacttttagcaggtctgaggattatgtcctgaagaccactctggaaagaggtgcaggaacagattagtcaggtttcctaggacaaggaagagcttcagggaagagcagtggctaactcctgtaatcccaacacttggggaggccgaggcaggcagatcaactgaggtcaggagttgaagaccagcctggccaacatggtg

SEQ ID NO: 3358 - DNA, 2740 bp, Homo sapiens; identical to SEQ ID NO: 3357

SEQ ID NO: 3359 - DNA, 2740 bp, Homo sapiens; identical to SEQ ID NO: 3357

SEQ ID NO: 3360 - DNA, 1197 bp, Homo sapiens
cccggccccaagtgatctattcttgccatgactgttaactaaacatggtgacaggattgcattttctttacattagatttgaaaaccgatgttggttttgggagattgctgcaatttttaggtgacttctctttcagactctgaagaagaagctatggagactacaccagccaaaggaaagaaagctgcaaaagttgttcctgtgaaagccaagaacgtggctgaggatgaagatgaagaagaggatgatgaggacgaggatgacgacgacgacgaagatgatgaagatgatgatgatgaagatgatgaggaggaggaagaagaggaggaggaaggtacttaaattagattctgacatacgacatgagttatgtttaaaggaggcacttaagtgtttgtggctactgatgtgtgatacattgtttgacatcttgtccagagcctgtcaaagaagcacctggaaaacgaaagaaggaaatggccaaacagaaagcagctcctgaagccaagaaacagaaagtggaaggtaacttgcagaattaggggatatgggggagataaacagcacaaatgatgaataacaaagggacttaatactgaaacctgatgttacattgtagtgtgctgatgtgctgtgtatagaaattttgctttggaaactaactttttaccacactacaagtagactgagttgagctttttttgtgcaggcacagaaccgactacggctttcaatctctttgttggaaacctaaactttaacaaatctgctcctgaattaaaaactggtatcagcgatgtttttgctaaaaatgatcttgctgttgtggatgtcagaattggtatgactaggtaagtgcttcactgcacgttacatacacgtgggtctgttaatgcttttccttcccctgttagcacagttactttagcctgctactgttaaacatgaatactgtaaacatcttcaaggattagcattagtgaactaagttagaattaaactgtagatcccctaagttgcaatttccataatcagtcgtaacttggtatagcacagaataatttttagtaagtttttttgttgtttttgttatgtattgagacggacgctggcttttgctcaggctggagtacagtggcgcaatcttggctcactgcaacctctgcctcccgggttcaagcgattctcctgcctaa

SEQ ID NO: 3361 - DNA, 1197 bp, Homo sapiens; identical to SEQ ID NO: 3360

SEQ ID NO: 3362 - DNA, 1100 bp, Homo sapiens
tgcctccaaaagggccaacgggaactccgcggtccctgaacttccggtgctggcggactcctcgctccagggccaccaggagccgcggcgtgagtgcgtgccgggaccgagcgcggggtctctgaggaactccaaggctgcccaagcctacggacccagccacattggcgaaccggagaccgcccgattccaccacccccgcgctcccctcacagccggcgccaaaaacgccagtcccacgacgcaggccgggacccgcgcgcccacggcccaatcagcgcggaccttgcacaaagcgagccccgcccccacggcgccgttgccagcccctccccctcccgtggccgcctcggcccgcctactccccgccccgcgccgttcacggttagaggctcgcgattggctcatggggacggccgcgagctttggttggtcggcgcggagtcacgagggcgccgtcgtcgcctttccacaggcgattactgggcaggctcagtctttcgcctcagtctcgagctctcgctggccttcgggtgtacgtgctccgggatcttcagcacccgcggccgccatcgccgtcgcttggcttcttctggactcatctgcgccacttgtccgcttcacactccgccgccatcatggtgaagctcgcgaaggtaaacggccttgagcgcgagcgcagacgtgtaggcctgctttccgaggggcgagcgcggcgccgcggggaggagggcctgcgcgcagtcccgggcgcgttctagggcgccatgctgcgggaagtctcgcgcgattagtggggaggtctcgcggcttctggctacttggtggcgaggtgaagagcttctgcaggtgctgggggcggcgaacgcggcgggaaagacagagtcactgagcgcggggagggggcgctgggcctcggggtggagagatgagaccaaacttttgcgacgcgtacgagctgggactcgactcctgacgcacgtgcccgggagcgcggcctgccacgtgggccgcgccgcgtgggtcctggaatctccagagggaccgggtgccttgggccgggaaatggcggtatcggccctagtcggagtcccggctgc

SEQ ID NO: 3363 - DNA, 1188 bp, Homo sapiens
ccttttgaaggacttaaaggagaagaaggaagttgtggaagaggcagaaaatggaagagacgcccctgctaacgggaatgctgtgagtgtctgctttgctcctgagccctggcagctaccgccccacaaaatttttcctgttctactttaaacatacctatatatgtgtgtgtatgtgtatatgtatagctttgcacagtggcagtatcgtagccaatgagctttacccgaggcgcgattattgctagttaaatatttataaaaacctttcgagcagcgcctgaacaagaataggttcagaggagactccggtagtctgagtttgggcttggcccagggtggggaaaagcccttgtcctggggcagttaatgtgcaggtttcatgatggagcctggagggtgttgactggagaagggtctctggggtgggcttggcttggctgggctgtagatgcagccgccagcctctggtgggaggccgggcatcaggagcaacgctctgtccagcctggggccagctggtaatgacatggcctgttttctgtcgaggagaatgaggaaaatggggagcaggaggctgacaatgaggtagacgaagaagaggaagaaggtggggaggaagaggaggaggaagaagaaggtgatggtgagtagccttgtctatcttccccttttcaggtactttttcctggccttgtctggcagaaggggaaggaaggaattggggctcctgggagtgggacaatggtacttggggccagtggaccacatggccctgggcacccacctgtagagtcagggaaggtctccctgacatggagttgtgcccatgcccactcacactcactcgcacacctgaaagtttctttcgtgcagctctgaaagccactgatctattgggctggccttttggggtgcagctgcttgggcctctctcctctggagagtcccacctgtgtagtgggcgtgggtgccctgattgggcccagttgcaggcagtagaggcagggcagggaccttgcagtccactacatgttcctcgggatttccccaggagccacagtaggagggaagtgtggtttacctggcctttgattctctccaggtgaggaagaggatggagatgaagatgaggaagctgagtcagctacgggcaagcgggcagctgaagatgatgaggtgggttct

SEQ ID NO: 3364 - DNA, 1219 bp, Homo sapiens
catgtatatctgcttttctttccccaatatcataacaattataccacctaattttataaaatattttattttaggtgattttcatatctattcttccaggtgaaccagctaataatattgccaagttggagaaaactactattgggactttgattggaattgtacaaaatccataatatagctggtataaattgacattttggtaatattcagtcttaacaaatatggttgtccctgttattttaaattttgtaattttcttcatatagatcctgcatatttattgttataatttcttctgattatcttatactcttattactattgtgaatacattttcccctacatttcattataactgataacatacagggaagttttagattttataaatccatcttttattctgtcactttactcactcctcattatttcaaattgttttttggttgcttctctgggattttcttgtttgactctcatgtttgactctcgtgtcatctacaaattaccattgttttgtggtgtactttccaaatacttatgacacttattcagatttcataacttattgcatgggccagtatttctaaaacactacagtggggaatattggaaaaagaaaacatccacctcaaggagacatactgtgagaatcgctatggaccacctgggaagggcatgggatagcctctgtcacctagttaccacttgataaaaggtaattgttgctgtttgtcatgtccaagaagaagcagtcttcttctagttttagaaagagttctgaaggactgagtatttaatttttatcaaatgcctttttaatatctattgtgatgattatattataccccttatttcatttactggtaaaataattttatatatttatatttggtttatatatgtgaaaccattttgcatgattacaatgaactattcttgatacaatacttttttattgtactctgaaacttatttagggtttttatatatgtattcatagttgaggttgatttacctgattttggttatgttatggttttaagtcatgtatattttacaaaatattctggaggcatttatgtagcataattattatctgatttttgaaatacttaaaaaaagttggtaaagccacttcttctcaatgccatttatacagataattctttaatatttacttcaatttattctttagtgttgaattggtcttgtt

SEQ ID NO: 3365 - DNA, 1243 bp, Homo sapiens
gataccagggctgtcacccggagttcagagctgggtcctagtactagcaggtagtttgcatcccagctggggtagttgagcagaaattgaaccagcctggggaaacattcagtacctggctcagaactgtcaaagcatgaggagggtaggaaacagagcacaaagaacagaacctggagagttggactgactccagtactggcctaataactggcagcgggtaagtgaaaggagccagctttcaaagcagggaagattttgccgtaaaaatgggatggaatttatatggtgggagctttgggttccaggtataaggagggacttagctagttacacagtggactggctgagtgatgaactgccttgactgttgtaaagagagttccgctttggaggaggagttgggatggggcgcatcaacgccccttcccagtcccactccactcctgtgattccatgatgcaccgggcacctgcagaggtcgatgatgattggtaaaaggtctgattgcactgaatgtcacggtccctttgttgccctcaactcccagcagcccattttttccctcccgtcacatttaagtcatgtgtatgggatcatggagcagctgataatttgggattctgtcagtgtgtgtttctgagagtgatcggctcacagctgacgagtatccaacaaaaccagttacacaggagactgacgagtggcagtcatgggtgtgatggtgcatgatctcaagttttcaatctgagacctcctaaggagaaagaaaccataaaaaagaaaaggaaatttcatgggggtaaaaggtttggtcacctgtcatacttttcagcagtgggtcacaagagggaggcaaagtggaaaatgaagttaccaaagtgatgcctgttgcccagcctgttaatagtcactccctccgtgatacttcaagcattttatttttttttagtcccaagcaaatgtaaatatcacatattctcttccccaagtgaccttttagacaagtgattatctacttaacaatctcatattgatagtctatgttttctagtctttcttttccttctctattatagaaatttccaaacatacgcagtatctcttcccccccacacttatgctggagcaatttgaagccaattctaggcattatatttcatccaaaaatattttactgcccataatcttcttaagagagtatagtgaatttttcgattattcccttttcccattctagaat

SEQ ID NO: 3366 - DNA, 1168 bp, Homo sapiens
gtttggagtgcagtggcatgatctgggctccttgcagcctcgaccttctgggctcaagcagtcctctcacctcagcctcccctgtaacagctgagactataagtacccaccacacccagctaattcgaatttttttgtagagatgagggtctcactaatttccccaggctggtctcaaactcctgggctcaagcaatcctcccaccttggcttcccaaagtgctaggattaccagtgtgagccactttgccaacccttgcattttctaattagaaagaaaacatcagtgaataccttctgaacctctggtgttttacacatagaaaaatgttgatcatgcactgcatagaggtcaatgatgaatggtaaaaggtctgagtcctcagatcccctcccggcatcccagttatccccagctgcctctcctccatcgcacttcagaagtgctgcgatgggcagaagggcagctgacactccgtgatgtccctcattctgtgttcctccgtgagctcagggaagacactggttggcatccaacagcttagtcacaaagggatttgattgttgggagtgctggtatctgtggctatgatctgccttgttcaagctgagacctctgattgaaaatcccccaggggttttaattgtttacataaggagtcctgatgtttccttttgtaaattatgcctgtggtgaccttgtctagtctgactttaaatatggaactgactttcagcagcatggcgcaacatcgaggctttaaaaattctttaatttgatataattcagacatagaaaaattacaaaaacagtacagcaggtatctgtggtagagctgatttcaaattcaagattgaggatggggagcacgtgaagcttggtgctagtgatgttgaatttttgtttttaatgttatttttagtgggagttttatccttttggtcttgatacctcacctttggccaacactcaaagataggcttcctatgagatacatggcccctggataagactcagtgaatgaaattgttgcttcttgtcctgtttgggatgtgtgtgtgtgtgtgtgtgtgtgtgtgtgtgacaggatcttgctatcactcaggtggagtacaatggcactatcatagttcactgcaacctcaacctcccaggctcaagcaatcc

SEQ ID NO: 3367 - DNA, 1237 bp, Homo sapiens
cttgtcgcctgctgctgggcgtgatgtcgctggaggtgctggcagggactctgatttggtggtccgcgctgcccctgccctgcctctgtcctggctctgaactagtagatgatggtgccagagggcagggagctcgcctggggagagggctgtgccccgtagggacagtgcccaggtgaaggatgcccctggtcctccagggcactgactttgcccttttttcccgttgatagtcatggctcagaggtgcttgtaaatgtcttgggaagaggtttctgtaacccctgccctggtgtgaggaggaaatggctctggcctggctgcctggccgtggcttctctttggctcccaaagagaaggacagtgttgggagtatctgccgtggcttctctttggctcccaaagagaaggacagtgttgggagtatctgccggcgctgtccaggtcctttagtcagcgtcactccatctgatgtgcagaagctgggctgcacctgcgggggtgggcatagaccgggctgggtctgcagcagcccctggtcctgagcaggcggcagtgaacagcactggcccacctcccactcacagcccctctgtcccctctgcagtgcacccaggtgggcccctctgcgtgcctttgggtgctcccctctcgtggtcgttctggcccgaggcccttagagtatggaggctgagccaggccttgggtttccccagcacagcctcctgtcgctgcatgcgacgtgttgggatttttggatgaaagactctcccacgctctgttggtggacttagctgcctcactggaagtgatgtgggtggaaggtggttgtatgttaccttttccacctctcattgttttccccagaacattgtagatgggggttggcagagggagaaataagccagccacggcagtcgcttggtttcccaggtggaatgggctaacacaggagatgatgggaacctgtcccgcagtccctgcatgaccattggccctgctggcctggcgatgtgggcatcctggggttcttagggtcccagaacaagccccaggcaagctggaacttgggtggggaggggacatgaggaggataaacagctgactgtggcttcaaggacatcagggccaccccaagtcctcagtgtcctactcctggcaaggagttgggtttggatcaaaagtgtttaaaattaatatgttgtcagtgattagaacaacactgtttacataaaaa

SEQ ID NO: 3368 - DNA, 1099 bp, Homo sapiens
caaatttgaactctcagaaatcttttaagttaaatgaaagagacttctttgtcttcagtcacttttctcaggggatgccactgagtgagatgattggcatgttccaggatgagactctgtagacatgacactaatacacctggcaaagccatagacgcaagtcagccattcccatgcatcccttccatggggctcatgctcacttgttggttatgaccttgcctaagtggaggtcttgggttcctgagtatgtcgttaatgaaaccttggattttaatcatttcagacaagtaatggaggtgggagtttaagcgactattcctcctccgttccatcgactcccagcaccagccagaaggaacttcggatcgatgttcctcccactgccaacacgcccacgcccgttcgcaagcagtctaagcgccggtccaacctgttcaccgtgagtgtcaaccctgggtggagatttgaatgcgattccgaagcgttcccattaacgtaaacctggttgccacatggttcagtggtatttgtagaatctcaactatattaaagtgaataacattgatttctgtggaggactaagaaaattaagagaagcaaagatttggatgttgagtagaatgggaatttcttcatgtagacattcctgacttcgtgtgtctgaaatgaagagctgggggtgtgtataaaggcacttgttatcctgtggctccagctaaagatgtgtcacagtggatacaaggagatgacaaaactctaagattcccagatgtgtgtctctaaccgttcagatgatatataagctattactgtccacaggccctcttcttcttctgctggggtgcctggcgctgccctcggggtggaggtgggggactgggaggtgcttcctggaggctcattgccatgaggctctccacttgggttttttgctgtagagcatgttgaaagcagagatgagctatctgggttcaggtttataaattcacaatctgggtgcactcgggcatgcattgttccttttttttttttttttcttttgagacagggtctcactctgttgcccaggctggagtgcagtggctcagtcatggct

SEQ ID NO: 3369 - DNA, 1198 bp, Homo sapiens
tcacagtgggaaaaatccagaaaattgttggaatccagaatgctgtctctcagacattcctagaggacatttctgggttttgtaggaaatgaaaacattttgcatggggcatgtggtccgtgtgtgtgtgtgtgtgtgtgtgtgtgtgtgtgtgtgtgtgtagcaagtgttttttttttctttctctccaaatgatgaacacagagttaaagaaaaggtgttcagacttcgctatctagtatttattctgcacagtgactttaaaacacccctgcagggggaagtcattcacaggaccatgtgtcatttccctgcggttcctttacacccacacatggaggcgggcaattgctatctgcaggggacatagccattgacaccagaagaggagctgggggctggttctgggggggtcccgtgtgtgtcagatgcctagtgtgaccaggccacagcacagcagccaccgctgacagtgactttgtgaatgggcctcttccaggccctctgtctcccagctctccctctgggcatgtgagaaaaactagtatgggtatgggaaatgaaccaaagtcagaagctaatctggcttgtctccacctggacaaacctgttccctgaagtctgtgacaataatgaacattgaagctttagaaagagctgaaactgatcatggctcagaaaatgacgatgattggactggatatcatgtgatcaactttgatgcctccattgagttcagggactttcttcttcccctacttacccaacctcattccctccccatctccttattttatgcaggtgagtgttttagaatctaattgttaccttgatattcctagtctatctcttggttattattatcaatttccccgttctcaagtttcttgtagacccagttaaagcacaaacaagacaatcctggaaagcttaagagatgagtgactttttaaagtttaactttattctaaccaaaaaagcttcacgttcatttaattccccatattctaagttatttggaaatttatactttaaaatgaagtgaactttataatgtagttttacattatatttttagctgtctaacaaggttatttcctatctgtaaacataactcaaataagtactatagattttatagttaatgagggaatggcaggaaacagttttatttaagccttcacaatttttgaagtat

SEQ ID NO: 3370 - DNA, 1197 bp, Homo sapiens
tttgtgaaactgaaagcgttttgataaaattggaaaataagattttcttccctgtcttcccatggccatcctgccagccatcgcctagcgctgtctctatccccagttgatatgaaaggaagtgctgggaagggaggtgcgtggtccctttaaatgatacagaagggctgggcaggcgcagtggctcacgcctgtaatcccagcactttggaagaccaaggtgggcgtatcacttgagttcaggagttggccagcctggccaacatggtgaaaccccgtctctactaaaaatacaaaaattagctggatgtggtggctcgtgcctgtgatcccagctacccaggaggctgaggcaggagaatgggttgaacctgggaggcggaggttgcagtgagctgagattgtgccactgcactccagcctgggcaacagagtgagactccgtctcaaaaaaataaataaataaataaataaataaataaataaataaaaataaaaataaatgaataaataaataaatgatatggaagggggaagggaagtgctgggtagaggagggagtggtccttggctagggctccatccccaggcctgtgcccccgggcttagatgaggactggcaattttgttttcctgtccaaatgttgcatttcccaagacccccctggctgccacacccccatcttgtgcctataaaaaccctgagaccctagcaggcagacacgcaagcagctgcacgtcgagaggaacacatcagcagaacacacgagtggctggacatcaacagcacaccgacaggcaccggcagaacgacacagagtttggctggagcagtcagagaaggggtgggccaccaagtgtccctattccgggggaaaaccatctcccttctggctcccccatctgctgagaactactgccactccataaaaccttgcacccattctccaagcccacgtgtgatccaattcttccagtacaccaaggcaagaaccccaggatacagaaagcccactgtccttgcgataaggcatgggtctaattgagctgactaacacgagatccctatggatggctaaactaaaagagcaccctgtaacacacgcccactggggcttcagctgtaaacattcacccctagtcactgccgtcgggttggagccccacagcctgccctgtctctatgctcccctagag

SEQ ID NO: 3371 - DNA, 1224 bp, Homo sapiens
ggtgcggagccctagcgtcactgacgaccgggacagccgagcagctgcaggatccgtcgtgttccccagcaattttaatatttaaaaattcgttactgttgctgttacttgttttctatgtattggatgtcttcgtgaagaaccctcaaaagtgcaacgaactcctccctgccagagggcggccgcgcgctctgagtacagcttcccgcggagccggccaggtcctccagggcaccgagaaagccggccagaacggcggcgccctatcccggccgcagcgatgtctgacggcgccccggaactgacggtctggtacgcaggggcgctcggcggcaacggcggctttaaacgtcatcgcgggcgcgacgcctgagggacagtctggggtttggctgtccggacggtgcagcggcgaggccggccgcgaagatgccagtggcggtgatggcggaaagcgcctttagtttcaaaaagttgctggatcagtgcgagaaccaggagctcgaggtaaccctttgcgtcgcgctgggagaaactgcggagtagtcttaggccctggggcggcaccagtttccagggtaacggggtctgaggctagcgggctttgggagctcacggggcgggcgtgggaggtggacgtgtggatccctgaccgccgcaacctgctccgaccgggcccggtctccccgaactcgccgggacctttttgttatgtgtcttcagcttgtgagcccgaaaaccctgtgcgtctttgctccagcacctaccgatgagctcatattaattaggcatctttccttcccagtatcgggttgggagagggtagtaaagtgggttttattaaagatcttggtatacacacacacactaacacacacaccgcaactcacacgcacaccaagaaaaatgtgaccattgtaacctttttttaactcacaaagcctttctcgtaatgttgtcaagttagcttgccattttgtcttcagtaagacagatgaaagttatgcagctgttaaagttaatgtttttcttagacacttaaaaagggtttatatcattagttttaaaattaaataaaggagacaacatccagaagcagcagctcactaatagataatagatactttccagttgagttaaaatggaaagaattgtctttgcaacgcagctgtggtgattttctgtctcttattcaggacgcttgatgtaatgggcagaatcaga

SEQ ID NO: 3372 - DNA, 1311 bp, Homo sapiens
ccttctgtcccccaatatgtgaattttgactcagtatatgatcagctgtgaacaccaaagcatcggtgggtttaacaccttgaaaaaggctttgggcattttcttaattcaagagattttgctgttgcagagggcacttagtcattaagaaaacttcatttccaactcattttcgataagctgagttacttgctctaaaataaaagatggcaataaatatctcatctttggatatgaacgattcacccaagttcagcctgcatctgactcacttcagtccatttaagagaaataacccacatccaaagggttaaacatcagaatgagagctgactcattcaaacagggccacatgtgaactcgccctgagccctgtgtgcccgtgatttgctgcccgagggctcttgtactcacccaccctcagaaccttcctggaaattgtgctctgtagacatctattgctgcccagtacgtggtgcgtttaattttatttaaatataataatggaaaggtatcagtgtagaatgtagtattgatgactcttcctaatatcaattaaaatttatttcaatatttaatatcaactaaaattaaatatttttttctgtgcgtgaactcaaaagtcctaatttggccccatctcctagttttgtcagttgcctggcccagccgtctttatttccttctgaccctcgttctctccctcccccgtgagtgcatgcctgttactgttttggttgtataaggtaatcgtctctgaactcactggactgatgtacctttgcgatgccgtgagggtgtgagcctctctctcctctctgctgcccatttgctctgattacagggactctccggctccagccttgggcttgccggtggtggcctggctcccacacccctgtctgccccaaatggaagctgggtctgtctccttttcacatcactttgtcgctccttccctttccttctgtgcatcactttaattgctgattacatttagtggatagttcagcctcctctacacaaagtcacaagagcaaagcttagcaactgttttaattggcttgactagtttgctaagacttttgtcaatcttttagaaaaaccatgtcaaataagttagaacctatatagaaaaggagacttaaggaaaaggagggttttattaaatgcatattttcaaaaactcgagtccaaaaaattggtctcttgggtctctcctccttttccagcaattgttccccatttggggtttcatttgtttttttaaaaatattttttctcttgtaaatgtgtccaggaagcaatttg

SEQ ID NO: 3373 - DNA, 1264 bp, Homo sapiens
ttgctgtaacaaacagtgctgcacttaataaataacctttatacacactattttgtttcactgtgaatgtagctgtaggaaaaagtccaagaactagaattgctgggtcacggggctcatttggtagatgtgataaatggcccacagtagaggttgtaccaatttatactcccaccaatagtgggtggctggacaaaatactctttatggcagatttataaaatttaaaaattcataatattctatgcatataaccacactgcacttataccaatacatttatataaattcttaaaaattaataatattgcttaactataaaacagacataattgactggaatctcatgtttttgaatgttggaaaaccccaaatctttcaaaaggtcccactcaggaagttgaatttctttgaagcttttttgatgttagccacaaaagaaattaagtaacagaaattgttgctctgacccttacctcagcacagtttttgtaaatgctttttttgctgtatctctgcagtcaaataatttagtaatccattctgtggtgaaacatttccacgcaaaccagacctcaaagggacacacaggtgggcaccacagcccagtgaagggggccaagccccatttcattacttcctcggtggaacacgactccatccggctgcccctggagcacctggtggaagaacaagtggcaggtgagtgagtgcagggtggccctgggaccagcctgctgagctccagctgcgaggcgggaagtggcctgcgagcagagcccgggatccgctgcagagatgtagattcagtgtgccactcactgtaactcactggttctgatgaggaggcaggccctggcaccttggtgaatagttgcccctcactgcactgggctccctggctgcccctctcggtgcagaggccagctgccacaagggggttggcaagtgtggccaaactttcccttaggaagttcattgagaatgaatatgtagaactagccatttgtataactgagtgatatttgaaacttgcatgtaataaatatttaacctttaaatagtacgcctgcaaataggcaaatgatgcttgtcattatttggttttcatcataaaatctcagctcccactctcctctcacatgaaggaaaaggatcaaatagacctaaacttcaggtgtgaagcctggaataagcgagctgccgcacctgatctcagcacccatgacgcgaggcctcctgctatgtgtggagaagcggagtg

SEQ ID NO: 3374 - DNA, 1264 bp, Homo sapiens; identical to SEQ ID NO: 3373

SEQ ID NO: 3375 - DNA, 1176 bp, Homo sapiens
tgcctctcacatcacagatcagttttcattttctagaaatgtctgtaacaagaaacgcagtatgaacactttttcctttttttaatttttaaagtcatcatatagtcatatagattttttcattttagcttgcagttccatgcatgtaaacacatgatcagttacaatcaccacaacaggtccagggctccacctgcccccaaatcctttgtgttatttcttttctttttttctttttctttcttcttcttctttttttttttgggtgaaatctcgctctgtcgcccaggctggagtgcagtggtgcgatctcggctcaccgcaagctccacctcccaggttcaagcgattctgctgcctcagcctcccgagtagctgggataacaggcacccgccacgatgcccagctaattttttgtatttttagtagagacggggtttcaccatcttggccaggctggttttgaactcatgacctcaaatgatccacccacctcggcctgccaaagtgctgggattacaggagtgagccaccgcgcccagcctcagctatttctttatggtcacacactacctcccccccccgccccccgccgatctgttctcctccaccatagttttaattattgaaaatgagaatggcacatacatggaatcacacaatcggcagcctttgtgaccagtttctttcaccaacacctgccttggagagttgttcacaagctcgtatgcattgatagtgtggtcctcgtgtggccgatagagttgcactgtggatatatcaagcgtgtgggtctttcgcctgctgaggggcgtctgggctatgccagcgtttgaagttgggaatacgctcagactttgtgactttaccttgcagggcgctgggcatctcagtcttcctataaatattcttgagctctgttctggaagggcttaaactgcaaagaaagtttagtccttttgtttctttgctagttgggacctgagcagaatcgaatctagggctactcttgccccttcctggggcaaaaaagcccttctgagtgcttacccagtgcccacgagggtggcatccactcagccggcgggagtaggagctgcgcctcccctgtgtgcctggacgttgccttttccagttctcagggatttcctcacacacatgctctgatgggctct

SEQ ID NO: 3376 - DNA, 1280 bp, Homo sapiens
gcccttaggccatatgggaggacatagggagggcaggcagagcttgggacagacagcgagggtggaagttggtaggggcaactgtgtcattgatcttcttatccaattgccataccttcttagtgagttatttgttctggcaagattccattaggttcgaggcgtgtgtaagtttcgctgggaaccagcgggtgagttgcagcctgcactgcaaatcccaatgtcagtggactgggaagagcacgatccatatccgcggcagtggtggctgtggtttgttatgggtaaaagtgaaatagttgtattaaatcagaactccaagctatgccttcaacatgtagatgagttgaaatctaaatctttttgcattactataattgtctgagttgatatgagcaaattgcctgaagcacccactgaaagtctgagtagatccccttgcttgctttcttactctacttggcattttcttttaagtaaattttttggattgttttggaagtggttttattcagtgtgaggatttggggaaaacacataaaaccataaagatatctctcagaggcacctgcggttaataatctgtgttcacctccttctgtctttgtacacgtgtgtgagtgtgtgtgctgtttctccctttgtccttgtatacttgtgtgagtgcgcgtgctgtttctcccttatctgtccttgtacacgtgtgtgagtgtgtgctgtttctccctttctgtccttgtacacttgtgtgtgtgtgctgtttctccctttctgtccttgtacacgtgtgtgagtgtgtgtgctgtgtctccctttctgtccttgtacacgtgtgtgagtgtgtgtgctgtgtctccctttctgtccttgtacacgtgtgtgagtgcatgtgctgtttctccctctttgagtggggctctgcggatttgctgcttccctggcatcaacgctgtagctggtgctttgcttgctgctcttgtgtaggccagaaaacccacacttggtgttcgttccctgtctctgcttttgtgagtggccaggtcctgttgcgtctgtttcacaagtggcttcgcttcttcctgttgacctccaggctgccatcattcccacctgagcttgttcggcggcttcctcttggtctccttgggtttagtctctgccctcagtccttctccagtaaggcagaagcagccgtgatctcaatgcagaacccaccatctcagtcctgtgcctgaagtccttcctttcctgtaggaggtgtgttaaagtctgccactctt

SEQ ID NO: 3377 - DNA, 1216 bp, Homo sapiens
ggccttggtggggactgcaggtgaccatggcccttctcaggcggtgcttccgctgctcccagtagccgggatgtccttgcgtgtttgacctggttctgttctccacagattgaccgactcatcagtcacggggccgacatcctgaagcctgtaatgctcaggcagggagaaaaggaggcagtgggcacagccgtggactatggctacttcagattcttccaggtaggtggtgagcctcccatgaggaaggagggggagtgtgggtcacgtgcagggcccccggctggggcattagcttctctggggcaaagctgggctcaaggttcctagcgccgcccccagagcagccccttggctgcagaggtgaaccccccaaagtgctgagctcatgccaggtgcagctgtatgtgctcccagctttgtgtgtctgtctgggttcgtcctcagttatatatcacaagagctgacaggagccctcgatcaccgagagtcaccccagcagtgaggggcgggcccgggaccctgtggtgaccctggtgctgtgccgcaggaccggaggattgcccgctgccccttccacacgctgatgccagcagagcgcgagacgttcctggcgcggaagcggctcctggagtacatgggcttgcagctacggcaggctgtctttgccaaggagagccagtgggaccccacgtggctgtacctgtgcaagagaggtgagcagtgggccctgctctgctctgctccacagggcggcgttccggcctcgtgcctggggctgttatccctggagatctggaccccctggggctcttggaggggccttcctggggctgggctcgtcggcttgtcccctttgtgtcccgtcgtccaaggagctcgtccaggagagactgagaagtggggtctggactggggagatgtccctgggaagaggagttggtggcctagggccagggcccaggtcagaggggccccacgcccaggagagaactaggcactgctgcgggagccctgtcaggagtgccagtctatccggcacagggactgtgggcccgaggcctggggtgctgctcccctgcatggtcacacccctccctacagggtgcatcctgcacacccctacatgtccccagctccccacatgcacccactccacaaacgcagtacctactgacatctactcccccatgtacccacacccacgtactcaacc

SEQ ID NO: 3378 - DNA, 1099 bp, Homo sapiens
ttaaggcatttgccttcgttttccaacctctccttcacttctaagcacctgggtgcggacaggccacattttgtgagcttagcagccatgtatagggccatgcagcctgaggtgtggcctggtcaggtgcaggcttctgtccgatgccttcacaggggtgttcttttctctttgagggtttggggaaagctgccctggtcttttcagcctagctgctttgaagacagctctaggccacgggcattggtccttgctgaagaaggtcctagaatgaggttatcactccaatttattctaatgacacttttttggttctttccaaaggaacctccaaaattcccagttgttccaatcctttcatcatcatttatggacacaaacctggagtctctgtactatgaggtgaacgtgccttcccagggtagctatgagctgaggccaccgccagcaccactgctcctgccacgcgtctcaggcagccacgagggcggccacttccaggacaccgggcagtgtggggggtccatagaccacaggagcagctctctgaagggggactccccgttggtgaagggcagccttggccatgtggaaagcgggcttgaggacgtgttgggaaacacagaccggggcagtctgtgcagtgctgagacgaaatttgagtccaacgtgtgtgtgtgcgacttctccatcgagctctcgcaggccatgctggagagaagcgcccagtcccacagcttgctgaagatggcctcgccctcaccgtgcaccagcagcttcgacaaagggaccatgcggaggatggcgctgtccatgatcgagtaggtcctggcaccagctggtgggggtggagggccaccatcagggctgaatcctatgctcagcagacccacgtctcttccctgtgccagtgggaggcgttgtgtctggagatgtgtgtctgaatgtgtgagcatccctgtgtcggtggctccacgccatggccagccctgtgggggtgccacggtgacgggctgttttcagtgccaccccagccctgtgggggtgccacggtgacgggctgttttcagtaccacgccagccctgctttggcctttgg

SEQ ID NO: 3379 - DNA, 1132 bp, Homo sapiens
tggctttgcaccctgtgggcccaaagagcaactttccatggagatgatcctaaaggctgaggaagggaaccacgaatggatttgtaggatcctgaaggacaactttgctagtgctgacgtggcggacgcaaagggctacactgtgcttgctgcggctgctgtaagccccacaccctcccagctggtgcccgcaggagcttagctgtgagggtcacacatgtgggtggccctctgtggccccctctgcaggagcagagctgaggtacatggggacactgattgtccacacctccacctcgccgttcagcagaaacccactcagctgagtgtgacactcgtggtccagtgcagaagggtttggggcagagtgcctgttccattcctctgtcccacacttgtccctttgccaagctcccgaatgagcactggttcctgccctgccatagggtggcctcatgagggcatcaggacacccagtgacccttcccacccctgagggccaggtgcatcatcctgagtcctgcctcatctccctccagactcactgccacaacgacattgtcaaccttctcctggactgtggggccgacgtgaacaagtgctcagatgagggtctcacggcactcagcatgtgtttcctcctccactaccccgcccagtccttcaagcccaatgttgctgaacggaccatacctgagccccaggtaagccccccggtggccactgcaccaccaactgtctcctgtagtcttctctgtctctgtaaatgtccaccaagcctcctccctcctgtgtggaccaggcttgtacagggtgagttataaggcagggagtgggcaagagagacagagcctgggcatcccctaagggaccctgagcagatgccaaggtatgtgtgttctttactcatctcctgcatagcagcctggggccccgagacctgccctgccagcactgtgcaggaaaggggtgctgtggagggagagtgggcatccatgacaatgcccccaaggtggggctgagaatctgcatgcctaaccgtttcctggcagtaccgatgttattgaaacaccaggggttcggtctcagtcctgctgctcaccacacagaaagccaatcactgagatgccaa

SEQ ID NO: 3380 - DNA, 1199 bp, Homo sapiens
ggtgaggaggcgagtccagtgtccaggcctggcagcccctcctcagagaaggggctgtatgtgactcaagagggccaagggcatccgagcagatggccctgggctgggctccctaccccaaggctggccccctcagtctgagcctgcgctttcctcaggtcccagagggtggaaggagccaggacgcacccccactgctgctgcaggagccgctgctgagctgcgtgccacatcgctacgcccaggaggtgagccggctctgcctcctgcctgcgggcacctacaaggttgtgccctccacctacctgccggacacagagggggccttcacagtgaccatcgcaaccaggattgacaggtggggctctgggacttgggggcggccagctggaggctggggtgctggagtcttagtgctcgcctgtccccccacgtctcctgcctgcccctcaccctcaagcccctatctgtcctggcagaccagggctgtcctgcctacctggggacccttccttgctggtctgagcctggaaggagagtctagtgggaggtgggccaggagcacacagccacttgtgtgacaagtgcagtctgggagcgctgatctggtgtctctccacaggccatccattcacagccaggagatgctgggccagttcctccaagaggtgtgtatgcagccccgccagcccggctcacctgcctggggctgcctggtggcctagggtctacctgcaacctcaggcaggtggtttctgcctgggacgtgaggtgcccttgactcttcctgtgagagccccgggcggtgccttgaagggcagggggagctgaggctgcgtcccattccctggctgcactcggggtggggtgtgagaaggggcgagtgccaccgctgcccgggccccccatctgtctttgcaggtctccatcatggcagtgatgaaaacctaacagggtggccccctgtgccagctcaggtgactggagcccgagggcctgacaggttcccagcagctgggccggccagccttgcactgtgggggctggtcctgagtcttggcctgcctcccagccctgccaggaggctgcggcctaggggtccacgggaagcctccgtcaggagagacgcagccctgggggccagctggtgctgcaaggaagggtgggaagcttgctggcttctgttgcgccactgagac

SEQ ID NO: 3381 - DNA, 2237 bp, Homo sapiens
tttgttcttgtcccatttcaccccctctgcagacaccaatgtccgagggccacccaggacaggacgggggtcagccccaagctgagagtctggtcataggagtcatgtccagaggcctagggaggttttagggccctccccacccacacccacaggtcgatttggtctctttttagctcaaggaaagacagtagccaagcaacagagcccctctcccgccgtggcccgtgggagcagttacatcgggtctggtgctccagacctagggcccagcactttcatcagatcctgcctcctggagtgggggaaacgcagcaccccactggttctgaggcccctaccctcccaggctgtcccacgtgatgctgacatgagcctcagagaccccaatcccatgcctgggggagagacagcggctcaggagtgggggagcacgggccttctacaccacatgggaaggctctggcatgaggttttcctttgggaaggttgtttgggcccctgaagttccatctccgagagtggtgtgcagggcaggccagggcccatgctggctgcagtctctgtggctgcctgcctgggccagcctgtttgggagctgggactgtgggctcgccttttcgtacctgggctcaggtgcggtgtggccaccgccaccctcatcccctgcctgggaggctctcccaggggctgatgggggggttctgtgagggagaatcagggctcgggaagccacgcctgggaaggcaggacacaggacacagcagctttctttggaaatctcccaggtgaggattcacatcccaaaataaaattcagaagccaggtggcctgtgctccccatgggtgacctctggaggcagtggaccaagatgcagcaaggagaggatgcagaacagcttcttgcagaagcacctgctccggcatccagcgctgcctggaggcaggaaggagaggcagggcaggacacgctggtctgagatgagggggagccccacgggccccaggcaggctagaggaggcacaggccctgccacggccaactcaggtcagccagcctgaggctgtggcctccaaagggtctgggcgcaccccccaggtcgcaggtgtctgaggccagccaacctgcagagcactcgcggcgtgggtgggctgagtggaggtgcctgggagctgcctaaattcagaagcctccactgccatggagactgcctggctgtgtcctctcagccaggtgccgtgttggccttggctaggacccagagccacactgcagcctccgccgactccctccttccgggcctgctctagtgaggagtgcctaagccaggacccagaaactcagagttgatggtgagaggaggccgcctgagtcaggacacctggcttcttgaaaagttcgctctgccagaaaccacctagggaccacgttagctgccttccttgagctccccaggagtcggtttccacatctgtgaggtggagggctggtgtggaggtgctcatggggtgcggtgcttgggagacagccaggcccagggtggctgctgcttcctgctaagtgggggaggtgagacagatctggaaagccgtctccctcagatggtttcatttaatgctttatactgccgagtctgggggcttgttttggtttgggggcagccatcctccaccagaaagggggagctccttccgctgcggctccagatagatggggatgccgggctccaggccgaccagcacttgggatctgatgggacacggccagtgcctaggggtgccaagtccaaggcctcccactgggagtcatcgctgagaagatgccaatgtttcatccaccggctgcacaggcacaaactcccccacccaggacggctgtgatgaggtggccctccctgtcaaccctggtccctggagtccccagcacctggggccctggtggggctgatgtcacaggtgtttactgtgctgctgcactggtcctatgccagcctcacccatgtggggaccacggaaggcacactcccttacccccggtgccgggccgtgcggtcccccagacggacagcagctgtggcgacctgcgtttctccctgggcctgtgcttcctgtagttagtccgtcccctggttcccctgtggctcagaggccgcgtccctggcttgtacatatgtgattgctgtgggcacaccccagaccccatgtcatagctgccgtcccgacgtcacgacgcctgt

SEQ ID NO: 3382 - DNA, 1225 bp, Homo sapiens
tgtgtgatgggtctcagagaagggagtggtagacagaggtgggtgaaggatgtgaggacagaggctgtttgtcaggagctggacacgagtggagggtcagtgggagctgagggacaggtcctctcgggccaggcctgggtgctggtgaaatgtgcttggacaggtgtagtaggctgtggccaaggtgtggtgtaggcaatgggcctggcagcatggcagagcggccccgtgagggttgtggggcttttgaacaagggtatgtgcggctgccctgttggttcttggggtcttgaccactgtcctcctcatgagctgtgccgagtgtacatggccatgtgcctttcctagccggggcacagagaacgtgagcgtccatgtgacgtgctaaggccacagagtgcccaggacccggtgtatcttgggaatggctggggttggctggttgtttcccttgaggagggggaggtgcccttgctgcctctgagtccctttggccccggcatctcctccttgagtgtgcccttggcacgtgataggtcaggtctcccatccatgcatgcctccctcctgtccctacagtgcccgccaccaagctcagcacactgacgcggccctgtccgggaccctgccactgcaagtacgacctgctggtctacttcgagatctgtgagctggaggccaacggcgagtgagtgctggtgctggggcccccagggcgtgagtgtgtgtcggggggtgcgcggagagggacgaggacttgagctgcctgagggttgccagcatccagagtcgttcttccagcgggtgttcactgcagacctcttgtgggcccggcctcatctaggtcttggggagtaaaagcagacaaagtcctggaggagctggcatgaggggcagggaggtgctggacagataagcacctgaattagtgtccccatggtcctgagcactaggacagcaaaccagggtatggctcaggggcagggcagggaggcagacagcacttacaaagtgatcaagggacttttgagggaggtgggaggggagccctgaggccctggggaggcaggttccagggccccagggtggaggccagtgggggtctgcctggtgccctgggggcagctgggagctgggctgtggctggcagctcagagtggggcctggtggagactcggatccttgcccagagtgggacaggagccttagatgttggagaagacga

SEQ ID NO: 3383 - DNA, 1136 bp, Homo sapiens
cctgcaggcagcgtctggacctgatgcgggagatgtacgaccgcgctgcagaggtgccctccagtgtcatcgaggactgtgacaacgtggtgaccggcggagaccccttctatgaccgcttcccctggttccggctggtgggcaggtgggcgcctcctcccttccttggcagagagagagattgagagagagagatggcagtgggggtaggagtgggccctggcctgatacaaggagcggccctgacaagtgcttttccagccccatattcccagccctgtcctccctggcctgaggttcctcccagccattcctctccacacaccacagggcctgttatttcaggggacgtgggatggggtcttggcactgccacccaaacccactgcagggctgtagccgccagaacccatgggtccatgtgtatgaatatgtgaggctcccaagcaaactttccaggtcacctgttggtcctgagggtgggaacatggaggcagggctgtgtcacctgagccttacaaatggctgcctccttccccggtctccagtctggggtctgcacccagcccccttcaccccatgggaccgtggtattctgaggcctcaacgtggccaaactctcgaggtcctcatatggcctcagccactcccagccgagacccctgttctcagtcccacctgcaggtgtcctccggaaccttccggaaccttcctgctggccatacatgtgatttctttccaagcctgggggcacagttttggttctctcatcttttaaagcagcattctcgatggtctgtgtgtttggttttggttttaaacagaagccccccagccccggccccggcccctgttcgtccctgcgagtcgctggtgttaacttctctctgtcttgtcgcactaacctcagttcagccatctctggctgcaacagctaccctcttctcaacacatgcatgagcgagcgcatggctgctctcaccccctcccccaccttctcgagccccgactccgacgccaccgagcctgccgaggagcagagcgtgggggaggaggaggaggaggaggaggaggaggaggatgaggaggaggaggacctggaggacgacgtctttccggagcacgcgctgtgcgac

SEQ ID NO: 3384 - DNA, 1186 bp, Homo sapiens
gtgggccttggagccctgaggcgccctggcacgtccaccggcctgaggcccagccaggagcttcaggggacaaggtggcacttgtgtttccagaggcaggcgaggtgcaggggtgagcaggcgggcgggatgctgggggtgctgggcagactgaccctgtcttcctgtcttctgcctgcagctagctgacgtggtggacagtgaggcgctgcaggtatacatgaaacccccagcacacgaagaggccaaggcaccttccagaggctttgtggtgcgggacgcaccctggaccgccagcagcagtgagaaggtcagatgcgggcttctgccctcctgggtcccagggagggtgggcgggcaggcgggcttggtgtcctgagggtggcaactgcgtcggaagctgcttgcgagttggggagcatcccctcctgaagccgtgtcctctctctgcacaggctcctgacatgagcagctctgaggaatttcccagctttggggctcaggtggctcccaagaccctcccttggggccccaaacgataatgatcaaaaagaacagaaccctctccagcctgctgacccaaacccaaccacacaatggtttgtctcaatctgacccagcggctggaccctccgtaaattgttgacgctcttcccccttcccgaggtcccgcagggagcctagcgcctggctgtgtgtgcggccgctcctccaggcctggccgtgcccgctcaggacctgctccactgtttaacactaaaccaaggtcatgagcattcgtgctaagataacagactccagctcctggtccacccggcatgtcagtcagcactctggccttcatcacgagagctccgcagccgtggctaggattccacttcctgtgtcatgacctcaggaaataaacgtccttgactttataaaagccaaacgtttgccctcttcctttcccacctccctcctgccagtttcccttggtccagacagtcctgtttgtggagtgcaatcagcctcctccagctgccagagcgcctcagcacaggtgtcagggtgcaaggaagacctggcaatggacagcaggaggcaggttcctggagctggggggtgacctgagaggcagagggtgacgggttctcaggcagtcctgattttacctgccgtggggtctgaaagcaccaagggtccc

SEQ ID NO: 3385 - DNA, 1179 bp, Homo sapiens
agagaaatgtccacctgaccccaagaggcccaggtgacaggtgaatgagagcccttgggagcctcagagaggcccgggtgacaggtgaatgagctacacctggaggcgccactgatcaaggacccagctggagctcctgctcattttctggaaggagacgcaggagaaaatgctccaggccccagatgatacatagtgccagagacctcacccatctggcaagtaccgagacacagcccaaacctcaagccagaattaggtcctgagagacttgccactctcaacttggccctcgaacccccatctaggcacatctggttactgctcccaagtcacaggaaaggtcaacaagcacctctgcccccgacacgctccaaccgaggctctcacctggttcccatcgtccttatcaggaaactggatgttcacgtcatgctccaaccggatttgggtaattactgccccctttctcccgataatcttgggatggtatttggggtctacagtgacactcagcttaaaactccttaaagcctacaaatgaaaggagcaagaatgaggcaaagattgagctgatccaccctgtgactccattccccttccaccctggtcataggacactggagatgctgcagtgttctgtaacccgtggtccggaatggtccgccatctctctggtccgacctctgccaccttccattatctgctaataatgagaaccagggaacttggctgctccacaaggaggtctataaatccttcaaaagagggcttgggaccacttgcgaggatcgtgctcaggaactgacagagctaggcagtgagtcacgagcttggggccccgctctcctcatttgtcaaacagggatctgatggatacgcacagaaatgctctggatctttttaggactggggcagatgcagaccaagaagagggggcagccacagcccctgaacacccatggccaaaggctacaggtatgacctggctgcaggagacaacccagagtccacgcaggggtacactgacaccatgtgaggttcacgagctccaccccattcaccagactcgacgtgctcacgggaggagtggaaagccaacccccttagcaaaccagcaccccagcacagtctgctccaagttccagaacccctgctcctgtctgcagcactctgctc

SEQ ID NO: 3386 - DNA, 1187 bp, Homo sapiens
gaagtgtttcctctaagcgggggaaacctaggaaggcttcctgaacgaggggtatttgcgccaagccttgacgtgagtctcgaacagttgcagtgcctccaggccacgcgggagggaggaaaggacaccccgggccggggcacaacccgcgggccggagccgcccgcgcccatcccgctcaggccgcagccaggcacggcaccctcccgtccccgagccacgtcgctgctcgtgggctcgcggagcactccccaggtctcacctcgggccccacaccagaaggagaaagctaggggccgcgccagctccgccctcccccgcggggcggcgggccccagcccgggcacaggaaggccacgtccccggggagggacgcccgactcgatggtctgcgcagggcccgtcggccccacgtgacgtgcgcgcagccaatcccagagaggccccccgatcatcgagacggcggcggtggtgggctagacgagtttcgcgcggccgctcgccgtcccccgcccagtcgtactcggcgccccagctcggtgctgccgccatcttcttggaggacaggaggagaggcgaaggctccccctccccgtgatcgctccgcactcccgccaccacctgccctcccgcgaccgcctctctcctcctcagtgggcacttgtctccttctaacaaacggccttccccccactccagttacccaccgcaaggcgaagattctcattacctgttccactcttataagcataagaaaaccgagctcataaggtaggaactgtggcgaaacagggacaagccgccatcttggtaaaggagaagaggctacgcttgacctccccccccacccccagcctctatatggccaactgccgtgggaggagcacggcgcttgcgcagaggcggacaacgcggacgactctgggcttgcgcactcggaagccggccgcatgggggaggggaagaaggccaggtcgcactgagccaggaagcagttggcaaaggggcggggtgacgcggtgacgcaatccgcctgcgcgctgggcggggcggggcgggctggggcgggctgtgagcggaccgcgagcgctgggcgggtccgcggcgcggtcggtcggcgcctgttctcgggctgtttggcgggtgagtgtctcgccggtgtaccccgcacaagttgtgggccggcc

SEQ ID NO: 3387 - DNA, 1855 bp, Homo sapiens
gccctatctacaagaacctcttgcctcctgccagcctctactagcttcttgccttcaccagcctttcttctagtcagacacttactggtagctgttatctgccctccccatgatcctgttcactcaggcttcctgtcatccacctgcaattgctctctcatgggcttggccaacagttcagttctcagatgtgggccccacctgtggggtttgtgtgattggcaattctacttctgaaacttcccttccttggctgctgaaccactgtgtttgcttttctatctgctgttttttaccaccttccttcctgatccctgaaggtcagtattccttagtattattttgatcacattatttctgtggcttctgatttgcccttccaggtatcttatttcttgttgtgaaccacatttacccacaggagtcctcttttgaccactgatggactcctgtccttccagctcccctgtctctttaaatggtcccacaattcttgaaatcatccagactgagaaatgtgtaaattattttttactcatcacttctgactcctctgctcacttttaaatagcttactaactgtttccgaactcttctctcctccaaagtgtaagctccatctttatgaggccagcataggacaaaagatgaggttagcatggatggatagtagaccaggaaaggggccgtaagatgaggacaggtgagcaagttcatgcttcttattgctcagtttctcccagagataagatggttcctcccatttaggaataaggatttatgaaaagactgaaggtcgagttacagagtaaaggatgtagagaggagggccttttctggagttctgaattagtgcagacattgtactaagaccaaatctctgaccattcaaggccctttttaggtcacattaaggctttccattcttaaaaaccagaaagcaaatccagtgcacagtttgaggtcgggatattttctgctcacgttgctcttgttctctcttccctgaatggctcaggtactgaggtgagaccaaacaaaactgtggcctgcctggtgcctgtgagaatgcccaccatgcaatgagcatttgagtgctagggttttaattgattgactgatgaatgcattcgtatttcaacttcagcccagttctttctcccctcaagccccatcccccacactactgcctgcttgataggtccgattgtgggatttcactgctgactgctggctgcctgttgaatgaaatacagatccccaggtcgctagcctggtgttgatggaactctccactttgtaattccaatttttgtttccttatccaactggatgtcttagattccaaccttttgaatttcttattctcaaaatgcaccccatgtgtcctctctgtgcctttgacgaggttttgtttttttttctttctttcttcctttttttccatctggggtacttctcccttctctctgcttttaagactcctgcctgttctccagggtcttctcatgcctgtagcttctctgtggcaattacccttcttgaggctgattgtggtgtgatttccattttagctgttgtgctggggctatcgttagtcttcctgctgctttgtacattgagggtagtggtgcattattgctaatgttatttttattctgtacagaggatcctcaaaattcaagtataaatacctttctagcagttttgtaaattttttttttttttttttttttttgagacggagtcttgctccgtcacccaggctgaagtgcagtggtctcagctcactgcaagctccgcctcccgggttcacgccattctcctgcctcagcctccccagcagctgggacta

SEQ ID NO: 3388 - DNA, 1189 bp, Homo sapiens
tcagcgatgcagctcatttgaagcaggaagcagtgacaggtgtttgcttattttctctgagcttcattttcaacctttatggaatgaaaattttacttttagatcgataaaattttatttctgtatactttctagttttgcagcatttccagtttccaggagcctcatgaatggctttttggtttagttaactttgtggtcatgtaagccctgccttttgctcagtttatgacctttgttaaggagaaaagtagaactgttaataattaacgcagcagacattgcctcactcccacttaagtgtgttttgttttcttttttctagaaaacactttcctggataaaaaagaaaacattccagatgcatgatccagctgtgtgttttcaatccttgggagggtgccatccacattttaacagtacctgtgcctgagaatttaatttttaaaagactttgatgtgtttttgtatgaagtacttttaacgtatgtatttcattgctgtgtcacactctgtgttttgtgaggtgaatgtcttccttttctttctccctaaccactaatgttagaattgatttccaagaatcggcatgtatacttaatactgaatttctttgatttaactgacttaacaactgactaaccattgatgagcactcctgatttttatctagaacattcagatttaccataatgttccttagtggtagaggtgtgtgcctagtgatgtagaaagatacactgacttggtgcaaggccatctgcttaccacatcacaccacttggagatctttgcttccttgcttttatgtttgtacacaacacctaaaaccagttttgctgctataattctatactgttgattcgtctgcgattttatctgttaaccaaataaaacataatagaatttcctaatgagatatatctttatacttaaacagcttttttagaggtgagttttaaagaagtctcttaattctgatgctaggttgtttttaaaaccactatgcaaagaactcaccacaagccaccttttgtagtgttctccactaatactggttatcctgtgctacagagaaaatcaaagcagtcataagctccagttttcgtattgcaaataagactcttacctacaaaatgagattcagtgaactaatttggtttttactcaaccaaattaaaaatttttt

SEQ ID NO: 3389 - DNA, 1110 bp, Homo sapiens
aaggaaaattagcagttggtctattcagaatcaaacctttttatattttatactgcactttagtgtattttctgtcactgtaggtatagaagatctgcctcccctgtggaaattggggtctgttggtgggcgtgcccctgaagcctggcttgggttgaaaagtgttcccgccctaaggccttggtgccctgaacctctgatgcctaccgggttctcctgatttgagtttcctttaaatactccctttttgagtaattttctgatgggaggaaagtagcagtcatcatctttttgtgtgcaggctgtctcatttatttttagccattgtcgtttcattcattttgtgtaatataaaccgtgtgtcatgtcaaagtgaaagacatttcaaatctgtagcataggctagtgggcaggtccgcacagtcgaagccacacctggtctgttttctgtgcactgtagccttagtgtcacctttcttcttgtgtctccttatggtacactccagcggttgccttttttatcatttctactgaagttgggaaattcaaccccagaaattgacagatgaaaggagacaatggttgtgtagggagatggagaaaatgcttaatctgaggatgagacagggttttttcatttttgtgggggctagaaaaaacataaaatgaggcagttaaataataatagttaatgaaggtgtgctacagaaaataatctggtgttcttgctaactttgcccttcactgttgcttaattgtgaacagccaaaagctatatgttatggcttattgtgtgaaggtaactaagaagtggtgttccatgacttcagagtacatccatgcggagtccattatttgagtttgacatttaataactttgctggaaaatctgtaaaaaagaaaaacaagtttgctagtgactaagccccgcatatgtgagtgaaagtacttcaggcacgctgcctcctggtaacagctatgcagggagggaggacccacactgctacacttctgatcccctttggttttactacccaaatctaaatagatacttttgataatagataactgctcttttactaagacatagtctctacctatagaaatgta

SEQ ID NO: 3390 - DNA, 1132 bp, Homo sapiens
cccggcctcagtggccacatggctgtcctcagctggcctctgcccctccacctggtggctcccgggagctactctgacacgctggtggcaaaacgtcagagctgcccctgtgctgactcgagtccttagcaaagagacagggcaggacagatgctgggccctccaccgcccaacggacttagggtccaaccgccatgccgccggcagatgcgccaagtcctggtccacacacagggaccccttcccggcgcccctgggcagcagctctgggggtggggtctgggccagtcattgctgctcctgagaccctgtgcattggggacaccttcagacccacgtggtgcggtggcttgtcagggctgccaccgcagactgcacacccaagaggccgtcaggagcctgggcacagaggtgcacgcacgcagcagtgggctcttctctctgcaggttttcacacaacagaaaccacctgacatccacccgctgaagcgcactgctgttcagataggggacggaaggtcgtttgtttttgttctgagctccataagaactgtgctgacttggaaggtgccctgtgctatgtcgtgcctgcagggacacgtcggatcccgtgggcctcacatgccaggtcaccaggtcaccgtctccttccacccctgcagtgtgctgttgtgcacgtcagggacgctgttctctatgcccactgccctcctccctctcctggcccagcagtattgctcacgggggctccagccgccggcgtggccctcatgagctacgcctgggtcttctgcagactcatgcagccctatggccgctcagaccaaggcgcagagcaactatcagggcagctctgcctcctcctcccatgaggtggggagaggcaacagggcagcccccagaggagtgtcctggccgctgtcctcccggggcccatgatggccatagatttgccttgtggtgttggatcaggtactgtgtctgctcataagtacttgtgtcatccagaatgttttgttttttaagaaaattgaattacttgtttcctgaaatattctgaggttaatatgttagttttcatagaacattgagaggcccctgccactttcaataaagacctgacttggagaca

SEQ ID NO: 3391 - DNA, 1345 bp, Homo sapiens
tcgcgcgggaggtggcgggtctagctcaccaactcccagttcggtgtcttgagctgccagaagcttgggcagccctggaggatgctgagactccgcatgcttgttccttcagccacttacatcttcttgttgtgatgtgtgttccgtattttaagcaatctcaccaggattattattttatggccactttctctgccctccactctcttgtgtccgatcttctgtctgggattatgttgcaaacatatcctcgttcatttcctgcagtaaaggtctcctggtgaccacttcttcacttctggcgtgtctgaaaatacctttatttcatcctcattcttgaaggctcttttccacaggcgcatggcttcaggctgttgtttgttttcttttatcccggtggaaacgctgacccgctgtcctctggcctcctcgctgttgggaactttgctgtcggtagctgctgctgtgaagggattctgcctctctcctggccccccttgggccacttaaagatcattctttctgatcttctaaagttttcagtgtgtggtgtgtgtgtgtacgttctttttcatctccttggaattactgaatttcttaaacctgtggcttggtatcttttaccagttctagaaattcttagccattattgcttcagatattgtctgtgttttcctctccttttgggactgtgattcaggatagaatgtctcagtccgtcttctgtgtctcttaatctcccctccatattgtcatcatcgtgtctctctgtgctgcattctgtgtgatttcttctcatctgtcttccagttcacgaatgccctcttctgctgtgttttatttgctgctgaacccctccatgagtggttccctccgtccattgagttttacattttgattatgaaagtttttatttctaaaagttttgttatttttgtcaaatctgcaatgttactttttatagttttctattctaggtattctcaagctcaccatttgtgtctttaaacatagtttgacgtctataatcccagcactttgggaggccaaggcgggtgggtcatttgaggtcaggagtttgagaccagtctggccaacatgatgaaaccctgtctctactaaaagtacaaaaattaggctgggcacagtagttcacacctgtaatcccagcactttgggaggctgaggcaggtggatcacgaggtcaggagtttgagaccagcctggtcaacaaggtgaaaccccatctctactaaaaatacaaaaattagccgggcatggtggtggacgcctgtaatcccagctacttgggaggctgaggcaggagaattgcttcagaccataa

SEQ ID NO: 3392 - DNA, 1133 bp, Homo sapiens
cgaaggctttttgccacagcgtgggtgggccttacgcaatcagttgaaggctttttgccacagcgtgggtgggccttacccagtcaaaggcctttgccacagcgtgggtgggccttacccaatcagtcaaaggcctttgacacagcgtgggtgggccttgcccaatcagtcgaagtccttcgccacagtgtgggtgggccttacccaatcagtcgaagtcctttgccacagtgtgggtgggccttacccaatcagtcgaaggacttcgacacagcgtgggtgggccttacccaatcagtcgaaggccacaagagcagaaatctaagatctcttaaggaagagaggattctgacccagatggagactcaagctgcagcaccagctcctgctgggatctccagcctgctgacctggacttcagattttagacttagctccctcagtcacatgagtcagttcattaaaatcagtgtctgtcatctccctgtgtctcagtgtgtctctccatctttctctctctgtttgtttctctaaatatgtataatctcactcttgctcgcactgtctgtacacacacatcctgctggttctgcctctctgggagccctgatggctgcacagtgcgaggacttcagggccccgtcactttggctgtcgtttaccccccagtttatggtggcccctgtatttgcgggctccacatctgcagattcaaccataaaaataacaatacaacaataaaaaataaacaaaagacgatgtagtataacagtgacagacacagcatttccgtcgtaccaggaatcgtaagtaatctagaggtgatttaaagtatacaggaggggccgggcacagtggctcacgtctgtaatcccagcaatacgggaggccaaagcgggtggatcaccggaggtcaggagttcaataccagcctggccaacatggtgacaccccatctctactaaaaatacaaaaattagccaggcatggtggcgtgtgcctgtaatcccagctgcttgggaggctgaggcaggagaattgcttgaatctgggaggcggaggttgcagtgaggcgaggttgtgccacttcactccagcctgggcaaaagagcgaaactccgtctcaagaaaga

SEQ ID NO: 3393 - DNA, 1319 bp, Homo sapiens
tcctgggaaatcctttgatccgggagccctaggtttcctctccagccaacggggcgtcgctgccttaatgggaggagcactcggaagggttggtttgggcctgaaactctcccaagtggcatagccccttttccggtatggggtctcctacacccacgcgcaccacctctccggtcgcgtggctgcctctacagcctacctatacgtccctttttccccccaactgggaattgagaggtaaggtctttctctggaaatccagcagtagaggaagggaccacccaagaaaactaaaaaccaaggcaccttaccagtctgtctggggacaggatccctgctgcaccttccccaccccctcctgggaagtgccccctcacctcagggcacccgcaacctgggctcctccctgagcgcaccggcccttcctgtcacccaggtccaccctcagtactcaagctgcagtatacagcgggaaaaactgaggcactttggtgctaggggtttgggactgaggcgtggagagcagatgtgatggcaggaagactctcgcttttaaacatctggtttgggagagaccatcgacttggccagtgagactgagaatggattccgagtagtgatgggccgtttgcacctcggtttttccacgtgagaaatggggagaacgctgctgttaggaggaagttgtgtccagttcagggtgccctcgggagccctgtccctgttgctgtggcccctctcacgccgccatctctctgccccgccccgcccctccggcctccccacaccccccttgccctcactacctgtatctcaccggcgtgtgttcaccctcccgggtggctcacacactctcattcacacacacaaatctcaggaacaaacggtcccagagtcctccggacccctgcccagggtctctgcaggtctctgccccacgcgttcccgtcgctgacaaagccaccagctgcctcctttaagcttggtgctccggctctgggcctttcttgcgctctattttttttttttttttttttaagaaaaacaacaacaacaaaaaaagacaatgaaaaaaaaaacgtcatgtgagtgaagagatgtcactgtctgtggtcttggagaactagtctcgtagctgaggggtggggtccctctgtctggggcactggcacccacagcaggactccgccagtctgatgccaggactgaataaagtgtatttgccccgaccttgccctgtggttctgcatgtctgtgctcttcctcaaccctccctaaacagtttgccagattcaagtccgtgtgatttgggcccgagc

SEQ ID NO: 3394 - DNA, 1194 bp, Homo sapiens
cttcaccccttggacctctggcaggctcaccagtgattgctgctgccaacccccttgggatgcctgttccagctgccgctggcgctcagcagtaacggccctatctgtctcctgatgcctgagcagaggtgggggagtccaccctctccttgatgcagcttgcgcctggcggggaggggtgaaacacttcagaagcaccgtgtctgaaccgttgcttgtggatttatagtagttcagtcataaaaaaaaaattataataggctgattttcttttttctttttttttttaactcgaacttttcataactcaggggattccctgaaaaattacctgcaggtggaatatttcatggacaaatttttttttctcccctcccaaatttagttcctcatcacaaaagaacaaagataaaccagcctcaatcccggctgctgcatttaggtggagacttcttcccattcccaccattgttcctccaccgtcccacactttagggggttggtatctcgtgctcttctccagagattacaaaaatgtagcttctcaggggaggcaggaagaaaggaaggaaggaaagaaggaagggaggacccaatctataggagcagtggactgcttgctggtcgcttacatcactttactccataagcgcttcagtggggttatcctagtggctcttgtggaagtgtgtcttagttacatcaagatgttgaaaatctacccaaaatgcagacagatactaaaaacttctgttcagtaagaatcatgtcttactgatctaaccctaaatccaactcatttatacttttatttttagttcagtttaaaatgttgataccttccctcccaggctccttaccttggtcttttccctgttcatctcccaacatgctgtgctccatagctggtaggagagggaaggcaaaatctttcttagttttctttgtcttggccattttgaattcatttagttactgggcataacttactgctttttacaaaagaaacaaacattgtctgtacaggtttcatgctagagctaatgggagatgtggccacactgacttccattttaagctttctaccttcttttcctccgaccgtccccttccctcacatgccatccagtgagaagacctgctcctcagtcttgtaaatgtatcttgagaggtaggagcagagccactatctcc

SEQ ID NO: 3395 - DNA, 1171 bp, Homo sapiens
actggccagggtcttgcatgcactattttatgaaatcctcacaacaaccttatgagggaggcattttattcattaccattttatagataagatgaagaccgaatctggagaggtcacatcacttgcccaagcccaagtggtgaagctgggatttgagcctgatattcacactacctacattccctccagtataataggaactcatcgctaactttgagcacttagtgttctgagtacttcgtataggttatctcaatcctactccagctttgcgaactagagggtagtagtagtattattttataggtggggaaactgaagccagacaggattagtgaattgcccacagccataccccacccggtggtagagtgggatctgggcttggatcacactgttctgtcatcgtcttattccctgtcttcccctctgtctggcagacacccccaagtgggaattgtgcctgactcaccttcatgtgcttagggactggtatgatgtcctccacaacagggagaggttgctacattcaactgactttcttttttctcttccagctgccaaggggccaagggatgagctggggccctccttcccaatggcatctccccctggtctggaactgaagacactgagcaatggtccccaagccccaaggagatcagctcccctgggcccagtggccccaaccagggagggtgtggagaatgcctgcttctcctcagaggagcatgagacccatttccagaaccctgggaacacgagactgggcagctcacccagtccccctgggggtgtctcctcactgccccgatcccagcgggatgatctgtcccttcattcagaggaggggccagccctggagcccgtgagccgcccggtggattatggctttgtttccgccctcgttttcctggtgagtgggattcttctggtggtgacagcatacgccatcccccgtgaggctcgagtcaatccggacacagtgacagcgcgggagatggaacgactggagatgtactacgcccgcctaggctcccacctggacaggtgcatcatcgcaggcctcgggctgctcacggtgggcggcatgctcttgtcggtgctgctcatggtctccctgtgcaagggcgagctgtaccgccggaggaccttcgtccccggcaagggc

SEQ ID NO: 3396 - DNA, 1614 bp, Homo sapiens
tttattctcagtctggactgcacatgagagtcacctgggaaatttttaagactttcctgatgcccaggtcaaaccctaaaccagttaatcataatcatgggagtggaacccaggcattaagagttttttaaagcccccaggtgatgcctatatgtagcacagtttgagacccaatgatagtggggaactgtattgtcagcagcatgggtggctagccctcctgctgtcctcagcaaggcaaacttaaccttagattaaacaaaacacacagatcaatttaaggagaaagtttgtttcacctgggacccagcccaagtctttctggctgtctccagctggaacagaagtggcttggtctcagactgctcagctgttggggaagggatttggcgtggcagatggcatcgtggctgtcgccactgcacacaaagaacactgagttgctggaaactcacagattttctgtccccaacagatctgccatggagggatctggtgcctccagacatgtgcacatgaatccatatggagcttttcctgatgttccactccactttgtatagacatctgccctgactgaatgtgttctgtcactcagctttgcttccgacacctctgtttcctcttcccctttctcctcgtatgtgtgtttacctaaactatatgccataaacctcaagttattcattttattttgttttcattttggggtgaagattcagtttcagtcttttggatataggtttccaattaagtacatggtcaagtattaacagcacaagtggtaggttaacattagaataggaattggtgttggggggggggtttgcaagaatattttattttaattttttggatgaaatttttatctattatatattaaacattcttgctgctgcgctgcaaagccatagcagatttgaggcgctgttgaggactgaattactctccaagttgagagatgtctttgggttaaattaaaagccctacctaaaactgaggtggggatggggagagcctttgcctccaccattcccacccaccctccccttaaaccctctgcctttgaaagtagatcatgttcactgcaatgctggacactacaggtatctgtccctgggccagcagggacctctgaagccttctttgtggccttttttttttttcatcctgtggtttttctaatggactttcaggaattttgtaatctcataactttccaagctccaccacttcctaaatcttaagaactttaattgacagtttcaattgaaggtgctgtttgtagacttaacacccagtgaaagcccagccatcatgacaaatccttgaatgttctcttaagaaaatgatgctggtcatcgcagcttcagcatctcctgttttttgatgcttggctccctctgctgatctcagtttcctggcttttcctccctcagccccttctcacccctttgctgtcctgtgtagtgatttggtgagaaatcgttgctgcacccttcccccagcaccatttatgagtctcaagttttattattgcaataaaagtgctttatgccggcttttctcagctctgtgtcatggtggttattttcaggtgcctcccctgccatt

SEQ ID NO: 3397 - DNA, 1280 bp, Homo sapiens
gggtggctcttctctccccacccctccttggctctccagcacttcctgggcagccacggccccctccccccacattgccacatacctggaggctgacgttgccaaaccagccagggaaccaacctgggaagtggccagaactgcctggggtccaagaactcttgtgcctccgtccatcaccatgtgggttttgaagaccctcgactgcctccccgatgctccgaagcctgatcttccagggtggggaggagaaaatcccacctcccctgacctccaccacctccaccaccaccaccaccaccaccaccaccactaccaccaccacccaactggggctagagtggggaagatttcccctttagatcaaactgccccttccatggaaaagctggaaaaaaactctggaacccatatccaggcttggtgaggttgctgccaacagtcctggcctcccccatccctaggctaaagagccatgagtcctggaggaggagaggacccctcccaaaggactggagacaaaaccctctgcttccttgggtccctccaagactccctggggcccaactgtgttgctccacccggacccatctctcccttctagacctgagcttgcccctccagctagcactaagcaacatctcgctgtggacgcctgtaaattactgagaaatgtgaaacgtgcaatcttgaaactgaggtgttagaaaacttgatctgtggtgttttgttttgttttttttcttaaaacaacagcaacgtgatcttggctgtctgtcatgtgttgaagtccatggttgggtcttgtgaagtctgaggtttaacagtttgttgtcctggagggattttcttacagcgaagacttgagttcctccaagtcccagaaccccaagaatgggcaagaaggatcaggtcagccactccctggagacacagccttctggctgggactgacttggccatgttctcagctgagccacgcggctggtagtgcagccttctgtgaccccgctgtggtaagtccagcctgcccagggctgctgagggctgcctcttgacagtgcagtcttatcgagacccaatgcctcagtctgctcatccgtaaagtggggatagtgaagatgacacccctccccaccacctctcataagcactttaggaacacacagagggtagggatagtggccctggccgtctatcctacccctttagtgaccgcccccatcccggctttctgagctgatccttgaagaagaaatcttccatttctgctctcaaac

SEQ ID NO: 3398 - DNA, 1181 bp, Homo sapiens
gtgaaaaggataagttgccattgtaaattatgttgatgctattaaagagatgtacgaattagccaactgtatttaaggaaaatatttccatgacagcatttgaaatcatgagtcatatttgaaaatgcagttgccttctctcacttggattggacatgcttacattcaggtctagaagatgggagttgggcattcaagcttgatctttcccgacatgtggttttggatgggaagtctggtgctgagagttgtagcattaagggatttggtgtctgttatttcccactgtccttccccaagttggggaggagagtgggaagctgcattgtactgtactcttctaactctttcttcttatgtcctcttaggtgatgaccccacaaggaagaggtactgttgcagccgctgcagctgctgccacagccagtattgccggggctccaacccagtacccacctggccgtgggggtcctcccccacctatgggccgaggagcaccccctccaggtgaggagcccataaggagaccagtgctaattgatagaagatgccttagctggattaatgatgagatataaccttgactgaagctgatgatgagtttgtataattaagcaggattactctgagatccagcgtggctgactgatgagactaggtggacaagagccattgggagccctgggtgttaggctcaaatgtcagttttctgggagctgctgagagggtggaatggtccatctatctcagaacttggtggaaagctttgtagtttttttgctaccttttcaagatagacacttgagctatattcttggggcttttctcttgcaggcatgatgggcccacctcctggtatgagacctcctatgggtcccccaatggggatcccccctggaagagggactccaatgggcatgccccctccgggaatgcggcctcctccccctgggatgcgaggtaagtgcctgcagtggtgactttggcttctttccctagagcctagtgggataggaaatggagggaagattgcatttagatcatatcccatgggctttcaagccttaaatctagggaaatccagaaaggaaagagaagagggaacatttcttaaattgggcttacctcccctcttagaaaagttagagcagccatgcacccagggtgtttctcaatatcta

SEQ ID NO: 3399 - DNA, 1181 bp, Homo sapiens; identical to SEQ ID NO: 3398

SEQ ID NO: 3400 - DNA, 1161 bp, Homo sapiens
acactaacaaattcttgatatgtggatttcatttttcaccttgaagctgatctccttcctgataacaagcttcttgttgattagatttttagtttcagccctattctagctcttcctttactcagtgtttttaatgagatttgaatgttccatagcacttgagtcacatatctataatctgcacactggtagatggctctagtatgtatgcattggattattttggggacaccctatactctcatccctgcaactgacacgacaaggagaaaggcaattataatatgagaaagaccgatttcaagggaagagagaatagcagattactgggtagaggtcagggctaaaacagggtggcatgggagaattcctaggaaaaggctgtgggtgggagactgagctaagaatctgttgagaaagttggacacatggacaagaacgccatgggaagttttggggagggccagaggtgcttgggtccaaaagagcagagtctcatccctgtccatttctccttgcagacggtgggcaagagcagcaagatgctgcagcatattgattacaggatgaggtgcatcctgcaggacggccggatcttcattggcaccttcaaggcttttgacaagcacatgaatttgatcctctgtgactgtgatgagttcagaaagatcaagtgaggagtggactgtggggggcggagactggaggatgggaatggattgagtgggtgggccaagcaatagaggtggtgatgtagctagttggttcttctctgtttattctccagttttagagggcagacttaaatggggacattgaacgctaagaaatctttttgagtccagcaaaccttgctctctagtctagcaaagtacaagttgtgaagggctgctaggctttttgtttctctcactttgcgtgcccctgggtactggggtaaagggctctcatgttctccccacaggtgtgtgaggggggagagcttgagtttctggcctcattgcctatttgtaaagctgtagcctaaagggctctcccaatgcagcctggtctgaaactgctttaagaagcctctgaccctcttcagggtaagtgctcagctccccatgtgggtttggggccagtgatttttgttggcatttatacaaacaattggagata

SEQ ID NO: 3401 - DNA, 1227 bp, Homo sapiens
gggtacaactgccagactggaggagtcatagctgagatcctgcgaggtgagaccatcatctgttatattcctgttatcctggacattttgggggaggaggttctggaaacttggttgcttgttgtgatttctgggaaggccttcaggctgggctggtgcccgtgggtgcgggagctagctcagagccccttgttgctcaccgtcttgccctcttcttaggagttcgtctgcacttccacaatctggtgaagggtctgaccgatctgtcagcttgtaaagcacagctggggctgggacacagctattcccgtgccaaagttaagtttaatgtgaaccgggtggacaatatgatcatccagtccattagcctcctggaccagctggataaggacatcaataccttctctatgcgtgtcaggtaaagtgcaggggccacccataatactggagcctttggtctgtagttcagttaattttgagtcttgatgaggactgaccatcctgtgggtagaaccatgtgggctggggctgggtgtaggcctcctggtgcttaccacaggctgtgttcttacactgactgtatagaaagaggaggtagagtaaacctaccccatatacacctcagctcaggccctgtgcctggtctgtattgtgaatgggggaacatagaattgaggaagatttggatctttgtcccatttcctccaggcagagtaggtgtggagaaggcaaggctgtagctctatggtttttgatgaagcagctgggccagggagtgactgtggctctttgcagggagtggtacgggtatcactttccggagctggtgaagatcatcaacgacaatgccacatactgccgtcttgcccagtttattggaaaccgaagggaactgaatgaggacaagctggagaagctggaggagctgacaatggatggggccaaggctaaggctattctggatgcctcacggtcctccatgggtcagtgcagagcctggcaacctgcataaggtatggggctctaaatagctggcctcttgcattcacacttggtttttcctaggcatggacatatctgccattgacttgataaacatcgagagcttctccagtcgtgtggtgtctttatctgaataccgccagagcctacacacttacctgcgctccaagatgagccaagtagcccccagcctgtcagccctaattggggaagcggtgcgtcaca

SEQ ID NO: 3402 - DNA, 1227 bp, Homo sapiens; identical to SEQ ID NO: 3401

SEQ ID NO: 3403 - DNA, 1174 bp, Homo sapiens
tctctcagagccctgaagacaaggggtaacactccaaaatatggactcattttccactccaccttcattggccgagcagctgccaagaacaaaggccgcatctcccgatacctggcaaacaaatgcagtattgcctcacgaatcgattgcttctctggtatgggtgggggggcgttggcaggtgtgagaaggggctgggtggctgggtggggaggcttgcaaccatagcttccacaatgatggcaatatttttcgtcaacagcagttcacctagtgagtgttgagactctgggtctgagtgaagctgagggtagagggaacacagggttggggtagtttctctctttgggctgacaggctttgtcacccacacacatccagaggtgcccacgagtgtattcggggagaagcttcgagaacaagttgaagagcgactgtccttctatgagactggagagataccacgaaagaatctggatgtcatgaaggaagcaatggttcaggtcagttgggctttgctgggtgtggagtggcatagctagctgttggaggtgatgaactgtctgagcctgaccttgtagaatggaggcaaaaaaactgatttaatgagcctgatccaataaagccagaaaggagtcctcagagcaccagaagtcttcaggcccttttagcacttttctttgaccaggcagaggaagcggctgctgagattactaggaagctggagaaacaggagaagaaacgcttaaagaaggaaaagaaacggctggctgcacttgccctcgcgtcttcagaaaacagcagtagtactccagaggagtgtgaggtcagtaggcagcacggccctggcagagatcctaggttgtaggattttcaacagcagaacaaaggatatgctgcatcaagctgtggtcttgagtccaggcttttggactgaaacaaggacctgaaacatctaaaactacctcttgattctataggaaggagataggtgctgaacttgctcaagagcccagagagctggttgtagctcacacccgttccctgggcatgtgtgttctgtcctcggctgcctcccaggagtcctcaacctggggtagtgtaaattcctgctctgcttattatcagacgtgtgtccggaggtggtcgtgtttcacagtggggatgggggcag

SEQ ID NO: 3404 - DNA, 1174 bp, Homo sapiens; identical to SEQ ID NO: 3403

SEQ ID NO: 3405 - DNA, 1174 bp, Homo sapiens; identical to SEQ ID NO: 3403

SEQ ID NO: 3406 - DNA, 1438 bp, Homo sapiens
taccaggacctggggacctccgatagtggacgggcctccagcaagagtgggtcgtcgtcatctatggggcggccaggccacctgggctctggggagggcggaggtggaggcctgcctttcgcggcctgctcaccgccctcccccagtgcactcatccaggagctggaggagcggctgtgggagaaggagcaggaggtggcagctctgcggcgcagcctggagcagagcgaggcggctgtggcccaggtactggaggagcggcagaaggcgtgggagcgggagctggccgagctgcggcagggctgcagcgggaagctacagcaggtggcccgacgtgcccagcgcgcccagcagggcctacagctgcaggtgttgcggctgcagcaggacaagaagcagctgcaggaggaggcggcccggctgatgcggcagcgggaagagctggaggacaaggtggccgcctgccagaaggagcaggccgacttcctgccccggatagaggaaactaagtgggaggtgcgggctggggatctgggcctcccctctgcctcccttctgtccctctgggaaaccccagagcagttgcccctcactatcataacggtgggatggggggggggatgaaaggagcaggggggacaaaaatcaattgggagtgtctgtgaggacccgaggccatccgctgggtgagacatgtccatcttgagtccaggcagggaatcgggtgcgtcgctgctgatgaggggctgagcctgcagccccgggaagcttggtgcccctggctccagatctggtagctgggttggggtgagcagagctctgcctttacctggcttctcctctcacctgttcctgcccaggtgtgccagaaggctggcgagatctccctcctgaagcagcagctgaaggactcgcaggcggatgtgtcgcagaagttgagtgagatcgtgggactgcgctcgcagctgcgggagggccgggcttcgctgcgggagaaggaggagcagctgctcagcctgcgggactccttcagcagcaagcaggccagcctggagctgggcgaaggcgagctgcctgccgcctgcctcaagccggcgctgacccccgtggacccggccgagccacaggatgctctggccacctgcgagagcgacgaggctaagatgcgccgtcaggccggggtggccgctgccgcctccttggtttccgtggacggggaggcggaggctggcggggagagcgggacgcgggccctgcggcgggaggtggggcggctgcaggccgagctggcggctgagcggcgggcccgggagcgccagggtgccagcttcgccgaggagcgccgcgtgtggctggaggagaaggagaaggtgatcgagtaccagaagcagctgcagctgagctacgtggagatgtaccagcgcaaccagcagctgga

SEQ ID NO: 3407 - DNA, 1099 bp, Homo sapiens
ggccgcatgggtggggccgggggccagcatggcactgacttgcaccctgccttgcagaccggcaccacggcacgcccatgctgctggatggtgtcaagtgtgtgggcgccgagctggaatacgactcagagcacagcgactggcacggctttgactgaggcccgaggccccgcctgccccgggcccctcagccttaaaccccgccttgtccccccgacatgctgcgtgatggtgtggcttcctcgcccctctctggggtgggtgtgggggtggagtggccttgcccacgcctctcacctctgccttcatttgtgctgccaccctgcccctccctcgtcctcctctcccacttcctcctctctgtgtgcctcagtctcctgccggaagaaatgggttgagcccgaaaggaggctgtctgaggaagggagagggagggcctggggtgggtcccccactccccaccccaagccacagggactcccaccagggtctgggagaggacggagctggctctgtggcgtcgtggccccattactgctgccttgcttcagccacctctcctgcccctccctagtccccactgctgtccaccatgagtaggagggaggtgcagtccccagcccccacccctcaggtctgtgttacttggtttttaagcgactggttgggatagaaccctaaagaaataaacttccagtggataccggaggccaggtggatttttgttctctggggttggggtaatgcctactcctttgcagatgggccagggaaagacttgggtagactcactcaggaggcaggggcaccgcgtggtattatagcacctagccccacaagaggtatgcacaggtggtggcattttaggccagaagctggctgccaagacaattaatttgaatgaggagagagggacctcatgtgtaggccagagaggtcttaagcagtggagttgtttgggatgcttgatgggagacagcagcacccccttctggtcagttccctatgcacagctgaaagctttctcccttctctctctagcaccgggaacccttgcattcctcccactattagggtctccacgccatatcagcaggct

SEQ ID NO: 3408 - DNA, 1296 bp, Homo sapiens
tgaggaaagctgctaacatggaagatagaaaataaataacaataaaaacaagtcaaaacaagcaagcaaactaataattaaaataaacagaaaaaggcaagttggaggaaaccaagatttatttttaagaataagaggtgataggcagttcggcggtccagtgggtctgtctcttgcttcaacagtgtttggacggaacagatccggggacggtcttccagcctccgaccgccctccaatttcctctccacttgcaacctccgggaccatcttctcggctatctcctgcttctgggacctgccagcaccgtttttgtcgttagctccttcttggcgaccaaccatgagctcccagattcgtcaaaattattccaccgacgtggaggcagccgtcaacagcctggtcaatttgtacctgcaggcctcctacacctacctctctctgggcttctatttcgaccgcgatgatgcggctctggaaggcgtgagccacttcttccgcgaattgaccgaggagaagcgcgagggctacgagcgtctcctgaagatgcaaaaccagcgtggcggccgcgctctcttccaggacatcaagaagccagctgaagatgagtggggtaaaaccccagatgccatgaaagctgccatggccctggagaaaaagctgaaccaggcccttttggatcttcatgccctggattctgcccacatggacccccatctctgtgacttcctggagactcacttcctagatgaggaagtgaagctcatcaagaagatgggtgaccacctgacgaacctccacaggctgggaggcccagaggctgggctgggcgagtatctcttcgaaaggctcactctcaagcacgtctaagagccttatgagcccagcgacttctgaagggccccttgcaaagtaatagggcttctgcctaagcctctccctccagccaataggcagctttcttaactaccctaacaagccttggaccaaatggaaataaggctttctgatgcaaaaaaaaaaaaaaaaaaaaaaaaaaaaagaataagaggtgatattacacccatgaaacaagaataagatgctattttgagacaagaaacaaaaaataagctttaaaataaacacacacacatacacacacatacacacaacagcagaaatgaaaaattcaatggatggcttgagaaaaatgtctagaatatctcacagaaaatagatctgaaagacaaaacaatgaaaaacaggaaagaaaagatgaggaatgtagggggaatagtccaaaaggtttaaca

SEQ ID NO: 3409 - DNA, 1171 bp, Homo sapiens
ggtgggtacccagtgcacgtatgaagattcgctgagctgcacagttgagatatgtgtaattcactgtatgtatctacatagacctcactaacaagatagtcattcctgccctccaatcaatccgtcaaaggctgccacactgactttcttctccatgcatttcagggtctgaccactgaggtttctatcccacttggaaccgcagcgtccttaacatcccttaagtgacatgggtgaacaaaggaggctttttccgaaatacgcttaggctgagaagctgctctttgtgcctcccccgcccattgcacctgcccccgcgatgcctgggcctggacgggaatcctccctccaccaccccccctcccacccacccaccctccagcccctaaaatccctccaagtccccctgagacccaggcccgccaactccgtgcagaatcggttcccaaaagggccggtaggtggcgcccgagacccggagccacatccgggcagcgtccagttcggaggcaagggctcccgctccccttcccagacagcgggtgtcgcgctttcgctggggatgaggccacgccgggagcagggcggctccggccctttcctcctccccgcctctgtcctctgactcccgtccctctcctccctcgccccagagatgctaggtcctgcctccctcccgagaggacacggatcagggctggctccagtcctcccccaccctaccccaggttctccttcctgcaaactaaatttagaggtgaggatgtggccgcctgcacggggcgggcggggagggtcagcggcgatgccgccggatgtctgccagccgggccgggacgctgcgtcaggtcggtaaacacgcggcgtgctccggaggggccgcgccagctgcgacggggacgccgccaccctgggcaccctggactgacgtggcgccgcaacccgcccggcgggtctgccccaggccaccccacacacagtctcctatccactacggaaagggatggctgcagtggctctcacgccttactggtggaaccccttcttaaaaagctgctatgggggtcagggtgtagcaggtattaaactgggggtccccctcaccccaggctccctggagcaccacctctgaaaaccaggggaccagataagctccagcgttgggaagcca

SEQ ID NO: 3410 - DNA, 1172 bp, Homo sapiens
tctcagattcaaacccacatgcttctctctaattctcctctttctctgcatctagagacttctagttaaagaagcacttatcaaacaatctatgatggaagaccagttttgttttatttccaattgtcatgaattaatctttttggcctgtacactgttgaatgaaatgagtctgccaatcatgcacttggatattgtgacaacatcatattgctgtaacagctgctaaatgtttgttctcaatatctgtacttaactcatcatggacagtaacagacagttcatggatcagcaggggtccaggggccacagtgtgtaacctggtatagagtgtcactcgcctcatctgctatttcaagtctgagaaagatggctgggtgcagtggctcatgcctacaatcccagctttgggaggccaaggtgagtggatcgcctgaggccaggagttcgagaccagcctgggcaacatggtgaaaattagcctggcgtggtggcgcatgcctgtagacccagctattaaggaggctgaggcgggagaatcacttgaatccgggaggcagaggttgtggtgagccgagattgcgccactgcactccagcttgggcaatagactgagactccatttcaaaaaaaaaaaaagacagaaagactttagaaactaaaaatttcaagaacttgacttcctttttctacattctgctgtgtcattccttccctaagccagtaggcactgaacacgctagctgctgccaggctggagagaagcagtcatggggtcacagaagacagtagaaattaaattgtatcagttaacacagcaactttcagtcttgctgtagaaatgagaagtatgaaactggtacaaaaagaaaaaggaaagaaacaaagatgagcaactaatcataatttgtgaacacattaattgcaacttacaaaaaccaagaggatttttcttctttattttccggcgtctacattaaggacacagagattttttcaaaaagctgtttgcactaataagagagcttagcagcaggatagatgattacaaataatatcaaaattgagagaacttctactctactagaataacatttaggaacattgtctcattcacaataactataaaacaaaatacttgaagatcaaattaatagaaagttactgaagat

SEQ ID NO: 3411 - DNA, 1198 bp, Homo sapiens
tctagctgtgcgtgttggggtttcacactcaaatacagtcctggggaaagatagggccaactagagctagtaataaacagcaagaaaagtcagtaaataatgaaagagtcattaaagcatactatttagaattggggaggtaaccactagaaaaataaaaattagaaacgattagaagtggttatttttgggaatggagatagggatgggagaaagaaggaaaactttttgttccttttacaattaaatttctctcattgtttacgtatatttctttatcatgaaaaaaggacagatgaccttttagtttgcaacctccacttattcagtagtcattcagtaaacacttgaatatgtactctgtgctaggtactaggtatgacttttttggtattttttatgtttttaacttactccttaatgggttaccagaattttatgggtgattttggtgctggaatttaagaatggcactattttgtgtacttttgaggtactgtcaccttgcttgagttgatccttactttggttcatttctaggttcattgtccccatatcttgtgtgatctgtaatgacatcatggcctatatgtttggctttttctttggtcggaccccactcatcaaggtaaatggattaccctaatgtgaaataccactgtgaggggagggtggtgctctcaatgtgagtagatcagcctggcagacagaagaaatctagctgtgttgtattgtggccatgtcttcatgtcttcctggagaaaggccaaaggaaaacactgacaactgattaaaaaaaaaaaaagataataaagaaaataggctgggcgtggtgggtcatgcctgtaatcctagcactatgggatgctgaggcaggaggattgcttgaggccaggtgttcaaaagcagcctggggaacttagtgaggccttgcctttactaaaacatttaaaaattagccaggcatggtggtagcatgcacctgtagtcccagctccttgggaggctgagatgggaggatctcttgagcccaggaggttgaggcttcaaggagctgtgatagtgccactatactccagcctgggtgatggggcaagatcgtgtcttgaaaaaagaaaggaaaatatttttacagatttatataatcttttttggggacacattttttgggactttgatctggatttgagtgtagtca

SEQ ID NO: 3412 - DNA, 1101 bp, Homo sapiens
ctttaacccaagtcacattttcctcatccttgcattggagttgatcgttaaaagagcatctaactcataggatttagtgaggattaaataggagagttcatctaaagcactgatggtggcaggcagtgggtgggggtggcctaatggctaagaataaaggctgggtatctaagataattgacaagggcctttctttttttttttatggttaatgtaccattctttatgagaatgtgctagcataatgatagagggctgaagcatgtaatctataattaatacaaagtgaactgtcatgggggatggggagggaaatgggcctttctgcagaaatgtaagtgcggtcatggaaacggctatagctccttgattgtaattattcaacctcactagaggtctgcaactagctattaaagtgctagtggtcccgacaagggcctttctaagaacactgtctttgcaactgtaccccttttgaataatataaatatcatggttactcacttggcagagtggacatccctaagaaattcaatcagacattttgaggttggtgagagagggagagttgacggagttggaggaagaagaagtcgtgacaccatgactgagaactctgtctgatgacccagggtcataaaatttatcattataaatgtcaaataaaataaatgataattaatcaataaaaaatgacacatgataaataaataaataaataataaaattaccatctgtgcagggcaggctgaaaatgctgagaaggtaaaactctctaggagaatccttcagccagtgactgatgggagttggtggatactcaactcccttgcctcttgagccagatgactgaaacgtatgctctatactgtcccccagagatgcccagttgaactgggctccagttacccacagtggtaatttgcttaacagcataccttctattgactgctttcccttacctgtatcatttttcctttcttttcccagtgttttgtgagagcatcttccaaataaattacttgtactcacattcttgtctcgtgaccagtttctgggagaatctaaacttaagacagtctgcattgcacaacttatggc

SEQ ID NO: 3413 - DNA, 1199 bp, Homo sapiens
attgcagaacattgtatcacattttagtccagagatagaataaagttgaataaccttgacttacacaaaactgttttggtagttggatttcattatcttagtgaatttagtcattttacaatatgtttgtatttggccatttactgtaatcacatttttatatctgtacaatgacactttttgcagttgtggggtagtgtgtaacactgtccatcttgcatcattgaaactactacaatgatactatcatttaataatattaatattacttgaaatagactaagataaagaaaaggggtctgtatgatgtgcagttttgtgcctttatgtatttgccttgttctttgtcgaatgtgtgaaattccgtactgtggtttttcctataatagaaagtagagctgtgtattaaattagactgtgtctctctgatacctttacactactgagaatagcatggttttggccatgtaaaccaattttcaaagttctaatgacatagccatgtgtttttggttttttatatttcattttaaaatttgagtatcaccatacattaattaatactcctgtagtagataagctgtcattaagtaattcccaaaaaaagggccatttgcttgcattactttgaatttaatgttgcgcttgtgcactgtgttaatattgtttgtgatggattggacgttgtgactcttgccttttaagaagaaaaaaaagataggacaaagtatttgaagctcttaaaatgtacatattttggttcttctatctcaaattatttaaaatgcataattcacatttttgtaataattctatgcaattttgtggcatgatgtttcttccacttgtaattttatgtgctttcatcacaaatccaaaggaaagaataaaaatttcttaacacaacccagcggttatttcttggggtcagagtcaaccttcttttgacagggaaagtggtgggagcgggcataatgccagtctttagggccatcatgcctaccctgacagggcacatccatgcctgtaaaggatattgggatgctgcaatgtgtgtgccagaggacacagttgtccttgctatcattccaccaccctccatccaggagtggaattacacttgccattgtttgcgtaatggagaccctctcttcctttctctcttccttcctttctccctgtcttccttgaccaaagtt

SEQ ID NO: 3414 - DNA, 1179 bp, Homo sapiens
gctggtaacttgatcttggactttgcagcctccagaactgtgagaaataaatttctattatttataacttacccagtctgtgctattttattatagaatcatgaacagactaacacaatcagtggttagttggattttaagtgagttctaagttgctatttctccatctgtcctgttggtacctagtcctaccagttatatggcaaatcaatggtctgtggtcagttttgtttggaaatataccccgagtccctctgctagggatctataatacacagactacttctcccttctcccctccagcacctccaaaatatattaagcatctcacaggtacaggtggtgctaaaccatttttccatctcgaatatatttctataggtctgctatggtcatggctatgtccagatattaattcattctgtatgtttttttttttttttaaatatacacatccttagagcttaggtatgatgctagtaggctattttgctcctctgtcatttttctgccaaacccttctgactttttagctgtgctaccaccagaccactgagtgattaacgtgaatggattttcttgaaatagatcctgagaccttttgcatctaaaagcaggttccctatctctttcagctatataattgtgtatttaaacagtgggactcaacaaggtaattgcagtcttggagttcctagcagagtgagccatcgagccggcagtagggagctgtgtgccatgattgattccatgggggtttgggaaatttgaggtgatatgagccgaactgctctgaagagttgcccacaggtatctctgctgttacaccttgtatagttttgtgatgacttaacctaatataaaagatcacactgtcatttctctttgagaataatcagtgccaagggaggtttcttaggaggtctttggcactttattcttgatgagtttttggcagggccaggttcatgaatgtgtgacctgtggaattgcacagggttctagactcagaaaggtcctgcctgtgttttgtgtttggtttaaagatagctgtcagagtcttgaatttttttttctttttttttttttttgagatagggtcctgctgtgtcacccaggctggagtgcagtggtgtgatcaccgttcactgtagcctcgtcctcccagggtctccatag

SEQ ID NO: 3415 - DNA, 1319 bp, Homo sapiens
ttctattttctttttccccattaaaagaggaccaaacaattctttatacaaatggagtagcaactagttttgtagcactacatttaatgtaatgagatacctttgttcatttttttaaatttgaaatatactttacctgatccactttgattgtatactatattctttgttaattttaattttgtcctgttcctagactgctagaatctggcccctggccatcttaaagtgccaacatatgcctgcagggtttataaaaaatggcctggagtgacacattttattatacctaatattcactgcatcagtatcacatctagctcccttacttgtccacagataatgtaaacaaaggagggaaaaacttattaaattctccttcgctgctggcttgtgctggtttagtgcctgtgtccctggcagtgtccagtgtgttcacttccagttgaagtatccatgtgtttctgggcagcttttctgctcagtgtgatcctgagatggcttccccgccgccacccagagtgtggtccttggccgcctcctgctcctgctctgcaagcctgaaactggcttgtctggagccaggagttagtcctggggtgtgtgtgtgcctgcgcacccatgcgcatgcaagtgtgtttgccagctcaggagctgtctcctctctacctggctagtaagaggtgggacagtaatggtcctcctgctggccccagcaaggcccatgagtgactgccctgacgtattcactgtgcctctgggccacttcttcccctgtagatgtgggcttgttgccttcagccggcttccctgagggaggagaacactggattattggaaatgttttaatcactcttgccattacctacatctattagcatagatgatgaaaagctgttactggtgattatagatgagtatttccaggacaacgttctaaaagtacaattatttcttattggggagattacaggtagtttggcaaagcattgaagtacaaaggtacattttcaattaaaaagcacacttctacaaaagatttggtttttaaattatggttacacatttcagtaactcatagctgctgtgcaaattggtagaccttataagaaggcacttgtttgtaagccagagaagaaactttaattgcatcctatcagattgttgaggtgggtgtgatagtcttcaggtgcagtgcgttcattcactaacgctcactgtcagtgcccatgtttgctagctgcctccatgtgactagtgagctgctggtgaaagtcgtgtgaaatcctgtacactgtgtatagaataatgtaatttta

SEQ ID NO: 3416 - DNA, 1230 bp, Homo sapiens
cattattctccatttttcaattttcttgggtctcccactttcccctcccccatttgccttggccttcccttgattttttaaagtgaacttttgcttgaccttgtgtttgctgtttttcagcatgttccagtcctagcaaaagaaaagttcttagtcttaaatttaaattcgttggtatttcagaaaaggctcttatttatttaccattttctagtataccacagcattagagatatggtcataaatttacatttctaaagtgctctcagccttctgaattttgtgatagacaatttcccggggcacaaaatggagttaacccaggatgtggtgagaaaaacatgggagtggagatgaaaaacaagagcaaaatgaaaacaagaatttcatctgaaatcagctcctatcaacaatgctgtctctccctatgcctgagacaaagggcctttatcagatggcacggtgaataggcagggccttctctcaaaactgccaagtctgtttatgtatctattatttcctttgaaaattgcctgaagtggagccttgtgaagaatttctcaagcattgcctcaaaccattgccaaggttgggttgtaatggaagtgcagaaagaacaaaggacaggcaccagaatgttcttttattgcttgcatgacaaagaggaaagaaaaagagaggaatgggatagaccagtggttctccaagtgtggtagctgaaccaggttcatccacgacactagggaacttaataggactgtagaatctgaggtcccaccccagacctactaaatcagcaactctgaggaccagggtccgtccagcttgtggtttaacaagccagccaggtgattccaatatcagctaaactctgcgatccacaggtacagacattttacctctttaatcttaatttaaaaaacctcatcttctctgcccgagcccaacgcttctgcccgggacatggaggacctagacgtgcaggactgggctgtcagcaccaggtaggagaagggttttgttttgttttgtttttttgcctagaagtatttttctttagtttgatgacaaaaggggaccaggatagtaaggacagaaggaatagcacagacagaaatgaaccttactctttctgtcagcttcacaaagtaaacagagtcatatagaaggaaaagttaccattaggtagtttaatggactagtctatctctaggacaacaatggctttaa

SEQ ID NO: 3417 - DNA, 1198 bp, Homo sapiens
ctggctttgccactccagggagcccagaatacaggtgctaagtagagagggcatcatcagaaattaggaaactcggacttggtccagtttaaggtgtatgggactgtcctgtatccatgcattatgggatatttggcattggcatccttggccaatgcctaccagataccaggatttcctcccagtctgaaaccaatcgagaaaaaaaaacctcattcacacacagataggtatccaaggctaagtggccatgttccacctggtagaaccattgtactagcgtaaaattgctgtgtcttagggtgccagttttactggtggttgttaagtgattcttctgtagacattttctgccagcccttgatttttcccagccttggttaagaaatagtatcgtaaatttgtaattccctgatctgtagaggttaaactttactcacgtttatatgccatgttctaagcaatatatttttatattgataaatgtaaaaggctgcagggatagtatatttcatgaaatgtctggttctttttttcttccttctaggaggtagatgacttctttgagcaagagaagaacttccttattaactattacaataggatcaaagattcttgtgtgaaagctgacaaaatgaccagatctcataaaagtaaatatcatttaccgctagtcagagctttgctgatgagcctggctgtgtttggataaaaagacttgtccttgtttctgcagatgttgccgatgactatatccacaccgcagcctgcttacatagcctggctttagaagagcccacagtcatcaaaaagtaagtttttttggaaaagcatttcccctaacccaattgaagagtgccgagtggtgtaattaaaagcataaatgagtagtgactacatggtcctgctctggagttacaagctcagtaagacaagtctctagcactcatcttacatgttctctggacataagacacttgtaagacaattgtaggggacttgggctcttctatatgtaaacaaatacagtaaatgttgtcaaagcagtagtttctgtcacacttaaaagcctgttttctttagttttggagtttgtaagagtttatcttgcatcttcccctggcaattggtgcttgcaattttgcctggtaatgccctagaccttctttttttttggcctgtgatgcagcctcaggag

SEQ ID NO: 3418 - DNA, 1274 bp, Homo sapiens
tagttcactgcagactcaaaatcctgagctcaagtgatcttcccacctcagcctcccagagtgttaggagtaaaggcataggccaccgagcctaggtgattttttttaaggctttgctgtgttgcccaggcttgtctcaaactcctggccgcgggcgatcctcctgcctcagcctcccaaagtgctgggattacagacaagaacctctctgcctggctgggtttcttttattcatttgttggacctgctttcttggtagcagtggtgtattgattcccagtaggatttatctgccaggagatccttacagatcattagttcagctgttttgctttgtgaattcatttgaaagtattataatttcggtacttagtaattagatggatttcttgacatgcattagatatttaaggcagtaatttaactctggttccatgttgattccattagtacatgggcttgcagccttgtgaaatgatgattcagtttatccattcgctgagtgcgctgcactgaccttcttccaagcctcagttcctgttctaggaacttgaggctatgtagcctgaaaatgccctgcagtctgcagtgttctactgtgaactgcttgtgtgttggcaggctaccggtaagaatggttggtgtcagcagggacggggccctctgagacccatctcacaaagatgagtggtgaaaatctgatcacttgctgcagccctttagttttttattaagccgatgcctgagtagctttaatagctattagctatgttagtagactgagatcttctgttagaagtctttagttctgttttccttgggggactaagaaattatattgcaggcctgaattacaggaaggggagaaccaatggctagggaatgagagccaatacctgtaaaagcagagttgggctgggcgcggtggctcacgcctataatcccaggactttgggaggctgaggcgggcagatcacgaggtcaggagttagagaccagcctgaccaacatggtgaaaccctgtctctactaaaaatacaaaaattagctgggtggggtggtgggcgcctgtaatcccagctactcaggaggctgaggcaggagtatctgggagaattgaaccccgggggtggaggtcgcggtgagctgagactgtgccactgcactccagcctgggcaacagagtgagactccgtctcaaaaaaaaaaaaaaaaaagcagagttaatatattgcttatagttagttgaaccagttgtttctcacacaccagtg

SEQ ID NO: 3419 - DNA, 1208 bp, Homo sapiens
cacagattgtccacatgggtggctgagagagtggcatctttgcttctgatggttcaatgcacacaaacttaattttatgcaaaagttattaaaatattgtataaaattaccttcaggctatatgtataaggtgtgtctgaaacataagtgaattttatgtttaggcttgggtttgatctccaagatatctcatgatgtatatgcaatattccaaaactcaaaaaaatctgaatccaaagcacttctggtcccatgcatttctgataagggatattcaacctgcatcagttttcctgtttgtttcctttgacttctcttccacactgctggtttcatcatatgtctggtcggtcctccctgtctgttatggaaaggattctgtgatttgtgtggatttcctatccttctgtgtaggaaggcctgtttcctggggataggtggaagaagggggtttgtccagggcttacagataagatttcactctagatcgcttcttggccttttggttaagttcaagtgtagaatctgttcttaccagtttaatatgctgatatgtcctttatctgaggacaatatagtaaatggattttttgagcagggagatggaataggagcttgctccatccactccacacatggacctggtattgagtacctccaggaatgttcaaccctcgggggatatttaaaaaaaaagatttcaatctagaggctacaggctgcagatgctgggggtgatcacatgagagagctctgctgcagggaacgatatgtgagaagccttggctttctccagccgctcactcaactttttgttagagaagaattctctggtttgtctgcactttttttctctacctggcaataaatgaggatgtgcactgttccttcacaagggcgtagaaagaggactgagctctcagggggattccatacgtagaattttaattcgatctccccagttttcagcataatttttcactcttgctttccactttatgtgccagtgtcagatacagactttttttttttttttttgagatggggtctcactctgtcgagcaggctggagtgcagtggcacgatcttaggtcactgcaacctctgtctcccaggttcaagcgattctcctgcctcagcctcctgggtggctgggattacaggtgtgtgacaccatgcccaactaatttttatatttttagtagaga

SEQ ID NO: 3420 - DNA, 1188 bp, Homo sapiens
ttttcctggctccgggagtgaataccaagtagcaatagtactacagcgttgctgactttctccctaggtttctttctcctccttactgattttgggttttgtttctgattcgcccacagctggcggatttttccccatgaatggcgacaccaattaggaactcgcgggaaaccccgttgctccctttcccctggctggcagcgcggaagccgcacgatgcctggagttcctgtaaaccacgtgaaccagcgggacttcgtcagagctctggcagcctttctcaaaaagtccgggaagctgaaagtccccgaatgggtggacaccgtcaagctggccaagcacaaagagcttcctccctacgttgagaactggttctacacacgagccggttccacagcgcggcacctgtacctccagggtggcgctggggttggctccatgaccaagatctatggggacgtcagagaaacggcgtcatgcccagccacttcggccgaggcttcaagagtgtcctccgccgggtcctccaagccctggaggggctgaaaatggtggaaaaggaccaagatgggggccgcaaactgacacctcagggacagagagatctgggcagaattgccggacaggtggcagctgccaacaagaagcattggaacaaaccatgctgggttaatacattgcctcattcagaaaaaaaaaaaaaaattaggaactaggttttacattctgaacatttggtgatctctttaagtgaattaatagtttttagagatctattctcttttggataagagatgatgaaaaatctggtttgttagtctttttgtttgtttgcctttttgtctacttatgagttcaaatcagttaagacttccatgcccattgggaaggagaacagctttttgttatctagtccactgaatttttatgtttctgaatttactttcgacctgtggccaaagttgcagaaccaaagctatatgctatgtgtctatgtgtcttcccggctgtaatcaacaaaggccttcccctcttgttgtgggagtaaaaaaatcttactacctttgtaaagttttaataagttatattatttcatgtcttaaaggagctctgttataattcacttatggaaacaaacacatgtaaatcaattatttctaaaattccagaaaataagtaaattaaact

SEQ ID NO: 3421 - DNA, 1141 bp, Homo sapiens
cttggctcccttttctgggcttttcaaggatgtcgagagatttgggattgattattttgcgggagagggaggcaaggagaaaatccagataaaagtgctgtaggagaacagagttgggcagtttcagaaagcaggtcaccatattttgaacacttttctttctttatttttaaaaaatatgttttacttaaatttaatggtggtaaaaaacacaacatgaaatttaccctcttaaccattgttaagtgtacagttctgtaatgttaactagattcgcttagttttgtaacagatctctagaacttctcccccaccccagtttatgaaggtataattgacaaaaatgcatatatttatggtgtacaaaattatgttttgattcatgtatacattataaaattgttaaatctagctaattaacatatctgtcccctcacatacttaatactttttgtggtgacatttaagatctactctcatagcaatttttgagtatacaatatgttattattaactgtagtcaccacgttgtacagtagatcgccagaacttattcatgtcttacccaaaactttgcacccctacccaacaactccacaacccccgacaccagcccctggccacttctgttcactcgtagcttctctgcggccagctgctctagaatccacatctgagtaaggtctgtggcgtttgtctctctatgccggccttatttcacttagcgttaatgtcctctaggcgtatccatgttgttgcaaatgaaaagattttcctcctttttgaggtgtaataatatttcattgtacacagaagtacagtgagtcttttgtgtcagtgggttctacatctgtggatttaactaaccatgaatcaaaaatgtagttaggcatgtgatggttgcctctatactgaacatgtagaggctttttgttttcttgtcattattccctaaacaatatggtataacaactacttacacagcatttaccttgtcttaggtattatacgtaatctagaggtgatttaaagtatacaggaggatatgcataggttataggcaaatactacatcattttatagagggacttgagcatctgtgattttggtatccatgagaggtcctggaaccaccccctat

SEQ ID NO: 3422 - DNA, 1198 bp, Homo sapiens
gtggcacacagggcacattcggccaaagacacacatggacacgggcacacacacacaaacccacagagagagggaaagaaactcacagagattgagagacagagagagaagagagaatgggagacacacacacagacacacagatacacacacacacacacacacacacacacacagacacacacacagagtcatacagcagaggcatgaaaacacacacccccaggcaacccctgaggctgcggggttctgctgtcgaccctctggtgagagagcaccctaggggcacgcattccaacctgtcttcgagatctctgacggcggcacgacttttggggagactcaacccaaccaacaccatcccggcaggcctgaggctgggatgccgtgctgcttccccaggactccgcctggggtttcctcatcctggtcggccctttgcgactcctggcatccggaaaccttcccgtcgaccccgtggagaggtcaggccggagcctcagagccccgacacacaagcactggcacagagggctcctgctttgccgagcctcagagactggtttctaagacaactgtgggaagcactgtgacgggagaagccgctcgcacctcacgcatgcgcattggctgggccgactcgctctccgctcctggcaggcaggctgcgtcctctttaaataatgccaccgctgcgcagcggctggatccgggctccagtttggggcggcgtgggagaggcgaccgcgggtgtcttgtcctgtcccagggccaaacccccaggtgtcctgtccccaggacctccttgagctgacttccaccttgggaggaagggggagcttcaggacgcctgctgtgttctcaggactccccttcagatcccattttggcccactccgagtgagataggatgggctcgccacatctggtgaggcaggcagggcctcgctgcagcacagaatgatcccataggtctcaaggcctagtgtcagctgcaaattcactgatccatcagccctctgcctccctcctcctttgaaagagcagtggcctgcccagcttctaaaagccctggtgctccggaaagcccaccatgctttacaggacacttgcaggcaggaaccagggcaaatccgatgtggagaccatgtgaccacgcgtggcactggcgtatcccacagcagatggtgtgaatgtg

SEQ ID NO: 3423 - DNA, 2412 bp, Homo sapiens
acacatacaatacacacagataacttatttttatttgttcgatcactcctttagtccctcatttatttcacaaacattcattgacacttacgtggcagcactcttgtaagaatagaatatggtgatgtcatgctctccctggccgtgtccgagccgcgacgggcgaggggcggacattcgtggcgaatgggacccttcttctcgtcccgcccgcgggggccccttgtctctcctcttcctcgcctgcgggtggtgcgttgggaaggcatggggtgcggaacccggcctgacctcgctgtcccgcccccgccttctgcctcgcggggtgggtcggggggtcctctgacgcggcaggcacccctcgctctcgcctcctgtggttgtcgacttgcgggcggcccccctccgcagcggtgggggtgctgtcccgccggcccgtcgtgctgccctcccggggagtttgcgcgagcgttggctccccctgggcctttgcggtgctcctggagcgctccgggttgtccctcaggttcccgaggccgagcggtggtgtgtcgttcccacccccagcgccccctcctccggtcggcgcctcggtgtccgcgcgtgggtcctgagggagctcgtcggtgtggggttcgaggcggttgagtgagacgagacgcgcccctcccacgcggggaagggcgcccgcctggtccggcgagcgcacgtccggtgctcccctctggcgggtgcgcacgggccctgtgagcgatcgcggtgggcttgggctggtgacgcgtgcgccggccggccgccgaggggctaccgttctgcctccgaccggtcgtgtgtgggtttactcggaggtgctttgcctctgaagaaaagaggcgggtggacggggtgggggggggggtgggaggcgggggcttgtggagttgcgctcacgctcgcacctgccggtccccgccctgaccgcgaacgctcaaggttgccgcacgcaggtttttcctggtaccacaggccccctcccttccccaggcctccctgagcgcctctgcgggcccctcgggccccacgaggggcggctggcgggtggggagtgtgacccatcctcggtgagaaagccttctctagcgatccaagaggtgtgccttggggtacgggatcccccggcctgccgcctctgtctctctctccgttatggtagcgctgcagtagcgactcgcttgcagaggaaccctcctcagcttccccctcgacggggtgacggggggagagcgagggttccgccggccaccgcggtggtggccgagcgcggctcgtcgcctactgtggccggcgcctcccctttccgagtaaggggaggatcccgccggcagggcccagcgtcctagcgggttgggacgcggctgacagcgagcgatggctgcgcgcagcgttccgtccggcgagtgacccccctccgccgcgagtcagctctccgcccgctcccttgccgagtcgcgaccggtgcggacgacggcgtttgcgtggcacgtggtcgggccgcctggccctgggaaagcgtcccacggtgggggcgcgccggtctcccggagcgggaccgggtcggaggatggacgagaatcacgagcgatgtggccctggcgttgagtttgtggctgtggtcgcttcggggccccggtggcgggaccaggggctcgtgaggcaggtcttggtgggtgccgagggccttccggcgtcccaggcggggcgccgcgggaccgccctcgtgtctgtggcggtgggatcccgcggccgtgttttcctggtggcccggccatgcctgaggtttctccctcagccgcccctctgcgggctcccaggtgcccttgccctcgcggtccccggcccttgcctgtctgcgcccccttccccgcccgccgcccgccgatcctctctcctccccgagcggctcaccggctttacgtcggttggtggccgcgtctgggaccgaaccgggcaccgccttgtggaaaaaaaagaatagaatataccctgttaaatcagacatgatacttgcttttgtggagcttatgctttagtgcagaaacagaaagtcaagcaaaaactcaaactatgtaactttaaattggatatgtgctaatgaaggaaaatgtggcactgtaagaaaaaataatagggagttaaaggataaataggagtttgctggatgaaatttatgaagagctgaagatttcaaacaaaagaaactgatgcaggagggtgcagctttggagtcaagaatgaagttctaggagatagagagcaaagaaatggtgggagaggaggtcaaagtaggtaggattttatatattatcaatgggaaaatattgaacaatcctaagcagaaaggcaatgatatatgttcatcttcattacaaattc

SEQ ID NO: 3424 - DNA, 2412 bp, Homo sapiens; identical to SEQ ID NO: 3423

SEQ ID NO: 3425 - DNA, 1237 bp, Homo sapiens
aaaacccctgagtggcactgttaagtattatgttatgttactttagtcattaaacgtataagcatacctccaaaggttgaatgtaggccacttgcagaaagtaggcagaatgctcacatttaattcttgatgatactgtgtttagctttcttattctttgaaatatcattgagaagaaatactggcatctgctcaaagtaatttctttttcagttgacaatattataagtaatgttattgtatcatttccctacttggacagagtgtgaaaattttgaggattgtctgccacaaatttcttcttcatttgcaaaacattcatgagatattatatttaaatgattttatttaatattaagtgtacttggtgaaggtggcatagaaaatacaaaataaaactaatttaaaaatattaactattacatttataagaaagacttgctaatcataacactgttcataatgattctgaataaagcattatttcttttactgaaaacaattgtagctataactcaatcatctaaattgtcattagttttatttctttctaatcgcctctagctgaaattttaattttgattaattttctttttctccattggtttcgtgtgtgtgtggaggtaaaatatacagaatgtagaatttgttagtttttctatttttacgtttacacttcagtggcatttaaatacatgcaccattttaccttcccaccagcgttgcacaaggtttcagtttctccacatcctgcccaacatttgtttttctggttttcttggtttctgttttttgtttgttttgataatagcattctaatgggtgtgaagtggtattgcattatggttttgatttatatttccctaatgactagtgatgttgagcatcttttccagtgcttattggccatttgtatatcatctttggagcaatgtccgtgtatatcctttgcccagttttgaattgtatttgtctttttggagttctctatatagtctggatattaactccttatcatgtatgtagtttacaaatattttctccattctctgggttgccttttactgtgttgacagtggttcttgatgcacaaaactttttaattctgatgaagtccagtttgtctatgttttcttttgttgcctgtgcctttgatgttctatataagaaatcattgccaaattcattgtcgtgaagcttttcccattttcttctaaaagttttctaactttagctc

SEQ ID NO: 3426 - DNA, 1098 bp, Homo sapiens
catattttcctccaagcttttccccctacctaagtttttgtttttatttatgtaccactctctcaatttgtcctatatccttgtaccttacataccaatattattattttaaaaatcaactcactttgtaacctaacgtaaatttaaagggaacttttaaataaatatgtaaatggaaaaccagtaccttttgccacaaataacacagcaataatagctaatacttatataatgcttattacatgccaggtctttattctaagctttttacatttatataataatgcacttaattctcacaacaaccctatgaggtaagcactgtaggtacttaatccattttacagttaggaaacatagaggttaaataacttgcccaaaatcacaaactagtgagcggcagagctagcatacgaatcttaggtgatatgattccagggtccatgctgttatataaaaatagaggttaccttttaaaatagaaggttcttaggaagtatgtgcttatttaaaaaaaaaaaaaacaacagtctacacctcacctaagatcctttctcatagcatcagtcacacctgaactactgtttttttttttttttgagacaatctcactctgttgcccaggctagagtgcagaaatgtagtggtgtaatctcagctcactgcaacctctgcttcccaggttcaaccaattctcatgcctcagcctcctgagtagctgggaatacaggcacacaccaccatgcccagctaagttttgtatttttagtaatgactgggtttcgccatgttgcccaggctggtcttgagctcgtggtctcaagcaatccacctgccttggcctcccaaagtgctaggatagtaggcgtgagccactgcacccagctgaactacatttttgaaaacactgattaggaaattggtttgtcagttgtgtgtactctagaaatgctagggtgaagtagtaagtagggaagggtgaccagagttcattaggagttagttgagatcttagagtagttgggtaccaggttatacctgtgaaaattctgtgtaaacagatctgcaaagcactaggtaaggtgtgaccgaattgat

SEQ ID NO: 3427 - DNA, 1111 bp, Homo sapiens
ggcctggctcctccgtagacccctgttcttttcaacctctgcccacccgtgcatgtcatcacaaacatttgctcttaagttacaagagaccacatccacccagggattagggttcaagtagcagctgctaacccttgcaccagcccttgtgggactcccaacacaagacaaagctcaggatgctggtgatgctaggaagatgtccctcccctcactgccccacattctcccagtggctctaccagcctcacccatcaaaccagtgaatttctcaatcttgcctcacagtgactgcagcgccaagcggcatccaccaagcatcaagttggagaaaagggaacccaagcagtagagagcgatattggagtcttttgttcattcaaatcttggatttttttttttccctaagagattctctttttagggggaatgggaaacggacacctcataaagggttcaaagatcatcaatttttctgactttttaaatcattatcattattatttttaattaaaaaaatgcctgtatgcctttttttggtcggattgtaaataaatataccattgtcctactgttttgtcttgaatctcatgcaggggttggaggtctgaggtgagacaccttccccgagtgggttgagttgcacagtttcccccgaagctcattctcgtgtcacacttcagggctcaagccactgttgttccctgcctggtacaagtccattgcctagcccctccatactaaattgcagtcatttgctcttctgatcccacaagcaggaaatgacaatcaagtgtgttttggtagcagcaagatctggttttggattcccagcttcagtcttttactgtcagctcatctcactctatgaaacccagttcttcaattgtaagcaacagaaacatcggtcaaactggttttagcccaaaaatgaattgattggttcttaagtcatcaaggattttgtttattttgcttcaggtctggctggatccaggggctcaaaggatagccttagggctctttccccttttccactgtgctcctctccggcgtcactctgtcctgttatccacagtcttcctcctgatgggtgaggcagggagggcag

SEQ ID NO: 3428 - DNA, 1099 bp, Homo sapiens
tcagagtgctctgaagtaaaaccaggcaggtcagaaagtaaagagctggggtgtggctgagctggattgggagggcagggaaagcatctctggagtgatgagatgtacatttgagcagagccctgagtgaaattagggagcaagctgtgtgtctggtacctggaggcagaatattctaggaaataagagtcagagtgtggctgggcatggtggttcacacctgaaatcccagcactttgagaggctgaggcaggcagatcacctgaggtcaggagttcgagaccagcctggccaacatggtgaaatcctgtctctactaaaaatacaacaattagccaggcatggtgacatgcgcctgtaatcgcagctactcaggaggctgaggcaggagaattatttgaacctaggaggtggaggttgcagtgagctgagattgcgccattgcactccagcctgggcaacagagtaagactcagtctcaaaaaaaaaaaaaaaagagtgcaaaggaggtgggagtgcatttagagacaggaaggggacaagtgtgcttagtgggcagtaggttaggaaggtgggcagaggcaagtcgtaagtgaattttatttttgagccattggacacttctgagcaaaagagggaaatgatctgacaggaatgctctcaaaggatccctctggctgcttggtggagacaaactgtaggtagcagaaggggaagtgaggagactgcttggagtggcagggggtttggggacacggggatggggtgaggaaggtgcagtgggccggcaaaggtaatgcagatgagagagggcagcttggaccaggcagtggggacagagaagtaggaacgtgccttagatttattttgtctgctgataatcagagatgagaggggagataaaaagaagcaacaatagttccaaggtttttgatctgaaacttattgaaattcaacctatgccacttgtcgcccaggctggagtgcagtggcataatcttggctcactgcaacctctgcctcctgagttcaagcgattctcctgcctcaacctcctgagtagctagaattacaggcatgcgccaccacgcccggctaa

SEQ ID NO: 3429 - DNA, 1132 bp, Homo sapiens
cttggccaggcgtggtggctcacttctataatcccagcactttaggaggctgaggcgggcagatcacctgaggtcaggagttcgagactagctctagtctctactaaaatacaaaaattagtgtgtgtgtgtatatatatatactaatcaaacttccttgggaaagaaaatgtgaatgcatttctgtgtcatacatttcttgtgcagcactatatattctgtggtttagcagtattaacagcatcaagctgaacagtaaccagtgttgctaaggtctcgcatactataccatgtatgctgagaagatatgcatccttagaattgagaattagaacatttcagttaattgcagtaacttttcagtaactagatatatgtgtaatttgatttctgaagtaattttaactgtggaaaaactaagttgtcaccagcggtacctcatagcataactttagcccatgatatatggatggatggatataaatggaaattgcacactgaaattaggacgtttatatttcttcaggtattagaaaactactcggatgctccaatgacaccaaaacagattctgcaggtcatagaggcagaaggactaaaggaaatgaggtttgtattgttcttgttgcttaacatgagggtttcataggatatgtgtctttctgtagttgtagtgatatgagtaagtacacctgtgtatgtatttgtgcttctgtgtctggtagtgagatggaactatccatttcccaaattgtgtgtcgtctcagtggagggtggcagtgggtgaacatccatttgttttcatttagaggtgcagtggctttccccatctccttgttcttccttaaatcttggcatagagcttgttttttgtgtaaggagtcagggcacattttctcttgtgctgttttggaagtttcagacctgatagcctctattgtgcctaacgctacccttttctctatgccgtatcactgaagttctttcttttagaataaaagaacagtggtctcatcaacataaaaaaccactgacttttttccccttactaattgcagtcatatatgatgtgaatttactaaattttgaggtgacctttattttccaaatttatggtgtagttttcctggag

SEQ ID NO: 3430 - DNA, 1217 bp, Homo sapiens
tgcaatattcgtatcagtgaatgtgcttttccagagacctcagagccttcttatgagggttggagttcacagcaagacagcagtggaggccagctgtcttctatctgtgggccgtcttatcccctatgaaccattataccctgtttctcccttcaccttgattttttccccccacctttgttcagcatttaagagccaacctcttctcattgctaaaggcttcattagacactgaaatccttggtccttcatgtaggacacaagttaatgtccccatctttagggagataaaacaagaaatctagtgccgccttatataagatacagaggagatgagatagtgctggctggggcttctatatcttggtggtagagttaattctgatatgtctgccttttgagtgggaggtgaccactgacattccctagggggaagagatcctatttggtgcctgcatgaaaagatttaaccacaaccccccttccgaggcctctccctgcacaggcccctccttcctctgtcacataccacagcccaggacagctgtctggctatgaaagggcccagtgtgaaggggaatgtaggccctggctgggggaatccctgggtgtggcctggcgagcacctcctccccacccccccattcatcacagactctgcctttgcagaaagctagggtgcgagctggcaagaccttccccagcagccctggagactcattggaggaccagctgaagcccatgttggagtgggcccacgggggcttcaagcccactgggatcgagggcctcaaacccaacaacacgcaaccaggtgggaatgagtccccatggcagcacccgctgcctctgctggtgggaccacttcttgggagagtcagccacccctgctgccccacaccccacccagctttctagcagctggtctcaactctgaatgttggaaaaataggagcaggcatacgaaggctgtgccagctctatctggcttccccggccactttcttgctgatggtcacgtgcatataatttgtattgaatctgacatctgtcttgaagtcaggatgcagtgttgactagcaccttttttattaaaggaaaaaatagttaagctatgctcatttgagaaaattggaaagtgttaaagaagaatatgccacctgctaacattttgaccagtaccatatttctcccattataagataactctggtttct

SEQ ID NO: 3431 - DNA, 1643 bp, Homo sapiens
tgtaaagactgaattgaattttaagctaatgtgaaatcagagaatgttgtaataagtaaatgccttaagagtatttaaaatatgcttccacatttcaaaatataaaatgtaacatgacaagagattttgcgtttgacattgtgtctgggaaggaagggccagaccttggaacctttggaacctgctgtcaacaggtcttacagggctgcttgaaccctcataggcctaggctttggtctaaaaggaacatttaaaaagttgccctgtaaagttatttggtgtcattgaccaattgcatcccagctaaaaagcaagaggcatcgttgcctggataatagaggatgtgtttcagccctgagatgttacagttgaagagcttggttttcattgagcatttctctatttttccagttatccccgaaatttctatgtattatattttttggggaagtgaggtgtgcccagttttttaatctaacaactacttttggggacttgcccacatctctgggatttgaatggggattgtatcccattttactgtcttttaggtttacatttaccacgtttctcttctctgctccccttgcccactggggactcctctttggctccttgaagtttgctgcttagagttggaagtgcagcaggcaggtgatcatgctgcaagttctttctggacctctggcaaagggagtggtcagtgaaggccatcgttaccttgggatctgccaggctggggtgttttcggtatctgctgttcacagctctccactgtaatccgaatactttgccagtgcactaatctctttggagataaaattcattagtgtgttactaaatgttaattttcttttgcggaaaatacagtaccgtgtctgaattaattattaatatttaaaatacttcattccttaactctccctcatttgctttgcccacagcctattcagttcctttgtttggcaggattctgcaaaatgtgtctcacccactactgagattgttcagcccctgatgtatttgtattgatttgtttctggtggtagcttgtcctgaaatgtgtgtagaaagcaagtattttatgataaaaatgttgtgtagtgcatgctctgtgtggaattcagaggaaaacccagattcagtgattaacaatgccaaaaaatgcaagtaactagccattgttcaaatgacagtggtgctatttctcttttgtggccttttagacttttgttgccctaaaattccattttattgggaacccattttccacctggtctttcttgacagggtttttttctactttaaacagtttctaaataaaattctgtatttcaagagtatcatgtcttctgaaatttgtcttgccctgggtatatgctgttaggttcaagtgatgggaaaccagtgcttctttcttcagtgaggactgatcttttcacatcctttactgatttttcagatgtgcttatttcttcttcttcttcttttttttttttttttttttgagatggagtcttggtctgtcgcccaggctggagtgcagtggcatgatctcggctcactgcaacctctgcctcccaggttcaaacagttctctgcctcagcctcccaagtagctgggattataggcacccaccacc

SEQ ID NO: 3432 - DNA, 1148 bp, Homo sapiens
attttatgtctggccggtgggagtaggttagtttggtgattcttgcatccaggttatttctctgttggaaagaagtagtcatttagagtgtgttgagtaagggctgcaggatgttgcagtatgaaacactctcgcatcattcagatcatacatacaaatatttatcgtctggtgtaagttggtcacctgggtgctggtgcagctggtgtgaccatgacagacaaggcctatttctaaacattcaccttgataatgtttcctttctttgaaggatggtgggggcatgcaacatgtaaaatcttacttttctattacaccttgtccaatctgaagcctgtctctctgtatgcctttgtgggaagagagttctgcacttgatcatttgatcactttgggacacactcttaaaaaaaattatattttgtttcaaagagagcctggcacatagagaaaagtcaattatgattgttactattgctactattccctctgccacttctagggccggtagcaaatgaacaactgccttatgttttttgctcattctgtgactgttggtgcttccttccctcactctcgtcatctgtaaaacggggataagaaaccctacatcctagtgctgttttgaggatgaaatgatgttggttatgtaaagacacctggttttgcccctagcacacagatggcacttagaacccctcctcccccacttttttttttctgagacaaagtctcactctgtcacccaggctgcaatatagtgatgcaatcacagctcactgcagcctcaacctccctggctctggtgatcctcctgcctcagcctcccaagtagctgggacttacaggcatgcaccactacgcctggctaattttttgctgagataaggtgacaacatgttgtccacgctggtcttgaactcctggactcaagcaatttgcctgcctcggcctcccaaagtgtggggattactggcatgagccacctcacccggcttcagaccacatttttctccccaagtccctgttctctgctttccaccaacataaaccaggacccatttacatgacaatgaagggaaaaggtgcatcccatggcagtcgtgtattaacctgaaagaacattcagaatccactttcacccccac

SEQ ID NO: 3433 - DNA, 1138 bp, Homo sapiens
tcacccttgttgcccaggctggagtacaatggtgcgatcttggcccaccgcaacctctgcctcctgggttcaagcgattctcctgtccctcagcctcccaagttgctgggattacaggcatgtgccaccatgcctgggtacttttgtatttttagtagagacagggtttctctatgttggtcaggctgggcttgaactctcaacctcaggtgatccgcctgcctcggccccccaaagtgtggggattacagccatgagccaccgcacctggctggtggtttaatttttttctgggcatttaattgaattgctctggaacccttttctgtggttttcttatataggaagatacaggctccagtgcgatgggagtgttggttaaatttgaaggatgatactcaattcttagagaagttttctgtgccctggtctctaatcccagctacagataaagtggaataagaagaagccattaaacaccaggtggatttggggaaaggtgcttgtttctttttcccttccaggctgcatggctgagaggttgaaggaggagattctcaacagagagaaaatggtagatattttggctggtcctgatgcctaccgggaccttccccggctgctggctgttgctgagtcgggccagcaagctgccaacgtgctgctctctctggacgagacctatgctgatgtcatgccagtccagacaagcgccagtgccacgtctgcctttgtgtgagtcactgcctaagagatagggaataagcctcttcctcctttcacacttttttttttttttttgagacagggtctcactcttgtcatccaggctggagtgcagtgtcatgatcagggctcactgcagccttgacctcctgggctcttgctttagtcccctgagtagctgggactacaggtgtgcacccccacacctggctaatttttttttgaatttttacagagatagggtctcactatattgcccaggctggtctcaaactcctgagcttgggtgatcctcccacctcagccttccaaaatcctgggattataagggtgagccactgcgcctggccatggcattaaattttctgtaacagaggttgccaaatagcttactacctctttttgtaaataa

SEQ ID NO: 3434 - DNA, 1130 bp, Homo sapiens
cccaccccacgaggccctcgactaccacttcggcctcgaggagggcgagggcatcagagacctcttcgactgtgactttggggacctcacccccctggatttctgacagggcttggagggaccagggtttccagagatgctcaccttgtctctgcagccctggagccccctgtccctggccgtcctcccagcctgtttggaaacatttaatttatacccctctcctctgtctccagaagcttctagctctggggtctggctaccgctaggaggctgagcaagccaggaagggaaggagtctgtgtggtgtgtatgtgcatgcagcctacacccacacgtgtgtaccgggggtgaatgtgtgtgagcatgtgtgtgtgcatgtaccggggaatgaaggtgaacatacacctctgtgtgtgcactgcagacacgccccagtgtgtccacatgtgtgtgcatgagtccatgtgtgcgcgtgggggggctctaactgcactttcggcccttttgctctgggggtcccacaaggcccagggcagtgcctgctcccagaatctggtgctctgaccaggccaggtggggaggctttggctggctgggcgtgtaggacggtgagagcacttctgtcttaaaggttttttctgattgaagctttaatggagcgttatttatttatcgaggcctctttggtgagcctggggaatcagcaaaggggaggaggggtgtggggttgataccccaactccctctacccttgagcaagggcaggggtccctgagctgttcttctgccccatactgaaggaactgaggcctgggtgatttatttattgggaaagtgagggagggagacagactgactgacagccatgggtggtcagatggtggggtgggccctctccagggggccagttcagggccccagctgccccccaggatggatatgagatgggagaggtgagtgggggaccttcactgatgtgggcaggaggggtggtgaaggcctcccccagcccagaccctgtggtccctcctgcagtgtctgaagcgcctgcctccccactgctctgccccaccctccaatctgcactttgatttgcttcctaacagctctgttccctcctgctttgg

SEQ ID NO: 3435 - DNA, 1245 bp, Homo sapiens
ggcctatgttccggtgtccccacgcctccagcaggggacgcccgggctgggggcggggagtcacaccgcgcctggtaccatccggacaaagcctgcgcgcgccccgccccgccattggccgtaccgccccgcgccgccgccccatcccgcccctcgccgccgggtccggcgcgttaaagccaataggaaccgccgccgttgttcccgtcacggccggggcagccaattgtggcggcgctcggcggctcgtggctctttcgcggcaaaaaggatttggcgcgtaaaagtggccgggactttgcaggcagcggcggccgggggcggagcgggatcgagccctcgccgaggcctgccgccatgggcccgcgccgccgccgccgcctgtcacccgggccgcgcgggccgtgagcgtcatggccttggccggggcccctgcgggcggcccatgcgcgccggcgctggaggccctgctcggggccggcgcgctgcggctgctcgactcctcgcagatcgtcatcatctccgccgcgcaggacgccagcgccccgccggctcccaccggccccgcggcgcccgccgccggcccctgcgaccctgacctgctgctcttcgccacaccgcaggcgccccggcccacacccagtgcgccgcggcccgcgctcggccgcccgccggtacggaccccagggacgccgcgccgacagcgccgcctgtgccccccgcgcagacccgggagggcgccgtgtttggcctggaggcggcagggggcgggggaggggttgactgaggcgcccaggctgggcggtgcagagccggggttgggcctccgggccccgccctggggtgcggggtgacctcgggccggtccctgtttgctgctctgtgctctgcgcctcagcttcctcaccggagcctccccagcgtcggactcagtgataataatagcccacgtgtattcaactggcgtttactgcatgccaggcctttgggcgacttcaagccagctaaaactcacaaccccgctgtgagctgtgttgtcactgtgcccatctgacggaggaggaactgaggcccagagagggaaagtgacttgcccctggtcacacggctgcaggtggtggggctgggatttgaactgaggcctgctggcttcagctcagaatttgcatctcggtagtgagcacagctgctaggggaagtgaaggcggggcggaggaaagtcctggggcctaaccgttggtgagc

SEQ ID NO: 3436 - DNA, 1262 bp, Homo sapiens
aactgagaagcaagcccagtacctgggcatgtcctgtgatggccccttcaagccggatcactaccgctactgagagccaggtctgcgtttcaccctccagctgctgtccttgcccaggccccacctctcctccctaagagctaatggcaccaactttgtgattggtttgtcagtgtcccccatcgactctctggggctgatcacttagtttttggcctctgctgcagccgtcatactgttccaaatgtggcagcgggaacagagtaccctcttcaagccccggtcatgatggaggtcccagccacagggaaccatgagctcagtggtcttggaacagctcactaagtcagtccttccttagcctggaagtcagtagtggagtcacaaagcccatgtgttttgccatctaggccttcacctggtctgtggacttatacctgtgtgcttggtttacaggtccagtggttcttcagcccatgacagatgagaaggggctatattgaagggcaaagaggaactgttgtttgaattttcctgagagcctggcttagtgctgggccttctcttaaacctcattacaatgaggttagtacttttagtccctgttttacaggggttagaatagactgttaaggggcaactgagaaagaacagagaagtgacagctaggggttgagaggggccagaaaaacatgaatgcaggcagatttcgtgaaatctgccaccactttataaccagatggttcctttcacaaccctgggtcaaaaagagaataatttggcctataatgttaaaagaaagcaggaaggtgggtaaataaaaatcttggtgcctggaagaattttgagcctttattttatagataatcctctgccaacaatgtatgccatgaatagggggttatagttgtgctgatgaagcattcacggggtactctgcagtggaacggctgtctgtggtccttaggcttgaaagaatgggtaaagtgaagagggaactctttcgtttttttttgagacagagtctcgctccgtcacccaggctggagtgcagtgatgcaatctcagctcaatgcaaccttcgcctcctgggttcaagcgatcctcctgcctcagcctcctgagtagttgagatcacacccagctaatttttttttggtatttttagtagagacggggttttaccatgttagccaggctgatcttgaactcctgacctcaagtgatctgcctgggattataggcgtgagccactgtgcccg

SEQ ID NO: 3437 - DNA, 1169 bp, Homo sapiens
tttgtccacaagtatttcttaaaggtgtaatgtatgactactaactatctgtaagaatgttatttcttatcagaccttccatattataaccaacatcaaaaattggtctgtaatctgcacggtttcacaggaaagcagttttaaggagctggaaaattaataaatgaacttaaaataccaaggaatattaataatttcctattctaaaagtttttatttccagtgacatcagaagatcagagaacctgtacatgcttcgtgattagtaatgggacataggggtagacaggaccgaaaaagtaaacaagcctattaactggcagcgttggttatttcccattacttatttctttaagtaattttcacctgtgcatctacatcttaagttttatatttatcatctgccttttattttttacagttaaaattctatcctgaattttagaaaatgaaagattcttttcctattttccccaaatcttttatagcatctgtcaatggttcaccatctgccacttctgaaagtgatgggtctagtacaggctctctgccgccgacaaatacaaatacaaatacatctgaaggagcaacatctggattaataattcctcttactatatctggaggctcaggccctaggccattaaatcctgtaactcaagctcccttgccacctgggtgagtaactttttaaattaacatatgttgtctttaggattcttcataagcctacttattaataaggaaaataacagtaaacaacagtaaactccattgttttgatgactgttttttaatttcttttttttttgagatggagtgctctgtctcccagactggagtgcagtggtgtgatcttggctcactgcgacctccgccccctgggttcaagtaattctcctgccttagcctccctagtagctaggattacaggtgtgcactaccaagcccggctaatttttgtatttttagtaggggatttcaccatgttggccaggctggtctcgaactcctgacctcaagtgatccgaccacctcaacctctgaaagtgctgggattacaggcatgagcacccagccaactgtttttatgttattgtaactgattttgggggatctggagtcaaaatgaacaaggaaaacacaccatatttgaaatcttcagggca

SEQ ID NO: 3438 - DNA, 1190 bp, Homo sapiens
gttatatgtagattgagaaatgggataattttcaccatttgataaatgagagaatagtggcttaagcaataccactttaatttgaaaaatgtggaactatctaaaaggatccagaaaagtacaattaattcacagcaatctgtaggatgaactattaggaaaagtggaagtcgaacaactattggataaaataacaatatgtgggctgtttatactttaaggaatacataagtggtttctttaaaaccccacatgttttttggtctctgttacctatttaaaggcttcaaaaccttaattgatagtgtttttcactggagaaagaagtaccagttttatttcttaagcagacctacttcctaaaacaatataatgctggttctcccttaacattatagccataaatttaaacatgagtactagcaaggaagcaaatagataacatattttaagaaattatgaaattcacatatgacaatgattatcacaatacagaaagagttctttaacttttaggctacatgtgtgtcccagatgatctctgttcccatgctcctgggaattcagcaggagtgaaagtgatggcagcagctattgcttttgtggaactgggctgttgattttgtaagttgtaagaagaatgttggccagccacggtgggtcacacctgtaatcccaacactttgggaggccaaggtgggtggatcacttgaggggaggagtttgagaccagcctggccaacatggtgaaaccccgtctctactaaaaatataaaaattagccgagcatggtggggcgtgcctatagtcccagctactcgggaggctaaggcaggagaattgcttgaacccaggaggtggaggttgcggtgagccgagatcatgccactgcactccagcctgggtgtcgagcaaaattttcctgggtggaggttgcggtgagccgagatcacgccactgcactccagcctgggcgacaagagcaaaattttgtctcaaaacaacaacaacaaaaaagaaggaatgaagcaatgttgccactatcgtgtctgctgcaaggcttgagggacaggttctcccaacagtccgttctccattgacaaatacttcctgtacccttccttttttaagttttggccagggaattggggaaacatcttttttgaggacattttgtgccccctctgtaa

SEQ ID NO: 3439 - DNA, 1293 bp, Homo sapiens
gtggaggaggaggagaaggctcaccctgggaggtcgcagagggtaggaaaagctatggagagttagtattaggtcaaccagaaggcttgccaaccatcagagctattcaagtagaatagatacatcatgtcattttctagctcttcttcggtgcagtatgttcaattctttgaatgtaatatcttattggctttttaccacaactctatgatataaatataattatattctccattttaaagatcagcaaactgagacacagagaggtgaaatgattccctgaggttgcctactagtgagtggtagagctaggatttgaacccaggtctagagttggattcttagccactgttctctaccacattggggcggacattcaagttttggccagtagactcagagaggattcaggagtcaatgactgaggatgggactccttgaaattttaggtccaattaagcctgcaaaatgttctctgtttcttcctccagcaccatcaaacaggatgactttaccgctcgtctctttgacatccacaagcaagtcctaaaagagggcattgcccaggtaaccattcccagccctactccagtctgtaacctgtccctcccatctctgtttgttttctgttttgcttgaagaatttggtccaggccctcagctcatgggaatctgcctctcactggtcctcactgggtttatcccagtgaccaattctaggatgaccagaagaatgattccactgggcttgggagtgtttgctggtacctctaatctctgtgtagagttcatggtacctgtgtgctctgtggctaggtcctcagagtcagtccctgggcaggtactgtcagccttcagttttccccacagactgtgttcctgggcctgaatcgctcagactacatgttccagcgcagcgcagatggctccccagccctgaaacagatcgaaatcaacaccatctctgccagctttgggggcctggcctcccggaccccagctgtgcaccggtgggtcccctgggcagcccccggcatacctgtggggtgacatgctgatgggtgtacagtcactggctaggccagggaactccagctatgattgtgctttcctgggccccgggtcacatgttgcccctggccaccccgacagcagtttccacttgtaatgagatccttggtatgtcagggagaaaaaggacctcatagctcatctagtcctgtccctccattgtacaggcagagggaacaatatcttgagagccccagagagaggaatgcagggacttctgtc

SEQ ID NO: 3440 - DNA, 1203 bp, Homo sapiens
gcagtgcacgacagaggcaggattctgcgtgatagttcttcaggttcacttcacagattagctgacacttaactgttctggaagctgggccaaggagtgctaacatggaaattgagtaactatagttttttgcccaaggtacaggagaataaatatgagtagatagaatctcttaaattaaaaatttctccagtaaatttttcctaagtctttgcctcctgcctgtttagttcccattaaaagcttggagatgaaaaagaatacaaagtaacaagcaagcattcgcagaaaaactcagttttctgagaacttaacttctatttagtttctaattgtatgttgcttacttggggctatgttccaggcaccttcagtatatccctctactccttacaacattaaggggtaggtatggttgtcagtattgctgttttacaaaggaggatggatactgaagcacagagaggtccactgatttactgaagaccacccggctagtgaatggggttcaaacccagtagtctggcttcagggtcagtgctcttaactaccgtgtcacactgtgtctcagtcacacttcattcagcagcttgtcgtcttccaaggttgtgattttaacatgacggggaaagatagttccaagtctgtaggatagagtaagttagattctctcttttttttttttttttgagacagtccagctctgtcgcccaggctggagtgcagtggcacgatctctgttggttcactgcaaccttcaccttccaggctcaagcgatccttccacctctccctcttgagtagctgggactacaggcgcatgccaccatgcccagctaattttttaaatttttttatagcaatgaggtctcactgtattgtccaggctggtctcaaactcctaggctcaagcagtccacctgcctcggcctcccaaagtcctgggatcataggcatgagccaccacacctagtcggaataagttagggtcttctgtcttgatactttaaagagtatcactgtgttttctgtatgagccttacctgaatatatctgataaccactcctctataacacatagaggcctttgcaaaaggcctctagggaagcagttcctgtaggaacttgagaggaccttggcagttactgattcatctgttcacctttaaaatgaggaaactgaagggaagtcactctgctaag

SEQ ID NO: 3441 - DNA, 1163 bp, Homo sapiens
agcctagcaccattgccaccagcatgcgggattccctcattgacaggtacctggggcctctcctttcttctgctcagggttgggggttaacttgcattttgagagtatggggaaaagatgtcatctagaatgggagcctaccagtttgttctggtagcttctcgagtgtgagagcatatctgtacactgctgagcagataagagccagcatattcaaaaaatatttcttgagcatctgctaatcctcatctttgtggtttttcagggctaggatactagagcagtagctgcttgagcagcttgtcagagctggtcccgggatgagggctgaggcaggcacctcacttgagagtgaggtgggctctgtgaaacagctactgaccgtgcgctttcctttctcttcagcctcacctgagtcaccttccaagttgttccatgggctcctggctctggactgtggccaaccttctccacattccgcccaatctgtaccggatgctggcagggaggtggcagagagctcactgggactgaggggctgggcacccaacccttttccacctgtgcttatcgcctggatctatcattactgcaaaaacctgctctgttgtgctggctggcaggccctgtggctgctggctgagggttctgctgtcctgtgccaccccattaaagtgcagttccctccgggccattctgaatgtgatgtttggggccctcagcctgtgtacaatccctgcactctccagttgttccagcattctgggaagatagggtgggatgaacacaacacacacccaacccagttcaccacctccacacacgccattcccttctcctctaccatcaggatgtgaggcttcatcctggggcaagaaacactctccactacagttctccttttttcttttttctttttgaggcagtgtctccctctgtcacccaggctggagtgttgtgacgcaaggatggctcactgtagccttgacctgttgggctcaagcgatcctctcgcctcgtttatttttttgtagaaacgaagtcactgtgttgcccaggctggtttatactcctgaactcaagcgacccaccgcctcggcctcccaaagtgttgggattacaggcgtgagccacggcgcccggtctagttctcacagttttca

SEQ ID NO: 3442 - DNA, 1206 bp, Homo sapiens
ccaagatcctggaggaggacctggaacagatcaagctgtccttgagagagcgaggccgggagctgaccactcagaggcagctgatgcaggaacgggcagaggaagggaagggcccaagtaaagcacagcgcgggagcctagagcacatgaagctgatcctgcgtgataaggagaaggaggtggaatgtcagcaggagcatatccatgaactccaggagctcaaagaccagctggagcagcagctccagggcctgcacaggaaggtaggtgagaccagcctcctcctgtcccagcgagagcaggaaatagtggtcctgcagcagcaactgcaggaagccagggaacaaggggagctgaaggagcagtcacttcagagtcaactggatgaggcccagagagccctagcccagagggaccaggaactggaggctctgcagcaagaacagcagcaggcccagggacaggaggagagggtgaaggaaaaggcagacgccctccagggagctctggagcaagcccatatgacactgaaggagcgtcatggagagcttcaggaccacaaggaacaggcacgaaggctggaggaagagctggcagtggagggacggcgggtccaggccctggaggaggtgctgggagacctaagggctgagtctcgggaacaggagaaagctctgttggccctccagcagcagtgtgctgagcaggcacaggagcatgaggtggagaccagggccctgcaggacagctggctgcaggcccaggcagtgctcaaggaacgggaccaggagctggaagctctgcgggcagaaagtcagtcctcccggcatcaggaggaggctgcccgggcccgggctgaggctctgcaggaggcccttggcaaggctcatgctgccctgcaggggaaagagcagcatctcctcgagcaggcagaattgagccgcagtctggaggccagcactgcaaccctgcaagcctccctggatgcctgccaggcacacagtcggcagctggaggaggctctgaggatacaagaaggtgagatccaggaccaggatctccgataccaggaggatgtgcagcagctgcagcaggcacttgcccagagggatgaagagctgagacatcagcaggaacgggagcagctgctggagaagtctctggcccagagggtccaagagaatatgatccaagagaagcagaatc

SEQ ID NO: 3443 - DNA, 1179 bp, Homo sapiens
ccaggctcccctcccaccccaggtactgaggacaaatcagttctctgtgaccagacatgagaaggttgccaatgggctgttgggcgaccaaggccttcccggagtcttcgtcctctatgagctctcgcccatgatggtgaagctgacggagaagcacaggtgaggatgggggcaaagcggcctctgggggcctgggcctgagggaggaggatgcctgctgagcccaccctctccttctaccaggtccttcacccacttcctgacaggtgtgtgcgccatcattgggggcatgttcacaggtaagaggcccagggcgtctgtgagctgtggggtggggagggtaaagcctgggtgccccaggtttggttgggggtgaaggggcagatgctggcctggccagttaagtgacaaggctctcagcgtcaaaagccaaggcccccactgggccagtgccagcccttgtctctctcccagtggctggactcatcgattcgctcatctaccactcagcacgagccatccagaagaaaattgatctagggaagacaacgtagtcaccctcggtgcttcctctgtctcctctttctccctggcctgtggttgtcccccagcctctgccaccctccacctcctcggtcagccccagccccaggttgataaatctattgattgattgtgatagtactcactggtctccgtgtgatccttgccatggccagagcctcatcctggccactcactgaaggcaattgtgactgacagatcggggcccagagccctcgggagccccacatgggcatcccctagttaaccggggtttattcaaaccagattcatgtccagcccacagccctgtcctgggtccctcctccactgtggtcctcaggcctctcgggttcagccccagggctcagatggaccttttcagcgtgagcttcctggagccaccatggcccccaggctcatgagtgatcaaccccaggccactaattcagggccctgagtgcatattggggcttgccacttcttcattgatgggtaaagctggggccgctctccgccaccctgggctcaatacacctgatcctgtcacactcactgatcccactctgtgccaaaccccacgctggctctcactgcagagaggaatccctccaggtcctctgcagtctagatgga

SEQ ID NO: 3444 - DNA, 1218 bp, Homo sapiens
caggtgaggagcttgccccctaagtggactgcgctggagaagagaacctggggagggacttattctcatctgccacctggcttgtttatgtccacacacacctttccctcaggtgcaatgctccgattatgacagtgacgggtcacatgatctcatcggtaccttccacaccagcttggcccagctgcaggcagtcccggtgagtgctggtcttgccaggggtgtggaaatgggcctagatagctgaagcttgtgggagagaggaaggagaaggcagctcgagtccttgactgatgctctgagaatttcctaccctaatttttctgtcctcaccaggctgagtttgaatgcatccaccctgagaagcagcagaaaaagaaaagctacaagaactctggaactatccgtgtcaagatttgtcgggtgagacaaaagcccatgtaaccaaggctctgattcctgagctccatgacaccaactgctatcaccccaggcatgaccctggtttcatttgcaggtagaaacagagtactcctttctggactatgtgatgggaggctgtcagatcaacttcactgtaagttactttaccaagggcaagagaacaggtctggggctcagggtggcctttagctgccttcctcacctcctcccaggtgggcgtggacttcactggctccaatggagacccctcctcacctgactccctacactacctgagtccaacaggggtcaatgagtacctgatggcactgtggagtgtgggcagcgtggttcaggactatgactcgtgagtacctgcttctctgggctatacccgctccctgcagatgcttcagcctctgagcttacagtcccctcactgccttttgcccaatacactgtcctcccacagagacaagctgttccctgcatttggatttggggcccaggttccccctgactggcaggtgagctccctctctttctgccactcctgttttcagtttcagggtcctgattttgggggatgtggtaaatttacttgctacttggcactcagctttaagaggagatgcagggttggattcctgcaggcacgtagacagcaagtgctcaggactccatagctcctataggaatcttggcacacgccagtgtcctttttcattcttagcagaggtcatggggaaagaacctcattttcattcttgtctccaggtctcgcatgaatttgcc

SEQ ID NO: 3445 - DNA, 1144 bp, Homo sapiens
ttaagagggttaaatagtttttttgtttcttttttttttttttttttttttttttgagatggtcttgctctgctgcccaggctggagtgcagtggtacagtcagctcactgtaacctcgatgtcctgggctcaagcaatcctgcttcagcctcctaagtagctatttttttttttttttaatttttttgtagagatgaggtaattgctggggtaggggtgatggtggagtggaggggtagtttcactatgtggctcaggccggtcttgaactccggggctcaagtgatgctcccgccttggcctctcaaagtgctgggattacaggtgtgagccactatgcctggcctcagtttcttaaaaggttttaaatcacaccaactggtaccagtgcctctgattgccttgatttttctgtgatcccacttggaagtttgttaatgccacactccactatactccacacattagattgcagtgggggctggagagtggcccagcctttatacataactcccttctgtggtttggcctgtgggaccagtagggtccctgtgctgtaactctgactgaagtgatggacattaatgcaactactaattactgatgtagatgagctgctttacttctatgaccattgaattgacagattggaattggaagcacctgtcaccttcaagcttttaagacaacttcacatgaatgtacagcttagccatagctgtatctcatactaacagatttttgcagtggtgtgcacccagcacttatactttggtggaaaagcaaaataaggttcctgttcttcaacagttgagggttttaagtcacaactaagtgcttggttgtgcttatactaggtacattcctataccacgggaaccaggtagtggctttcctggccatttgctaagttatggttagacaggaacaagtgtaaactagtctttgtcatagtgtagtttcctgttgttgaaatattcctttgctttctcggcttccctaacatgtaaattctgaagacccatcttaaactctccccagtgtcccaaatgaatttattccagtgaagggtaaggggcttgcattatgaacaataggtaggtttcttttccaagagctctggtctgcttttgttcatttact

SEQ ID NO: 3446 - DNA, 1173 bp, Homo sapiens
aactttacactctaaaggtcattttcacatttagaggctgttattgccatatccctagattgtaaattatcatttacagagcacttactctatgttaagcactgtgctaaatactgtagttttcaaaatcctgtaaataatgttgagatgcccattttacacttgacactatgtgtaaattgtagagctgactcttgaacccccaccttactccaaaatcattaacaccaagaaactaaaagacagatgtctttattgggtcttaaactgcaggcaacaccagtcaaaaaagctggtttctctatgtattttacactgcatctgctgcctcccacaaactgaaggcagttaatacgacatccaccagaaaaataccctggagacccagatggatctttttccttctcattacccaccccaggtagtaagatataatatccagtaagtggaaaatcagatgtaggggttgctagactagtgttagcaaaaaattggaaaggagcagttaatactctttctgatatttttgttaccaaatagctccatcttggtttcctcctcaggatcggaatgcggggtcgagagctgatgggcggcattgggaaaaccatgatgcagagtggcggcacctttggcacattcatggccattgggatgggcatccgatgctaaccatggttgccaactacatctgtcccttcccatcaatcccagcccatgtactaataaaagaaagtctttgagtagtcagtgtccctctcttaaaggaatattcttctctcagcctattatccagctttgccaaggatcttctgcactaaagagatggactaacgtaatgactagggttagtatctctttcacaaggcctgcctctcttaatccaaaattggaaaacttgggagtgtctagtattttccatagatactattcaactaattactcagtacaactctgtgcttgttactacggtcaccattttaaaggagaaaaactacttcaaaaaatggatttataagccgaaatttcctcaaggtcacacattgcattatttccaaagcaatgttcatcctgaggttggttgtttccttggtcgcccaggttggagtgcagtggcacgatctcggcttaccgcaacttctgcctcctgtgttcaagcgtttctcctgcctc

SEQ ID NO: 3447 - DNA, 1205 bp, Homo sapiens
ttttctccagataagccattgtgggtatatgtgtaaaccaaaattttatatatatgtaatttatatcaagttatgtatttatttgcttgtgtatgaagtatttatgttttatatatgaggattatattgactattttgtccctgggcacatttttgttagaaaagtactaaattctacctcaggtggtctgcctgcctcggcctctccaagtgttgagattacaggtgtgagccactgcacccagccagttttcacattttctaaccacaatccccatgttctcaaatataaagctgtcattacttgtaatatcttttatttaaactaccacatcaacaagcctaatttgcgttagctagcgtcgtcatcatgtatgttgtgtttgctacttacagcttgcagtttctaccttagtattcagaagtaattattgaatatgctaaaaatataaatatatttttaagtatagtttgtattttaaaaattaaagcactgtctcctgtccttgcctcccctatcatgtagttttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtaagtgtttcttgctattacgaatgatttactgtgggtattgtagtggaaaagaaaggtagccatgtaaactaagaaagggaaaaagattttatcttattttgtagttggcgttatccttggtcacactgcatattattttatagatgatgtgccttgtattaatgtatggaaatctatattatgtgttttgaatgccacagtataagttgcaagatttcttttcctttatgtagtgtttatatgtcatacttaggaataaatttagttgcagctattataatgttacaagtttttctttttgtaatttcttattttttgatgcagggtctggctctgttgcccaatttggagtgcagttgtgcgatcctggctcaccgcaacctctgcctctttggctgaagccatcctcccaccctaatctctaaatagctgggactaacagttgcaaacaaccaccaccacgcctggcta

SEQ ID NO: 3448 - DNA, 1201 bp, Homo sapiens
ccattaaagaactcatctatgtaaccaaaacccacctgtacctgaaaacctgttgaactatatgaagaaataaaaaagataaaaattattttaaaatctgttatgaaattaattttatatgttttactcctattagagaacctattgataatttaactcctgaggaaagagatgcaaggacagtcttctgtatgcagctggcggcaagaattcgaccaagggatttggaagagtttttctctacagtaggaaaggtaatcttaacctgtttagggaggtcaagtaggtagaaattgcaagagaaaacatgtaaacatcaaatacttcatttgatttagtagcagtatttgtttgtggtaatgtttccattttgcctcttgtagtattggagttgataaatgttactacaaatttgttcaaagataaagataggatataggaattgtcctacagatttacttttttaattaaatttttaaaaataccttcatccttcaacagtgtctcttgaaataattctacatgtgttacaatggatgtttgcacaaacaactgtgttttctttctaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggtaatttttttgttggttaagagtttgattattggtggtgttgaaagcctcctgttgcatggtatagtgctgttgtgttctgtgactgctgctcattacgttgagtcggatgttttcaggactttttttttttttttaactttgcgtttattaacattgatacagttttctcaagactgtcgtcctgtcgtttctccttgtgtttgaaatgtaatgattttgccttttttttgttttgtttttgagatggagtctctctcaccaggctggagtgcaatggcatgatcgctgctcactgcaacctccacctcctgggttcaagcgattctcctgcctcagcctcctgagtagctgggattacaggagcctgccaccacgttcggctactttttgtgtttttagtagagatggggtttcatcatgttggccaggctagtattgaactcctgacctcaggtgatccacctgccccagccttc

SEQ ID NO: 3449 - DNA, 1216 bp, Homo sapiens
tttgagacggagtctcgctgtgttgcccaggctggagtgcagtggtgcagtctctgctcactgcagtctccacctctcgggttcaagcgattctcgtgcctcagcctccctagtagctgggattacaggtgcccaccctggctaatttttgtatttttagtagagatggggttttgccatcttggccaggctggtctcaaactcctgaccaattttacggcattgtatccctaacttctagaacactgcctggcacattgtagatcttctgatcttttgttaagctgtctggtcttttgttaagtgatcattctggccaggcgtggtggctcacacctgtaatcccagcactttgggaggcggagacaggcaaatcacaagatcgggagtttgagaccagcctggccaacatggtgaaaccccacctctactaaaaatacaaaaaattagctggatatagtggcgggcgcctgtaataccagctactcgggaggctgaggcaggagaatcgcttgaacccaggaggcggaggttgcagtgagccaagatgatcatgccactccactccagcccgggtgacagagtgatattccatctcaaaaaaaaaaaaaaaaaaaaaagtgatcattccatgtagaacgttgtactaagtctcatatgcaaggtcttcttcttttgagacagggtcttgctctgttgcccagacgggaatgcagtggtgcaatcatggctcactgcagcctcaatctcccaggctcaagcgatctttccacttcaacttcccaagtagctgggaccacgggcccaccacacccggctaatttttaaatttttttatagagacagtgtctcgtattgttgcccaggctggtcttgaactccgggctcaagtgatcctcccgccttggtctcccacagtgctaggattataggtgtaagctcgtcctgcagagtcttttataagcccttaaagaacttggaattgattggactgtattccatttttctaaattttatctctatgcctggagcttttactgacttcaaaatgcagtatgaagtattagttttaaggtttttttgttttgttttgttttaagcagtgaaagcacagatttattgaaatgaaagtacactccacagagtgggagcgggctcaagcaagtagctcaagagccgtttttttggtttgtttttgagacggggtcttgctctg

SEQ ID NO: 3450 - DNA, 1131 bp, Homo sapiens
aaggcctgtcctctgggagtgacctttattagtccaccccttggagctagacatcctgtacttagtcacggggatggtggaagagggagaagaggaagggtgaagggaagggctctttgctagtatctccatatctagacgatggttttagatgataaccacaggtctacaagagcgtttttagtaaagtgcctgtgttcattgtggacaaagttattattttgcaacatctaagctttacgaatggggtgacaacttatgataaaaactagagctagtgaattagcctatttgtaaatacctttgttataattgataggatacatcttggacatggaattgttaagccacctctgagcagtgtatgtcaggacttgttcattaggttggcagcagaggggcagaaggaattatacaggtagagatgtatgcagatgtgtccatatatgtccatatttacattttgatagccattgatgtatgcatctcttggctgtactataagaacacattaattcaatggaaatacactttgctaatattttaatggtatagatctgctaatgaattctcttaaaaacatactgtattctgttgctgtgtgtttcattttaaattgagcattaagggaatgcagcatttaaatcagaactctgccaatgcttttatctagaggcgtgttgccatttttgtcttatatgaaatttctgtcccaagaaaggcaggattacatctttttttttttttttagcagtttgagttggtgtagtgtattcttggttatcagaatactcatatagctttgggattttgaattggtaaatattcatgatgtgtgaaaaatcatgatacatactgtacagtctcagtcccataaaattggatgttgtgcctacacacaggatctagaagaatatgtcaaactataaactgcttgtgattgtgaatgactttgttctttgcttgtgtttttcaatttcctataatgcacatactaacttttaaaaaataaaggttattttaaaagcctgtattaagccctcgttgcttgtagaatagagttagtatacgctacagaagcacaggttcatgctccttcatgcttgggctctgaggtatctggaatttctc

SEQ ID NO: 3451 - DNA, 1158 bp, Homo sapiens
ggagagaggagggggaggtgcagagagctctatgccatcctgtttacagcgaggcaagatgaatcattatgtctgtgcattttgttttacttatctgtgtatatagtgtacataaaggacagacgagtcctaattgacaacatctagtctttctggatgttaaagaggttgccagtgtatgacaaaagtagagttagtaaactaatatattttgtacattttgttttacaagtcctaggaaagattgtcttctgaaaatttgatgtcttctgggttgatggagatgggaagggttctaggccagaatgttcacatttggaagactctttcaaattataactgttgttacatgtttgcagtttattcaagactgctgtatacatagtagacaaattaactccttacttgaaacatctagtctatctagatgtttagaagtgcccgatgtatgttaaatgtataggtagtaaaataccactttgtaaatatctttttgctaaaattcataggaaatgcttttggaaattgaattgtgaagccacctttgtgaacagtatagtaatgtctatacttgttcaatagtttagaggaggtaggagggaagaaattgcaaaaggtaatattactagtgtgttcatacttggacattttcagacaccatttttctatatgttttgtgcattttgttttgctctgtatatagtatatataatggacaaatagtcctaatttttcaacatctagtctctagatgttaaagaggttgccagtgtatgacaaaggagtaaaattagcatattttgtacactttgtgttgaaattcgtaggaaaacttgtcttctgtaaagacttttgcataggaatttgtttgaccatctctaagcattacacgtgcctgtacttgtccactggattgaaggcagagaaggaagggaggagggaatgattcaaggccaaaatggccacatttagaagatacctcagatgataaccattgttatgtgtgtgcaattttatttaacagtgctgtgtatgtggtggacaagttatatgaaatatctagtctttctagatatttggaagtgcttgatgtatttaaaagtggtagtagaataacactttgtaaatagcttttaaaaactgatgggaaatgctgtt

SEQ ID NO: 3452 - DNA, 1191 bp, Homo sapiens
atcctaggttattgctagccaaaatatttttgtcctgagtagtgtcactgggccaaaagatagatcaggacgacagcctttagttttcctgaaatcaccaggtcaggcacaaggagaaaaggttcctggatactgactaacttgggtgggtggatctagccaggagaaagacagtaacatgtgttctgtactttctgggaagatccctgaagccatcacagaggctccccaacttctgagtcgcccatctgttgctgtgggagtgtgaacggatcgctgaaggagagggagctttgctctctctaggtgggcaagtttcctgggctctctgtgttgcctccctctggcttcttcctcccgtgccctctccccgtgtgccccagggggatcagggatcctcaccctcctgaggcccagtggggaagaatgaacatggcttcatccaggttaactgatgctgccatttgcccagcctcttccatcccagccctgtcagtgagcccaggtctggtgcaactgctgcaggatgcctgtagtagggaactctggaagtgtattgggctgaggtgggattttccctccccacagtgcactgagcaatggagggtggtgagggagccatgctgctgaattctggttggcatttccccattatgtaaaatggggtgttgggtagggcagactctgcttgggtttggttgtaagataaacctggaggagaagcacagttgtcccattgaattatttgagcaaaaactactgtaaataacttttttgtcttttgtcaaataaaatttttttttgtttttttaagcagaaacagggttcttgattgatccaccagggctcagggcccaggcttgaagacaaagcagtcactggcttcttattttgctttacatcttttactctccctctagtagccagctgtgagttctgtgcacgctgtacccccattccctttcaccagctccattctgtatcccattcaactcagggtaaagggggcatttgcatctcacattgggccagtcttccctggaatcaacagttaagctctggggttgctaagtggtgaggatgtaaccttgaggaactggcaactttgtcctccccctctctcggtaagaaacaagcatgactgcagtgtgaacccggcacagagagaagcagctatgagatggaagctcc

SEQ ID NO: 3453 - DNA, 1206 bp, Homo sapiens
tgcggtgactacaatcagctgagattccaaccagatctaaaggattaaagtggcctcacatatcgccactcacctagagcaaatgatacaaaatggggatggctatatcttgtcctgggtgtcatggtaaatgagtcggaaaagctaaacataaagactttgatgagactcctaggttagctgggcttaaccggggcttcatcttctagtccccttggttctctgttacagtaccatctgccagcatgactcggctcgcccgatcacgaacccactcaacctcgagtagcctcggctctggagaaagtcccttcagccggtctgtcaccagcaatcagtcagatggaactcaagaatcctgtgagtcccctgatgtcctggacagacaccagaccatggaggtgtcctgctaagcagatgctcctcccctggaccattgcaagtccatccttcaaatgaccactccataatataacatttcatccagtaaactggcctctactatctttaactcatgcatggccactgaacctctctctagtagcctggatttatcattctctctgcctgcccacccccttttttgtatagcccaagaaccacttccatgccatactgtaacattccaacatctttagctgatcagatctctccatatcctctcttgccagctttttcccgtgctcccccaactatgtatcagataagattctttgatcccgactctgtgtgtgcgagcacgcgtgtctgtgtttgtgtgtgcatagttctgtggttttagacacgctttcttgtagtgcttctgcaaaaaacaaaaaagggacttattttgcattctcaatggtgtttttaagggaattaggcagaacagatttctaggttgggtaggccactgcattctcttttgtttgcaaattggtcaacaaaatttgcaaagtgatttcaggagagagcagctttgaggaatgtggaaaatcataattgccgtctggaccattgattgattgtgaccagtagcagaagggtgcctgttacatagagaggctccttctgtccaaatgaatttctgtatactcttctataaataaaagggaggaatatattctgctggaagcccatgaaccatcgctgaggttctgatacaacatagagttttttccaaggagtgaatgtggtttaattactggactctcttagcacaggaag

SEQ ID NO: 3454 - DNA, 1099 bp, Homo sapiens
tggtggcgcacgcctgtaatttcatctgctccggatgctgagacaggagaatctcttgaacctggagggtggaagttgtagtgagccgagatcatgccactgcactccagcctgggtgacagaacaagactctgtctcaagaaaaaaaaaagaaaaaaaaaagccaggtttggtggtgcacacctgtagtcccagctactctggaggctgaaatgggaggatcacttgagcccaggagtttgaggctgcagtgagctattattgcactactgcattccagcctgggtgacatatcaagacctgtttgggagaaaaaaaaaaaaaagaaaatgcagacagaatgtgggactgggcaccaacaacatctctacaagaggtgaacaagacggtcctggtctttgccctcacgcagcacacggaccagggtggtagaccagagtgtgccctcagtgttatttccactaataacgacgtttcctcctctgtccttcgcagaaccaaatctgtttcttccatgtctgagtttgaaagtttgctcgactgttccccttaccttgctggcggagatgcccggggcaagaagctgcctaacaaccctgcctttggctttgtgagctccgagccaggggatccagagaaagacaccaaggagaagcctgggctctcgtcgagggactgcaaccacctgggtgccctggcctgccaggaccccccagggaggcagatgcagcgcagctacacggctcctgacaagacgggcatccgagtctactatagtcccccggtggcccggcgcctcggagtccctgtggttcatgacaaagagggcaagatcattatcgagcccggcttcctcttcaccacagccaagcccaaagagtcggccgaggctgatgggctggctgagagctcctatggtcggtggctctgcaacttctcacggcagcgcctggacggaggctcagcgggcagcccctcggcggccgggcctggcttcccagcggccctgcatgactttgagatgtcaggcaacatgagtgatgacatgaaggagatcaccaactgtgtgcgccaggccatgcgctccggctcactggag

SEQ ID NO: 3455 - DNA, 1138 bp, Homo sapiens
ggggacctggacagcgcgctgtcagccgaggagctggccgatgccccccactcgcgggagaccgagctgaaggtgcacctgaagctggtggaggaggaagccaacctgctgagccgccgcatcgtggagctggaggtggagaaccgaggcctgcgggctgagatggacgacatgaaggatcatggaggtggctgtgggggtcctgaggcacgcctggccttctccgcgctgggtggcggagagtgcggggagagcttggcagagctgcggcgacacctgcagtttgtcgaagaggaggccgagctgctgcggcgctcctctgccgagctcgaggaccagaacaagctgctgctgaacgagctggccaagttccgctcggagcacgagctggacgtggcgctgtcggaggacagttgttctgtgctcagcgaaccttcacaggaggagctggcggccgccaagctgcagatcggcgagctcagcggcaaggtcaagaagctgcagtacgagaaccgcgtgctcctctccaacctccagcgctgtgacctcgcctcctgccagagtacgcggcccatgctggagacggacgccgaggccggggactctgcccagtgtgtgcctgctcccctgggcgagacacacgagtcccatgcggtccgactctgcagagccagggaggccgaggtgctgcctgggctgagagagcaggccgccctggtcagtaaggccatcgatgtcctggtggctgatgccaatggcttcacggctggcctccggctgtgtctggacaacgagtgtgctgacttccggctgcatgaggcccccgacaacagcgagggccccagggacaccaagctcatccatgccatcctggtgcgcctgagcgtgctgcagcaggagctgaatgccttcacgcggaaggcagatgcagtcctcgggtgctctgtcaaggaacagcaggagtccttctcatcactgccccccttgggctcccaggggctctctaaggagattcttctggcaaaagaccttggctcagactttcaggtaaggtgcctcatgcacagatcctattatttatttttttcctttgttttgttttgtttttcttgagatagggtctctccccgctggccag

SEQ ID NO: 3456 - DNA, 1130 bp, Homo sapiens
tggaggtctgtcattcagcctgccacatccaggtcccccacggtgcttcattcagtcctaggtgtggccagtactccggcctcctagctgctactgtgggcccagtgacctgactcttccttccctccgcaggacgagattgaggagctgcgggccgagatgctggagatgcgggacgtctatatggaggaggacgtgtatcagctgcaggagctgcgacagcagctggaccaggccagcaagacctgccgcatcctgcagtaccggctgcgcaaagccgagcgccgcagtctccgtgccgcccagaccggccaggtggacggcgagcttatccgtggtctggagcaggatgtcaaggtcagcctgggctcgggtgcccttgttgctgggatgggaccacaagtctaagtggggcccaggttggccttgcatctcatttccgtgtgtccatggccaagttctaccacctctctgggcctcagtttcctcatctaagtaggaattcctggtgaacccacagggcttctatcaagggtatcccaaaatgatatcataatatgaatccttcctactagcagcagctactgttttttttttttcctttgagacagagtttctctcttgttgcccaggctggaatgcaatggcgcgatctcagctcactgcaacttctgcctcccgggatcaagcgatttctcttgcctcagcctcccaagtagctgggattacaggcacctgccaccacacccggctaatttttgtatttttagtagagacagggtttcaccatgttggccagcctggtttcgaactcctgacctcaggtgatctgcccaccttggcctcccaaagtgctggggttacaggcatgagccactgcgcctggctgagaagctactgtttattgagtatcaaccaccacctggtgctagcctctaattgtccccgcacagttccatgggggtttctttttcttcttgtttttttagagacaaggtcttgctctgttgcctaggtatcaggcagtgatgtgatcatagctcactgtagcctccacctcctgggctacccccacctcagcttcctgagtagctgggactacaggcacacaccaccacacctggctaatt

SEQ ID NO: 3457 - DNA, 1099 bp, Homo sapiens
caggccctgtgctgggtgtctggacccagtggccacgtagtaggcttctgcatgtagctcttctcttcttggctcccaggagctacagggggaggactctagtctgtcactgggtggaggagaggaggtcaccacagtcagcaaagctcttggctgctccttaccctgagtcccagccgcagcctccttggggctgagcctgtgtccctgggcatactctgtcttgcacatacaaatgcacatatactgttcacagctcaagctcagagacacacagccacttgcacacatctcacagacccatccagtgactcgctggtgttggatgctttcagaagcacgcctccagacagattagagaggatactcactcagagaagtgcacaaacccatgcagccacacaactcccattctatcacacgcacacatcaccaaacagacacaacggaggctcagaccctgctgcaacccccacgtcagaaacacattctcatatacacatcttacacccctagacacacccggatatgtcccagagacagactgacatcctgcagacacactcagacttatcagaagtacacatgtaggcggagacacaaacccacacagacgttatacacacacactagcatccacagaagtctgcacatctacccttgccaggctggcccaggcacaagctcaccacccgggtacctcccctgcctcttctacaaagagagcagcagagacttgcacacctacccgaggcttacagacacccaccaaggggactcccacatgcacatcagcagggacacagcacagtctggcatgcaaacattaggcatgtagcatttgcccacaggagccagaggctctcaaaccagggaacctagacacacgcacacacgtgcgcgcacgcacacacacacacacacacgctgtgacatttcatccacacacagaaacaggaaatcctggtctgtgtctccctggagctaatgtgtacaaactactactgttttcagtggctcactagacttacttctacaaggctgctgggaacactaaggagtgtggccagggccttgactttgtaaccttctggagctg

SEQ ID NO: 3458 - DNA, 1146 bp, Homo sapiens
agagtgacctaagcataagtgaaagacacctcccctcacccttctagccccctacaaggtgccaggttggggtaaagagttggagatgatggccaggagtggcctccaacacgctggtgagaggcctgattaggttttggggaagatctgagagctctggcctcttcgtgagtggaacataaagccgcctcttgttgggagatcctaccccagtgacagaggaatcccccaaactaggctgtgccctggctccgtggcggctccagacccgggtagtgcctttgtcccctgaatactcactcccccggtccagagggccttcccactgcccagcctggagaaggcctcccctgacctgctctctcagtatcctggagagctggccagaggccatcacaggcatcatcctcagagctcctcagacctgggactttgtttttgctggttcagtgcattttgtgtatttaagagcaaacactagccaggcgtggcggcgtgtgcctgtagtcccagctacttgggaggctgaggcaggaggattgctcgaacctgggaggcggaggttgcagtgagcctagatcacgccattgcactccagcctgggtgacagagtgagactccatctccaaaaaaaaaagcacaaacactgcactgcctgtgctgaaattagtgaccacccagtgggctccaggctccgctaggtaacttcgttttcccagcagtggagtgggcaccaccttggtggggcagtgcccctgtgcccagggcacacctcattcccagttctatagcaattcaccaagaacaaagtctgcagttagagccaaagctggtggtggccagagggtgctgaagatacaggccagtggggatgggagccatgagccccgaatgtcttctgctctgatgctccccggactaagcctccctggcacactgggagtgaggggcagcctgagcaagtaggggaactcagaccacaggccagcagatttcccagcagtccatcactggccaccgtgtagccagattctgttccgtccacactggggtgaagagtacttggaatgtctgccatcctgtatgatcaccccaccccctgtccatccatcagtagataataagggttggttacaattcataaga

SEQ ID NO: 3459 - DNA, 1175 bp, Homo sapiens
atacaggaaggccgttttcatattatagcaggcactattggggttacgtagatgtgaaagttaaggccctggcctttgagatatggcatagctcatgggagggatgagatctgaattctgataacaattcaggatgatgtagaaaagtgaattgtacaatgtgcaaaatgctaattaactaataaccaacatttgtgtagcatgttgttgtttacatagtgccttcctgcatgcctcactttggattggcgtgatgagagtaaacgtcttgcaagacagggcatttgagcaaggggttgaagaatggcaagggtttatcagatctggggctgtggggtgatcattggggaagggcttgcagaagagctcaaggtgctttcagtgcaatgggagcggttgtgttttgccagagcacctgaatcctgtcaaaagcaggaggtgatgagcttggaaaggtagcagaggccaaattgcaggctttgaatggtggttgactcactttgcaagacaaaggggcagctgcgttttctcgtgtggtattcaagacttcttttcttctcctggacttcaggctgtttttgtacaagagcgcatactcatttctttctctctttttcaaatgtgactaaatcacacttcccagggacaccaagctgtttctgattgcaactgtaacagcctgtgtaccagctgggatttttgtattaagcagctctatggggctactataccagcagaaaattagaagtcttgctctaaaaagcattttcagcaaatacttgttttgttcttaaagtttttactgcctcaatttgtcagctaatggatcagaagtgattgggactgcctggagcttttttcagttatggtcttagatgtgagtcagagaatattatctattgagtttcacccacttctctgcccctgtgcttttacagactgtccttatttttctaggctgatgtggtcatcaagttccctgaggaagaagctccctcgactgtcttgtcccagaaccttttcactccaaaacaggaaattcaggtatatcccaaagggcctatccactaaacgtgggagaagagagggcaacaaagccctggacagtggctctgctccctttaacttgttttgtgatgttttatagtttgatcctcacaccctgtggattaggc

SEQ ID NO: 3460 - DNA, 1201 bp, Homo sapiens
cagagtggagcctggccaggggtcagccttggaagggcaggaaagtgctggggagcaggcagggcagggccctggagcaccggagtcccacgcagctggcaggagaaacccttcaaaggaatggaggaggcccaactgagaggtgcgggaaagtctggcctccgtgtctggggcccagggagaggctgctgtccagaagccagcactggcctccatggggcaggggagcgaagaatggataggctgcaggtttgtcaaggagcaggtaggcagacttgcggggcactatgaggggcttagggcaggggtcctcagttgcagaggggaaggcagagaaacctccaggcctaatactccctccccagctcatctgtggccaaacaggagggagcctatgagggcgcacagtctcacccccacctccaccacctcatctacctgctgagagggccatggggaagagagagcgtcaggtgggggtgggagtgagattttgcggaaaagattgtgaagacctggggcacattagaggtagggcagggagaggggaggggtggccagacagctgggtctgggagtgggggtgggggtaggaggatggagagtttgatcctggctcagggagtctgtgaagctggtggaaccagtgaacagagcaggggagagaatagtgaacatgtgatgtctggggcttgagctgaagagccgtgatggggggacactgaggtgaggcagtttgttgcagggcctttgaattcccaggagtggacaagcagggagatctcagggagggagagaagcagaagagggaggcgcagctgcagaggcatctgcgctagagcaaggaggaggcaaaggggctggagaagtagccaggagtgaccccacccatgcacacatgcacccacacacatacacacatgcgcacacacacatgcacacgcaggtgcacactcatatgtatacacatatgcacacacgcacacatgtgcacatgcacacacactgtgatttgcagcgtgacataaagtcttaggaagcctccatcagccatcttttagtgcaggcataactgctctgtattctccctggactctgagctcccacaggccatggcctaaggctttgtggcctgtgaccccagcgaatacccagtgggtgctcagtgcaagtctgttaatggatggatgaaaggatggac

SEQ ID NO: 3461 - DNA, 1136 bp, Homo sapiens
cattgtcacctctgtgacccctccttgtcagggtctccttccttcccagaatgttactgactcctcagtccctcttctggtttccctttatttctcttctacccttttccttttttggggagtacctgtccaagacagggctcatttttgcacttatctcgaatttgaagagattgctgacgcccgagagcctcgctttttcatccttctttccttgttcagcaggctagacagaaacatgtcttgactgttagttgtccacaaatcttcagtattttctccacttcatttttaagaaaggaagcaacagatagatgttgctctttcacctgggtgtctgggctcaagctttcccgcccagcctcacttcctttgcccttcctcctgcctttctcaactgtcccaaggagggggcctcattgtgtctcccgtgcatgctctgcagcattgaagtatggtgtgttcacgtagttctagcagtccccagctgagtgagtgggagagtacctgtgtgtttcgtaacggccttgatccccttgatagatgtttggatattttttggtgtgccctgtgtgtgtgtgtgtacaaatacatgtgtatattccttttaaagaagctttatcgaacgtggtctgattttgaggtttagcaatagctagctatatatggtaggtgccgctacagtttttatttagcatggggattgcagagtgaccagcacactggactccgaggtggttcagacaagacagaggggagcagtggccatcatcctcccgccaggagcttcttcgttcctgcgcatatagactgtacattatgaagaatacccaggaagactttgtgactgtcacttgctgctttttctgcgcttcagtaacaagtgttggcaaacgagactttctcctggcccctgcctgctggagatcagcatgcctgtcctttcagtctgatccatccatctctctcttgcctgaggggaaagagagatgggccaggcagagaacagaactggaggcagtccatctagggaatgggactgtgaggccatacttgtgaaacgtctggactgctattctagagcttttatttggtgtgttcgttgcacagctgtttgaaatgtttaataaagcttt

SEQ ID NO: 3462 - DNA, 1182 bp, Homo sapiens
acgctgggctgtttgaaaaaggcaagcttagcctaggctgccatcttaaaatatttcgaggctgtagctgcctcaggatcctttgcctgtggtctggtggccggcagtgccccgctaacagctttaactctgcacttagtgcctgagcacctatggctgtgagagatgctagatacagaaccctgtccttaccacgtgggggcacagcagggagcccttggtcgtcctttggcaaccactgggcggtattgtgaggtctgggccccttgaggacgggctgcagccccaggaggcgatacatgatctctgctgggcagggcccaggcaaagccagcccactgtgtgaaaccgtgccaaagagccctctccccgatcccccaggagaagccccggggagacatcccaggaagcttcccgaattagtgacttggagaggagtagaactttcacgggtgggcagggaggaaagggcatttcacatttgctgttgttaaccatgatccattttcccaaataagtatacattctgttcctgttttttttttttttttctttttttttttttttttttgtctgtctgtctgttctttgtctgtttgtctgttgtgttgacttttctcttcaggatccctgctgccttggtgatcccgggctgacagccagagagcacagcggctcagctcctggagagtgagggttgaagaaagcggagggcagccgcctgcgcccgctggctcccattaggtcggttcctgcagcggtgcccggcagccttggtgaaggccctgcccggcagagatcatgtattgcctccagtggctgctgcccgtcctcctcatccccaagcccctcaaccccgccctgtggttcagccactccatgttcatgggcttctacctgctcagcttcctcctggaacggaagccttgcacaatttgtgccttggttttcctggcagccctgttccttatctgctatagctgctggggaaactgtttcctgtaccactgctccgattccccgcttccagaatcggcgcatgatcccggcgttgtgggcacctaacggcctgccctgttagctttccaaggaagcagaagacgggaggggaggcattgacataggtcataaagcattggagtttcaaatcccgcagcctcgcgggtgtcacattcctgacgg

SEQ ID NO: 3463 - DNA, 1209 bp, Homo sapiens
cggttcacctgaggtcgggagttctagactagcctgactagcatggagaaaccctgtctctactaaaaatacaaaattagctgggcgtggtggcacatgtctgtaatcccagctacttgggagcctgaggcaggagaatcacttgaacccaggaggtggaggttgtggtgagccaagatcacgccattgcactcccgcctgggaaacaagagtgaaactcagtctcaaaaaaaaaaaaaaaaaaaagaaaggaagaaaagaaaattacaaagaacaggggagggagggagggatggactagttaaatgatctccagtacatttatataacaaaatactgtgcaacattttaaaagaataaaacaggatgtaagggcgatctggctgcaatatccatcaccccattgattgccagggttcattcggctgatctggctggctgggcagttgtccccttcctccctctccactccatgtgtgtccctcctgaagctgcacactctgtcgaagaggacgaccatccccaatagaggaagactggtcttcagtcaagggtatataagtagctgagcccccctgctagaacctccaaacaagctctcaaggtccatttgtaggagaacgtagggctccaagcttccaaggctccagacacattcaaatgaggcactacctgtggtagtctgcctttgaaagaataaaaaataaaatagcaatagctatcagaattttaaatgcacataccctttgactcagcaatcctgcttttaggaatttacttgccatgatcaaagatgatgaataaagtgtttgttgatgcattgtttgcattaatgaaagaatggaaacaacctaaaagtccatcaagagagtactggctaaataagtgcctcataaacatgggtagtgtaccacatagcctttcaaaataatgaggtagttctttgtatagctccaagatacattattaaagaaaaagacaagcagcggccgggctctgtggctcatacctgtaatcccagcactttgggaggccgaggtgggtggatcacccaaggtcaggagtttgagaccagcctgaccaacatggcaaaaccccatctctactaaaaatacaaaaattatctgagcatggtggcaggtgcctgtaatcccagctacttgggaggctgaggcaggagaattgctagaacccaggaggcggaggttg

SEQ ID NO: 3464 - DNA, 1277 bp, Homo sapiens
aatagtcagggtagattatggagtgagacaggtctgatgtcattcaggaaggctggagtgtcctggatgacgcggctcataagtaaatgcctacttgtgagatcaactgtcccagtttgcctgagattgagggacttcccagaaagtgggtttttcattgctaaacccagggagatcttgagcaaactgggacaagttggtcagcatgtgtgggatgtaaaaatccatggtgtcagcttgagaggacaggttatggggtaacagtgggagtagggtgaacatggagcagctgccattgatggaactgaggggtactcttaagttcaggctttggagattagggtaaagtcacttattgcaaggcctaggcatggtgccttgtgcctgtattactagcactttgggaggccaaggtgggatgatttcttgaggccaggagatcaaaaccagcctaggcagcagaccccgtctccacaaaaaattagccaggcacggtagcgcactcctgtagtcccagctactcaggaggctgaggcaggaggattgcttaagcccaggaattcgaggattcaatgagttaatgatggcaccactgcagcccagcctgggtgccagagtgagacctgtttttaagagaaagaaaaattgcagcaatgacatgatctaaggatgtgcacgcatgaactgtcatctctgattcacagagggaggaatctacacatgtcccaggggccatggtgaaaaggtgcagttaatctccccacttgaagttaaaaccaccttggctggagttggggcaaaaatcacgctggtaagcctgtcttgatgaatttggcacattaatggtctgccaggcattctttgttttttttttttctcatgttttttgttttttttttttttgagtcagcctcactgttgcccaggctgcagtgtagtggtgtgatcttggctcactgcaacctctgcctcccaggttcaagtgattcttgtgcctcagcctcctaagtagctgggactatgcgcatgtgccgcaacgcccagctaatttttgtatttttagtagagatggggtttcgccatgttggccagctggtctcgaacttctgacctcaagtaaatacccgcctcggccttccaaagtgttgagattacaggtgtgagccaccatgcctggcctaaggggcaggcatttatgtttaaaggcaccataccagcagtcagttccctgcagaagcatccagaagtcacaggtcctttttctgccttggcctttg

SEQ ID NO: 3465 - DNA, 1178 bp, Homo sapiens
aggcggagtctcaccatgttgcttgggctcgttttgaattcctgggctcaagcaatccttccaccttggcttcccaaagtgctgggattatggatagtaagtccaggcctggccgacgtgtggatagtatcacacaatccctgacttcctaatccagtgaattctcaacatttcacccagagttgatcttccatctcattctcttatgagggaagcatttgagtagtggttctcaaactgtggtcccagaaccaggtaccatcagtattacttgggaacttgtaagaagtgcaagttcttagccctgtcccaacctactacatcagaagttttggatctggagccagcaatctggcttaacatggtctccaggtgattcgtattcatgctaaagtttgggaaatcaaaccatgttagaaatctttgggaatcagaagcagctgctgcaattctaggctgcaaatctggtcactgacttgtttccaggtctcttagtttgggcccttcctaagctgctgtcagtgcctcccctctcaactcactcactgccctattttgtccctgtattcgaaagtgatcgtgggctgcctttgccctggtcattgatagtgcagggagaggaatcaatgaaagcgcttccccgtgtttgaagggtccactcctatcccttccaaactctggagctttcgtacatgcctttattctcaccagtgatgttacctcctggtacctggttgtcgtgccagacccctgtttacctcattagggatggcaccaggttcaacaggccggagaagagacctggagccagtgaaggaaacagggtttatctggggaacttgagggcagtcagcagtctagtggtggggggctggatgggggcacctcatccacttgtaaaatgcatgcagattatatagcaccttcccccagtaacctccacatggcaaccctcgtttcctaagaagctattgttacatgcatctaccatacactggtgctgtatggttcattgagtgtcccttgtgcctagcatgggactcagaggctcctgtcaaaggacagtgaagcagggacctgccacactgagtttatgtctctgagctagttttggagccacagtagtggttaccccttcctagagctccccccagaagctctctctgcctccccatcac

SEQ ID NO: 3466 - DNA, 1112 bp, Homo sapiens
ttactgggatctggttatgtagacaccacctgcctagcacgcaccaaaattccagactttcaggaaaacaggtgcctgtgccacattatttgcacggagagactgtgtccagtgaacggttctgatcagtaaactgttgactaggaacatcccgagagccaagttcccagatgccagccaagggccatctgacctgttttgaatctcaatttcctgatacagaaaacaaaggtagggcataattgatttttacagacgtgaccccatgatcctgctctctagtccccagatttttccagggcttttgtcagaggtgtttcccctttgattccccttggtggttaggttttatgggattttacaggacagatggcagctgcaggagtcttgtactgtccctgacttgggtcatcccacaggccctggcaccatcctcctgcccttcctggctctcctgtctgtttctgctcctgcatccgaaagtgatcataggctgcctgtgcctaggtcattgatagtgcagggagaggaacgctgaaagaggttgtccccgtgtttggagggtccaccctatcccatccgaaccctgaagctttcacacaactcctgttgctctcctgccagcccttgaggagtccggcgcttgcttggctgccacatgaaagtcagtgcggggggacatcatgcttaagtctttctcagcttgacctctctttgcagaaaccaggctctgtgttctgaggggtagatcaggaagggaatgtgatatgtaatgagtcatggtgtgtcgcagtggatagcacagtttcgaataagtgcaatattggcatataaacatgagggagactttgaggttggggtgagcagggctgaccccgtgtgtgtgtgtgtgtgtgtgtgtgtgtgtgtgtgtgtatgtgtaacttggggacaggatagggtagcatctttacatctttacatgtcattggcctggaatagggggtcctgaagggtttgtcgtaagaaagagaaagtgctcattgctgcaaggggagcacagccgggttctgagaggcaaaacacttccctcacttcccacccaagagtttcgcctgttctctcgaccctct

SEQ ID NO: 3467 - DNA, 1205 bp, Homo sapiens
cctgcagcactctgatctgcaccccctgaggggcttccactgtccgcggggtgagaatgcccctgggtaagtgccgctgcttctgcgcaccttggggaaggacccttctgtgggacgcagtagaggggacagtcaatgagctcagccagttctgagttctgagaactgtctggcaaagcgggtgcagagcaaagcgtgacttaggagacgggctgcgcttggggtcacatgctagctaagttccttcattcccctgaggttgactttctgtaaagtagggaaactgcaaaggctctctgagggcagaggccttggctgtttttcttgattttgaacccacggtgcctgtccacgtgtagatactcagaactggtgggctgaatgtacagccgaggcatttttaccagaagtctgttttcctgtggactctgggtggggacagatggaatctgcctgtgaagtgatgatggctctcagggtcctgggtacccttctcttccctggggggtgagcctccctctggagatctggcagctaacacgctgacgtgggctcacctgcccttttttgcacctgtattcgaaagtgatcgtgggctgcctgtgccctggtcattgatagtgcagggaaagaaatcgcggaaagtgcttccccgtgtttggagggtccgctcctgtccctttcaaactctggagctttctcacacctccttctcaccatctttcaaatgcctcctggcacttggtgtcttattagtgagtgctccctgtgcaaggctcagtgcagggttccatgaggcgttcaccagggtctatgaggggtgagtccctgcctcaggattggtggtgaaaccacagctgcagcccccactagtcacaccctgtggcaattactggcttgattgtctttgcctctctctattgtgaccttgaggacagtgtcttgagttttgtttaatattttattgtatttttttagagacaggatctcactctgttgtccaggctgaggtgcagtgtgcagtggcgtgatcatagcttgaactcctgtactcaagtgatcctcgcacctcagcctcccaaatagctgggacagacagggtctcgctatgttgcccaggctggtcctgaactcctggcttcaagtgattttccctcagtcttccaaagtgctggaattacaggtgtgagccacttcgcctgtct

SEQ ID NO: 3468 - DNA, 1205 bp, Homo sapiens; identical to SEQ ID NO: 3467

SEQ ID NO: 3469 - DNA, 1211 bp, Homo sapiens
ttgcgccactgcactccagcctgggcgacagagcaagactccgtctcaaaagaaaagaaaaaatagtctggttttgtgtttaagaggtaatgaccttgagatgatttgcagtgggtcagatgtaatgaatgtaacttcctatattttgactttcacaggcctctgtatgatcttggtatagattagcattgtatgaatgacatcagtgatttgtggactggctgcatcacagtcatttggaggaatttttagaaatagtgattccaggattccgccttcactgattttaatgtagaaggtctagagcaggcgaagagaaccttatttttaggagatttcccagatgattttgatatactctgctctctaccctcccccttttatttttcatttgcaagggaatttcttagtttccttcctttaaaagtgagtttttcaagagcagcactattgccatcttgggccagataagttctttgttacgggggctatcctgtgtattttagaacatttagcagcatctttggcctctaccactagatatttgtagtgtgcctcaccagttatgacaaccaaaaatgtctccaaatgttggatgtctgctgaagagcaaaatcacccctagatgagaagcactgttttagaatgaaggactctttgtgaggccagtagaaaccccacgcattacatttagtgcttagtgaagaggagagaactttctggacacttcatttttcctggaattctcttctttggcctaagaaaaggatattttcatactcatttattaattacacctaatgtttattgaattttagtagattttatagcatttatcaagatttatagttaaataattgcatacctatgtaatgtttctcattaaccagacagtaaactctgtgaaggcagggacatagtgtcttttagtaaacatgcctggttcagtaattgttttgccaggaagagagctcagggcttttcttgcattacttcacaaccattattattatctctactttatggattaagaaactgaggcagtggggttaagaaacttgcccaaggctcagccaatccaaatctgtctaactctggagaatgcatttttctctatagtgatatatcctcaaatttattctgagcttggacatgatttgtcagaagcttcaaaactaaccaatttttatgaagatttattttgatatatt

SEQ ID NO: 3470 - DNA, 1127 bp, Homo sapiens
gtgcctggccctgagctccttatctttaaaattgttgtaggacatcaggtggagcttttcagcactctgtgggacatcaggtggagctatgggaggacagaatcaaatggggaggaagaaaagaaaaattcctggagaatgccaccacttgaaagttaggtgacagaagaaaagccaggacgaagattgagcaggagcagtaagagataaaggaagccaaaagggttgatgggagagttaaaagcttgaatggtcagcttaacctaggatgagaattattttttgaaacaaggaaagcttgaaaggataagaaaataggatgtgagggtgatctggctgcgatatctgtcaccccattgattgccagggttgattcggctgatctggctggctaagctggtgtctttctgtcctcaccacttcgtgtgtgtctctcccaaagctgcatgcttggtcgaagaggacgaccatccccaatagaggaggactgatcttccgtcaagagtatacgagtagctgcgctcccctgctagaacctccaaacaagcgctcaaggacatgaaaatagataaggaagtagaatgaagaataaagagggaagttcattttttgaggcaactaagatgatcttttaagatttccagggttgagattagaaaggagactgtggagaagggtgttgggaaagggcaggcagaaggaagctgagaagtaaccacaggattgcctaaatagcacctgggactttctgcactcctgcccccctggagcatatttaacttttctattgctacaaaaaccattccaaacttagcagcataaaacagcaaccattttattgtgctcatgggtttggtgggtgaggaattgagagaggctacagggatctctgcttcaagttgcctggagccactgctgggaagaattaaatagttggggactggaatcagctggagggttttttacttacctgtctggtatctgggctgggaggactcaaggtctgggttcatgggggactcttgacccaggcacccacatatggcctcttggtgtgccttgggctcctcccagtgtggccactggtttccaagagggagcttcccaagagagcagctagagagtga

SEQ ID NO: 3471 - DNA, 1180 bp, Homo sapiens
ctgcttggaggaaggagggaagggcattccagactagggaagcagattgcaagctctgagagggcagactggcgtctgtctggttcactgctgtagccctgcacctggtgcagagttggtgcctggcgaacatttgcggagcgggaaaggagggagagaggagttgggcatttctagagcgcaggaggcagagaagactggttagagaggaagctggagacaccattctcaaacttgacagtgcactggaatcactggcagggtttgttaaagcgtagattgttagacacccccctcctgcagggttcctgatccagcagggctggggtagggccaccggatttgcattgccagcaaattcccaggtgctgctgctgctgctggtccagggatcactgagaaccactgggctagaccacgaaccctgtgaaggcagagaggagccaggagaggtttctgagaaggagagaggggagcacttaggtttgtgatttagaaaactgtgggtgtgcggcacggtggcgcatgcccgtagtcccagctactcggtaggctgaagcaggaggatcacttgggtctgggagatctgggctgtagtgcgctatgctgatcgggtgtcggcactaagtttggcattaatatggtgacctcccgggagcggaggaccatcagggtgcctaaggagggatgaagtggcccaggtcggaaacagagcaggtcaaaactcccctgctgatcagaaaactgtgcatggctgctgaggacaggggtttccacctccgtcccacctctcctgccagggcagtggcacccttagctcaggagggtgcgtcaggacccagttccatcctcacacggtggggaagcctgggctgtgctcccagaacaagaaacagacctgggtgatgagtgacaaatgtggacggttctctgcactgtgggtggaaatagaaacccttagtcagctgtggggttcagcaaagaatttccctggttaacggaaacttgactggctgtgggtgagggggaggttgggttctgagacgtctgggaggcctgggctcttcggttctcgtggtgcccagctcagcgtgatgccttcaggtttgagaccacttcctcctgttgagcctcttctctgggggcactcattatgtatgctgcgtaacaaatcacccca

SEQ ID NO: 3472 - DNA, 1156 bp, Homo sapiens
caagcactctgctgggagaaaggccctttgttcatcccccaaagcaaagcattcaccacgtttttggagaatctcatgtctccaggatccctccagttatttattggtgcatagcaaaccacctcccaacttggtggattaaatcatttccagatgcttctcaactatggtggttccacttacaatttttcaacttcataatggtgtgaaagtaatacacacccagtaaaaaccgtccttcaagtacccattcaaccactctgttttttactttcagcatggtattcaataaattacatgagatattcaacacttgatttatggactttgtgttagatgacttttgcccaacattaggataatatgtgttccgagcacatttaaagtagaagaggctaagctatgatgtagactaggtgtattaaatgcatcttcaacttatgatgtttccaacctacagtggttttattgggatgtagctccatcataagtcaaagagcatctgtatttagttcacaaatgtacatttgctcaggactgcacagggaaggcccatctctgctccttgcagcatcagctgggcagcttgactggggcctagaatatccacttcgaagtggctcactcacaagactgtcatctgagagctcagtcaaggctgagggccagctaagggtttctattcttctccacatgtttctcatcccatgggccactcaacgggctacttagccttccttataacgtggtggctgagttccaagaatgagtgttccaagagacagtaggtggaaactaccagtttcttaaggcctgggcccagaaactaacacagtgtaactttcaccatattctgttgatcaagcaatcacagtactcagatccaaggttaaagtgcacaacctcccatttcaattggagcagtgtcaaagaatttggcaactaggttttaaattcaccctatcctgaataggccttctgtcttccccaaacccctaggacatatatgcaagggcttcttggatattttatcccaaaagtctaagacacttttttcttctaggcctgagagcctgaagactacgtagacaccttacatgagtgttagttaccttttaccatataacaaactcctccaaaacttaaaacagcaatt

SEQ ID NO: 3473 - DNA, 1225 bp, Homo sapiens
gggagggacttctatctcttatctcttctcttcctccacccactttctcctatatcctcccccacttccaggtttctctggcccttccaacagcaagtatcgccaggagcagctccctaatctacatactacagatctatccacaagaagacagatggaaccactcttttcttctgaattctagaaccttaaggaagttaacctgagtggctcagcttggatcaagtgcccatcctggtccaaacaactgtagcagcacatctgtgtatttgtgtatcttgttcctccataatcttgcagtccggggaaagtgtgcagatggatgggtccctgaaaagcaagagttgtttagacaacgctagaggtgttcagttctgggagacaagagttgggccaggttgataactagcctaagagagtcggaatcagatgaataagaactagatcttgggtgacaacctagatcaagagtcttgaggttcagtcatttcaaaaagctcaagtctcattgcttcttggccttctggctaagatcatgtgcagtatctgttcttaccagtttaatatctgatacatcctctatctgaggataatataataaatagatttttggagcaaggagatggaataggagcttgctctgtccactctacacattggcctggattgcagtacctccaggaatggtgcaccctctctaccacccccaaaaagcccaagtctcaagaggtagtctggaaaaaagtgtttttggatttacctacatttttttttccaagatggagtctcgctctgtcacccaggctggagtgcagtggcgccatcttggctcactgtaacctctgcctccaggattcaagcagttctcctgcctcagtctcccaagtagctgggattacaggtgtgtgccaaccatgctcagctaatttttctatttttagtagagacagggtttcaccatgttggccaggcaggtctcaaagtcctgacctcaggtgatctgcctgccttggcctcccgaagtgctaagattacaggcgtgagccactgcgcccggcctaatttttgtaattttagtagagacgagttttcaccatgttgaccaggctggtctcgaactcctgacctcaggtgatccacccccgccctcggcctcccaaagtgctggcactacaggcatgagccaccgctcctggccgggtttgcctacattttggagatgctg

SEQ ID NO: 3474 - DNA, 1149 bp, Homo sapiens
ttcaggtcacttaccagctagctgtgtgagaaaatcagtaaattacctaacgtctctgcctcagtttcatctgtacgtttttcacttgtacatctgcagaagcacctactttagagatcactgccaagattaaatgagttgatcacataaaacctttagaacatgcttggtgcactattaatttgcatcctcactagacagatgtgaaagagaagatggaacatctgaccctgggcctcagatatgggccattgctgagtcaccctaatcccccccttatttctcctttgtttgcaggtgcaagaagtggggtgtcccaattgagaagatttacaacaaaacccagcgggagaagtttgcctgggccattgacatggctgatgaagactatgagttttagccagtctcaagaggcagagttctgtgaagaggaacagtgtggtttgggaaagatggataaactgagcctcacttgccctcgtgcctgggggagagaggcagcaagtcttaacaaaccaacatctttgcgaaaagataaacctggagatattataagggagagctgagccagttgtcctatggacaacttatttaaaaatatttcagatatcaaaattctagctgtatgatttgttttgaattttgtttttattttcaagagggcaagtggatgggaatttgtcagcgttctaccaggcaaattcactgtttcactgaaatgtttggattctcttagctactgtatgcaaagtccgattatattggtgcgtttttacagttagggttttgcaataacttctatattttaatagaaataaattcctaaactcccttccctctctcccatttcaggaatttaaaattaagtagaacaaaaaacccagcgcacctgttagagtcgtcactctctattgtcatggggatcaattttcattaaacttgaagcagtcgtggctttggcagtgttttggttcagacacctgttcacagaaaaagcatgatgggaaaatatttcctgacttgagtgttcctttttaaatgtgaatttttatttctttttaattattttaaaatatttaaacctttttcttgatcttaaagatcgtgtagattggggttggggagggatgaagggcgagtgaatctaag

SEQ ID NO: 3475 - DNA, 1136 bp, Homo sapiens
ctgcagggcatgtctacgggcacctcaatctcagcgtctctagaactgagctcagtacccaccaccccaagcctgttgggcctgggcttcacatctcagggaaaggcaccagatcctctgtcccccaacccagaaactagggtagccaccatccttcactcctctcgtttccacacccagtaaattactccaaaatcatctcctcaataccataaaatttattttctgaaaaaattttactccttagaaattcttcaaataatgagacactatcaacttgttttgaaccaaaaagcactttttagagaaaacacattaccctgaaatgacctcagtcaggccagttttggatgcttataagtagtcccctgacaaaaatcagtaaacaaggagacaaagaaatttaacacagacttagtaattttcacaatcccaagaattccattcagacaagcctcttagaaatcactaaatagcaaagacttttttagattttataattgtactgtgtgtgtgtgtgtgtgtgtgtgtgtgtgtgtgtgtatacacacacaattttttttttttttttttgagacggagtctagctctgtcacccaggctggagtgcagtggcgaaatcctggctcactgcaacctctgccgcctgggttcaaaccattctcctgtctcagcctcctgccaccacgcccagctaatttttgtatttttcgtagagatggggtttcaccatgttggccaggctggtctcgaactcctgacctcatgatcttcccgcctcagcctcccaaagtgctgggattacaggcgtgagccaccgtgtctggcccacacaaatgtttttaaaggagtcttttaggccaggagcagttagctcatgcctgtaatcccagcagtttgggagaccaaggcagaaagatcacttgagcctcggagcccaaggctgcagtgagctatgactgtaactgcattccagcttaggtgacagtgagattctatctatacacacacacaccacacagtcttttagaaaaattgagatagtaatggataataagagttgaggtttgggtcaaaataatatgggaggggttagtgggtagaatttggcatgaaacaaaagtggccaccaattc

SEQ ID NO: 3476 - DNA, 1093 bp, Homo sapiens
acatcacgctccaggccccgccccaccggccgcccatatagcgaaagcctggcgcgcgcgcgcgccattgtgtggctggactcggccgcccctgtggtgtgaggcgcgtgttcgggctcttgccgtccccgcacccgcaccgcggttactggcttgcggtccgccgttcgacaaccagcccttgggtccccgcccgccacggacatgccgcgcgtctacataggacgcctgagctacaacgtccgggagaaggacatccagcgctttttcagtggctatggccgcctcctcgaagtagacctcaaaaatgggtgagtcgggcctgggcgcccgcgcccagcgtcccaggcctggtggcggcgggaactctccaaggaaagaagcggccaaggccgcggcgccgcgtggcagggcctcaaagatggcgacggcgcggcgtcgcgggggcgcgcggtggggtacgggcgcgcgcacgtgcgcgtcctggctaacgactcccccgcggttgtccggccctcgcaccgcccctaggtacggcttcgtggagttcgaggactcccgcgacgccgacgacgccgtttacgagctgaacggcaaggagctctgcggcgagcgcgtgatcgtagagcacgcccggggcccgcgtcgcgatcgcgacggctacagctacggaagccgcagtgagtcccacccccgcgcgctccgcgcccttggggaccctgggggcgggggtgggtggggtggggcctcccagcccgggcaggcgcgagggccgggggtcgtttgacttgggtgtccccgagccccgctgccttcacgtctgcccggggcagccatgggacgccggagcgcggggattgggtttgggtgtttggttttgtttatttgccaagttgggaggtgggtggcttcttctggccccttgtcagcactgtcacgggttcttcccacagaggaagtaaggggtggctgtatttgttgtattctccttacttacctatcagtgcattagttagaggttcgggggcaggctcgggtggaggtggggtagggggcgcgggggacggggaaggggaggagcataaagtatagg

SEQ ID NO: 3477 - DNA, 1147 bp, Homo sapiens
ctgaagttcagtcgtttcattttgcctaaatgaatatgagagatatcttccatttttccatcccaattccctatccgcctgtctgagcctcaggaaactagcctcatgacttcctccacacacttccctgccctctggtttctgagtgggacgtggagagagggaggagatggaagttggggtctttattcccacagcaccccacccctacccccgcagacttaactaaggctggcagtggccttcaaccaaaggccatagtgtctggtgtacacagccctcttgttccaagtcccggtaaccactgcctccccttgtcctagcccctccgtcttacgctaaccattgtaatttttctacatcctgcccacaccattataaataagttaatgatttattgtgtcgtcttcaaattactgaagtggggagtgtgccttctgtttcctgttgtgacgctgcagataatagcaagtaagttaaacagtaagtaaatatttcctatttcagaggaatataaaacatcacacttagtgcttgcttcagcagcatatatactaaaattggaacgatacagagaagattagcatgacccctgcgcaaggatggcacgcaaatttgtgaagcattccatattttaattaaaaattatttaaaaaataaagaataaatatcgggggtagatatgcaggcaggacggggcaaagctctgaggggtagggtatgcaggtcagcattatctagttgcaatggttatgttgggtaatgggccacctggtggtctagctggaggcaacaaggctgtaaatcaattgttcattctttcctgagatgggacactctcaaccttggtttgatattctggatctcctaaggccagttcctggaattatttaaataaaaggcatggttaaacattaagagagcacagaagaacaatatagaatggctggactaggtgtggtggctcacacctgtaatcactttgggaggctaaggcaagaggatcacttgagcctaggagttcgagaccagccggggcaacgtagtgagaccctgtctctacaaaagaattaaaaattaggcaggtgtggtggcgtgcacctgtagtcctgtaggtctaaaactggcctgtttggagatttggtta

SEQ ID NO: 3478 - DNA, 1132 bp, Homo sapiens
ccaattttttttttttttttttttgagatggagtctcgctctgttgcccaggctagagtgcagtggtgccatctcggctgactgcaacctctgcctcccaggttcaagcaattctcctacctcagcctcctgactaggtgggattacaggcacataccacatagcctggctattttttgtatttttagtagagacggggtttcaccatgttgccaggctggactggaactcctgacctcaggtgatccgcccacctcggcctcccaaagtgctgggtttataggcgtgagccatcgagtccggcctgaccaaggaatttaaagcagcagcacacccctcaccccatcccaccactatctgtctcattactattatatatttctttctttctcatccttcattataatcaatagtgatcttcaattatttatttctgtgtttgatcagtcatctccacataaatgctgaccgtctgtcttattcattgctgtatccccaacacttagtacctggcacatagtaggtgcttaataagtccttgtgttggatttcagtaacttgaacttgttaataaaaaacagtgtatggggccggcttggtgccatgtgcctgtaatcccagctactggggaggctgaggcaggagaatcgcttgaacccgggaggtggagggtagaggttgcagtgagccgagatcgtcccactgtactccagcctgggagacagagcaagactccatctcaaaaaccaaaaaccaaaaccaaaacaaaaaaacactgtatgggcccaatgcagtggctcacacctgtaatcccagtactctggaggctgaggtgggaggactgcttgagcccaagagttcaagaccagcctaggcaacacagggagactctgtctctataaaaaattaaaaaataaaaataagccaggtgttgcagtatatgcctgtagtcccaactactccagaggctgaggcaggaggattgcttgagcccgggaggtcaaggctgcagtgagccatgatctcaccactgtactccggtctaggtgacagagcgagaccctgtctctaaagaaaaaaaaaaaattagctgggcgcagtggctcacgcctctaatcccagcactttggga

SEQ ID NO: 3479 - DNA, 1137 bp, Homo sapiens
ttgagttgaagcactcctaggccctggggactatgggggcgtggcttggagtgaggcactctgggactgggcctgtgggtgtctgggggcgtggcttagactggggcaccctgagtgggcctgtgttagtttgggggcgtggcttagagtggggtaccgtgggactgggcctgtgggagcctgggggcgtggcttagagtggggcaccctgggactggaccccgcaggtgcttgggggcgtagcctggagtgagggtttggctggtgtagcttggagtgaggccccctggcgtggagtcttgaggcctgctgagggcgtgagctggcatgaggcgaagagagggccatggcaccgactccgagatgggtcaaggacccgtacgggagtcgcaatcctcagaccctcccgcgctccagttccggataagcgagtataagccgctgaacatggcgggagtggagcagcccccgagccccgagctgcggcaggaaggcgtgaccgaatacgaagatggcggggccccggcgggagatggcgaggcgggcccccaacaggcgggtaggagccccgctccccaggccctgagctgggccctgtgcgggtggggcgaggcctgagccccagaaggttcgggggcggggcccggggtggtcctggggtggagaaggctggaggaggccatccgatgcggagatggaccgaggcggaggcagggcctgagggggcgtgggcggagcctgagtgtggctgcgatggggagggaggcctgaggcccatttggcccccgcagaggaccacccccagaatcctccagaagatcccaatcaggaccccccagaggatgatagcacctgtcagtgccaggcgtgcgggcctcaccaagccgcgggtccagatcttggttcctctaatgatggctgccctcagctgttccaggagcggtaaggggaggaggtcgcagccctacttgctctaccttcagcccccaaagcctcattcctgttcaggggttaggagaggggctgggtggtgcagggcgggtggttctttccctaaggctggcccttcctcaggtcagtcatagtggagaactcctcaggctctaccagcgcttctgagctcctcaaacccatgaa

SEQ ID NO: 3480 - DNA, 1150 bp, Homo sapiens
attcctgtaatcccagctacatgagaggctgaggcaggagaatcgcttgaacctgggaggcggagcttgctgtgtgccaagatcgcgccatctcactccagcctgggcaacaagagcaaaactccatctcaaaaaaaaaaaaagaaagaaaataggaattcatttaaaataaaagtgtttattattctagttcatggaatggataaagaatgataaatgtaaggcccagaatacaaatgacaagtattggtgagaatgggaagttattggaacccttccacactgatggtgggaatgtaaaatgatgcagtcaccatgaaaaacagtatggtagttcctcaaaaatttaagcataaaattgccatatgatggctctgtgtggtggcccacgcctgtaatcccagcactttgggaggctgagaagggtggatcacttgaggtcaggagttcgagactagcctggccaacatggtgaaacctcatctctactaaaaatacaaaaattagccgggcgtgatggtgtgcgcctgtaatcccaactacttgggaggctgaggcaggagaatcacttgaacctgggaggcggagttgcagcgagcagagatcgggccactgcactccagcgttggcaacagagtgagactctttcaaaaaaaaaaaaaaaaaaaaactgccatatgatctagcaattccacttctgggtatatgcccaaaagaatggaaaaccagatctcagagatagttgcacacctatcttcctagcagcgctattcacaatagccaaaaggtggaaatagcccaagtatccatcggcagatgagtagataagatatggtatatacatacaatggaatattattcaatcttaaataggaaggtaattctgatacatgctacacatggatgaatcttgaggacattatgccaaacgaaaataaggcagacacaaaaagacaaatactgtatgatttcacttatgcaagcatgaggtacgtagagtagtcgaattcgtagagacagaaaatagaagggtggtggttgccagggcctgggggaggtggggaatggagcgttgctgcttaataggtatagagtttcagttttgcaagatgaaaacagttctgcagattgattgcctaacagtgtgagt

SEQ ID NO: 3481 - DNA, 1235 bp, Homo sapiens
aaccacaacctctacctcctgggttcaagcgattctccttcctcagactcccaagtagctgggattacaggcatgtgccaccatgcctggctaattttgtatttttagtagagacagggtttctctgtgttggtcaggctggtctcgaactcccgatctcaggtgatctgctcgcctaggccgcccagagtgctgggatcacaggtgtggtgagccaccgcactcggcaatttttttttttttttaattaaaaaaaattttgttttttacctgaacctgacagtagctggtgccattttataatttttgccatagcctgaatgattcagttgcttatttcacagagcttcgtggaaatgctctgtaaattattagggctagagacttgtgagacttcatcttggaactgaaagagaccttagagttcatctagtggaagattcatttacaggagcaggaacttggcttagggaggttagtgatgtgcctgatggcaccccacccacagagctggggttcaaaggccccctgctgccccctgcaggacagacaatgctgtgaagaatcactggaactctaccatcaaaaggaaggtggacacaggaggcttcttgagcgagtccaaagactgcaagcccccagtgtacttgctgctggagctcgaggacaaggacggcctccagagtgcccagcccacggaaggccaggtgagacagctgctcagcctttggcttggtttgatttcacattcatctgacaccatctcattgaacaccttgtccacagctattggtcagtttctgccacagagtctaaaagtgggctctgtgcttctggggccttgtgagacttctgcacataactggcacttgtctgcctgcagatgaaggatagcagagcaagctgattatataaaactgtgaattagttaaggagatcctcagcctccatctctccttgctggtggccaccttcttacctgttgctcattttaattttttaaaactgaaagcatgtttgcaataaaaaaatcagaggtggctgggtgcgttggttcacacctgtaatcccagcaagttgagaggctgaagcgggcggattgctcaagcccaggagttggaggccagttcaggcaacatggtgaaaccttgtctctatctttttaattaaaaaaaattaaaaaatgtattgagttgtaatttacgtactctaataaacagttttgagttatgaca

SEQ ID NO: 3482 - DNA, 1199 bp, Homo sapiens
gccatggacctcccagccatcatggtgtccaacatgctagcacaggacagccacctgctgtcgggccagctgcccacggtgagtccctatcgcctgctgcagttcctgctgatgacagcagggagggggttgagagggaagcagaagaatgttgatgctttgataagaactctctgctcatgggcagggtctgggtttacctggttgcttggagttggtaatcccatgctgggattacctggtagcatgggagtctgtgggacacggtgggtgggcatggagagaaatctaatatcagcacactgcttccttctggagctctgcgtacagtatctcggtattggtttgcattatttgttaatagtataatctcatttttattttttaacagttttattgaggtataatttatattccatacaattcacccatttaaagtatactacttaatgacttttcatatattgacagagttgtgtgaccattaacacgattgattttagaacatttcatcaccccataaagaaacactagctaggcacagtgttgtgtacctataatctcagctacttgggaggctaaatgggaggatcgcttgagcccaggagtcctgggctgtagtgccctatgcaaatcagttggctgcactagctttggcatcagtatggtgacctcctgggagaggggaaccactaggttgcttaaggaggggtaaactggccacggtcggaaacagagcaggtcaaaactcccatgctaaccagtagtgggattgtgcctgtgaaaaggcactgcactccgggcatcatggcaagaccctatcacgaaaagaaaagaaaaatgctctgttgccgggcatggtggctcacgcctataaccccagcactttgggagactgaggcaggaggatcacttgagtctaggagttcaagaccagccttggcaacatagcaagaccccgtctctacaaaacaaattagccaggtgtggtggcatgtacctgtagtcctagctacttaggaggctgaggtgggaggatcactcaagcccgggaggtcaaggctgtggtgacagagtgagaccctttctcaaaaaaacaacaggaagaaacatcatatttttggccatcactcccaatccaccccctgaaatcttcagccctaggcaaccactaattgactttctgtctctataaattt

SEQ ID NO: 3483 - DNA, 1207 bp, Homo sapiens
cctcagcaagggtgcaaagggggaagaactaggggctccattgttcttcaggcgacaggagaccgttgctccagtgcatgtctgctgggacaaggattcctggcctcgaagccctgggctgcacagccctactgggctccacctctataaaccagtgacttctctgggcctgggtctgggggagagggttgccagggagactcagctctccttgggggctggcccagctgactgagggtacacaggattgggtctagaccttgatgcctgggtggagggcccttgtaaggggccatagcctcttcaggaccaactggagggagagttaggaaacaccagctcctgcctggggcagtgagggaatgggagcagctgtgggcgcctcatttcaggcaagtcctccccaaaccttcagatgcagtgagacctggccttcctgttgtgcttttcagactttgttttcagaatgcttttatctcgagtgtgcccttcggccctcacaagagcccctggggagtaggtggtggcctgtgccgtcatccccatttcaaagcagggagctgaggtcctgggaggggaaagtgcttgcctgaggtcccactgtgttagtgggtgggcaggactggaactcggttctccaacagcccagagctcactcttttacacccagaggtggagcaggtggcttagggggtggttatgtacttcacaagccaattcccttcagccaggagctcctgggtgcatttccgtgtcagaaacagtaccgagtcccaccccctctggaggcacagctgttgcgtcaggcaaggtcacctgcatttatttattgagcagcagtgctgtgtcaggcccagggaccgagcccctctccctgttcccctatggtgtctccgaggccctctgggagggccccacatctggagcagcacctcagagtggacagaaagcattagcgtccacgagctcacccgacgccgagcctgtgaggtgggctgatggtgcccgtctaacccagcgcttcagggaggtcagaatggagccgaacccagggctgtgagcatcacctctggagccctttcactttatgactgcttcctggacgggtggtgggaaggcaggagcctgggtccttaggctgggggcctctctccatccacccacctttccctcattccctctcttggagcagcagccgcccaggcct

SEQ ID NO: 3484 - DNA, 1094 bp, Homo sapiens
gaatcctgaaatggaaattctttgtggcagataactggcttatgacaccttgaaaagttcaagtgctcatataacacaccacactgaaccccctttcctacagcaatatgttcactatgttaccaatttgcaacttgtgcttcaatagtggaatctactttcattgttaacactgagctaaagaaaaaaagccgtgtgttttatgaatgaccttatctgtttcctggataatacctttaagaataatgtcctgagtcaggcgtggtggtgcgtgcatctagtcccaactatttgggaggctgaggcaggaggatcgcttgagcccaggagtttaaagctgcagtgccctgtggttgcacctgtgaataactgcactccagcctgggcaacatagcgagacctcatctccaaaaaagaaaacaaaaaacaaaaaaaggaatgatgttctgtagagatggcctttcacttgaggagtactcagttttcaggttcttcctagctcggggcttttaaattttgaaatctaaacattctttcccaccatcctttttgactgttgaccttggttttctcttctaagtttctgtccctctgcttccttactttttttcctttttgaattctatctttatctgtcttttgttcactttttaatgctatatatgggcaggggtgagagacattactgagcaccttggtgagcaagcctggctttaaagattggagaagagcttctggcaccagaaccctgtcttcctccagttctcaacacggtgttgctcttcagtcataccggaatctgaatcaaaaaagtatttttaaatatccatgatttctccctgtattgaggctagccctgatcatgctttttgtgcctgtcaccaggtctcccaagtgcactcatccaggtcagtgctcagatgtgtttaaggagaccctatattcagggaagttgcgtgaacactgcagtggggagaattgagaatagtcaggcctatcagtctcacagaatcacccctctacctttgatattccacttagctgtagagtccatctgtttgtccatctgctgaaatgagaaaagaaaaatttat

SEQ ID NO: 3485 - DNA, 1189 bp, Homo sapiens
ggcctcaagtcctctcttctgagtcctttcttccccttggtggtggtagtggggatatttttcatgaattaccacttggaggacctggcttgatttattatacagggagccgatagttttcctaacacaagtggtcagaggtacagcagttctgcttggccgaactgttgaaggagactgttctcagagctcctccctctgtgatctttttgaggaagcgaggagaggtgtgaaagtgcttttaaactgtcaactggggttcctgtgggaggagttacccctcaatgacggtccataataagctcatgaaggggcatttggagcagccacgacactcagtgcacccttgtgtggggcagccctgccctgggccagaccctttgcaagaagtccacttggaggttgggcatggtgatgtgcgcctgtaatcccagctgctcaggaggctgaggcgggaggatcccttgaacccaggcgcttgagaccagcctggcaacttagtgagactctgtttcaggaaaaaaaaaaaaagtgtatttggctgttctgaagcaggccatcatcacccttcacctcacccacaggtggctctcgggggctggtccatgggcggctgtggcgtcaggatggagtcctagctgtgacctgtgcccaggagggcgtgatccgagtgaagccccaggtctcagagagcaagctgtagccagaggtaccagcttcgcctggggcttcaagaacctcccatctatccccattcctgagacaggagttacagtcccttttggccctcacatccaataaagagactgataccactggagtggctggcttttaattcccctgggccagacctgcagccttgccttcatcccttaactccaggactccaggggcagagtccctggccttcagccaagaggccttgccagcttgggggcccaccaacaagggaacattgccccaacctgtgccacagccccccggctgtttataggctggagaggctgtgtcagacttccctgtactacacaagggcaaccccagccaaagctcaccctgagcctagctcaacagaagtttccttgatctgcttcacattctcttttggaacttctaggggctcccagcaccctctgcagcctcccagctattctgttctcatcaggtccttcccctgccttctggggca

SEQ ID NO: 3486 - DNA, 1193 bp, Homo sapiens
ctcacacctgtaatcccagtgctttgggaggctgaggtgggtggatcacgaggtcaggagttcaagaccagcctggccaacatgatgaaacccccatctctactaaaactacaaaaattaaccaggcgtggtggcgggcacctgtaatcccagctactcgggaggctaagccaggagaatcgctggaacccaggaggcggaggttacagtgagtcgagatcttgccactgcactccagactgggcaacagggcaaaactccgtctcaagaaaaaaaaaaaaaaaaagaaaaggccaagcgtggtggctgtaatcctagcactttgggaggctaaggcaggcagatcacgaggtcaggagtttgagaccagcctgaccaacatggtaaaaccctgtctctactaaaaatacaaaaattagccgggcacggtagcatgcctgtagtcccagctactcgggaggctgaggcaggagaatcgcttgaacccgggaggcggaggttgcagtgagccaagaccgtgccagtgcattccaacctgggtgacagagggagactccgtctcaaaaaaaaaaaagccttccttggtttcctgccaatttcctgtcatgtttctttgtcccgaattgggccaatatccatgcccattcctaatacaattaccttaattgacttagattagccctgaagcatgtagtgatgtgggggaggaatgacaactgaagaaaatagaaaagaagggacaaaggttgttgagttggcaaccaacaattcctgttatagctttttaaattaattcactttaagtggtactgattattcatattgttatttccatgtatagagagagaagaaattggaggcttagaggaagtgaagtgacttgtccaaggtcacatagctaagtggaatttattttttttttttttacttttctgagacaaagtctcactctgtcgcccaggctggagtgcagtggcgtgatcttgactcactgcaacctctgcctcctgggttcaagtgattcttctgcctcagccacccgagtagctgagattacaggtgtgcaccagcatgcccggctaattttttgtatttttagtagagatggagtttctccatgttggccaggctggtcatgaactcttggcctcaagtgatccacctaccttggcctcccaaaatgctaggattac

SEQ ID NO: 3487 - DNA, 1151 bp, Homo sapiens
caaggtcaggagtttgagaccagcctggccaacatagtgaaacatcgtctctactaaaaatacaaaaaaattagctgggtgtggtggtgcatgcctatagtcccagctactcagaaggctgaggcaggagaatcgcttgaacctgggaggcagaggttcgatgagccgagatcagaccactgcactccagcctgggcaacagagcgagactccgtctcaagaaaaaaaaaaaaaaaaagaatagcacacatggaaaagtgcacaaaacataaatgtaaaacctaatgatttatcaaaaagtgagcctgggttagcatcacccatgccatggtactgaacagtcaagcagaagacctctgcagggtaattggtgttccaactacttttgtgataatcgcttccttgcttttggagttgtaccacctgagaatgtgtccctaaacactgtagtttcgttttgtctgttccttgaactttatgtaaattgaattatacagtattattttgtgtctgccttcttttgcacaagaatacacttgcaaaactcctttatgttgtttcatatagctgtggtgagttcattttcattgctgtttttttgttttccactgtatgtttatctactctattgttaagggatataagtgaagcctcccacctgccatacctctcaatttcttttctaaaaattatttttatttttatttatttttttagacagagtctcgctctgtcgcccaggctggagtgcagtagcgcgatctcagcttgctgcaacctctgcctcctgggttcaagtgattcttctgcctcagcctcccaagtagctgggattacaggcacccgccacaacacctggctaatttttgtattttcagtagagacagggtttctgcatgttggccaggctggtctcgaactcctgacctcaagtgatctgcccgcctcggcctcccaaagtgctgggattacaggcatcagccaccgtgcctggctttatttatttgtttattgagtctggctctgtcacatgggctggagtgccatggcacaatatcagctcactgcagcctccgcctcccaagttccagcaattctcctgcctcagcctcccaggtagctgggattacaggcacacgccaccacgcctg

SEQ ID NO: 3488 - DNA, 1193 bp, Homo sapiens
ccccagtgaaggaatgtggcatgccacgtgctaggccaattctattaattcttgcagtaaaacagatttattgtgttaaaaacttaattataggctgggcacagtgactcatggctgtaatcccagcacttcgggaggctgaggcgggtggatcccttgaggccaggagttccagaccagcctggccaacatggtaaaaccctgtctctagtaaaaatataaaaaatagccgggtgtgatagcaggagcctgaagttctagctatttgggaggctgaggcaggagaatcgcttgaatccaggaggcagaggttgcagtgagccgagattgcacaactgcactccagcctgggtgacagagcgagactccatctcaaaaaaacaaaagcaaagaaaacttatttcttaaaacaatttctaatatttattgagcacttgctcggcgccaattgacatagatcgacgacattgatcctcactcccttatcattcccggatgaggaaaaggattcccagctgcatgcctactccatccctatgcggcgtgtcagtttcagcacttttgacgtttggggccagataactctttcttgtggggggccgctctgtgcatggcagcagatttagcagcgttttggtctctagctcctagatgccagtagcaaccccccactctcctaaaatgtctggatgcaatgcccagtgtgccctggagagaagaattgctcatagctgagaatcagtggttcagaggataaccccaaagccctagaggttaatggggaaatagaaaataaaaccactctaatagcaaacagtaacagagtacttactgcatgccaggcactgttcagatgattgatttaatcctcacggcagcctgatgagatgtagctactgttattgtccctttgtatcatattattagtgtctctctttgctgctgccaggaagagggaggcagaggtgccagtaactggcccagggttacacagcagggcaacagctgagccggggcttgaatccacagtgtctggcttctaatctgtgcttgaatccaggcctctttacttctggagtctttcccactatattacattaacagtaatgcaggcaggtcctggcaccagagctgcctagcttacttggattcaccagccgagtggtatgtgagtttcaacacactgaagcctt

SEQ ID NO: 3489 - DNA, 1565 bp, Homo sapiens
ccacttaaacatatttttggattccattcttcctgtgtgttggggcgcttaaatttccaagtggagggatgatttattgacatattttggaaagccaaatgtgtttttctgttgaactagccactcaaaccagtgcccgactacataactaatatttttgctagagtccaggagtgaggcgtttacaaagtctgggcttcatgggaacacatgtgaagcttattgttccagattgttcttttgtcaggtaacttgtggtaacttgtgttaaaatgcaatctcttggtacttgttcacttcccaactcagtaaatgccaactacttcctcaactcttccagccacactggcttctatcatgggcctgtactcagagtgtaagcactgaagacaggggtgtttggtttggctaccaagttattgccagctacaggatacaacacagaagtgctcaaacaccgaatgcaaatttgcaaatatgaagcataccaaccaaatcttactcctcatggctttcaaatcttactcctcactcaagaacttcctgctggcatatatgatgacttagcttttttccccgacagatcgactatgttgatctaacttttctaagccagtttctgtctgatatgccagcttgagcagctcctttgtcccagctcccctgggcatctagctgatgggagctcatttttctgttttttcatttcaggtttattgttggccaaaaccaggctttgattgaaccaggatgaatgcgggtgttggaagtagaatatatatatacatataaaattggtaagtggtgccaacacgtcttccctggctgagtagacacaggctctggagggggtagtagctgcttttcagtgtgggtttgtcaccctacttcttgtacgactcaaatgtggcctttgcagctgatgatacagcttctttccccatcagatcgaccctgttgatctctacactattggccagttttgtctgatgcattggccccagtaataactcctatctttgttttctgcttatctttatcagagactattgcttgttcatgggaactgggctttctctattttttccagcattcagatggcttcttttgacctgttaactttctataggttgggagccacgtgtaccagtgtgtgttgatcttggcttgattcagtctgccttgtaacaggtgaggtttctgctttctatctgccaaaccccaccgcaaaatttgtccaactgggcctaacctcaggacccatttccaagttgggtataaaactgggagaataagtcattaggactgacattggcctgttggtattactaggtctttgttggaaataagagcttggagttccaaagaaaacgagcacttgaacaaaagatttctcagcaaggcaaatttacttctgccgtagggtgctgctgctggcattcctggcaagagcacacctaacaaaagagagaaagggtttttattcctaacaagtagtccctgcttctgtgtcctatccccattggctggagtcgacagcgcaatctaaactagtcctgattggc

SEQ ID NO: 3490 - DNA, 1565 bp, Homo sapiens; identical to SEQ ID NO: 3489

SEQ ID NO: 3491 - DNA, 1565 bp, Homo sapiens; identical to SEQ ID NO: 3489

SEQ ID NO: 3492 - DNA, 1190 bp, Homo sapiens
aggggctagcggctgtcgccatgacaaccggacagcctacagcttcctgcgtcaccagggacgcaggtttgctcttggctgggaagcagtggggacaatggagtgggggctgggaaatggggggaccctaaacactcagtcttggggggaggcagttctcatttctggttttttttttttttttgagatggagtctcgctctgtcgcccaagctggagtgcagtggtgcgatctcgactcactgcaacctctgcctcccgggttcaagtgattctcctgcctcagcctcctgagtagctgggattacaggcgtgtgctaccatgcccggctaatttttgtagttgtagtagagatggggtttcaccatgttgcccaggctggtctggaactcttgacctcaagtgatctgactaactcagcctcccaaagtgctgggattacaggtattagccaccatgcccggctgggagttctcatttctgagagttgcttgaaggctgggagggcctggtgatgctacctaagtgtgtgtgtgtgtgtgtgtgtgtgtgtgtgtgtgtgtgtgtgtgtagtgtctgggctgtgtggagccaagctgcctgggtctgaatctcagctttgcctcttctgtgccgtggcattttgggcaagtgagttaatctctcggtgccttagttccctctaatgtaaaataaggtggacagtagtacctcataggactgttatgaggattaaatgagataatagtctcacggcacttacaatgcaccttgcattgtgccttaattcttgacatcaatctacatctgactctaggttgtcttcttgctggggtagtgggaaatttggtctcaatcatcctcagggatccctacttccctggcttttgtcattcattcaacaaatacttattgagcacctactgcatgccacgtattgttctagaggctgagaccacagcagtgaacaaagcaaacaaaaatccctggcagagtagagctaacattctagtagggatagatagacattaaatatgacaaaaaggaaaatagatattatatcagatgacaataagaagaaaaagaaagcagggctggaggattccaactgcaggggagctgttgcaattttagaaaaattgatgcatggggatgtgagtgtgtcagggaaggcctcactgagagagtaa

SEQ ID NO: 3493 - DNA, 1177 bp, Homo sapiens
ctctccattgtaaatgcacgtttccccctttgcagttatgtgatctgtgggaagaatttgtttttgattttctttccaaagtgtagccttacaagatttgttttttgtttgttttttttctggtttgttttcttttttaaatccaagcctttgcggaggtcgaggccaagccacccaccttggcttctcaaagggcttggattataggtgtgagccaccttgcctgactccttacaagtttccatcaatcatgctcttccaacgtgcctttgtagagtaggttggcccttctgtttctgtggacttgggtcttgaattgctttaaaatgtgaacattacttagctaaagaaagaaaagtttatgtctgatcaagtgacagagtctgtctgtcataatagatgacagaaaaataatccagcattctgcatggcccagagaacccgtttctaggactacaagttgatatatgcaaaagacaagccatctggaggagaggaagggtttcattacccacaaggtgttaaggaaagactttgttttgctaagtgtgtgtgccttagaagctagaaattttcaagtgctttctctggcatcttttgcctttttatggaaagcatggctctgatttcctatgtttgacagtttgggtgttaataccagttggaatgctgccttcttggaagcacttaaattcccaacgagtagataacccattagtctgttacaagcttccaggctaacaataatgtgattaaaatatattatccccataggacatgaagaataatctttccaaaagagaatcaggagggagaccaaagaacagtatgtggaagaatatgtttggatggtaggctagatagaggaaacttgcttgatgaagttaaagctagaagcaccaagagctttaggatcattatgaatcatttggggtaggataatttgggggtagaataacagtttgagattaggggaattattagggtctggagcaatgaagaggggaggaatctcttactaaggcagaaggttgtgtttttgtgcttcccccgaccccatacaaaaatttattgattattgttttaaaaaaaaatgaaaagaaaaagaccctgcccaaaggcagcattcctaaagggtgctcataaagtagatgctgtgtgaaaaggggttctcagt

SEQ ID NO: 3494 - DNA, 1124 bp, Homo sapiens
gccttcggtgaggaattcagggctttccccatatcttctctcccccacctttatcgaggggtgctgctttttctccctcctcctcaagttcctttttgcaccgtcaccacccaacaccttccatgacacttccttgctttggccagaagccatcaggtaaggttggaaagagcctctgacctcccttgtttagttttggaaccatactcactcactctccaccagcctgggaaatgaatattgggtcctcagccctgccaccctctgctgtcatcagctgatgcattgtttttagctcaggttttgataaggtgaaaagaatagtcaccagggttactcagacctgccagctctcggagtccttggtggttgaacttggagaaagaccgcatgaagatacttgtaagcacacatgatccctctgaattgttttactttcctgtaactgcttttgcttttaaaaattgaagaagttttaaacagggctttcatttggtcatccttgcaatccattggggtctagtttggaatctgacaactggaacaaaaagaaccttgaatccggtgcatgccttggttttggtgctgctgctgcttcccaagatcctcagcagggattaagaaggaacccggtgtgcacagcagatccccgaaattggtgggcttgacctcctggcaaattgctgcgtctttccacttgctgttcaggaccactaaatgctgaaatgtggatgcataccgaaataaaagcaattcattgtgtactaaaggttttttttttttttttaatttagtatttgtgtaaaaccaccttttgaagcagcaactatcaagtctgaaaagcaattgatgtttccattaatctttttctggggggaaaaccttagttctaaggatttaacatcctgtaagtgaagtttaacataacagtattccataagcagcctttttattgtcagaccattgcctgattttaatataataaaaaaaaagtgtgcgttaatatttaacaggctgtacttttcttcctcttggcatattagggacagaatttaatgttttagatgctttgggattcaaattgacatcctaaagcaggggtcggcaaactttctaaaagggcc

SEQ ID NO: 3495 - DNA, 1124 bp, Homo sapiens; identical to SEQ ID NO: 3494

SEQ ID NO: 3496 - DNA, 1158 bp, Homo sapiens
agagtgagactcttgtctcaaaaaaaattttttttccaacaatacagagtatatagaataagaggttaacttagtcccgctttaactctgtgtcagtcaggaaaagagaaatcataccagctaatttttttcccagctttattgagatgtaattgataaataaaagctgtatatatccaaggtatacagtgtgatgatttgatatacattgtgtaatgattaccacaaccaaattaatcaacgcatccatcaccacgtgtagctaccttgtgtgtctgtggtaaggacacttaagatctactcttttaccaaatttcaagtaaacaatccagtattattaactgtagtcaccatgctttacattagattcccagaacttactcataactgaaagtttgtgccctttgaccagtatctccccttacaccctggtccctgtcaaccactgttctgttctctgcttctgtgagttctacttttagattccatgtataattgagatcatacactttttgtctttctgtgtctggctgatttcacttagcataatgtccttcaggctcatctatgttgtcatgactagcaagatttctttttttttttttttttgagacagagtctcgcactgttgcccaggctggagtgcagtggcgccatctcggctcactgcagcccccgcctcccaggttcaagcaattctccgactggcaggatttcttatttatggctgaataatatttcattgtgtgatatatgccatattttctctaggacatttaagttgtttccatatattggctattgtgaataactgcaatgagtgtggaagtgcagatgatctctttgagatactgatttaatttcctttggattgatacccaatactaggcaacagagataatttaatataggaagttgatcaaatagatgttggactaaaaaatcaaagaaggcacaatatgagaacacagagatactgctgcagaaacagtaaccaccctctgggtttgggaggccagcagaggaagcttgggctgtcagaacctggcacttggggaaaaggtgccccctctgctgctgctggcacctgcggggcaggggcaagcctggttgggggagtgcaaaagacactgaagcccagaaccagctcttgctgcc

SEQ ID NO: 3497 - DNA, 1158 bp, Homo sapiens; identical to SEQ ID NO: 3496

SEQ ID NO: 3498 - DNA, 1144 bp, Homo sapiens
ctccccaggtgctgggattataggcgtgagccaccgctcccagcccctctcctagttttgtaagagcttgtgatagtaactggagtaaatgccgtattttgctgatgtacctcactgccagttaacaccttctatgttgttagtttggaaactcggtgtttgaaactagtataaaccaaagccccatgctaattaactgaattgatactttgaatgtaaaagctgtttcttgtttttactttggcactttccaccttgattgttgagatactttatttgataaaccgtccatgctttgcccattgtgggtggccattgtgatttcatggttttttgttgtttgtctgatcctgtttattagaaagtgaggagaggatgattatgttccttcatcctctcagtgtcttagtactccctacacctgcgttatgttatgacctacctttgcgatctgccagttttggggtcagcttaagtgagaattcatattctgcttcactggaatgagaaggctctcctcacatattatcatgcttctcaagttggtatatatgagccaacttgattatgtagtgtgtgtgtgtgtgtgtgtgtgtgtgtataggaagtcacagataaaaattgagccaactgtggaaagtgacagttttgattgcagggcacacgtttttttattctaatcaatgaaaaatgcaaaattcatattactgtttttagtcctgggtcctgtcatctctgtgtattaattcagtcctctgccttaaggagttccttgagatttcactcacaagctttggtattattgatccctaccttggttccaagacagcagctagagaaagcctggaacctctcaagaatttcagcagtgttctggaaataaagatttagaaaataagaggaaagcatagacaacgttggatggagtttacaaagggaagcctgctctgaatatatgccacagttttagatttaagttaaagatttaatttaaaagcatacacgtaatctaaaagagtcatgcattatttgaccagctgttagaattaaaaatgaatctgcatatcctaataccctcttcagtaagggtatagatttgtaattgagtcacttagctgtgggttgtgtttatatgtcacttctc

SEQ ID NO: 3499 - DNA, 1191 bp, Homo sapiens
tttccctttgatagttgtgacgcctgtttctggaccccatgcaccttccggaatattcctgcctgctcactgccgtcttcccctttccttgcagatgtgtacttcatcgccaccttgtcattcttgtggaaagtctccgtcatcactctggtcagctgcctccccctctatgtcctcaagtacctgcgaagacggttctctccccccagctactcaaagctcacatcataggccgtgcgttcgctggagggggccctggtcttggcgcttccctgatggacagagctcaagttccatttatattaaccgccacctgtggattttgcagtaattgctaacacatgcagttttaatgggaagtggctctgcgcctaaacggagtcctaacgctgcatcaacgggagggagggtcctgaaagagacccatctgggcctgtctgaacccctcgttcttcatgtttaggtgaatatgaatatgttaaagctggtggctcagctgggagatttatatgggtcactgtgcgagcttccttatgacttgaattttgttgtcacatgataaaagtttctgtgtagctgaaggttgtagaaggcttgtgtgtgtgtgtgtgtgtgtgtgtgtgtgtgtgtgtgtttttaaagagtcctaatgtgtatgtactctttatgtctttcttgctcttacaaagaggtgtcagaaaaatagaaagctcttggtgtcggtttgggaggaaaagacagtgacatttggtaaaaagttatccacacaataatctccattcggaaatgctcagtatcgtctccagccagccctgcttatccaggttacactggattcctgggatcgtaaccagtaaatgagaggagagggagagagagtgtcctaagtccaatctgttatccttgatctgattcagcatccatagtgtgtgagttaacttcacctgccacctcgtaaaagaatttcagaggtgtgatcccgctttattgggacctggtaacaatcacaaagccagtggctgtttgagaaggacctcagacattttcagcagagttgttttagcaggaaacgtgccactgaatggcccctaaatgtgtcgacagtgtgataagagactcaactaattctttaggcaacatggcagatgtgactcagatcctccaagaccaaagcggaaaggtcagggggct

SEQ ID NO: 3500 - DNA, 1193 bp, Homo sapiens
ggtctcgaactcctgacctcaggtcatccacccgcctcggcctcccaaagtgctgggattagaggcatgagccaccatgcctggccattctttttttttttttttttttttaaattagtccctcacttttccatgtggatatacaatataattaatcacttccctacggatggacattgagtttatttccaattttcacagttgcaagcaaagctgcaaaacacatcctcacgtagaaaaattggcttgcttatgacatgactctccagaatgaagtcccagaattgaaaatactcagtaaaaagctacaaactcagctgggcgcggtggctcacgcctgtaatcccagcactttgggaggccgaggcgggcggatcacgaggtcaggagatcaagaccatcctggctaacacggtgaaaccccgtctctactaaaaatacaaaaaattagccgggcgtggtggcaggcgcctgtagtcccagctactcgggaggctgaggcaggagaatggcgtgaacccgggaggcggagcttgcagtgagtgtggagatcgcgccactgcagtccagcctgggtgacagagcaagactccgtctcaaaaaaaaaaaaaaaactacaaaactcgattcaaattttcagttgttaaaatagaacctttgttcttcaggacctgagactgaaggaagatgttctcattggtcagtatgtctgattatatgtcaatatagggtaaaagaaaggaaaatagtttgtagctttgggtaattttaatatccataagttgtagcagtataatttttaaagttgcatttgaactggaggtttggttttgaaaccactggagaaagtaaaaaattagagctgggcgtagtggcacacacctgtaatctcagtcactagggatactgaggcaaagcctgggtgacagagcaagactctgtgtcaaaaaataaaaaataaagaatgaaatataaagaaagtaaaaaattacatataattaaaaaaattggcttcaaaacgaagtcccagctgggcatggtagcacattcctctagtcccggctactcaggaggctgagagaggaggattgcttgagtctaggagttcaaggccgtaatgcactatgtgaatagccactgcactccagcctaggcagcatagcaggaccctatctcaaaaaaaaaaaaaaaaa

SEQ ID NO: 3501 - DNA, 1357 bp, Homo sapiens
atgttgcatggaaataacagttatccagatgactgagtttttggcgccaccttaaacagcacgctcagggtaagtgaggaatcactgttcaggctgccctttcagactgattttattttcaccacatgcaagtgtggcctgttcaaatgtagaaaaaaaatcagtgcatgtagccacaactgatatttggaaccctttgcacttgtggtccttcatctttggggggttatagatcctactgagaatctgatgaaagctgcagccctttgcacgtacaaactacattctgcatttaatttccagagacttcacagaccctcttcaactccatccaagactttcaaagaatcgtactccaattagcgagattactacaaagccaaacttcctctttaaacttgtgttgatttcccctacaccctccctaccaaagaaggactaaatatcttcttcttttccatgctttgtaaagctatttcttaaatgatgggatgtatgttgcctattgtggagaccaaggatatgtttcttgccctccaaatgatcttggagaacagaaaaatgattgtttttgtggttattggggagtcctcctgggatctgaataattcccccccaaaaaattatgtgtcatgggctaggcgccagcctgaaaaggagttgtcggtctgaatttatgttacattgaattgcaagaaaagagtccctgccaatatcatccagcaaagcactagacctcggtttctcaaccttggcaccactggcatgttgtggagaattatttgttgtaggggcattctgtgtttagaatgtagagtgtgtgtgtgtgtgtgtgtgtgtgtgtgtctgtgtgtgttttgttttgtttttgagacggagtttcgctcttgttgcccaggctggagtacaatggcgcaatctcggctcactgcaacctccggctcccaggttcaagtgattctcctgcctcagcctcccgagtagctgggattacagacatggccggctaattttttgtgtttttagtagaaagagggtttctccatgttggtcaggctggtctcgaactcccaacctcaggtgatccgcctgcctcggcatcccaaagtgctgagattacaagcgtgagccaccacgcccagctaaatgtagagtgtttagcagtatttttagcctctacccctcagtcgcgcccccccagttacgagaacccaaaatgtctccagacagtgccaactgtcccctggaggacagactcgcccccacttagaaccgctgggctagaccatgcaagttacctcaagcttgatgactgttttccaagttttctttccaacttttgggtgagatgtgtgtg

SEQ ID NO: 3502 - DNA, 1125 bp, Homo sapiens
gtttctgaccaggtctaggaagaaaagaaaatggaagtgagaagaaaatagagtgaaaatagaaaatcaaatgagaaatgaagtccacaattctaaggggccaggagagtaaaagtgctcacaggattccaatcaggatggaagggagtggacaggggacatctatatctagaaatatgtctgggtagtattggcttctaggagacaatggaacagtgccctcaagagttgggaaatgattttgaacttagaattctatacccagccaaactatctcaagtatgagagcaaaatagaatgatgtgcaaggactcaagattttactcccagccaccatgctagtgggagttactagaagataaactctagcaaaggaagggaggaaacatctggcatgatatatttgatatgtgaatacctgaatatggctaactgggattgcagcaaagagaaatatcaggctgatacttgtatagaaagtcaagagaaactaaatcagaagttttaaaaatccattttaaaaattccttgtgaaagggccgggcgcggtggctcaagcctgtaatcccagcactttgggaggctgaggcaggcagatcacgaggtcaggagatcgaaaccatcctggctaacacggtgaaaccccgtctctactaaaaatacaaaaaaattagctgggcgtggtggcgggcacctgtagtcccagctactcgggaggctgaggcaggagaatggcatgaacctgggaggcggagcttgcagtgagctgagattgcgtcactgcactccagcctgggcgacagagtgagactctgtatcaaaaaaaaaaaaaaaaattccttgtgaaagttacaaaattatgagagtggatgacttctgaaattgagattccttctttcaagaaacacagtctaatcaagaagcaagttaaaatgtgcccccaaatgagcaacacgtaagaaaagaaaacaaaattatattgatgggtggttacgccatccactggcctgagtgtgacagcagacttataaggaagtgattgtaatcctggtgcagtgtttggctccgatgaatatcacattcccagtcaccatttaaattatttatagttggcttctgaacttg

SEQ ID NO: 3503 - DNA, 1171 bp, Homo sapiens
gatgccgtgctgcttgctgtttggaagaagtgagaggaaggggtccacctgaccattctccatgtggttcatgaagctgcccaagatccctacagctgccacttcttatcctgagtacttctataaccactgccatttttcccaaacagggtttggcctgtaattttctccatcaatcagatttttatgtcatctttcccttaggatttctgaactatcaatgaatgatacacattcttgtttcccaatatgctgatgtagacttcagtatctttctctctcagtatttggacaggaggaggcggcacacccatatgcccaggctatcatcttggtcaaatctttgtagccatcttgaccaaaaaacctttaactttgactccttatgtgtttgaaggagacaaaccgcacaagtgtgagttctgtgacaagtgcttcagccggaaggacaacctgaccatgcacatgcggtgccacaccagtgtgaagccacacaagtgtcacctgtgtgactacgctgccgtggacagcagtagcctcaagaagcacctgcggatccactctgatgagcggccgtacaaatgccagctctgcccctatgccagccgcaactccagccagctcaccgtccacctgcgatctcacacgggtgagtccctgaccaggaaacctcaatcccttactttttctctaatttcttaaccttcatttacttaacaacacaagcaacttaaatgacttggtgtggtagaagtacaagaatttggaacttctgtgataattgtgagatttgtcatttttctgttgccggaacaacaacttttggtaaaatatgactgacagctgggttttatatcttgactatatagaatccagctgggagtagatacccactataactgccaagaagccaatgatgtatctcaagtcagacctataaactagatgtttcagtaaatgtatacactgattgcatggctaaatttggaatgtagcaggatccattaagtataattaaaaatcacaaacttttaatcttaggaacttcctttatgggaccctactgaaatgataggaccaactcatcgtggcatggaaaaatggggtttgagatattcataaagatgctcataagttgaaaattttcaatgaattcctggaaaatggtgag

SEQ ID NO: 3504 - DNA, 1200 bp, Homo sapiens
tggtgaatcatggagttcaagagaggaatgagcctctgtgctcactgtcagctttctcccctctagttctttagatcagtccctgaagtatacagagacgggagcattgtcctgctttgtttcaaatgtcttagaaactagggcttaatgttcattaattagtgactatctttcaggagcttctaaacattgttgaaccagccatctgaactccgactgctaaattaaaattcacatttcatgagctgctagtgtccccaaaagataaagcaactacagctgccataattggcaacacactgacgttttaagttacccaaagagtcaaagcagtcatttttcttcctccttctttcctgttcatgggtctgatgaagataaaggattgcaaagtctctgtcctcttcttttctatttactatggcttaaaaagccaggccaattttgggggaagggtctatctcacggacctacgtgttcttgcttgtagttcttaaagctgtgggtcgggagaacccagagctgacttctgtgacccatcacaggtgacatgggttttattgcttatccaagatctttttcctctcccctgcatccagggacgtccgtgaagtcatgtcccctgaatacccctggagagtagtactgtgtgtatctgtctataaaaatctcttttgcttgttttattggagacactgagggctttggattgtcgttgtctcaaccaggaatgatcctgtactgccccagctccccaacccaggccggcattttgcaatttgcagagtcatttttggttgtcaaaacagatgggagcttttactgtcagcttgtggggtagagaccagagatgctgctaaacatcccgtaatgcacagggcagccccacagcagagaatcacctggccccaaatgtcagtcgcgcggaggctggggaaccccggtggaatattctgtgctatgctgtagtagctggggtttgttttcctaaccaacaaatccaaacagaaaagcatcggggatgctaagctgggttggagcagaagtagtttgggaaattcttttgtttctatgacattaaggactttttttaaagggatgcatcccatgtttttggcttctttaaggcaacatggtatacaaatacaagtgcaaagagtatcttcagggtataccacaaaatcataataatccagcaat

SEQ ID NO: 3505 - DNA, 1220 bp, Homo sapiens
catatgtgccgtatgtcagtagcttgacagttttcaaatcgtgcctatatttttttgcatacacaaatttttgtgtttgcaaactcagaatccatgccaaaatacaatgttatatgtcattttcagctccttctctaaaggaatggcccatttctcattgtagtttgagaaatacatgtatgaagagataggggtcttgggcttcccagtgtcactttgaacacctgaataacatttaactcctgagaccttctcggtgtagaggccactgcttccccctgctggagatggcatttcattgaagggcctctcgtggctttccctgcccccggctgtctggcctgaagaaggagaaagaaccaaactgaactatgaaaagttaccactctgaggagacctctcttaattaacacttggggccatgtttgctgttgttgagaaggagtgttctcaaagatgagctggaatggaattgtatttagaaaggcccctgcaaagtatatagatggatgactctagttcatgacatacaaatcccataaggccaacgaccactcttctggaacaccaagagcagctctgagatcatgctggccctacgcgaattgagtttctgtggcctaattggatttggagaacgccttccctggccccttttcctcagacagatctgctctgataggaaccttttcaagaaagttactgttgtttcaatgccactccttacctgtatagaacatttccaatacattcgctcattgaacttaatccttgcaactgtgactggggggtagatggctctgtttgcatacgaagaaataaaggctccaggaggttaaatcgggcaactttttagaactaaatcagtctctgtaaggcctacattgctaagataccatttcagctctgaaaatctgcttcagggaagtgagtggatgaggccttcctgcctcagctactctgcccgtctgtacatcttttgtgtctgcctccgtaccttattcagttattttcacactaaagtaagtagaattaagactgtagttcagatgctttttctttttctgttggaaactgaacacactacagacagtgaaaaaaggtacatattccattttctcattgcctgaagatctctgctgatgctcctggagaatgactttgggggctttagaaagaatattgccagtccgtctcggcaaggagatgatgggagcgct

SEQ ID NO: 3506 - DNA, 1210 bp, Homo sapiens
ttctagctaataataatacataccaagagatggtaagagtttttcttttattttgccacctgtgtctctctccgggaaagagtggtttctcagctctcttactaccagggatgaagccgtgtctgcgggatgtaatttgcagagaccttacatatgtggtcactcacatgttatctgaatacagctacagacaatttttgtgggtcatttattttttaattttgttgcatttgcaggtctgatttacatgttaaaatatacatttatttaacatgataaaattacattttagctctgctctcttattttattttcctgagggaaaatagaatgtggtattgtatgtgatatttggtgtttatgaaacagattaacagcatattttagtgaaaccaaagcaagtgtgttttatctgtttccagtgtattttaatatttacagtcattttttgcttgtttcctagctcattttcaaaacaaccacagtaaataaaaattaaagcatatattgatgtagcttaatttaaaaaaaaaaaaggagattttaaaatgccttgcttagtggatctttatatttagtcagcttaaaatctcagtgttttctcaactgaccatgccttgtctgtctgtctgtcccatgctgctttctttgtgctttccccaactggatgggactgatggggacaacatgtctcttcaggagctggacgaggtattgtgttttgaatatttttatatgttgggtaatttgagtttataaaatacctacttttcctgaagtctttgctcatatataaaatgctaacagcttatacatatttagcatttgttttgattactttataatttttttaacagtttaatatgtagaatttaatctattttcacaccatgtgaactgatgatttaaaaaaggctttgggaagatcgtttactagtcttgggaaagtgtcttaactttggaagcagtaaaggttgaacactttcttcaaggaagccagaatgttttgagaattaatgtctgtagcttcctgatttctgagaagtgagtcgtgcacttcctcaggtagacagtatagaaggccagcatgtctgtgaaggccctaaatgagaaggactgtagccacggcaactgtgggagggtcttccttgtcactcctgtctggaatgagatgacacccagtggatgcacctggagctattgtcacctg

SEQ ID NO: 3507 - DNA, 1210 bp, Homo sapiens; identical to SEQ ID NO: 3506

SEQ ID NO: 3508 - DNA, 1099 bp, Homo sapiens
gcgccgccgccgggggcacgagtagggcctgggctgactgggacacggactcgagcgacgaggacgacgcctactacgcggcgccgcgcgttgggggcatcgtgtggcggcccgggccgctcaaggctggcgcgctgagcgcccacctgcccctcgtggtgttcctggtcttctcggtgcgcagcccctcgtgggtgctcaacttcctgctgcagaagcgcacggagcagggccgcggctgcggcttcgtgttcggggcgacctgctgcttccgagtgttcctgggctgcgccttcttctcctacttgggcggccgcgccaagcgcagaggccgcgggcgctccggggccagaggcgccttcggctcgggccatggcgcccggcgccgggggcgcgaggagcggctcatctagtcagaccccccaccccgccaccgccaccagacaccaccatcgctgtgtagtgtgggtttttattcgtgttcgtgtgtgtgtgtggacacattttccttttcggttgctctgtcctttggttcgtgctcgcctcgctttttccacactcctgctctctggctctctgtgtctctcgctctttcgaaaattttcctaagtccgggcgcgcgctccctccccttccgcccaccccagcccctcggcggcgcccgcgggagggggaggaggcctcgggggcgccgggcgacgcggtccggggggtggagcgttggcgtcgtgcgaggggtcgtcactggcgcggagacgccccctctcccccctcggctcagccgggctgctgcccgagcccggggggtggggggcgtctccccggcccgtcccgtccccggccgggcgcgggcggagggaccccctccccgggctcccggggggccgcctccctccgccggctcccgccctcccagccgccgccgccgccgcggccgctcctcggccctcctcctcctcctcctccttccacccccctcgccgccgccgcctcctcctccccccgcctccccccgcccgccgcggcgcttttggctcggggcggcggcgggggcccggccgaggcaataagagcggcggcggcggcagcggcggcagca

SEQ ID NO: 3509 - DNA, 1050 bp, Homo sapiens
cttttatgttcctacctacaagtcccccatcatcattttttttggtaagattcacattttcccaggaggaaaatttagtcccagcacatcttacaaatgaagtttcttattttcacaacattgaaccatttattggcatattctaacacatttagtgtatattcttcctaaacaattctgtgaagaaactaaattactcagtagcttaccccattccccctacacacgagaaaagaaactacccaaaaccagtaattcacaataagacccagcagctaattgcgtgaacttttgaatatgtttaacgtgttgaattaaagttctttgtgagcattaattcattaattgggctcaaaattcaaaatcacaccaagtgtcggtcacatagggaactctggtctcagggtttgaatgacagtgttgttgattagttcaagctcttgcctttctctaaactttcttgtgttcactttcaggaattctatgagcatgccaaggctctgtgggaggatgaaggagtgcgtgcctgctacgaacgctccaacgagtaccagctgattgactgtgcccagtagtaagtaaccgccacccaacccatcagcacataaaacagacaaaaacaagaaaacatgaaaacctgtgatcctgctttgaaagttacttgttgatgattcctttcttagaagccaaccagttaccccactggcagaaagttctaatctgattcaattgtttatttataaagtccttaattgcattttttttcttttagtgcagcgacattattttacataaacatttaaagcctgttagagcaaaatgatgatgagtttcatagtattcctaattagtaggaagtaattaattgaattgaccctaagcatttagggaaatagggctgtgctcacattttgaataatgtaaaaatactatattttattgctgtaattttaaaacataacaaagaggaatggtgaagacatagctacgcctcctctctccttggtagttgttgattgatctatttctgctctcaggtaagcgactcta

SEQ ID NO: 3510 - DNA, 1878 bp, Homo sapiens
caagaatattgccagagagcaacaggaataaagaagctaagtaaagaataaaaaagaaaaatagaaaaaataaaaataaacacgaagaacaaagccccaccaccgtgctgtgctgtttgtgtggccccactgcgtcgaggccacaggctagctgctagacgcatctagagttccctgattcctaaaattatttatcttaaatcctgtttgccctaaccttcttaaggcatcagctttgagttacaaatgtaaccaacacacaagcaaatgtgccattgacttagtgctgcataactgtgggacggtcacttccgttgagcctgaccttgtagagagacacaaatagttggcaaattgatgtgagcgctgtgaacaccccacgtgtctttctttttctcccagcttcctggacaagatcgacgtgatcaagcaggctgactatgtgccgagcgatcaggtgtgcaaaacccctccccaccagaggactctgagccctctttccaaactactccagacctttgctttagattggcaattattactgtttcggttggctttggtgagatccattgacctcaattttgtttcaggacctgcttcgctgccgtgtcctgacttctggaatctttgagaccaagttccaggtggacaaagtcaacttccagtaagccaactgttacctttttatataacagagatcatggtttcttgacattcaccccagtccctctggaataaccagctgtcctcctccccaccagcatgtttgacgtgggtggccagcgcgatgaacgccgcaagtggatccagtgcttcaacggtaggatgctgtgggcttggctgttcgtaaagaacgctttgcttctgtgttgttagggatcagggtcgctgctcacgctcttggctttgctctctttggttaagatgtgactgccatcatcttcgtggtggccagcagcagctacaacatggtcatccgggaggacaaccagaccaaccgcctgcaggaggctctgaacctcttcaagagcatctggaacaacaggtttgtggagtgaccgcccaccccctgcgcttgcccaggaggccctggtctgcactgtttatagagaagaaccccgtgcaagcattccagacccctggccgaaagcgcgcttctcccaagcattcacacggcctcccttcttgtagatggctgcgcaccatctctgtgatcctgttcctcaacaagcaagatctgctcgctgagaaagtccttgctgggaaatcgaagattgaggactactttccagaatttgctcgctacactactcctgaggatggtgtgtatggcttccactcttgctggctgttcattgcggtggttctttttcaaacggtcaggctgaaaacccccatccccctcccaccaccaaaccataaaggatctataagagaagcaagaaaaacgcactcccactaattctcatatggaaaaatcagggttttgaagacttcaggagctacagagatgctagcaccccagctctgcttgaattttaaattacattaatatgtattccctttttatatagctactcccgagcccggagaggacccacgcgtgacccgggccaagtacttcattcgagatgagtttctggtgagtcgagcctgtctttagtttcctctcttgttcctcctctttttctcatggatgtaaatttacttaattccaaattcaggggttcagctacccagttccatggttttagttcacgcacatccagtgtggatttgagctctttgcgcccctctttttgcttttgttttcatatgacatcagaggctggctgacagccgtccctggtaggtgtccccatcagggatagggtggtt

SEQ ID NO: 3511 - DNA, 1130 bp, Homo sapiens
tgggtagtttttttttttttttttttgataagttggtgtaaggctatgtgacttgatcaaaacagatgcagggcctctaaataaaagggatcatctgaaattaatgttgtttgaaattactatctgattttgagggttccagtatttctgtgaaaattcaacaagaactccttggaaactggtattgatattcagtctccttaaggtagatttttcaagcttttcatacattggaactccacctgactttggaccaaccccagaacagagcagagccacctcctatagacgcccattgccctgctgctgtacacttcagcagcttgcacaagggagctcacttaaaaggagaaattgtgtagttttaaaatatattttgtgtaaaataccttactatgctataaaccaccattaaaaaccagtgttttgatttggtacttaaatatttttggagtgaaaattatcactaaagtaacatgactccaacaaaagtatggtttcattataaaagagtactgtattgatttgcccaagttttgtaacttagtaaaggtattaacttccttggatttgtactttgtgatttagtatgctgtatcgtgggctggttatgttaactgaaaaaaataaagtcattacctgagttttgcagtgctctaacttaaacagaagaacagctgttcacatcttttagcattttacatttgcctaacttaaaaattgccatgtgtcaaaatcatggttttgtaattgctaaggcatgatatgtcaggttatttgaatataattactttttgaagtaattgtgaccacaaaacatcttttttacatgaaggagctgtgtatcatttgaaattactcaaatgatgtcttgctctgaggcataaatcccaggtacttagtgtttttaataatatggtgccactgcaggatttgggggcggtggggaagaacaagcataatggtagggggaggcttggcctgaaactaaccactgagtgaattgcactgcaggttttacttaacgggaattccttatttgggatgtcaagagggcagctgcaaactgaaaaacaatccagtaaatgtactttgttttatgtattgtagcaggcaattaactactaaat

SEQ ID NO: 3512 - DNA, 1176 bp, Homo sapiens
ggaacccaaggaggcctcgaaatttcagagaaaggagttcatgctgccctggctcccgggccatagtcacacttcgaacaatccacgcatactccgaaggactgaagcatggacttccccaaacaacaacagagatttccagtccttccactacccgcccagctatacctccaacggccatgcccccccacacaggagcattcttgtttgcatagcacagctcagaactcggggaccccggtgcggcctggccagctgccccttgacctctgttggtccatctcctggactggctgtctgcagaggggggcacccagcacgtggcacagtgaaccccgccctccctgggcagccatgggagggtcagaaaggacaggttggagactgagaccccagctcaactctgaaggctgcacaggggcagctgtgagtttggtttggacaaggaccctgacatccaacgggaacatgccgtgagcctggcacagatgtgtgcactcaaggccaaagctgttcagaaaaggcatgaccttagccatggggaagggccataggctgaggtgggggccggggcccctggtggagctcatgctgcccccaaaggcaccccgagacactccctgaccccagtggcaggtgcagggtggggctccgggagggctccctgtccttccccagtgctggcaccgccctgcccgacaccaggtcctgcccagggtccctggtacctcacctccttcctcgggaagccagttgtcactggcctgggagagacagaaagctgaccaagcacgaggcttccccacgtggggcctgccccctgccgcagcccaaggcgcccagacacagccatgccagagggagaatgcaccctctgagttttctcatgcagtgagcacaggcagccgagcgctgtcccaggggtgccgggacacagaccctctcactgtcctgcagaaccaattccttccccctgtctggcttgagtcaacccagccctggagatagcagtgccagcctcgaggacagcagcaagtttggacccggccgctgcctgcccccgacgagggtccataggagaggagaggcaccgtctgcagcgtgcagaggcatctgtgcgacaggtaggcacggcaagacggggcctcctgccacccacacaggctcacaagcgtc

SEQ ID NO: 3513 - DNA, 1180 bp, Homo sapiens
cctctcggtggcagggctgtgcctgtctcagagacaccagctcccgcagcccactgcagggcgggccgagtggggtcaaagtgagcagtccagggttggccgctctggccccttcccttctctccctgtggcttcaccttcctgtgcctgtcccctcatctgcaaagtagagatggtgctaggactccactggcaggaccgccaccagcgccgcatggagacttttaaggcaccaagagtcctggagccgctgtgtgcgagtggggttggctgctgctgttagggggtgccagagggacacacacacacacacacatacacacacacacacacacacacacacccacacccccgcgtcagccttcagggccgaagctcccgactcctgagctgtggtagggagcacggattcacacacacacacacacacacacacacacacacacacacacacacccgcgtcagccttcagggccgaagctcccgacccctgagctgtggtagggagcacggattctgacttggagggcagagtgcccaggacttgcctctcccggcgtgtgtctgtgtctggccccatgactgtcacctgcacgtgcccgcacgctgcgtgttcctgccccgtctcctgccgtgtttccctggcactgtgatgctgctgctctgaatgacctggcaggtttgtgaagactggaatgacttgatcagcatccttctcctgctacgtgagctgcgtaccctctggagttgtgcctctgtcccatagacagggacgtggacggacgtgccggaggctgccagagaccacccagatctgaagtagcacagaacggtgtcctcaagtctgcagcatctgtctgctgagtgggacactgtggaagacactcgtggcttcacttgcactgtgggcatcccattgcagtctgccatctgctctttccatgtcagtctctctccgacaaacttcatgggctcaggacttgtggcgtccctctgtcctgggcagccaccttccttcccctctctggcactgactggccatctagcctaggggcggccacctccctacccctttgcgacactgactggccgtctgcctttgcatcctttttagtgattgttaacgaggtcacaagccagcagcacgaggattgatttctagatacctgcgttcttcaga

SEQ ID NO: 3514 - DNA, 1128 bp, Homo sapiens
gcgccgccgcgccccccgcgcccgccgcgccctcgccccccgccgcccccgcgcccgccgcccccgccgccgccccgcccccgccaccccccgcgcccgccactctggcccggccgcccggccaccccgccggacccccgaccgccgcgcccgccgtgccgccccccgccgccgcccagaacgggggcagcgccggggcagcccccgcccccgccccggccgccgggggccccgcgggggtcagcggccaacccgggcccggcgcggcggctgcggcgccggcgccgggggtcaaggccgagtcgcccaagagggtggtgcaggcggcgcccccggcggcgcagaccctggcggccagcggcccggccagcacggcggccagcatggtcatcgggccaactatgcaaggggcgctgcccagcccggccgccgtcccgccgcccgcccccgggacccccaccgggctgcccaaaggcgcggccggcgcagtgacccagagcctgtcccggacgcccacggccaccaccagcgggattcgggccaccctgacgcccaccgtgctggccccccgcttgccgcagccgcctcagaacccgaccaacatccagaacttccagctgcccccaggtgagtggccgcacggggcgggagggaagggcggctcccagcagcgccagctgccagttccaggaagttctccgctggtggaatgctaaggtcatctgtcccgtaggcccgtggctggagcaggccgaggggcagtctctacccaggtgcggggccagcccgggtggctgtctgcgagtgagccagagggagtcggcatagcctgcgtccctgtcgctgtccctgacgtccgcgctggctgcctgtgcctggggctggtctgtttcggagtggctcagccaggactcttagtggagtggtccttacctgctcccgccctatgcgtccctgcccgggttggtaggctcagcgcaggggctccctgggccaggcgatggggtctgcagagctgagggcagtacctggggctgtgagtggcagcagctgtcccctgctcagttctgcagttaggcgtgtggcctgtgtccccacttagcctttctgccccttggtgaccctggg

SEQ ID NO: 3515 - DNA, 1110 bp, Homo sapiens
gggaaaactgaaaacgcacacggaacaaatagtgacagaaaccaggtgcccaccgccctccacaagaggccatcttctccagcgcgtttcctaactgaagctgtgcctgtcccccccgtggattatttacagtctgtggctgcttttgctgtttcggctgtggcttcccagtgggagaggaccggcaaaccatttaatccactcttgggagaaacgtatgaattaatcaggtaaggggggaaaggcccatcataaatatcttgtaaatggaattccttggatgacagataagtttgattctttcactagcattgattcctctgctctgagaataaactgtttgaattaagagctcacgaaagcgtttggatgctgtaggcgagatgtttcacacacacggggtgttgtgctagcgtgccacggcgtctgagtgagtgtaaagcgctggcaatgagatattttagtgtgttcgactcaagcgtggagatagcgcgcactgtagacgcttccgtgtgtgtgtgcgacgtctgtgaaatgtgtaggattgttgtgagcttcaccgaaaatggaaataggtactaatgagcaaaactaggctgtttcactaaagcatttagtgaacgctattgaaaaagcaggtaaatccaaacacaggaatgattgcaaagaggagcttcactcccaaggccacgtttgccaccacagcctccccagagttttaggaagggtcagacggctctggccaagggagagttaaccagaccacgcctcatctccagacatccctgaaacttcttcctatggaactttcttctaggcagcgttgccatcccttcctagagtctccccagcttccctcctgtctctggtggccctcacctcacagacgtgagactgactccaagtcctagaactctgaccccagaggtccagccgggccccagatccgttgtttgtggctgggcctctggaaggactggttggggttctcttcacccacctggttgccctggggactgctgtggttattcacagaatcatcctgggattctgcccaggtgacagtgcccacccacaccaacaaatgaagtcaaaagcaggccagaccat

SEQ ID NO: 3516 - DNA, 1097 bp, Homo sapiens
gggccagggtgggactcggctgaagggcaggccctggggtcagggaggcgctggagtgggaggggagggaggtgggaagggcgaggggtggcgggcctcccgtcaccctgccttccctgcaggtggacgtccagcttcaagtggcagtgccacagccaggccgctatgccctagtggtggagtacgccaatgaggatgcccgccaggaggtgggcgtggccgtgcacaccccacagcgggccccccagcaggggctgctctccctgcacccctgcctgtacaggtgagtgggagccggtggggctggagtaagggcacgcccggggctgccccacctgctgaccaccctccccccacagcaccctgtgccggggcactgcccgggatacccaggaccacctggctgtcttccacctggactcggaggccagcgtgaggctcacagccgaacaggcacgcttcttcctggtaaggacccctcaggtccccaccccaaggggtcagcttctttcagaagatttgaaacatgcatgagaggggagaggacagttggggtcccaggtccccaaggcggccacactcgctcatgcccagcccagcatgtttcttctggaacccctcctgcaagcgttttgtggattcagtcccttttgacgtacccccgagctgttccatgtgctcaggaaagcacctgcagtcacagctccctggccccagggcagccacctcctggcacagacagcgttggttgcctgttctggaactttcttttctttttttttttttttgaaatggagtctcactctgtcgcccaggctggagcgcaatggcaagatcttggctcactgcaacctccacctcctgggttcaagcgattctcgtgcctcagtctcccaagtacctgagactataggcactcaccaccacgcctggctaattttcgtatttttaggagagacagggtttcaccatattggccaggctattctcaaactcctgacctcaggtgatccgccctcttgggcctcccaaaatgctgggattacagacaggagccaccatacctggcctggcactttctataaatgccacacaac

SEQ ID NO: 3517 - DNA, 1097 bp, Homo sapiens; identical to SEQ ID NO: 3516

SEQ ID NO: 3518 - DNA, 1177 bp, Homo sapiens
ggctctggggctctctcggcctcggtgcacatgtatgaactgggctggaaacttcaggcctgaagccagtttgcttttagattgttctgggccagaaatcaggttccgccatgtgagcgtcttgcctctcacagcctcagtttcaccaactgtaaaatgatacggagggaagaggaaccctttccactccacctgggaagtggtccctccacccacccacccatctatccctccacccacccacccacccatctatccctccacccacccatccacccacccacccacctacctatccttctacccacccatccacccatctatccctccacccacccaccacccatctatccctccacccacccacccacccatctatccctccacccacccaccacccatctatccctccacccacccaccacccatctatccctccacccacccactcacccatccctccacccacccacctatcctatcccatccctctgcctgctgacccacccacccacccacccccaacgtatccacccacccacccctacccatccatccacccacccacccccctacctatgcagcacccaccctttattccttgtttccatccatctgtccacctgtctgctcattcctccctccacacctgcaccgtcttccttccttctcacccactttcctgaccacgtggatgtatctaccaaggcccctgtctcggcctaggccagggggctgccagccttggtcagggtgggggcagggactccctggagtggggtggggaaatgtccttcctgggcttcagggctgatcctggggcggggctggggcctccatcaggaagccaggctgagcggcgggtgggtccgggcactccccctgcagcgggctgccagcagcctttgttctgggatctggagcggatgccctgggacgggggtgggggcggctggcactgggcatcgggaaggcttcctgctcctggaaggctgaggagggcggggtgggctgcatcacggttcggatctcatacccctggtgtgcggtggggcaggggctggcgcaggggaggggagactagtccctgtggtgtccacccagaagcagctgagcctgggcccccgggagtgccagctgggctcctggcctgggtcccgctgcgcccagccgtgga

SEQ ID NO: 3519 - DNA, 1177 bp, Homo sapiens
cccggagctacgacctgggctgggggcccggcggcgccgtcgtcccacggcctggcccgaggccagcaggtgccccttccgggaggcggccgggccggggtccgaagggttaaggccgcccggccgcccctccccctcctctctccttcccccccccaccccgcctccccggacctctccccggggctcggggctcgggcgctcgggcgggccggggcggggcctgacgtccgcgggcggagcgagccctgccggccgcctggcttcagacccgccgggctcccgccgcgcgcgctgtccctggagctcggggacgcggcccggagccgggaagatggcgaagcggctctgcgcggggagcgcactgtgtgttcgcggcccccggggccccgcgccgctgctgctggtcgggctggcgctgctgggcgcggcgcgggcgcgggaggaggcgggcggcggcttcagcctgcacccgccctacttcaacctggccgagggcgcccgcatcgccgcctccgcgacctgcggagaggaggccccggcgcgcggctccccgcgccccaccgaggacctttactgcaagctggtagggggccccgtggccggcggcgaccccaaccagaccatccgggtgagcgcaggggcgggccgtggggcttcctcccggggcactcggacccggaacaccggcccgaccccagggggagcgccgtggcccggggcgagtccaggtgcggactctctggttccgcattttgggggcccaagaaggcaccccgacccggccgctccgtctcggccgggaaacttcgcgtccctccgggaaggcggaattaaagtccccggcatggacccgggggcggctgggcgccggtccagttcgactgcggtgaccggggcgggaggggggccgggcccagtccctggcggccccaagtccgggatcccggggagggcgggacttggcctccgccgcctgctgccggtggggagggggcgcagctccgccctacccgggacaggctggaacctgttggcctctggatggggtgggaggggccagccacctgaggctcccactagcccctctcggaggagtctagggactcgaggagacctccaaagtaggggagggccagctgcgaagttttgactggggctgggaacacgtggctcc

SEQ ID NO: 3520 - DNA, 1720 bp, Homo sapiens
cacggcgccgcgcggtgactccccaggcgcagcccagcctcgaaatgcagaacgacgccggcgagttcgtggacctgtacgtgccgcggaaatggtaagcgccccccacatgcctctcttccgtccttacctaaccaccacgtcccctcgcctgcccttgttcccccacacccctcccgtccttacctcgtcacgtccctaacttgtcctgcccccgacgttactcttttccattcatatacccccaacctccctcgtcccctctttcattcttaccgcccaagtcccctctgctcactgcgccctttctccacagctccgctagcaatcgcatcatcggtgccaaggaccacgcatccatccagatgaacgtggccgaggtgagctgggagcccgggaggcgggaaggttgtgatatatgtgcgggaaaggcaggctgtcccattgtggaggagcccctggggtgaaggtacaggcagaggctggctttgaggattggtgtttcccaaacctgggggagtggtttgtgacccttcttctctttctaggttgacaaggtcacaggcaggtttaatggccagtttaaaacttatgctatctgcggggccattcgtaggatggtgagtgtttccctgggctttgctcatcacttcgggacatcgtggactttaccgtgcgcattggagtgtgtgatggtgcctgagtagatctgctggcagagtagtttgagccagctggactgggctggccgcctgccgcttcttgagggtggaagaggggtgctctgagaagacactcaggcagcagactctgcctctcactaggaggtgcccccccgaccccgctccaccatagtcaggctgcaggctgccccgggagaggtggctccccttctgcgcctgtctccattcgctcagcgggggagagacgtgggctggtggcacagctgaccttctgccatctcaggcagccggagtggaaatattcttagtgtgcttttttttttttcttaagggtgagtcagatgattccattctccgattggccaaggccgatggcatcgtctcaaagtaaggttgggggctcacatttgggcagagtgagtggactaggactgctccagaggcgtggtcttaacgttgtccttttcccctggttctaggaacttttgactggagagaatcacagatgtggaatatttgtcataaataaataatgaaaacctacctgtgcaggttcattctgtgtctgtaggcccagggttgaggttttgctgtcagtgggtgacgggtggggtagggtacccagttagttgaaaggagacaagctgtgaaacatattgcaaaactgaggtttaaaggacaaatacattatccatttaaaaacagatatctaagacaaaataactcaaacattctgaggtctgatacttgcttatgcacactgacatccacaactgctaccggtgcggaagcaacgccaggcctggttctgtatagtcacagccgagctgaacaccttagctccgacacctggatgtgttctagagaatgacaggctgagactgtagtttggtttaactactggctttgttgcaataatcctcgaataccacacagtggcagcttttggcatcataaaaatgggacataactgaagggaaggcttcacacatcacaaagaccgggttggttaatgactaaatctcactacatgaata

SEQ ID NO: 3521 - DNA, 1150 bp, Homo sapiens
tggctgcttggtgacatggattagcgctacgtgggctgcagcatttgggatccaggctacctagaggggcatcgggccagggaaaacctcggattagcaagcaataaaaacatgacctcactcttcctcaaaggagcccctggtcttccctgtgtgactcagttctttccatctgtttgtcccgctgcaagcctctttctgcgctgactgtgacattggaacgtggccttcctgtcaccccctccgtgccacgcactgaaggccacccccacccacctgggaaactaagaactggatattttgcctcattcacttgtactgtaacaatgtatataatttggttggtatttcactatttaatttttaagaagcctattttactagtgttttatatgaacaaagtactgcagaagttaaacctgtgttgtattttttctgagatgttttgctttaagagatactttttgctcagtttttatatgccagatacagagaatttgtagcggttatttttgtatgatctagtaacttgcaaacagaccaaatggatgagaggcggggaccgtgcagctgtcggctgatgaggaggcggccgccccagtgctgatggagatgccactttcgtgtgactgcgaacattaaagcacaaaaaaatccaacctggagttgtgtgattttgataccaaagtaagttcacttttcctccaaaaggaagtttttatttttccaagatttataactaaagcatacacttagatgacttattaacattcacttgatacaacatataaacaaaatagtaacagattctgagtggttattttgtggactgtgacaagcacttcaaatacaaaatgttaggagggcaaaacggtgcgggccctcgtaggtcaggcaggcaccagtgggctccttcctgctgaaagctgcggctgtgagatgagaccgctggctgggtcacagagtgaaatccagcgttccgtgtgcggacgaggagacaagctgtcctggccagccatcgcaccccaatgtcttcagcttgacgttgcttctctgccagtggagcctcctccaccacctgggaacatccctggccatctgtccctgaagtcctcctcaccatgacgcagatcacaaggcacccactaaa

SEQ ID NO: 3522 - DNA, 1175 bp, Homo sapiens
ggctggtctcgatcttacctcaggtgatcctcccgcctcggcctctgaaagtgctggcattacaggcttgagccactgtgcccggcccccgtgttgactttttaatatccacaacgatgaaaatcaggacatttaacattggtgcaagactgttattcacattttgcctgctgtctcaatagtgcccactacaactttttccccagtcgggatggcgtctggggcgctggttgtgtttagttgtgagatgcccctgcacgctgggggccctgaaggtgccagccactcctggggcctcccttgtggtgtctgtccctcccttcttcacaccagcaggtggttgagtcccgcttcgcatctccctgccatctgcatcaggccccggtgtcgctgtccctcacgtgctgtctgttgtcaggccctgctgcagactcggactggcctgtcccttctctcctcctttcctgcggacacgctgtgacttctcccgtgatccttctgtgagaactccctggacctcgtgtcctgtactggcaaccgcccatttctctgctctccttggctgcccggctgcccggcgcttgtctgtacctcctgagccacttcatcctctcttggatccattcccagcagcctgtgatcatggcctcccatgccgtttggtcacgccaccacgcccagctaatttttgtatttttagtagagatggagttttgccatattggccaggctggtctcgaactcctgacctcaggtgatccgcccgcctcggcctcccacagtgctgggattaccaacgtgagccaccgcgcctggcctacatacggattttcattctgtttttgaacatggccactggagggcctctcggctgcagagcaagcgtttgtagcttgttcgtggcagaatgagccgaacgctgtgttgtgacctgttttaaaaataaagcatcttgaaaaagaaaagccattctttttgtcctaatgagtttatgcctccttacctctggccacctgagctccttggtctgctgtacccctctggcctgggccgtgctggagtctttctggggctcagtcattcactttgttggttttttatgtggggtcagtggtagtgctttttccatcataatttgctcttatctttattatcccaaaaccttatttctatta

SEQ ID NO: 3523 - DNA, 1199 bp, Homo sapiens
gtggcgcgttcaatcctcagtgggtcagtgtgacctacggcatctggatctgcctggagtgctcggggagacaccgcgggcttggggttcacctcaggtcagtgtcctgccgctctggctctgcggagagcctgcggccaccccagcatctgttcctgacaccagaggtgctgacgccagggaagcttgggggccacctcccattgcattgccagtgtccactctagtgacgccatggcacagagttccagctgctggccactcagcctccctgcggctgctgcttgctgtgtctaattctcaggacgatgctgggtggagggtgtccctgggtgtccccggtgctggttgatctgctcgatcctctgctttccagctttgtgcgctctgttactatggacaagtggaaggacattgagcttgagaagatgaaagctggtgggaatgctaagttccgagagttcctggagtctcaggaggattacgatccttgctggtccttgcaggagaagtacaacagcagagccgcggccctctttagggataaggtagagatgggcccgattcactcttgcccatggtgtggggctgccctgccgtttgtggcagctggactgtggcctttagtggttctggagtcggttcttctgctggttctgacacacccactgggccacacacaacttgccgccctggagcagaggcttcctgcccagaggggaggcaaatggcttgcggggggagacagaccttccccgcctccaggggagaaagcagctgtgaccgtttattgcctctgtgacatgttgggcacagtgtttctaagaagtctggaggccaaataggtgggtccccctgtgttggaagttggagctgcaccaactaggagctccccagcactgttgttcattgtaaagtgagtcctggcctcgcatccacacctggtctgtgcacctgagcaggggccgtcgagggggccgggaggaggctgcgggtggtgggtgctccaggcgggccgtggggggtgcgctggagtcgacggtgcccgagggcatcgccaggcgcctttatgctctcgaatgccctgtgtctccttgtcaggtggtcgctctggccgaaggcagagagtggtctctggagtcatcacctgcccagaactggaccccacctcagcccaggacgctgccgtccatggtgca

SEQ ID NO: 3524 - DNA, 1146 bp, Homo sapiens
aagtggggggcggaagtgcagtgggctcagcgccgactgcgcgcctctgcccgcgaaaactctgagctggctgacagctggggacgggtggcggccctcgactggagtcggttgagttcctgagggaccccggttctggaaggttcgccgcggagacaagtgagcagtgagtcgcagtgaccctacaagtggttcttttacccgagcggctcgtaggcgcgttgcggtttttcgaaactacagctcccggcaggccccaagccgccctcggggccgcgggtcggcggattggccgcgctgcattttgggacctgtagtttcctgcgctcgtggcgctggcgccgcggcgttggctgagcccttgaccggggctggagggaagggccgacattcagtgtgtccgcgtctgttctgttagtcccagttcccgggcgggattgaggcttagagaagttgagtgatttgctgagggctgcacgggttggcatcccggcatgctctttcgctactttggctgcatctggttgcccacccgggcggatggggaatggactccagccagccaggagggcagagggctggagaggcagggccggaggttcagaccctccgctctgacgttgcgcctggtgaggccgggaggggtgccgcttgcctcttcagccctcacgctcttgtggaagtcgcggaattactgcaggcggaacttgcagcactgtgggcgtcttttccagagaaggacggagttgtggggcgggaggataaggcaaggcccagccacttcgcatcttcgccccgccagctcctcgagatgggatataccagggttgctctccaaccctctccgcaggagggactgatggaaacgcctgggaaagtagcccggtacccacaaaggctgtctacaaacagagtcttactgtctttcccaggtctgtgccatagggattctcgaagagaacagcgttgtgtcccagtgcacatgctcgcatcgcttaccaggagtgcccgagaccctaagatgttcggagtggttttttcgcacagacccgaatagcctgcccctcagccacgctctgtgcccttctgagaacaggctgatatgcccaagatagtcctgaatggtgtgaccgtagacttcccttt

SEQ ID NO: 3525 - DNA, 1146 bp, Homo sapiens; identical to SEQ ID NO: 3524

SEQ ID NO: 3526 - DNA, 1151 bp, Homo sapiens
gacgcgggtgtgacaggagccagctttggctgcttgtcggggagcctcagacctggcggcggcggcttggggcggacgtagccgggggccgcgacccaggttcttccttcgcagtcgttccctgccagccgcgcgccgcctccaggtgcactccaggagcagccgcgccgctgctcacccgccctgtagtccgctccccccagggccgtccccgttttaagaaatggggtgatggggcgtccctacccggcgcctgcaggggctcctggggagcgcgccggtggctcgctgctcccgggtggggcgcggggctggcgctcgagggtgccgtggcccaggcggggctgcagcgagtgtgttccccgttccgcgcgcgtgaagcgtgggagcgaagcctcgggggagggcgggagcgcggctgagctcactgtgaacacccggctgggtagtcccgcgagcaggggaggggccggaaccgatgtgtatgcggagaggtcgcagtcattgctgtgagcaggacacagtggcggctgacctgggagaagttacagagggacggggtgggagagggacgaggagtcgggaatggcccccaggctctcgtcctgagcggtcggctggacgtggggcgccactgaccaccgtggagaagcccgggggaggggaggtgctttctggctgcacactgacctatgttggggtgcccagggcaggatgtacacgctgctgtcgggcttgtacaagtacatgtttcagaaggacgagtactgcatcctgatcctgggcctggacaatgctgggaagacggtgagtgcccacgcccttgcgcgcacctttcccacggcctggcggcgcccccttcggttttgtgctgtcagctgcacgttcactacccagacggaagccaaatttcacctgagacggcaggatagtcaccaccagcctcctgaagagcagagtgttgctctgtttctgtttctgtcttttaaagaacagacctgagtaaggatatttggaagccagtatagcccctccttgatgtgtttcgcctctgcctctctcctcagaccttcctggagcagtcgaaaacccgatttaacaagaactacaaggggatgagtctatccaaaatcaccaccaccgtgggccta

SEQ ID NO: 3527 - DNA, 1168 bp, Homo sapiens
ggcttctcagacttgggacctgggtgcctgggatcctggcagacagaggttgtgtccagacagccagcatggaagtttcgggaatgggaactggtgggcagtgtccagctctccagaggggtgtgtgtatgcgtgtgcgtgtgtgtgtatatatgtgggaggtcacctgacccaagcatggcgggctgagtccaggaggggtctgcatgttggaggtgtacccagggatcagtgatggtggtttctgaagccccatgtccctggtgaaggaggactgaaccaaggactctgtgagggcaggtgaggcgctcacagcctcgcgaaggtggagaagggcaggggcaggagagggctgcggaggaggggccacggtgcagcaggccgtggggactgccatgcactctgcctggtgtcacatgcccacagcagcctcggtgacgagagcacggagcccaagaggtggggtgtcgtggctctgcccaggatctgagctcattggtcaaagcccgggtcaccatgcacaatcctctggcctggctgggccactgccctctgtccatctcttgcagtggtggggtcggacgccgtggactctgcacagtcctctgccctctgtccgtctcttgcagtggtggggtcagatgctgtggactctgggacctgcagctctgcctttgctggctgggaggtgcacacgcgaggtataggctccagactcctcaccaagatgggctatgagtttggcaagggtgagtacaagctgccctggagaagtgggcaggctgctgcagcatagcccaggtccagcagccatcaggttcccggggtcccgcagccatcgggttcccagggtcccgcagccacagcactgccatccccgtgctcctcagattcccggggtcccgcggccacagcactgccatccccgtgctcctcagattcccagggtcctacggccacagcactgccatctccgtgctcctcagattcccggggtcccgtggccacagcactgccatccccgtgctcctcagattcccggggtcccgcagccacagcactgccatccccgtgcctccgcaggtttgggccgacacgcggaaggccgggtggagcccatccatgctgtggtgttgcctcgagggaagtcgctggaccagtgtgtgga

SEQ ID NO: 3528 - DNA, 1124 bp, Homo sapiens
cagcagcaacagtggagactggggatgggacctggccagtgaccagtcctctccgtccaccccgtcacccccactgccccccgaggcagcccactttctgtttggggagcccaccctgagaaaaaggaaggtgagcttgggggcggcccccagggaggggcgggtgtggcggctgagcctgaccctggcccctgttgctgcagagcccggcccaggtcatgttccagtgtctgtggaagagctgcgggaaggtgctgagcacggcgtcggcgatgcagagacacatccgcctggtgcacctggggtgcggcggggcctggggtgcggcggggcctgcgggttggctggggttgtgaggcccggccaggccaccccttcagctcccactggctggctgtgtctcccgcaggaggcaggcagagcctgagcagagtgatggtgaggaggacttctactacacagagctggatgttggtgtggacacgctgaccgacgggctgtccagcctgactccagtgtcccccacggcctccatgccgcctgccttcccccgcctggagctgccagagctgctggagcccccagccctgcctagtcccctgcggccgcctgccccgcccctgcccccgccccctgtcctgagcaccgttgctaacccccagtcctgtcacagtgaccgtgtctaccaggtgggtgaggccacgggtggcagctggggcgggtctcagggctctctggaggggagtgaagccctggctgtgtctccctgtagggctgcctgacgcccgcccgcctggagccgcagcccacggaggtcggagcctgcccacccgccttgtcctccaggatcggagtcaccctgaggtgcgtgtgggctgagggcctgcggctggcaccaggtggggagggtcctggtctcacagcaccccatgtcctgtgaccccccgcacaggaagccccgcggcgacgcgaagaagtgccggaaggtgtatggcatggagcgccgggacctctggtgcacagcctgccgctggaagaaagcctgccagcggttcctggactaagtccggctcgttcaagaacataagctaccaccttctccctccccaccccctccaggcccg

SEQ ID NO: 3529 - DNA, 1208 bp, Homo sapiens
gtaaattccaaaaagcatttggtttgttagaaaaaacctgttttctccgctttataaaaacatttgaagccatgctttatattgaactcttaaggagagtattaggaactcgtccgttcaggttctaacttgttggtgttaagtgtctggattaaagactctctttttcgtgtgccgaagccatgatttctcaaattcattcagttgtgtcatacaggaaaaggaagcaaaaatttcagctttatttttgttttccggcttaggcttggttgggaagatttgatggtggttagacacgtctgcccttatttgcctgtttagaaaaacctattctaatgacaaaaacagttacattgctcccactattgtcatggttacctgaaggcaaaagtttactcaaagcttctgagattttatgttcgtttatttgcttctctttttaaaaaaatgtcagctgagtttcaggaatgagtagtctgtcaaacaagagatgaaattagaagcctggatctaagggctttggggaagtttcggttgagttcccctttcacttgtgtcggtgctgtaggactcggggtggctccagctggcgtctggcccagcagagagctgtaggggcccgctctggttgctggctgtgtggactctgagggacacccctggcgagggtgttaatgagcctgcagcgtctgagtccacccaccctcagactggcccctgactcactctgcacctgccatatcagcctccttgctagttctgaacagagccacatgctctgtccttggatcttcctggaatgcctggttccttaaccccctagcctggcgactgcctgcctgccttgccacccagttcccttcctcgcttaattttcccacagcgctgaatcctcctagtgtcctgcttaatgcatttatcatacttaatattttactgtgagttagtaaggtccgtggagagaatgttttgtgaaaaaaacagttgctggcacatgatcggggcccagtaaatatttgttcagtgaatgaacgtgaggagcttagcagcagctgtgcgtggtgctggccttgtcacccggaagtccttgtcggtgaggactgagcatgtagaggtaagggttcctggagtgttggccctcaggacagagagccaccatctctcacctgcccaatgaggaaagacagccaggtaaggggtggcttgga

SEQ ID NO: 3530 - DNA, 1197 bp, Homo sapiens
gaagccgggacgctcaccgttggccgagtaccttagagcagccctgacgcctgcttctgtctcttggtgaaagtggcgcccagacttcagtccttacagcccagaactcagaaccgtggaggtgctgtgacccacagggtttaccttgtaattgttgttaaaacccttctgggcttcataatggaatgcttatgttgaaatattattttaagtactattatctatgatgtggttagaaatgccaaagaatttttagcttttttgagacggagtcttgctctgttgcccaggctggagtgtagtggcgcgatctccgctcactgcaagctccccctcctgggttcacgcgattctcccgcctcagtcttccgagtcgctgggactacaggcgcctaccaccatacctggctaattttttttggtattttttgtagagacggggtttcacgacgttacccaggatggtctcgatctcctgacctcgtgatccacccgcctcggcctcccaaagtgctgggattacaggcatgaaccaccgtgcccggcctttttttttttttttggtagatggagtctcgctctgtcgcccaggctggagtgtggtggcgtgatcttggctcactgcagcctccacctccctagttcaaacgattcttctgcttcagcctgctgagtagctgggattacaggcacctgccaccacgccctgctaatttctgtatttttagcagagatggggtttcactgtgttgcccaggctggtctcaaactcctgacctcaggtgatctgccctcctcggcctaccaaaatgttgggattacaggtgtgaaccaccacgcccggccagagtgtgtagcttttgtaaaagttttggaaatggcctcagataatttcagaggtttttaaataaagaacgctcaaaatggagcaaaatggagagcccctgataggcctcctgcgtggaggtttgcagtaagccagaggcacctgtgggtcccagggagagacgggctgctccatggatgctcctgggacctggggcactgggtgggcctcaggcagataggagctggtccgtatctcttgccaagcccaggccaactcctgatgaagcagattcctgtgggtgacaagtgtcagaagatagaataggaccttagggtcaggaaggatttcttgaacaaaaaaggggaaaa

SEQ ID NO: 3531 - DNA, 1144 bp, Homo sapiens
ccagcactgccaggcctctggggcagtgactacagacatgtcccagcagccagggagcctgctgtacctcctgtgcccagcctcacggaccagtcagctttccctggttgcaggtggagggcctcgcgcctgtcctcccacccacccgggtcctgcttgccccagctctgtcctcgcagcccgcacagctctgccagcaggaactgggcaactgcagcaagaagcttgggctgggccggggccgcatcccactgtccctccccaagggcaggcatgcaggggggtcagccacaagggacctgcccttctccctgccttctgtgggttgggaggctcctgactgagccacctggagggagagccctcacattcagagccctccaaagagtttgccaaatgttggaaatgcctccagggcccgtccaccagccgtccagcttccggtgcctgcatgagtctccgcttggccctctcctcggcctaggaacccgcaggtcttgtcccgtcaggttcctcctgaagcttttgttctgagaggaaaaactttccagggtttcaaacttggaaaaacacctgaacgcagccagacacattttccgtcgtctggtcagccaaggaagtgttggcctgtggctgcactcacttccttcagccccaggaagccttggtcgggggcaggagggagggtcaggcagggctgggggcctgaccgcccacactcctcctcaggcctgcggggaacgccctgctccccaactaagcagccttctctttgttctcttccttctctctgtaaacccccgtttcctgccttgttccctccctgaacatgctcttcacctggcaagcagaggaagctacgttgggatatgtgagcagtgtgctccgtggtgctgctgtgtgacccgccttcccgtagccccttgccccgctgctcccgctaggccctctttcctgctcctgccccgcccctttccctgccgctgtcacgcctcttttctgccctgccacaccccatttccggccccgcccctttccctgccgctgtcacgcctcttttctgccctgccacaccccattcccggccccgcccctttccctgccgctgtcacgcctcttttctgccctgccacaccccattccc

SEQ ID NO: 3532 - DNA, 1185 bp, Homo sapiens
agtgctggcttccccaggcctgtagccttgcctcttggccggctagggcagccagggtgcatgcccatgccaggcaagaccagtctgcgtccactctgctgttcagacagcccagccagtggcatggcccccaggagcccggactctgcgcccctgctcaggacagcctccgcctccccgaccctgggctgtctcctgcccacttcccaagtgagggatgtagccgcctcctgggagcagaatgaggagaggaagcacctgtggacacagacagatgggccggtcctgcctctgaggcagctcccaggagtggcctactattgaggagtatgacctccatgtggagtcttcccttttccctgagcttctggcagcccctgcctcagtactagaagctccaagagaaacccatggtaggaggaagctgacacccatggctgacctgtctgcccctgggagagagcttagggctgccaggacttctctgtgcacatccttgactgactctgcggagggtggggccgaaaccctgtttctgtgggcggggaggtggctgtgtcccctgtgccctgctgagccctgggcggggaggtggctgtgtcccctgtgccctgctgagccctgggcggggaggtggctgtgtcccctgtgccctgctgagccctgggcggggaggtggctgtgtcccctgtgctctgctgagccctgggtggtgagccctgggtggctgcaggtccctgcaggatcccccgtgagtgggggtagggcaaggcagttattttcagatggtgccagagggtggagtttcagatttgtttatgcctgtcggaagcactctggggctagggatggggtgcccagctcagcactgacgttcaggacacctggccaagaggcgcctcagatatccttgtcctgctgcggggggttcactctgtagccccaggcaggccggggtactgtagctttttccaggggatccaggaggggtgcaggcacacggcgcacagtggtcctccgcaggcctgcggtcctaggctggccgaatgtgccagcccacacacaggagggggcagttcacaccgagggctggcccgaggattgtcagggccacaccaggcaaagccagcgctattaatatcaggcatacacaagcccccagctgggtgatcctcttatgcctgt

SEQ ID NO: 3533 - DNA, 1127 bp, Homo sapiens
ggccccagccttgggcagcagggcgttctctctggccagcatcctgggccttcactgctggtgcttccacgacttgtttggctgaagtggtagtggtgggtctgtaggcagaggactgagaggatccagagagaggtggggggcgggtcagcctgccaagcctggagacaagtctgcgaagagcatcaggtaggatagttcagccggcacagggacgggagcttggtgcagtgccagattgggccaggggtcctcagtgcccaccttggctgttttccatctgtgtctggagagaagattccaagggtacctgcctgggtaggctggcattgcatcaagtcagcatgggaaggtatgagggccccagtgagaagctgtgcccccactgctgggcctgggcagcttgtgagccagcagccatcatcagagacataattggcccctggaggaatgttgccagcctccttcctcctgcgcaaggcacctctcccaggggcacaccccctcccagcactgggtaggagtgcatcaccttcggcatcatcttcgcagctgtggggctacgcacactgtggagctgcgtacactgtagagctgcgtgttgggaagggggtctggaagttggtgagggtctcaggacaggactagatcctatcaaactgatgatgactcctgggttatctggggagaccttggctggcagcccctcccctaagtcagaagcccccatcacttgcttttcccacgtgaacaaaaccacaggaaggcaggcccctcttccctgaccagagaggacctgccaagggcagggctccagggcagcctcaccacgtgttccaagtggggcccgtcaggcttcacagattgtctacttgctctgcagagatgacggatcctttctgcgttggaggccgtcggctcccggggtccagcaagagtggtcccgggaaggatggcagccgaaaggaggtccgacttccaatgctgcatgacccaccgaagatgggtaagaggagtcagggccagagtcaattccagatggttctgggcagcaagtggtaggagtggaccattgccctgggcgtcctgtctccaggtacccagctaggcccctagagttcccaagg

SEQ ID NO: 3534 - DNA, 1150 bp, Homo sapiens
gtagggcagcagtgtgcgcacaggacgcacacagacaggtgtgcccataaccagtacacacaagctctacacaactggacagggtacagctctgctcggacagggcgcaccaggggcgagggcgggcagctgggctggttcagagggagggggccatgggttcagagggaggggaccatgggtcccactctcacagacaggtctccggactgcatcagagcactcgggaagcagcaatgccccaggctgtttttagcccccaggggccagttagggtcccagtgcaagctcgacctagcttcttccgcctctccacgaggaggcgctcccgcgcacgcgcctaccacgttcctgccccctagccgcggccggaagtcgtcgaaccaggacgtcgggacttccgcccagggaatcaaaagtgggcggggcgtgtgcggactgagcgctctgcttccggggcgcgggtgacgcgacgacggcgacactttgctacggagtgcatcggacgtcgaagcctagagtctctgcgtctttccctcttccgctgcctcattcctttccttcctagccttggtcgtcgccgccaccatgaacaagaagaagaaaccgttcctagggatgcccgcgcccctcggctacgtgccggggctgggccgggggtgaggcctggggcggcgcgcgaggggcggggacccggctacaggagcgcagtgctttggggcgtgtttgggggcgggggtctatggccgcgcagtctgaaagacgcttggtggatcggcttaatccctgcaggaagcaacgggctttggggtcaggacatacctgtgtgtgcaccctgcttgccgcctagatgtgacacattgactctcagcccagtgttttggtctgtaagatgggtaatgctgtatacggtctgcagtgaggagtagaggaatctgacgtgtagtggaaacacgcgaccaccttcctcaggtcgggctgacactccccccccccgcccgcccgcccgccccgccttaagcgtgcctgggtcctctatgcctgcaacacagatgaccaccgtgcgttgctggataagtgagcagtcgttattatcctatttggctattcatttgatgaggaacactactgggtttttcttggtggtggt

SEQ ID NO: 3535 - DNA, 1218 bp, Homo sapiens
aacacaaggactgcaactcctatgtgtgtctcagtgtgaactaagcccagagacagtagactgagggggcatgtaacacactgagacaccggttggggcagccaagggagtgcaggcatcaccctgcccctaaccctaggctgcatatcttgaggctccaaaagagaccccttccttctgcttgaggagagacggaagtgtagggaggcctttgtcttgcatcgagggtaccagctcagccatagcataatagggcactgataagagtcatgaggtaccccccttccgggccctagctcccagatgacatttctaggcaaccttgggccagaaggaaaccgctgccctgaaggaaagggttcagtcctggcagtattcattacctgctaaccgaagagcccttgggccctgaatagccagcagtgatacccaggtactacatcaagggccttgggaaagcctctgagacttagtggctttagatgagactcagcacattactagctgtggtggctacagaggaaaacttctgtttgagaaaagcagagggaaatgcaaaggggactttatcttgcactttaggtaccagcacagccacatgggggtagagcactgactgggctcttgtaatctcttattccaggactgtatgcttggatggcatttctggacatgccctgggccagaggggagtccagtgccctgcagggtaaatcccaggccaggtagcattcacaaaaagctgacttaagagaccttgggccttaagagagcatctgtggtagtctagcagtactccttgtacctagggtggtatggctacagagtgaggctcctctgtctttaaaaactggagagaagagtgggaaggctggtgtggtttgagtgccagctcagctgtaatacaataacaccaggtagacttctaatgttttagactctaatccctgactcctggactgcacttctggactcacccagggcctgggggccttcagtgccctgaagggaagcacagaggcatgacaggatttgccacctgctgactgtagagcctgagcgctttgagtgaacacaggcagtagccagggagtggttacagcaggccttgggcaagacccagtgttgtgctggcttcaggtctgacccagcacagtcacagcagtggtagccacaggggtgccagtgtcattccacttccagctttcagtaactcat

SEQ ID NO: 3536 - DNA, 1169 bp, Homo sapiens
ttccttgattaggtgctatttactcaaagaccaagaggaagtaagagagtgtgccaagcctgtacctagagagaaagtggtccaagcacagggaattgtgagtgcaaaagctttaaggtggagtcatgtgtggtatgttgaaagacaaggtaggaggccagggtggctagagtgcagtgagccagcagacagcagtagacactgaggccagagggttagaggacagggcctgggcaccatcaaataagctttggagttcctgttagggtcggagatctcactcagtgtgacatggggagcctctccggaggctttgggcagaagagtggtatcatcccactcaagtcacgtcggctgccatgtggtgatgaggctattaggtggctagtgtcaaagaagggagaagcagcgttatatcggaatgggctcctaccaactcagcagaagccatgtgtgcatctcttcctgaaccatgccctcatgtcacttgaaattagccacggcgaaggtaagtccatgtggaaatctgcaaatactatagaggatttcttctccctcccttgtcccttccccttctcgtctttcctgcatttcttcctttcttcttcttcttcttcctcctcctccagttccttcttttctctttttttttacaacattatatatacttatttattgtttataagcaaagttgttgataaacacttaccagcacatctcagaagagacttttagaagtgtattgcaaccatttatgtaaaagatggtggtggcttagactagcatggtaacaaaggaggtgataggaagtggtgagattctgcaaggaatcttcaaaggaagcacggacaggttttactgaatgactaagaaaacggtggagaaaacattcctcgacaaaatagtagagaaaataatgagtgaagcctggcttccaggttttcatcttagtatctaaaagaatagttatcgtggattaagatggaaatggcttcaataaatgagcagtttgtgaaatgagtgttaaaaacctgatttcagacatataaagattgacatcttaaggtgtagccaagtggagatattgagtagaaagttggatatatgagcttcgtactcaggaaaggagtctggattggagatatcaatttgggaagtatctgcaagga

SEQ ID NO: 3537 - DNA, 1227 bp, Homo sapiens
tccaccctggagtcaggatccctgagtttatagtgagtgtgagtcaacaccaactataaaagctgaccttttcatcagtgctttgtggtctttatctgtaatgtgaaaattataacaccaatgttgcaagattttcgagagaattaaaagattatatgcacatgacctttagcaaccatgatgcctagtaggtaataggagttgaataaaaggtaattactatcattaggcatattaactgaggcagtgtattgtttgcttataaaggttccgcatgctcagtgctgcagaatttatataggcagagccgtcgcaagaaatgttgggaggtggttttttttgtttttgtttttgttttttctgacggtcctcttatcttcaaaacatcatggcactgctgcctggatttgctggtttgaataggccacatttcagctattcttctcattgtcaggtcatggcaaataataagtctcaccttttctttctgaaattgcattcccgcttcattcatctgaagttaattcttttcttttttgtatcatgcttattttgcaaacatgaacaatcttgtcactaccgtgtatatgcaaataaagtgaaatgataaattgcttaagtgtctccgtttttctatctgtagaataggggtcataatcccttcctgttgcacttttccagacagttgagaaaataaaaacacgtaatgtagagaaaagagcatcagtattctcataaatagaaaattaagccatttagactatgtacaggaagtttgataagtagacttccagaaaagaagtggcaaagtattctttaattgttcattccctaagaaaaagctgtctctctcaatcttttgatacctctgtctttctttccctctctgtctacccgcctctgttctgtgtgcctagatcctgttaatattttctctcctctactattttcatgtctgcatgtaattttttttcatatctagccaagtgccaaaataacattatgtttgatatatcaattaattttttaattaaatcaattaatgagaacagctagagaaatgtagattttagttcacatgaaactggagggtactggctacgttgtaattaatatattaatagtttgtcagtcttggtcattgtcttggtcagaggatgccataggaagctagatcagtcctgtaatttcttcctattttttttttttaaataaagccaattattt

SEQ ID NO: 3538 - DNA, 1132 bp, Homo sapiens
cttttggtaatttaatttctattatgaatttctggtgcctatgagctagctatcacctacctgaaaggtgcttagaggtgaaggtactgtttctaaaaacacatcactgtgatacctttctatcctcacattttcaagcttgcctcttttctgttctttgtggatataacttaagcaattgtgttattcataaaggtttagaaatttcaatattcccaacactctatgtttctgattttataacagtagccatttttgaaagtcagatgtttggcctgttttatatgaataaagtttatttataaaatattataaaaaataagtaaataaacagaacattaataataaagttttggttcttcctattcctgactttcatataatgaaaattatcctattgatctaagtagaagttatcatagaaagtggacacgtataagactttccttcctttttttttttaataacatatgaggaacaagacttctcttcccatatacttcatattttagaggacattgttttaaaggcttatgtctcactgtaaaattctgtcagccaaatagtaccaatacgttttcaagtagttctcactgataatttagttgaaccagagatcaaatatttgctcccgaattactactggtaatcaagtagttgaacaaaaaattactaaagcatttccgttagatcagtcaaggacagtactgcatctttttttttttttttttttttaagacggagtctcggtctgtcacccaggctggagtgcagtggcgggatctcggctcactgcaagctccgcctcccaggttcacgccattctcctgcctcagcctcccgagcagctgggactacaggctcccatcaccacgctcggctaagtttttgtaattttagtagagacagggtttcaccgtgttagccaggatggtctcgatctcctgacctcgtgatctgcctgcctcggcctcccaaagtgctgggattacaggcgtgaaccactgcacccggcccagtactgcatcttaacagcaaagccattttattctactttataactgagagacttgataccatccatctctttaggttacagaggataatttgaagagaaatgttactgtagaat

SEQ ID NO: 3539 - DNA, 1239 bp, Homo sapiens
ttaatgtgttctcttccctacagatttcagaacttatatttccacctcttccaatgtggcaccctttgcccagaaaaaagccaggaatgtatcgagggaatggccatcagaatcactatcctcctcctgttccatttggttatccaaatcagggaagaaaaaataaaccatatcgcccaattccagtgacatgggtacctcctcctggaatgcattgtgaccggaatcactggattaatcctcacatgttagcacctcactaacttcgtttttgattgtgttggtgtcatgttgagaaaaaggtagaataaaccttactacacattaaaagttaaaagttcttactaatagtagtgaagttagatgggccaaaccatcaaacttatttttatagaagttattgagaataatctttcttaaaaaatatatgcactttagatattgatatagtttgagaaattttattaaagttagtcaagtgcctaagtttttaatattggacttgagtatttatatattgtgcatcaactctgttggatacgagaacactgtagaagtggacgatttgttctagcacctttgagaatttactttatggagcgtatgtaagttatttatatacaaggaaatctattttatgtcgttgtttaagagaattgtgtgaaatcatgtagttgcaaataaaaaatagtttgaggcatgacaacgcgtgtttctgttgtgtgcataaaaggggaaaagaacgggtatttcccttcaatgtatttaactaaatagcaaaaacattaaacagaacgtaagaattttaaaatttcctttgaaaaatcaactattaaccatacttttcctaaaagaccacatatcagaatatgcatatgaaaagttaaaaatttgttagtggtagttattgaaaatataataaaacatcttttaactatcagtgtcactatacatagggttttttaacaaagaatttggctcgtactaattttgacatgacatctgacttacatgtctaatgccattgcataaagtagatgtgttcttacagctgctctaatctctgtgccttgtgctttttttaaaaaacatttaagtctttactagaggcctaaaataaagtcaaataatacaatacttcagattcttcagtagtccatatttatacaactgtaattccatcagtcttgtaagggtacttgaactacaaaaagaaaaaaagagatatctctataagag

SEQ ID NO: 3540 - DNA, 1127 bp, Homo sapiens
tggccagtgatgatgagcattttttcatgtgtcttttggctgcataaatgtcttcttttgagaagtgtccgctcatatcctttgcccactttttgatggggttgtttgtttttttcttgtaaatttgtttgagttcattgtagattctggatattagccctttgtcagatgagtaagttgcgaaaattttctcccattttgtaggttgcctgttcactctgacggtagtttttttcgctgtgcagaagctctttagtttaattagatcccatttgtcaattttggcttttgttaccattgctttttgtgttttagacatgaagtccttgcccatgcctatgtcctgaatggtaatgcctaggttttcttctagggcttttatggttttaggtctaacgtttaagtctttaatccatcttgaattaatttttgtataagatgtaaggaagggatccagtttcagctttctacatatggctagccagttttcccagcaccatttattaaatagggaatcctttccccattgcttgtttttctcaggtttgtcaaagatcagatagttgtagatatgcggcgttatctctgagggctctgttctgttccattgatctatatctctgttttggtaccagtaccatgctgttttggttactgtagccttgtagtatagtttgaagtcaggtagcatgatgccttcagctttgttcttttggcttaggattgacttggcgatgcgggctcttttttggttccatatgaactttaaagtagttttttccaattctgtgaagaaagtcgttggtagcttgatggggatggcattgaatctataaattaccttgggcagtatggccattttcacgatattgattcttccgcagtatggccattttcacgatattgattcttcctacccatgagcatggaatgttcttccatttgtttgtatcctcttttatttcattgagcagtggtttgtagttctccttgaagaggtccttcacgtcccttgtaaggtggattcctaggtattttattctctttgaagcaattgtgaatgggagttcactcatgatttggctctctgtttgtctgttattggtgtgtaagaatgcttgtgattt

SEQ ID NO: 3541 - DNA, 1121 bp, Homo sapiens
aaatttttgacactgaagatgtcttgattgctttctttctcttcagatctgagtttgccaatttctgtttagcattccttttctactgagactcttatatcatttattgcccatattttgggccataaaacaagcttcaacacattttttagaaaaataaaatcatacagaatctgttctctgatgctgatggaatcaaattagagttaaataccagggaaatcatacaaaattttcacactcagaaattaagcaagatacttctaaaaatacagagattaaaaaagtcttacaaagaacaaaaaatatgttcgggtaaatgaaaataaaaagagaatataccaaaatttctgggattcaggtaaagcagtgctgagaaggaaatttatagcactaaacacttacatcacaaaggtggaaaaatcatgaatcaaccatctaagcttgcagtttaagaaactaaggaaaaaaatatatacttaacatggcagaggagatatcataatcacaaaggtagttttcccagggcaagccttatccactgcattccagatgtgctcacctctgtggtttccccaaatgtggaaaactggactgcataatttgtggtagcgggggactgcattaataccttcctctggctttttattttattttgttcatttttttaatttaaaaaatagtgagaaaagaagaaaataagcccaatgccagcagaatgaaggaaataataaagataataacagaaataaatgaaattgaaaaaagaaaaaaaaaacagaaaaatcaataaagaagtgaattttttaaaaagaccaacacagctgacaagattttagcacaagtgacacagaattttatatatatatatatatatatacacatataggtctatatatatgtctctctatatgtctatatgtctatatatatgtctatgtctatatgtctatagtctatgtctatatctctatatgtctatctgtctatatctatgtctatctatatctatgtctatgtctatatatatgtctatatgtctatatatgatgtctatgtctatatatgtctatatatgtctatatatatgtctatatatatgtctatatatatgtctatat

SEQ ID NO: 3542 - DNA, 1113 bp, Homo sapiens
gataagtgaagaatatttacacttacctggatttttagagaactgaatgacagtgttgacatgtgaatttattaggaccatgacgtgtgcctgagaagctgccggctaaatgtttgctgttagaataagagcagtataggagatcacataacatagtgattaaatggtggggatctgaaatcgaactgcccaatcttgaatccttataatcactttcagctgtgtaatcttgagtaattaactggtgcatgtctcctcatctgacatttggggagaattatagtatcttctgcatatgtagttaaatgacataatatatgcaaagtcaattaatggaatgcatggctcatagaaagtgttgcataaatgtttagctatatttctatgtaaatgtttacaaacagtgtttactaaaaaaatcagaaaattgatgagttaaatcttgagcattctacataatccattttattgcaatttggctaagcttgacccttttttccccctcttcttagatcccaaatttgaagtcatcgaaaaaccccaggcctgaagaaataaagtaaaattaatctggtaatttgtcacggattagttgtacaactagttagaagtttcagaataaacatgcatttcataactgtcaaatgttcttttaattctgagtccaaataaattatttggtgatgttgagtgtgttcttgatgaattgagttctgtgtgttagagttgtttttagatcctttcatttggttataataaagcagatggagaccttggatgaactggacacaacttgcacataaccctgcttgttgtggagggatgttacccttcctttagaacatgaagaaatggtttataaattcttggtcatagctttctcagaaatctgagtgtaattttttatatgtcttggaacatctattgtgtttaactttgatctcctcaaatgttaaataattttctcccagtaacccaggtccctcatctttgcttgcagatcacagagtctgttacagttctgttcagattgatgagggaaaggtagggatgacgggggttctataaaggaacttactttaaaagagtaaactttatggtgttgttttgtcc

SEQ ID NO: 3543 - DNA, 1173 bp, Homo sapiens
tgtcctttatggacccaacaggggaggaaaaaataccattgcactgggtttatccacttactgtggagttggggaaccagaaacaaccactggacacgttgcaagcgcgtcaaggtttccaccgccacctggtggctagatggagcacagcatctgtgtaactggtgggcaaaggcgttctgctccaagatgtcaaagtgggggagaaaattatgggtgttctgcaatcttggcaaaagaagagtactgtactccttatctttttactgcttctccatgttcacccttaaaagattgatttttattttttactcagctctcctcttgtttttcaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggg

SEQ ID NO: 3544 - DNA, 1186 bp, Homo sapiens
caggattgttactctgaaagtgaaccaagagagtcagaatttctaggataaggcaggtccatgtgagataaacttccatctgtaagggaggtaggagtgagctggggatctacctggaatgcgcacaatttctggatacacgaattaagccagaaggcattaattctctggtatctgttcaccagtggagactgctacatcttatttcccaattagtttccattccagttgttcgtataaacctctattatataacatcgtggtcttattaaataaataataaacaagaataaaaagagtaccaaagtgtaacccatgctaaaaaaaatcctgttgtaaattcactcaaaaagcaaataatcttttcctttgtgaaattggttcctaatatattgggtctgcatgttgattattttatgtggagttttcttacaatgaaacacatctactctaccactcactgttttctccttacactttgtagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggaggtaaggtggcctttgtgttcagcctcagagatgctgaaacatcttgtatggagtatttgtatcctgtaaattaatctttctgtttatcactgaaaaggtctctgcccactcccatcagagtctgctgttatgcaaaaatctgaactatgaatttttatggcatcctgttgaattaataatatcagtcacccatcacagagttaattttaactatttaatattaaacttgggatcaaaatcccactgataactatcataggttactggtagttctaacagggagttgaaataataatggcgttctgttttggtcattaatttaaaaatatttttaaatgctctctgggattgtcagtcattagtttaaggtgaattttcgttaaaggtttggtttgagattttgggcgttctctgtgtggatgtgtaagggtttttttttggccttttatcatttcttttccttcatagtggaagtcaaaggcattaataaatgcttgttaattttttt

SEQ ID NO: 3545 - DNA, 1135 bp, Homo sapiens
actaccaacgccatacttgctctcagtgctgagaggtggcacaaatattattttcagtcttggtcatcaggcagggcctggcaggcatcatgctctgtgtgagtcagtggagtttattataagaatgcggtagcctccacagtgattatatttattataggaaaacgtgtaattttgttgtcagaacctttcagcaggtaccacaaaatctcatatgggaaaacgtgtaaatttttcatgaataaattcctttcggtattggtaatttccttctctgttttagtataaaagaaagcattgccttataggtggctaagaacatctgtagcatacataacacttaatctaaaggagtgttgaagaccgggctgattcctaattgagaatgagcaagaatagaactctttttgatagttatccctgttcttcctccaagcctctgccttggagctatggatactataactaactgaagcttcttctttcaggtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtaagtcctgtccggtggctagcaattcacgttggatcacatgcatttgttttcaaaaaatttaacttcttgtattttgcatcagtattttaaccctacagtaaaaatcttggttcctaatgattcaccataccattaatatatttatttgcattaccctatgatatacatataaatgtttttaaaattatgatgtcgtattatgaccatcactaaacagtagtttaagatgtcacagcacttttttttttcctcactctgtcacccaggttggagtgcagtggcaagattatggcttactgtagccttgacctactgggctcaagcaatcctcccacctcagcctcccaagtagctggactataggcacatgccaccaggcctgactgattttttttaatttttagtagagatggggtctccttgtgttggccaggctgtctgaaactcctgggctcaagcgatcctctggctggacc

SEQ ID NO: 3546 - DNA, 1116 bp, Homo sapiens
ggcggcgccaagggcgcgtgcacctgtgggcgcggggcgcgagggcccctcccggcgcgagcgggcgcagttccccggcggcgccgctaggggtctctctcgggtgccgagcggggtgggccggatcagctgactcgcctggctctgagccccgccgccgcgctcgggctccgtcagtttcctcggcagcggtaggcgagagcacgcggaggagcgtgcgcgggggccccgggagacggcggcggtggcggcgcgggcagagcaaggacgcggcggatcccactcgcacagcagcgcactcggtgccccgcgcagggtcgcgatgctgcccggtttggcactgctcctgctggccgcctggacggctcgggcgctggaggtgggtgccgcgcctcggaaggcggggggaggctgcacggtggggacgcgataccccccaagaccttaacccaagtctttaatgcagagaagccgggggtccgtcaatgggacccctctcctctccgcccccgcttgcggacgtccagcgcatccccgctttcggcccagccctgccccagggagtcgcgctccggcccgctgagagggagcgggcgaggcgctggtctccctggttccgcgccagcccggggcgagaagggtagggggcgaccctgagcccagaccccgacttagtccctgccttggaagcgggggtcgggggaggcgagagacattcagacaggggggaagggggaaggagcacgtggggaaaaccgaaaacgcagcgtccctaaagccagtccttcgctcttgaatcgttgccctttcctttctcttgggccctggggaggaggaggaggagtcgggacagcccaggaagctaggagcccctcgcttttccctgcgttctccgcctcgtttcaccttcctctctcacccccatcccccttccttgctccaacctcttttcgcggctgctggcggcggcagcctgggtgcgaccctagcccgagccggcgtcggggtcgcgcaccgccttccacaggcaaactttgtgcatgtccgcgtctcccttttgtgtaacttgcgagaaatgggaggggtcggagacccatagccaccccgcgccttccc

SEQ ID NO: 3547 - DNA, 1196 bp, Homo sapiens
ctaagcaatttcttataaagagatggtaaaatcagacacaaggcccagaactgaaaacatatgctgaagggaaagtgtggaactggtaacacaggtggtcaccatagcaaatttctcatcttggaccaaaagaagcaatgaatcaaatatgacttagagaagtattgcatgcacaaggagcttttctccccccagacatggccaatatacaaaaaaatcaaaccaaatttgtaaatgttctatgaattaatctcaagctggaaaaattattttcttcttgaatgtaaattctcagcttctggattcttgaccactggcattgaccaactggcatctcgttgagcctgaagccaatatctttttctcttttccactgacattctgtgcatttgttattgttggcaacgttaagtactcgataataggaagataattttggctaggatagtaactgaggaactagggatagcttcttttctaaatgttgcttgtgtggggttaatgctgggataatcttgtgtctcttattaaatctttaaatccttaataaatgaggctcatgggatatgtctggcattgaactaacccagactgtgaagctcttaaaaagtttgcacacattccactgagaaaggtatttcaccacctcacaggatacaaaaaacaacaacaacaacaacaaaactgctgtgcctgaaactgagaaagataagaaatttgagaagctaattattgatttttaaattgaaattttgaacactgaaatttaacttgtgtgactaagatttttcgattttggattttagcttctttagatcttaacatctttgtgctttaatttgcaagggaatttaaactttgaattttctattttggagcttgatgatgggagaacttttgtccagcatctctatagcgctttttaattatttttgttattttattctttattatttttgttattatagtaactttatgcatgctagtattgaatactgcaatgtcattcaatctcatttcagacagttgcttctgggtacaaaaattccatagacataagttcattgactgggtcctttttgctgtaaaaagaatgttgaccagaagcattgtgaggtgagctcagctatgtgataatgaatgaggcattcactaagttcacagatggtcttgatgaaagtagcacagagggtggg

SEQ ID NO: 3548 - DNA, 1474 bp, Homo sapiens
atggtgactacactttgtccaccttagagcaagacattatgtacaaaggtgttgtcttgaggtacagcggctcctctgcggcattggaaagaattcgcagctttagccctctcaaagagcccttgaccatccaggttcttactgtgggcaatgcccttcgacctaaaattaaatacacctacttcgtaaagaagaagaaggaatctttcaatgctatccccactttttcagcatgggtcattgaagagtggggcgaatgttctaagtcatgtgaattgggttggcagagaagactggtagaatgccgagacattaatggacagcctgcttccgagtgtgcaaaggaagtgaagccagccagcaccagaccttgtgcagaccatccctgcccccagtggcagctgggggagtggtcatcatgttctaagacctgtgggaagggttacaaaaaaagaagcttgaagtgtctgtcccatgatggaggggtgttatctcatgagagctgtgatcctttaaagaaacctaaacatttcatagacttttgcacaatggcagaatgcagttaagtggtttaagtggtgttagctttgagggcaaggcaaagtgaggaagggctggtgcagggaaagcaagaaggctggagggatccagcgtatcttgccagtaaccagtgaggtgtatcagtaaggtgggattatgggggtagatagaaaaggagttgaatcatcagagtaaactgccagttgcaaatttgataggatagttagtgaggattattaacctctgagcagtgatatagcataataaagccccgggcattattattattatttcttttgttacatctattacaagtttagaaaaaacaaagcaattgtcaaaaaaagttagaactattacaacccctgtttcctggtacttatcaaatacttagtatcatgggggttgggaaatgaaaagtaggagaaaagtgagattttactaagacctgttttactttacctcactaacaatggggggagaaaggagtacaaataggatctttgaccagcactgtttatggctgctatggtttcagagaatgtttatacattatttctaccgagaattaaaacttcagattgttcaacatgagagaaaggctcagcaacgtgaaataacgcaaatggcttcctctttccttttttggaccatctcagtctttatttgtgtaattcattttgaggaaaaaacaactccatgtatttattcaagtgcattaaagtctacaatggaaaaaaagcagtgaagcattagatgctggtaaaagctagaggagacacaatgagcttagtacctccaacttcctttctttcctaccatgtaaccctgctttgggaatatggatgtaaagaagtaacttgtgtctcatgaaaatcagtacaatcacacaaggaggatgaaacgccggaacaaaaatgaggtgtgtagaaca

SEQ ID NO: 3549 - DNA, 1125 bp, Homo sapiens
cggagcgggctccggggtctcggagctttgggccagtacccacgctgctgctgctcgccgcggcgctactggccgtgtcggacgcactcgggcgcccctccgaggaggacgaggagctagtggtgccggagctggagcgcgccccgggacacgggaccacgcgcctccgcctgcacgcctttgaccagcagctggatctggagctgcggcccgacagcagctttttggcgcccggcttcacgctccagaacgtggggcgcaaatccgggtccgagacgccgcttccggaaaccgacctggcgcactgcttctactccggcaccgtgaatggcgatcccagctcggctgccgccctcagcctctgcgagggcgtgcgcggcgccttctacctgctgggggaggcgtatttcatccagccgctgcccgccgccagcgagcgcctcgccaccgccgccccaggggagaagccgccggcaccactacagttccacctcctgcggcggaatcggcagggcgacgtcggcggcacgtgcggggtcgtggacgacgagccccggccgactgggaaagcggagaccgaagacgaggacgaagggactgagggcgaggacgaaggggctcagtggtcgccgcaggacccggcactgcaaggcgtaggacagcccacaggtagaagaattgctctcgtttgtctgtccattcatcctcctctcctcactttatctatcccacgcgacttcagggtagactcctgctggcaggcaggatcataagtccgcggacagaacggaggcctggagtggaggaatgtggtttgaggtttggattggtgaactcagctagaaaacatacttgcatttgcccgaataatgaataaccaagaaaaaaactgacaaacgattttctgcaaactaaagcaaagcatttaggccggggagggagagtttgtaacctgactccttccacctttagcgagttggagcttgtgcgagttctttccactctgtgtatttctttttaatgattttgtgtgcgccttttgtgcgggttgcaacgttgcgctgagttttgtaaccgctgcctgtgcgtgcatcctgcgctcacgggagggcggatgtggagagg

SEQ ID NO: 3550 - DNA, 1225 bp, Homo sapiens
ttgtttttttccttttcccgtatttgctgaatctccactatccgactttttttttttaatcttttctttccccccccccccaccccacctctttctggagcacgaatccaaacattttcccaagcaacaaagaaaagttcgcacgctggcaccgcagcccggacaggctggcgctgctgccgggcccccctccctccgacacttgactcaatcctgcaagcaagtgtgtgtgtgtccccatcccccgccccgttaacttcatagcaaataacaaatacccataaagtcccagtcgcgcagcccctccccgcgggcagcgcactatgctgctcgggtgggcgtccctgctgctgtgcgcgttccgcctgcccctggccgcggtcggccccgccgcgacacctgcccaggataaagccgggcagcctccgactgctgcagcagccgcccagccccgccggcggcagggggaggaggtgcaggagcgagccgagcctcccggccacccgcaccccctggcgcagcggcgcaggagcaaggggctggtgcagaacatcgaccaactctactccggcggcggcaaggtgggctacctcgtctacgcgggcggccggaggttcctcttggacctggagcgagatggttcggtgggcattgctggcttcgtgcccgcaggaggcgggacgagtgcgccctggcgccaccggagccactgcttctatcggggcacagtggacggtagtccccgctctctggctgtctttgacctctgtgggggtctcgacggcttcttcgcggtcaagcacgcgcgctacaccctaaagccactgctgcgcggaccctgggcggaggaagaaaaggggcgcgtgtacggggatgggtccgcacggatcctgcacgtctacacccgcgagggcttcagcttcgaggccctgccgccgcgcgccagctgcgaaacccccgcgtccacaccggaggcccacgagcatgctccggcgcacagcaacccgagcggacgcgcagcactggcctcgcagctcttggaccagtccgctctctcgcccgctgggggctcaggaccgcagacgtggtggcggcggcggcgccgctccatctcccgggcccgccaggtggagctgcttctggtggctgacgcgtccatggcgcggttgtatggccggggcctgcagcattacctgctgaccctggcctccatcgccaataggct

SEQ ID NO: 3551 - DNA, 1293 bp, Homo sapiens
ggaacaatggtgaatttataataaaaacagaagtgtctcaggctgagaagaggtatggagaaaagagtagactcatgaatgatttctgcactctcaaagtaatggttaaagaccctttgcatagtgtaaacttgtcttgcccatgacatctgtgtaaatggaactagaactaacttttggattctactcatttttaaagaatgttgcagaagaaaatacaagggtactctattccttatatggagttgttgaacacagtggtactatgaggtcggggcattacactgcctatgccaaggcaagaaccgcaaatagtcatctctctaatcttgttcttcacggtgatattccacaaggtaagatgtcttggaaaattcaggcactcagcagattacggcaaaaccaaaaagtaatcaacttgaatctttccatttatgtttgatttttcattttctcatgacagattttgaaatggaatcaaaagggcagtggtttcacatcagcgacacacatgtgcaagctgtgcctacaactaaagtactaaactcacaagcgtacctcctattttatgagagaatactgtaataatatcaaaagcactttttctggaaacacatttatggcttttataatggctgaaataacgataaaaaaagactaattaaaatcatgttcacttaacattaaatacatgccagaagaaatcatgtttatttaaatattgaagggaaaaatacctaaaaatgtacaaaggttttatattgtcatagtggtttttattcctgctttgtttctggaaaggaaatcctgaattacttaagtactttgtgtttaatatatctgggtgatggatcacaacacatcaataaactgacttaccctaaaatcttgttttattactgggaagattttaacttctattgacttatcctactaggtaacactttaaaaaatatttcatcagactggctaatgaagcttcattacaagtgtgttaattttttttttttttttttttttttttttttgagacggagtcttgctctgtcgcccaggctggagtgcagtggtgcgatctcagcttactgcaagctctgcctcctaggttcacgccattctcctgtctcagcctcccgagcagctgggactacaggcgcccgccaccacgcccagctaattatttgtatttttagtagagacagggtttcaccgtgttagccaggatggtctcgatctcctgacctcgtgatccacctgccttggcctcccaaagtgctgggattacaggcttga

SEQ ID NO: 3552 - DNA, 1197 bp, Homo sapiens
tattttgtgtatcaacaggtgacagttaaaggatttgaacctttaattcagtttgcctacactgctaaactgattttaagtaaagagaatgtggatgaagtgtgcaaatgtgtggagtttttaagtgtacataatattgaggaatcctgctttcagtttctgaaatttaagtttttggactccactgcagaccagcaagaatgcccaagaaaaaaatgcttttcatcacactgtcagaaaacagaccttaaactttcacttttggaccagagggatctagaaactgatgaagtggaggaatttctggaaaataaaaatgttcagactcctcagtgtaaactccgcaggtatcaaggaaatgcaaaagcctcacctcctctacaagacagtgccagtcagacatatgagtccatgtgcttagagaaggatgctgctctggccttgccttctttatgccccaaatacagaaaattccaaaaagcatttggaactgacagagtccgtactggggaatctagtgtcaaagacattcatgcttctgttcagccaaatgaaaggtctgaaaatgaatgcctgggaggagtcccggagtgtagagatttgcaggtgatgttaaaatgtgacgaaagtaaattagcaatggaacctgaagaaacgaagaaagatcctgcttctcagtgcccaactgaaaaatcagaagtgactcctttcccccacaattcttccatagaccctcatggactttattctttgtctcttttacacacatatgaccaatatggtgacttgaattttgctggtatgcaaaacacaacagtgttaacagaaaagcctttgtcaggtacagacgtccaagaaaaaacatttggtgaaagtcaggatttacctttgaaatccgacttgggcaccagggaagatagtagtgttgcatctagtgataggagtagtgtggagcgagaagtggcagaacacctagcaaaaggcttctggagtgacatttgcagcacggacactccttgccaaatgcagttatcacctgctgtggccaaagatggctcagaacagatctcacagaaacggtctgagtgtccgtggttaggtatcaggattagtgagagcccagaaccaggtcaaaggactttcacaacattaagttctgtcaactgcccttttataagtactctgagtactgaaggc

SEQ ID NO: 3553 - DNA, 1198 bp, Homo sapiens
agtgttggtatctggtagcgtcactgaacttctcagcatcacaatggaaaattcctgctagtccttctggacaaacttttgacactgaaatctgagcagactggttgatgatggcttcctctctcttaggggcatcatgccagcagaaccctgtggggaggaccataccaaatgggcaagcccaacagtgctcagaagggcccctgggctgtgagggagcatcacttgcctctttgatcaggttcataaatctgggtccgaggcgccatggcttatgtctatggcactgcagggagctgacggtcagctgggatgcccggtgcgaggcaatggccaccatgtacacagcatcgtacatcagagccgcttcagtctgtggaggaaaacacacaccgcatcttaaattccacttttgcttaccttcctttacttgcataatcactctccctgcttccatagctcttatctgtctgatctcaaaggccatttactcttcagctaggtagttttcactctccaatagctatttttctccaaaataatacctcacactttggagtaaattgaagttataactctgcttcgtttcaagttctttaaaaaaaaataaagcaacccagatcagccacaaaagacttgattcaaggaacaaatattttgcgaagtgtcctccatgttaagcatggtgttaagatcaactaccttgagctagaagctactaaagctcaaagttgcaatatcagatttgtttctcagcatttgtctatatctatttatctatctacttactggtttatatttggtagaaagaaactgctacaatcactaacaggtgatttccagataaggatactggtgttggtcactttcatttagcagagttaagaagttcatagtcatggaatgaaactcaacggcaagttttgggagaccctctgaagggcagacaagtgcagcttgctcagaacatgcctcctcttgccagcatgtgctttcttgagagagattgaaacaagtcggtcattccttttagggggttgggcatctcgttcttcccttcctcatgaaattcctctcacttgcacaattttacataatacagcattttataaaatatgcttccctgtggtttcctttagggataaaatcttataatacccttgcatttcacttgagggtttcattgcaacttcaaata

SEQ ID NO: 3554 - DNA, 1415 bp, Homo sapiens
tttttgaaatatgtgtatcatttcaaacagaaattactcccttggtgaacattttggtttgtactttcagagttttcaatgtatagataggagcagaacttcaaatgtttagtaaggaagacaaggtcagcagagtttctggctgtccaaaagcagcgctctcagctatggcctgtggccatcttctctctgggcagagacaagtctaactctctgatgctcatatttatgagctcatttcacatctcagggggcagtctcagtagatgatgttactgttcacctgctcccaggtaagagtccgagaacctaccaggtgcatataggaagttgtgctgttacttacctaacaacccctgtgagccaaggtgttctgccctccctgcaggctgagcgctttctctaagatgcctatacctgtactaatagtgactcaattctcccctttccccccgctttgctgcagaccataaaaccatgggaaacgcagaaagtcaacatgtagagcacgagttttatggagaaaagcatgccagcctggggcgcaagcacacttcccgctccctgcgcctctcgcacaagacgcggaggaccaggcacgcttcctcggggaaggtgatccacaggaactccgaagtgagcacccgatccagcagcacccccagcatcccccagtccctggctgaaaatggcctggagcccttctcccaagatggtaccctagaagacttcgggagccccatctgggtggaccgagtggacatgggcttgagacctgtgtcttacactgactcttctgtcactcccagcgtagacagcagcatcgtcctcacagcagcctctgtgcagagcatgccagacactgaggagagcaggctttacggggatgacgctacatatttggctgagggaggcaggaggcagcattcctatacatccaatgggcccactttcatggagacggcgagctttaagaagaaacgctccaaatctgcagacatctggcgggaggacagcctggaattctcactctctgatctgagccaagaacatttaacaagcaacgaagaaatcttgggttccgccgaagagaaggactgcgaggaggctcgggggatggaaacgcgggcgagtccgcggcagctcagcacctgtcagagagccaattccttgggtgacttgtatgctcagaaaaactctggagtgacagcaaacggggggccggggagcaaatttgcaggctactgtcggaatttggtgtctgatattcccaatcttgcaaaccataagatgccaccagctgctgctgaagagactcctccgtacagtaattataacacacttccctgtaggaaatctcactgtctctctgaaggtgccaccaacccacaaattagccatagcaacagcatgca

SEQ ID NO: 3555 - DNA, 1199 bp, Homo sapiens
ggactgactgaaggcctgcatggattccatgttcatgagtttggagataatacagcaggtgggtgttgtgctgtgctggtgacccatacttgttcaccctagttagataaacagtagagtagcccctaaacgttaaaacccctcaacttgtttttgtttttgagaaagggtcttgctctgtcgctcaggctggagtgcagtggcgctgtgcgatcatggctgaccttagccttgacctcccaggctccattgatcctcatgccttggcccgtagctgggactacaggtacacaccaccacgcctggctaatttttgtatttttttctagaggtggggtttcatcatgttgcccaggctggtcttgaactgctgggctcaagtggtctatcctcctcgacctcccaaagtgctgggattacatgtgtgagccactgtgcctgggaaaaccctcaacttttcttttaaaaaagaggtcaactttattgtatataagcactgtgctaaaattgcaggaactgggaccatatcctgatttttgtaataatgccagcagagtacacacaagaaaagtaactgcactagattgtgaagactggggtggacctgcttctgaaggtccagtgccctttgtcttaagatttggtgtagtgtgtctttagaaaccaaaaaaagagaagaagatcaaccttaagattagccacaaaactgggctttgatacctaggtgtggaaaagaaagggaaagagttgatgttttgtcttacagcatcattgtagaagagggtgtttttttgtttgtttgttttttgagacggagtcttactctgtggcccaggctggagtgcagtggcgcgatctcggctcactgcaagctccgcctcccgggttcatgccattctcctgcctcagccccctgagtagctgggactacaggtgcccgccaccccgcctggctaattttttgtatttttagtagagacggggtttcactgtgttagccaagatggtctctctcctgacctcgtgatccgcctgtctcagcctcccaaagtgctgggattacaggcatgagccaccgcacccagccagaagagggtgttttttaaagaaggcaaataggaaataaaaacttgggctcttaacttttgtaatgatcccaggtgtttgagctgggggttgagggtgggtgcctcgagcaa

SEQ ID NO: 3556 - DNA, 1205 bp, Homo sapiens
ttaagattttttaggattataccttacttataggcccgtcattcatttggcatgaaattttgagttttattcactttcactttcctttttttccaaagcaattaaaaaaactgccaaagtaagagtgactgcggaactaaggttactgtaacttaccatggaggattaagggtagcgtgtggtggtctacaacatagttatttgggttttagtatttcatttagacagcaacacttacctaatgtttaaaggtaatgtctttgcaacaccaagaaaaagctttgagtagtagtttctacttttaaactactaaatattagtatatctctctactaggattaatgttatttttctaatattatgaggttcttaaacatcttttgggtattgttgggaggaggtagtgattacttgacagcccaaagttatcttcttaaaattttttacaggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcttaaaagtgtaattgtgtgactttttcagagttgctttaaagtacctgtagtgagaaactgatttatgatcacttggaagatttgtatagttttataaaactcagttaaaatgtctgtttcaatgacctgtattttgccagacttaaatcacagatgggtattaaacttgtcagaatttctttgtcattcaagcctgtgaataaaaaccctgtatggcacttattatgaggctattaaaagaatccaaattcaaactaaattagctctgatacttatttatataaacagcttcagtggaacagatttagtaatactaacagtgatagcattttattttgaaagtgttttgagaccatcaaaatgcatactttaaaacagcaggtcttttagctaaaactaacacaactctgcttagacaaataggctgtcctttgaaagctttagggaaatgttcctgcttagtcattttagcattttgattcataaagtacctcctcattttaaaaagacattatgatgtaagagagccatttgataactttttagtgagcttt

SEQ ID NO: 3557 - DNA, 1227 bp, Homo sapiens
ctttgggaggccaaggtgggcagagcaactgaggtcaggagttcaagaccagcctgactaacatggagaaaccccatctctactaaaaatacaaaaaaattagccaggtgtggtggcacatgcctgtaatcccagctacttgggaggctgaggcaggagaatcacttgaacctgggaggcggaggttgtggtgagccgagatcgcgccattgcactccagcctgggcaatgagagtgaaactccatctcaaaaaaatatatatgtgtgtgtgtgtgtgtgtgtgtgtgtgtgtgtgtgtgtgtgtatatatgtgtatatatgtgtatatatgtgtatatgtgtgtgtgtgtgtgtgtgtgtgtgtgtatatatatatatatatggcagcagtttcccaaaaatttttttttttttgcacagtgtatgttgttcattttatccacagggcttcagttattgtaaggatttgtggggggaggggtgtttttaatttaattttttaatttaaaaatttactaattttgaaaggctttattaaagatttgcaagttactgatttaaacatagtaactgagcttcaaagacaagatttactctgtggacaagttatgtgataatggtgattctgtataaccatatttctttatcacttagttatatttataatcaaaagttgaacaaagatgtatctcagacagatacaaattaaagttcatttttaaatccatgaatttaattgttttcatttaaaaattaatgcaagttagataaatttgaattagtagataaaacaatcccatcaaacaccattagcattttagagtatttcctttgtctttttttctcctccacttgtgtttggaattttttatgtagttaccagatctttttaatagcatgaaattctctgtcattttctcaataattattgtggaaaatttgagaatatctaataattgccttagataaatttctagaagtagaattactggttcaaaaggtatggacattttttagttcttgttttatagttttaaatttctcttcggaattaaaactcgtccattagatctcaccagcccagtactctttttgctttatgctagtccacatgcatgtccgttggataatgtaagaattttatctccttgtattaatttgtactttgattattgattggtatggttgaacactttttcctgtgtttgttaattagatattgggat

SEQ ID NO: 3558 - DNA, 1241 bp, Homo sapiens
tggcagttgctcggtaagattccctggaatcctggcctgtctggaggtgaggagcagtcccatgtcctggccggaactctgggagttattgaggaggagtagcagggtgctgtactcagggtgtttgggtctccagcccttcttctccctcccaggatgggagatctggactgcccctggaacgtgactgccgggacgatttaggaggagagtgcaggtggcggtcaccctgtatgtggtcagcctggtctgtgtggggcgctctattgctgctgtggtggagcagcatgagagtggagatgtggtctctgcataatgcagcggacagatttttttttttcctacttgttaccaggcactaggttcaggatatcttgctgctgccagggccagtagtttcttcaaattcccgtgggccatttcagctgtctggccttttattcagtgacagttggtaccatttacactgttgaagggggctggaacatactacagtttaatgtttctgctgggaagtttggctgtacacatcaaaacttttaaggtgcttatgcatgggtttggatttatgatgggcccgtccccctggacctctcatagtaccccatgccagagcaaactgtagccctgaaccattgcctggcctctgttcccgtaggctgctggcactgaagtgggttgcacaatagataaagaaaaaagataaaaaaacttttaagatacttgatcctgcaattccatgtctagtcatttatcccagtgaaataattaaagatgtgagtagaggttttgttagggaataatatttatattagctggaaatgggtcttctaactatccaccagtaagggattggctgagcaaattggggactggtcataagatggaatgcagcgattaaaaatactctggaggctggccgtcgtggctcacacctgtaatcccagcattttgggagttggaggctggaggattgcttgagcccgggagttcttgagaccatcctggacaacatagtgagattctgtctctaccaaaacaaacaaacaaacaaacaaacaaaacaaaagttagctgggtgtgttggcgtgtacctgttgtctcagctacttgggaagctgaggtgggagaattgcttgagcctgggatgtcaaggctgcagtaagtggagattgcgccactgcactctagcctggaggacagagggaggccctgtctcaaaaagaaaaaaaacatgctgc

SEQ ID NO: 3559 - DNA, 1136 bp, Homo sapiens
ccgcgcaaacagcagcgaacagcaagactcagttctgggtcgctgccgccgaactttcccaggccggaaacagcgtggaaacgttgccggaagtggagactgaaagcggcggaagggacgctggaatgtggagcggttgtggggcggcagctgcggaactgcgcgattgtggttcccgccgtatttcccgttccccatctagtaactcccatctcagcccacgtatctccctgagtggaaatctcgggccccagaccagtcgattgggaggtccgccctccccttcagcgacttggtctgtgttttggcagttgccgcgacaacagtcacttccgggaaggggctctgcgaatctccttccgtcggtccgctcagaatcagctgtcctctcagactgtgtgggtggtttccccggccgcagctccgtacgggcttggattgctgggcctcggtgcaccccagcctcccccactcgggttctgagcttgagctggcggctctttaactctgcttcactgttgctcttggcaacatccacttccgggagcgagtgccgtttcccccgctcaccgcgggctagggagcgtgggattccggactgtgagcggctgttagtgcgtcgcagctgctggcgatccggcgaccctcggccggcaggacccgcgggccacgcagccggggccttctcaacgcctcagtacctcggcgggaccgccatggttctgctgcacgtgaagcggggcgacgagagccagttcctgctgcaggcgcctgggagtaccgagctggaggagctcacggtgcaggtggcccgggtctataatgggcggctcaaggtgcagcgcctctgctcaggtgcggctcgcgggtgggcccatcccggacagatcgagagaccggcgtgggatggagaaagaggggcagggtgggccgaggggtcaggtttgtgaagattattgaagagatttgcagcagccggggttgaaacgggacactagggttaaccggagatgaataaggaaccggagaagatccggcctgtctgacaccccgggctgggaggtgggcccaggtgcctctcggagccaggatttggggtgctgcgaataagtggaaatgggctggggagggaggag

SEQ ID NO: 3560 - DNA, 1149 bp, Homo sapiens
tggctcacttcttagaggccatcaggaagggagagtctgacctctagatccttttttttttttttttgagacggagtctcactctgtcacccagactggagtgcagtgacatgatctcagctcactgcaacctccgcgtcctgggttcaagtgattcttctgcctcagcctcccaagtagctgggactacaggtgtgcaccaccacacccagctaatttttgtagttttagtagaaacggggtttcaccgtattggccaggctggtctcgaactcctgacttcaggtgatccacccgcctcagcctcccaaagttctgggattataggcgtgaggcaccgcgctcagccattttttttgtatttttagtagagacggagtttctccatgtttgccaggctgttcgcaaactcctggccccaagtgatctgcccacctcagcctcccaaagtgctgggattagaggcatgagccaccatgcctggcctagatcctcttttaaggggttcatctgattaggtcaggcccacccagaatagtctctcatttgattcaactgatttgggaccttaattacatctgtgaaataccttctcttctgccacttaatgtaacctaattatgagaggagggcctccatcgtatttacaggtcctgcccatgctcaagaggaggggattatacaggatgtgtacaccagggggcaggaatcttgggggccatctcagaattttgccttctccagtggggaggatgtccttctagagtagcagaacatttggacaccaggtggcaatgggaagaaagctgaataagtagaatgggacaagattagggtcaacctcaggctgtcctgtaggcttttggggattttgtgttggggtgatagttaacctgagctctggatttgaggaaggtgcatgcggcgacatggtatgtgggagagtggactaaggagacactaaagagagataaggaaaccagtcaggaggctattagagttctgggcttgaactgagatgcttttagctgttggtttctgggcaagttacttaacctctttagtctcgtacttatacttgctcttataaccccgcagtgtgtctctattttagcacttaatcagtgtccattggtatgctggcgcatg

SEQ ID NO: 3561 - DNA, 1198 bp, Homo sapiens
gcatactttgtatgctatatgtatgatatattctattcttacaataaactagagaaaggaaaatagtattaagaaaattataaggaagataaaatatatttactattcattaagtggaagtgggtcatcataacattcttcatcctcattgtcttcacgttgagtaggctgaggaggaggaagaagggttggtcttactgtctcaggggtgacaaaggtagaagaaaatctgaatatgagtggacccacacagttaaaactcatgttattcaagggtcaactacttatacaaaccgaggtggtatagcctactatacacctaggttatatgtatagcctattttgctccttggttacaaacccctacagcctgttactatactgaatactgtaggcagctgtaacacaagtatttacagtggtatttgtgtatcgagacatatctaaacatagaaaaggcacggtaaaaatatgctgttacaatcttacgggaccacgattgtatgtgcagttcatcattgactcaaatgttactggctgcatgactgtacctactggatccattgggcgcttaaaacttcaatacatctagagcattgctcacctgccacctttcttctgaccaacctcttcctctgtctgtatatcccatcttggtgaatgatactattatctatccttttgttcattgtttcagcagttatttattgattacttactgtgtgtcagatagtctgtggtataattttatatcattttgttcctgattcctagcacatagcttccaaaatctttggaatttcctgagtggtgggagtgtcttcttattcataatgagtccttttggatcttatctgagttcatgctaatgaactggctcctggggatgaggggctggacaccctcagaattgggggtggtccggaggaagcagtcaggaaactgcaggattggagggttggaactttcagccctccgccaccaccagctccagggaagagagagggactggaaattgagttcagtcacgtggtcagtgatctacttaatcatgcctatgcaatgaaattgcaaacgaaagccctggaactgtgaggttcggagagctgggttggtgaacccatgatgtgcagaaaggtgagtgcctatattgcacagaggaggagagggcatggaagctctgtacttcctctccccc

SEQ ID NO: 3562 - DNA, 1168 bp, Homo sapiens
tagcattgctttttaaccaaaaaagaagtgttttagaaattagaatagcctggacattattgttttacctcagttacaagaggtttttcatacttttatagaacctttaaattattatatatacaacttgaaacagcctctcagtctattgtgtttatccatgattctggaaaaataattatctatttgagggaaatgtttatgatcttaaaaatgggaaatacccatggcaaaaaaaatcagaagtagtgataataaaatgaataaaatatgaaagttagagatgattatctagagaagttcttagtttactgtcattaaggaactttaccaggctgttccttatggataatcctctttctctcctttttcttttccccacagtgtcccaccagtggcagagtgggctgttcctcagtcatcaagactgaaatacaggcaattattcaatagtcatgacaaaactatgagtggacacttaacaggtatttacaaataaaaattagtgaaatatgatctttgttttcaatgtaaactgtttctagatattgggtcatagatattttccatgtctgtgtgcttatttcttggcagtgtttcctttgtctctgttatctcatgttcttatccactgataactctttacatagttatatcattctctcatgccccattgctttgtggtaaaatggaatatagaccagggatactcctgtacgctgaaagccactgatatgcaaatcaaggcactagcaaagaaacacttctttgaacaaaaactagcttcaacttctgaagtccagctttgaacttgatgaacttgaagctgtctgttcactaggttagagttggaggcagcaggcagggtaaaagcagggagttgagaacatggctctgtctcagataactgcctagatagggctcaccactttggatatttctttatctattaatataaaaggccagagttaacttaggtgatctcaatggatttttttaaaagaagaatgattctgttatctacgtcagaaggatagacaggaattttagcatactgttcaaaatttttctcacgaaggtttaaatacttgttagaaagttataaagaaggctgggtgcagtggctcacgcctgtaatcccaatcccagccctttgggaggctgaggc

SEQ ID NO: 3563 - DNA, 1099 bp, Homo sapiens
gatgcggggagatgaacagccagcagagctaggcaaacatgaagatgtaaaaccaggttaaaatggcaacttttcagccaaggacatgatagatgcatgtcgtgtccccagggctgcacccaggagaggcctgtgtcctcctgcattgatggggctgcatcttcaggcattagaaacttgaaggcctttccttgttagttccaagttgtactgctagcacacagagcagaggcagggagggagtggcatttacaggccgtccttgaacggctgagtgggagctgcccgggtgatgctgtgaggcagggccttcctgtgctccctgaacctccagcgtgaacaaggagtgaatgctgcagagcagctccatgatgggcccaggtagcaaagggaggagctcacaaggcctgtcttggtgatgtgggcctggggtattttaactctggaagtttctgttttgctttatctaaattgaaaggatggttttgcctttcagcctttagaagaagccacactctctgaattaaaaactgtcctcaagagcttcctaagtcaaggccaagtattgaaattggaggctaaggtaggttttaaattatttatggtacgttttctcgggttattttaagcttaaaatggctacagaaagtactagtgaaatattagatctaactctatactaatttttctgtagttaaaattttgtatttattttaaatttaaatgattatctgactgtgcagttttacttttgcctttttctaggtgtaattataacctcttacatttgtgcaacacatttagcctttcaaaacacttttttgtgtgtcccatttgattagcgcgttttcacatttccagtcttacttcttttgtagactgatccgtcaatcttgggtggaatgattgtgcgcattggcgagaaatatgttgacatgtctgtcaagaccaagattcagaagctgggcagggctatgcgggagattgtctaaaagtgttggttttctgccatcagtgaaaattcttaaacttggagcaacaataaaaagcttccagaacagatcatattatgttcactgtcttttaaactggaatgtag

SEQ ID NO: 3564 - DNA, 1374 bp, Homo sapiens
gatcttagtgcctgtcctaatctgagcataccacagtaagacaagaaagggcaatgctgtggtaggcagttagctgctgaagttaggccacttagttatgaggtagatgaatttctgtcctcagctcaaaatgataatattctcactgacaaaagtatcagctgtgatcatatagattgctctttcctgtggaactgaagtgtattaaaaaaattttttttcttccaataaagaatgtctcgttgcgccgggtttgctagactgaaagtttcctcatcacgtggcgagacctcctctacttcaatctttgtcttttgtctctgctgccttgcagggttggtacagtaggcttcactagacttagctgcaactcagaatttctcctccagcacctgagtaaatgctgatggtcttgtggagagtggattaagagtacgagctaagttctcaatcccaattaagaagcggaaaatttaaactgtcttcttcaaagtttatcacaaccaccaccatcaagacagcaaaccaaaggacaaagactttgaccctgctgtgttgctctgtgtagtccagttcacgtatggtttacagacttggctggggttactaaaaataaataaaaagttggacacttctgtcattggagcgctattattcacaagttaccagaatgagagctgtactggacacagcagacattgccatagtggccctgtattttatcctggtcatgtgcattggtttttttgccatgtggaaatctaatagaagcaccgtgagtggatacttcctggcggggcgctctatgacctgggtaacaattggtgcctctctgtttgtgagcaatattgggagtgagcacttcattgggctggcaggatctggagctgcaagtggatttgcagtgggcgcatgggaattcaatgccttactgcttttacaacttctgggatgggttttcatcccaatttacatccggtcaggggtatataccatgcctgaatacttgtccaagcgatttggtggccataggattcaggtctattttgcagccttgtctctgattctctatattttcaccaagctctcggtggatctgtattcgggtgccctttttatccaggagtctttgggttggaatctttatgtgtctgtcatcctgctcattggcatgactgctttgctgactgtcaccggaggccttgttgcagtgatctacacagacactctgcaggctctgctcatgatcattggggcacttacacttatgattattagcataatggagattggcgggtttgaggaagttaagagaaggtacatgttggcctcacccgatgtcacttccatcttattgacatacaacctttccaa

SEQ ID NO: 3565 - DNA, 1207 bp, Homo sapiens
acgccattttcctgtctcagcctcccgagtaactgggactacaggcgcccgccaccacgcccggctaattttttgtatttttagtagagatggggtttcaccgtgttagccaggatggtctcgatctcctgacctcgtgaaccgcccgcctcggcctcccaaagtgctgggattacaggcgtgagctaccgtgcccggccatgtttttggttttcaatgcagttttactatgatgtacttagatgtagttttcttagtacagtcatgcatcatataaccatgtttcagtcaatgacagaccacttacacatcagaggtcctataagattgtaatggagcataaatagaaacctgatgtacggcacttgatgttggcattacaaatcaaataggggaaatgattgatattcagtattggtgctgagacatttggtttttcatatgaagcatatatatatgtgtgtgtgtgtgtgtgtgtaactaaaaatatgtatacatccagttttatgtaagtacacactaacacactctgaggttcacacaatgacaaaattgcctaatgatatatttctcagagcctatcctgtcattaagtgacacatgactgtatttatcctgcttggtgtttttagcactttttaaactgtggcttgttacctttcagtagttgtggaaacttcttggctatcgtctctttgaacactgttcctacctattctcattctcctctcctggaattttgaatacatacatagtggacctttcatcatgtaaccttacatctcttatgtttctttttgtatgtttctgtatgtaccatttataaacaaaacaaaactatttcaatctggttatttcctctgactgatcttccagttcattaattcctttttcagctttctgtcacttactattatattcattcattaatttcttaatttcagttcaagcatttttcagttgtagaatgtccactttcttctttttacaggttcaagttctctgctgagggtttccacatagccatctaatttcttggatttattaatcacatatattttaaactaaatatctgataaatcctgtgaggctgttcctttctctgttgatttctctcagttttctgttatgtgttcatgtctcctggtgtatgaagtaatttgcaattaaacacaaagcattttgtataaaaattgttgagacaatt

SEQ ID NO: 3566 - DNA, 1154 bp, Homo sapiens
aaagttctgggattacaagcgtgtgccaccgcactcggccagttgttttgtatttttagtagagacgaggtttcaccgtgttgtccaggcttgtcccaaactcctgacctcaggtgatccacccgcctcggtctcccaaagtgctgggattacaggtgtgagccaccgcgcccggctttatttttattttttgagagactctacctggctggagtgcagtggcgcaattttggctcactgcagcctctgactcccaggttcaagtgatcctcgcaccttagcctcctgagtagctgtgactacaggtgcatgccagcaccttaatttcttttatttatttatttgtttgtttattttttgagatggagtctcactctgtcacccaggctggagtgcagtggtgtgatctcagctcactgcaacctccacctccctggttcaagcgattctcgggccttagcctcccaagtagctgggactactggcgtgtgccgctatgccaggccaaattttgtatttttagtagagacggctttaccatgttgaccaggctggcctcaaactcctgaactcaagtgatccacccacgtcggcttctcagcgtgctcagattacaggcctgaggcaatgcgctcggcctagtatattaattttgtatttgatcctgaacagccctgaggtggggacagaatatttcttttatccctattttatgcataaggaagttggggaccagacacagtggctcattcctgtaatcctagtgcttcgtgtggctgaggtaggaggattgcttgaggccagtgcttcaagaccagcttgggcaacataccaagtctctacctcagctgagtacggtgccttacacctgtaatcccagcatatttgagaggtctgggccgggggattgcttgagcccaggagttcaagaccagcctgggcaatggggcaaaaccctgtctgtacaaaaaaatacaaaaattagctgggcctggtggtgcatgcctgtggtcccagctaccaggaggctgaggtgggaggattgcttgagcccaagaagttgaggctgtagtgagccaaaattgtgcctctgcttttcagtctaggcaacagggtgaggtcctatctcaaacaaacaaacaaacaaaaatcgt

SEQ ID NO: 3567 - DNA, 1176 bp, Homo sapiens
tttgagaccaagtatcactctgtcacccgggctggagtgcagtggtgtgatctcgtttcactgcaacctccacctcccaggttcaagtgattttcatgcctcagcttcccaagtagctgggattacaggtgcgcaccactacgcctggctaattcttgtggttttagtagagatggggtttcgccctgttggccaggctggtatcaaactcctgggctcaacgatcctcctgccccagcctcccaaagtgctgggattacaggcgtgagccaccacgcccggccccaattttgttttttaaaggaatcaacattaaaaggaaagccgtttctagtttgccacaatacttgcttcttattttcacactggtgggttttgatggcattcagattgccttgtggggttaactggactttgataaactgaggggaggccttgtagactccctggccatttggggacttctgaggccctctgggaggaagcccttccctgcatgcccctgctgcccaggacagggaagtgccccaagctgggcctgtgtagaggatgtcactcagcactgtccttctgccaccttttggtccccaattcagcccccgtggcctgcttggcccagtgtgaggttttttttttgaaacagagtctcactgtcatccaggctggagtgcagtggaacgatcgtggctcactacaacctccgcctcctgggttcaagcaattctcctgcctcagcctcccgaatagctgggattacaggcgcccaccaccatggctggctaatttttttgtatttgtagtagagacagggtttcaccatgttggccaggctggtcttgaactcctgacctcaaatgatacacctgccttggcctcccaaagtgctgggattacaggcgtgagccaccgcacccggcctattcaagtgaaaattgctagtagcacagataggttgcagcgacttagcaaatcgcgatgaaactgcatgagtgagtcgctatcacacactcttttccagttgtatcttttccctggtttttgccttcaaacaagcttgtgattttgctcgaacttccctcttctaagtagatgtgagagtgttggtaaggtctgtaacttttccctgttttggggacgaaggtccagcgatggtgccttcctggccatttcttccac

SEQ ID NO: 3568 - DNA, 1074 bp, Homo sapiens
cccccagagctaaagcggcccagactcgatgaaaacaaaggaggcacggaaagtctggacccttgatgggacctcggcttctgctcgaagcctaccaggctcccggtgtgtgcagggagacggtaaagctggaggtgcctgagaccagggcttccatggagcgggacacactgtaaatggatttctataacagaagtgacatgtgtactgatttttctccagaaatatggatgctgttgtattcagtatccatttttaacttgggacatgaacgttttaacgtagtaaatcctctttttgatgagtttctgaaactggagcggttcaacgttatccagtgtgaaaatcagtgagtcctccctggcatcctcgtgaaagtgcacacacttcatggagggactccttttcaataagaattaggaagatgagaaagtaatttgagattttactctgtcgaattttagagtatttgaagtgattgttagatttcacttctaaggagttgattgattaaactttggaaggtagttgtgtttgttttctgattttaaaggtgacgatgcttattcttttagtaactaagtgaagtgaaaaagatgggtatcacccatcatcttcccaccagaagtaaccctcgttaatgttgtagtatatttccttagcatttttgtggatctatttattctaaaaagagaattgagattttatttcatatgcaatttggtatctaaataggttagttttttagattggtttttcaaagcaaaaaaagtatcttttttgttttttgagacagggtcttgctctgttgcccaggctggagtgcagtggcgctatctcagctcactgcagcctcgacctcctgggctcgagcgatccttccacctcagcttcccgagtagctgggactacaggcatgtgccaccatgccatgctaatttcacacacacatgcacccacacacacacatatatatgatacatatatatatatatacacacacacacaagtatgtgtgtatatatatattttttttcttttttttttgagatggagtctcactctgtcgcccag

SEQ ID NO: 3569 - DNA, 1145 bp, Homo sapiens
gcctgagagctgccaggagagctggcagggaagaggaggcggccccctgggatggagacagctctggggagtgtggtggccatgatgttccatctgtcagctacatggtttagctcagaaggggaaaagtgtaaccaggtagaggctgaaggagggccagtaggcaggcaaaatggtctcatcttacagagaaaatagtgacttatagagataattatttagaagtctgagccctcctactcttgttctaataactaacaagttattgtcaagaattcttttaaaacgaaaatatttaattcatggtattcaggtttcctgtgcacggagcctctgcgctgcgttactgtatttattcatcggcctttgtccttgggcgtttcatccttcaagggaagccctaagtgatccatggtgtggtgtgttcctcacaggttcatcccgagttactccctgagtcttcaggcgacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacaggtatgaacagaaaatgtctgtgactgtgtttaatactttatcgaactgaggtttcctgattagataaaatcatggctagttaggtgttaacatgaaaagggttgcataattgttttgctcagaaagacagttgctacatttctttctttttgtaaatatagagataagtattttcaaataaattggtgggttttttctttctttttttttttttttttgagacagagtctcactctgttgcctaggctggagtgctgtggcacagtctcggctccctgcaacctctccctcccgagttcaagcgattctcctgcctcagcctcctgagaagctgggattataggcatgc

SEQ ID NO: 3570 - DNA, 1430 bp, Homo sapiens
aaatcgttaatatcgctgatattaagtaatttccccactctgagtgaatactttgatgattgccaacagtggctaataaaatgacggctaccacactcatgggtcactggggctgcgcagggctctttgaggtgggtggcttcttttggaaagtactatgaacgtctcgaagcagtattctagtgataagaattcttaacatagccaagcgccccacgtttgttccccacgtttgttccccttttctgtttgaaaaacctgttctggtagctccacaagagagatgatactgactttttaaattttttacaagagtctgtattcctgatatgcctatatttttcctcaaagattctgcattttaaggatgggcataagcaaactatattttaataatttatagttaatgttaaaatattggctgatttagaccaaaagattcaaatctcctctttgtgaaatcccatctgcatttgattttttattattttatgttcccccgttagattgttttaagtgtttgcttttcatcttttatagatgtaatctgattttcaaaaatcattaacactttttaattagtatcgactaagactttttccccctggaatcgaggctgtgtgtccgtcatcccagcccccggttggagcctgctctttgaactccgctgccttccttagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagaataaagaacattctaaaatgagaagttcactgtcactcttgtccattc

SEQ ID NO: 3571 - DNA, 1209 bp, Homo sapiens
gacagaggtagtcagacatcagcatagtcatctccactgaaagtttggctgaaaggtcagggtggcgctgaggggacagcaatgaaacccacccgcaccgggtgctccttcgccgttagagcttcctgcgactgcagtggtggcggcgtgtggtttcgctgcttggtaacagtgagcacaaacccaccctctcttctcttctcagaatttgaggttaacatcgtggtgctgcttcaccctgaccacctcatcacggagaacttcccgctgaagctctgcaggatatagcccggaggagggaagcatagagaacgggagtggccatctggaaatccagctggttatccaaatcctaaggggagctacagccagcggcatatacttgtttttgtgattattctgtatcagaaatgaaacagaccctcaaattaactttccttcctcatttcttgaggcttctgcttccaacaggcacctctaatcagaccttttctttgaaattcaacaagatttcttaatgctatttgccaagaccatttcacagaaaacattgactgtggctcttgccttatctgttcctttttaggtacagtaaaacaattgtgacagcagtttgagcttgctggagagtggcatcatggggacaaaaggaaacctctgacttgctaatggatgtagccagggactccccatagcaaagggtctgtggccagttgacatccaggatggctgcaagcgcacttgatggtcaggaagtttgcagatactcgccaaggcagagcgcaaagtgctagccactggaaatgcatgacttccctccacccctactctattctgtagttttttggttttgtttctgagacggagtctcagtctgtcacccaggctggagtgatctcagctcactgcaacctccacctcccaggttcaagcgactctcctgcctcagcctcccgagtagttgggattacaggtgactgccaccgtgcccggctaatgtttgtatttttagtagagacggggcttcaccatcttggccaggctggtcttgaactcctgacctcgtgacccacccgccttggcctcccaaagtgctgggattacaggtgtgagccaccacacccagcctctgtagttctttttacaacatttttcattataactttaaattttttaagcaactggaaaagtgttccttgctctcttggg

SEQ ID NO: 3572 - DNA, 1181 bp, Homo sapiens
aaagtgagattgtgatgggataacggaatgtcaagtctaattgtcaggaaaagacaaaataacatgggaatgacaatcaaaatggactaaggacttagaagatccgaaactatgaagctactaaaagaaacattggggaatgctccaggacattggtctgggcaaagatttcttgagcaataccttaaaaggacaggcaacccaagcaaaaatggacagatgggatcacatcaagctaaaaaacttctacacagcgaaggaaacaaagtgaacagaataacatgggaatgttttctgtaatttagtagtaactggcaatagtttacaaacacattttgtgtatactgctgtcattgcactgattaccttctgttgtagtgactttgttctattagtccactcaattaaaatatttggttttgtttatctttgtattcctgggcctggcagtactcaccacttaataggtgctcaaaaactttattaaatgatgagttgaagccctgaaacatttaaacaaaatgcagaagactgataattttataaatgcattgatcagaaaggggaaactatggtattgtaggcacattatggattttgcttcgtaattataaataatattctaggtatcaatttcagacagatgttgataagatttattcttattttgacatagccccagagctacacattgcacccaccattacttgtatttgctttaaaatagtcattcttaagatcatgattcaaataaattgggagtagagattccagaattcctataaatatggttttctctctgattcaggaatggaatataatagaaaattgtccaaggtttgattttccagggtcttcatcccagttcctgtggctcagcgtgaatatagaccctttctccaagcttgcagcattgctgttggggcaccttctccctaagcatccttccacttgggtagaaaacttctttttttaagtattttattaagatagagatgaaatcacgctatgttgcccaggtcggtctcaaactcctggcctcaagcaatcctcctgccttggcctgacaaaagtgttgggattacaggcatgagccaccacacctggcctaaaaacttgacttctgtttccaaagacccatgggtgatatgagataatcaggaattgtgttaaacattccc

SEQ ID NO: 3573 - DNA, 1172 bp, Homo sapiens
gtcccttcccatcatcgcatcagtaatggtagcttgagatggggcgtgatgagagtatttacaccatgggaatcagcagacactacaaatcagggccttctctcccccagagtgctgattgttaaacatttaccaacactctactggttatatctatcaataatttccatattagaaattaaagtaaattttaaaagaattcatttaaaaataattttacttattggcattaacagcatttttttcttgcaaaaagtaattattttttaaaaagttagcatggcattgtttcacatttgcaaatctctttaatgtctggtttagtattagagctggattcttctgtttctgcattcaatctgtttgcatatattttgatagagtatgtgaagaaaatccggcctaacagatatgtaacagaaacaaggaggagcatttaagactatttcagataattgtagatattctttctttactatgccaaaacttaacaaagtataattccttagttgcaattcaggtatgaaaccatattaataaactttcctaaggttacattaaattccattggcctacgttgcactttgaacagatcttttagccgtgtgtgattttgtaacatcctgcattggtcacttggaaaatattgcttcaaaatgttaacacatttcaaaatataatattcaacaattacattacttaatatcaccacaaatcacatcagaaaattactgggaaactatcaaactcacagtggtggatacacactttttaaaattcaaattttcacttgaaacctcaaattttataatcagcaacaaatacccctaagtatttgaggagagattctcggatgtttatactaactacattagaatttgaggtttaagtacttttggaactgaggccacaacactctgtcccctcagtggactctgacgttgttaaggtgatggtggtcttaggacacctgttttcaaatttgttctttttacatgcttcaaaattagtgagtacgccaaaaagcttatattcattggtgtgctagagccagctcactgcgttctcccaagagctacgtgtctcttcccaccattttgggggggaagcgacaggctcactttatttagtttttgaggaaggaccagccaaatacccaaatcagaataatt

SEQ ID NO: 3574 - DNA, 1189 bp, Homo sapiens
gtgacaagaatgtgggacaactggaaccctcaaacattgctgctaggaatgcaaaattgtcagaaaaacagttttgtagtttcttacatagttagacttatcatatgacccagcagttccacttctaggtatctatccaagagaaataaaaacatatattcataaaaagacttgtacataaatgcatatagtagcattccaaaaagcagaaacaatccaaatgtccattaactggtgcatgaacaaactaaatgtcacatgtccatatgatggaatactactcagcaatagaaggggaaaaagtgctgatacgcacaacaatatggatgaatctaaacagttattttgctgagtaaaagagccaggcataaaaactacatgctgtatcaatctattttattaaattctagaaaaggctgaattaggcagaaagcagacctttgtttgcctggggtcaggtagggatctggactgaatgcaaaagagcataaaggaaactttgagggtaattcaagttctaaaacttgattgtgttggtggttgcatgacagtatacatttatcaaaactcattgaactgtacacttaaagtggataagctttttttttttagcatgtagactatacctcaacaaagctgttaaaacataaatctaacctggcctacagggatctatgtaacagatcctatctactgttctcgccatcttatcccacttctttcactcaccatggtctggccatgctggtcttctgttgctctaactcagcagcaggctctttatatttcagggcctttgcctaagctatttcccttgcctcaaagcgtctctcactctactatttattcattggctccctactgccctcctttccttctccctccttcagctcttggcttaagtgttacttcctcagagataacttttctgatccccccttttatagtctttcctggctccttaaactttccttcacagttcgtatcaacatttgtaattaaatattgacttgtgcttatgaattcagcaacaacttattaaacccttattttgtgccttacattgagcagagggctgcagatgcaattgtatgcaaaatagatatggcttccttctcctcctggagcctgcagtgggattatttgtttagtgactgtcctcccctccttagcctgctactagactaca

SEQ ID NO: 3575 - DNA, 1145 bp, Homo sapiens
cctgtaaagctctacatgttcttcgcggggtgattaatttttatccaaaacttaggtgagagtttgctatttgaagtctcaaaaaaaatttttgttaatgccttcacctctttcctaaaagtgtaggtagaagtttagcactgcagtcatcagaagaggcaagattaatttccttgacattgaggagttgttggataattactaaatttgtccttgttaaataaaggtataaaacaaagatgttttttcttttttaatttaaattttttacagagctgagtgtaaaaatgttaactatgttttctttaacagaaagttctgtttttgtgatccttttaaaaataaagcttcacggaaggtatgagaatagtatttttcaactttaaatttctcattaccagaagaccatgtggtaattctctgtatacagttagaacagcacggaaacttgaaggcctaaaaaattagctgaccttgttaaaaatgttggcgtgagcagtatattattacctatctttttttattgtgtgtgtgtgtgtgtgtgtgttttaaactaattggctgaaatatctgcctgtttccctctttacatttttcttgtttctttccttatttatctttgtccatcttgagatctactgtaaagtgaattttttaatgaaaacagttccaagttttactctcagtgggtttgggacatcagatgtaattgagaggccaacaggtaagtcttcatgtcagtgtttgttgaggaacgagcctatgaggtcagttttcccaaaaggaaaaagggcagaagggatttgttcatttttacatctcgtttctgtaatacacctttgacttcatggttgatcagactttgaagtctaaacagaacgtaagcacttggtgtatcgattatcatactacacagtagacatgttttcaaggcatatcttgtcactgtgtgtgcttctgacttgtatctttccctagaactaaatattttgaaggtccaaacattatactttgggaaacttgattgatttttttttaatctagcttttcagctgataatggttacacgtggtattatttcaagtccaagatattatgtattctattttaactgtttcccagttttgtattttttgtattggaat

SEQ ID NO: 3576 - DNA, 1177 bp, Homo sapiens
ctggccctgccagccatcgccgtcatcggggaccagagctcgggcaagagctctgtgctggaggcactgtcaggagtcgcgcttcccagaggcagcggtaagttcaacggaccaccttccctccgcagcaagcagcgccacctgtaagccacaaagcttccccaggcaccaagaggttttagagacaggctgctgggtgagagagctgggaaagacaggacgctgggagagaggccgctgagagagacaggccactgggagagacaggccgctgggagacaggcctctgggagacaggctgctgggagagacacgttgctgggagagacaggtcactgggagagacagaccattgggagagacaggctgctgggagggacaggccattgggagacaggctgctgggagagacagatcactgggagagacaggccgctgggagagacaggccactgggagggccctaggagggcagcttctcaggcctggtggcagggggctggattccccatacatgtttaaatagctttcactgcccgtgtgtcagtcaggtgcagggaccttgccacctcttcctagtggtctttgtaagaatgtagaagcatttctttgataagttgataagttttaggtgacaggcgaagccttcttaaagaattgtctcaatgttttgaaaacctcttatttaggatcatgatatgagacaccttttccttgaacaaaaacttttaaaagtctgtttagagtgaagaagctgttgtacattcataatttaataaaataattataaaggaaaatgataaaggcggtaccctcagagtgggtactggagagtgtttagaaaggagtttttaggtaagcagggcatagggaagccagcaagaagggggtgggacaggaaggggagcagcttccagaacccaagaaggagcagcatgcaggggccctggcaggtgcagcggcagcagagagcgcccagctccttctcctccctggctcccctctcctgccactgctgcttacttctcaacccaaccagaatgctggggtggccgggaggcatctgatggtttctccaaggttgcccagagcaaggtggggctgctggagggctgcccggaccctgcacagccccctgcaacaaccgcaaagccacagtgagcctgggagagtgccc

SEQ ID NO: 3577 - DNA, 1191 bp, Homo sapiens
tcgcagggagctctgtctggcatcggtggcacagatggtgaacttgtttcaggaagtgtgagcacgggcctggctggcacccggtttacagggaggtgattgaggacgtcgttatgatttgatttgaccttggcacacactgcagagccacagggatgttgctgaatttcaatcaccgatcagcaaggatgaaccttctcaacttcctaggaatgtttagcagcaaccgaatataccaggcaaaactccttggtgcctgcgctgtgtgtgtgtgaggtgcgcggtgtgattgtgcgctgtgtgtgtgtgaggtgcacgctgcgtgatcgtgtgctgtgtgaggtgcgcgccgcgtgatcgtgcgctgtgtgtgtgtgtgaggtgcgtggtgtgatcgtgcgctgtgtgtgtggtgcacgccgcgtgatcgtgcgctgtgtgtgtgaggtgcgcggtgtgatcgtgcgctgtgtgtgaggtgcacgctgcgtgatcgtgtgctgtgagtgaggtgcgcgccgcgtgatcgtgtgctgtgtgaggtgcgcgccgcgtgatcgtgtgctgtgtgaggtgtgcgccgcgtgatcgtgcgctgtgtgtgtgaggtgcgcggtgtgatcgtgtgctgtgagtgaggtgcgcgccgcgtgatcgtgtgctgtgtgaggtgcgcgccgcgtgatcgtgtgctgtgtgaggtgcgcgccgcgtgatcgtgtgctgtgtgaggtgcgcgccgtgtgatcgtgcgctgtgtgagtgaggtgtgcgccgcgtgatcgtgcgctgtgtgagtgaggtgcgcgccgcgtgatcgtgcgctgtgtgtgtgaggtgcgcggtgtgatcgtgcgctgtgtgtgaggtgcacgctgcgtgatcgtgtgctgtgaggtgcgcgccgcgtgatcgtgtgctgtgtgaggtgcgcgccgcgtgatcgtgtgctgtgtgaggtgcgcgccgtgtgatcgtgcgctgtgtgagtgaggtgtgcgccgcgtgatcgtgcgctgtgtgaggtgcgcgccgcgtgattgtgcgctgtgtgagtgaggtgcgcgccgcgtgatcgtgtgctgtgtgagtgaggtgcaggccacgtgatcgtgcgctgtgtgtgtgtgaggtgcgcactgcgtgaccgtgcgctgcatgtgagtgaggtgtgcgccgcgtgatttggga

SEQ ID NO: 3578 - DNA, 1133 bp, Homo sapiens
tgtgtctgacatgctcccatgcgtgcacgtgcacaattcatgcatacgtgtgcacccacgcacgctcaccctggcgcgtctgactcgtggccctctctgcaggtggcagtgctggcagcacggtggcggtggccgtgaaggccgcgcaggagctgcaggagggccagcgctgcgtggtcattctgcccgactcagtgcggaactacatgtaagacacggcttccctcccaggtccctgctcctctccatcctgccacccttccctggatgcctctcacgcctcacctgagaaccggcagccagaactgggaggggaggaggccagcggggccctgtgagcaccgcctccactctcctgcccacgtgccctcacgctgtggggcttcccagcctcttaatgctgtgaaaatcaatgcacactcgcagtgacagccctgacaggaggggcatgaaagacggtggctccctctctgtccctcctgtcccttcctctctggtgtctgtccccctcactgctctggggtccgtgagctccaacgggtagccctggccacatggactgacgtcctcttgggccgggccctgtgccacctcctatccaccctgactccctctgctgcttcccccaaactccagattgggaccgagtgctgcccaggtggccccctaggacttgctgtgactgttttgcccagaggcccctcggacagtaacgccacagacctcgctggtcaccgggcagccaggctgagactggcgctgctctgcacctggtctccggaggcggtaccagggcgggtgtctacagacccccatgccctgtcccctgcacctgcagggtttcctccatggcctgcaagctgcagcggctacacagctcccgagagctcagctgcccttggagggccaggcctggctggtgggtgcccccagttgggttccccagtgtggggtgattcacatctggtgcccagggtcaagatgccctgtgcagggctcctgcccacccccgtcagtgcaagaacaccatctccccacatacttggccagcctgccatgtgtacctgtgcgtgtgagtgtgtgaggggcagagagcgagcatgagaggacgtgtttatctgagtgcctgagcg

SEQ ID NO: 3579 - DNA, 1420 bp, Homo sapiens
aaccccacatttcctttctgcactgccctagcagaggttctccatgagagccccatccctgcagtaaacttctgcctagacaaccaggcatttccatacatcctctaaactcttggcagaggttcccaaaacccaatttttgacttctgtgcactgacaggctcaataccacatggaagctcccaaggcttgaggcttgcaccttctgaagcaggacctgagcactatgttggcccctttcagccatggttggagtgacagggacacagggcaccaagtccctaggctgcacaaagcacagggaccctgggcctggcccatgaaaccactttttcctcctaggcctctaggcctatgatgggatgggctgccacaaaagtctgtgacatggctggagacattttctccactgtcttagggcttaacattcagctccttgttacttatgcaaatttctttagccagtctgaatttctcctcagaaaacaggattttcttttcaatcgcattgtcaggctgcaaattttccaaaccacttcccttataaaactgaatgccttgcattacttcccgttttcacgatctgctgctcgtctcaggctcgtagttcgccttcaacatgccggagccagcgaagtccgctcccgcgcccaagaagggctcgaagaaagccgtgactaaggcgcagaagaaggacggcaggaagcgcaagcgcagccgcaaggagagctactccgtatacgtgtacaaggtgctgaagcaggtccaccccgacaccggcatctcctctaaggccatgggaatcatgaactccttcgtcaacgacatcttcgaacgcatcgcaggtgaggcttcccgcctgccgcattacaacaagcgctcgaccatcacctccagggagatccagacggccgtgcgcctgctgctgcccggggagttggccaagcacgccgtgtccgagggcaccaaggccgtcaccaagtacaccagcgctaagtaaacttgccaaattgatgcctgcagctcctggggaaagtggaagtcagataactcctttatgaaaaggcagcattcaaaaactataaaaaatataaatccaacattattaaaattttgcacatccaaagatatcacgaacagttaaaaacaaacccacaaggtgacagaatatatttgtcacatactgacaaaaagttaaaactcaaatatataaagaatatttacaaatcaaatctcataaaataaaaactgtagagaatctgaatagaccattccaaggaaagtgggaaaatctccaaatagccaaaaatctcatttagaaaaactccgatttcacattaggaaatgctgataaacaataactctcaagcactgctggtggaatatgggagtataaatttaaaatactaccctggaaagc

SEQ ID NO: 3580 - DNA, 1099 bp, Homo sapiens
tttttaaaagctttgttctgacccatgaaagtagatccgatctgcctctgtagagggagagcaggcttgtccaacccacagccacatgtggcccaggatggctttgaatgcagcccaacacaaattcggaaactttcttaggaccttatgagatttttttttttaagctcttcactattactagtgttagtgtatactgtgtgtggcccaagacagttcttccagtgtgacccagggaaggcaaaagactggacacccctgaggtagaggaaccagccttgagaagtgcttgcaagtctctgatgcagatgacaggtcctcagggcaagattttacttttctgggttttaatgtgcagccttgccacttctcccgtgctgcgtaataacttgttttaatttatttttattttactgaacatattttgagtaggagcagggcaaaatatttttatattacattcaaaagtaacaaccaacagctttagtggaggaagaaaaccaatggacagaaatctcattttcccacgaaggaaaacagaccgggtgtggtgtgagtcagactgatgaggagtgtgcttttctcacggaacctcagaagagagggcgtctccccagagtgagcctgctgcacctcagcagggcatgctctctcagggaccccttcacccaggacagagcccagaaggctgagtttaccttcacattccaccttgtctctgagcaagctgtagggaggactttcccatggcgtgcagtgagcatccccagcatctcacctctgtgaggtctgccctgctgtctttgtgtttcacatcatttctgggattatgatgaagttttctttttttttttttttttttacagagtttcactctgttgcccaggctgaagtgcaggggtgccatcatggctcactacagccccaacctccctattgctcagctgatcctcctgcctcagccacccgagtagctgggactacaggtgcacgcctccatgcctggctaatttttgtattttttgtagggactgggtctcattgtgttgcctaggctggcgttgaactcctggactcgagcgatccacccgcctcggcc

SEQ ID NO: 3581 - DNA, 1176 bp, Homo sapiens
tgtgagtgagcagagcaggttatgtgcagacagggaaacgagaactttggacctggctttctgagtccaggtgagagctgtgtggccccccgatgccactctgcccgccggagggatgtgcctgctgagccttttccttccacgccgcctctcactgccaggccagcggcttccgctgagactcgctggagaggcggctcccgtgtccgtccaccgagcactcagatggatgctgatcaccagggccgagggggctcccagaaggaccccaggccctggggagggtggctgtgggaggccaagtccactgcccggaagtcttgtcagccctaagccagggaagcctggagcgtggcctggcgggtctgggtggacaccgtccccactccggactcccagcacaggggaggatacctgagcctgtatggccctgtagccctgggcagagctgggcctgtcgtgtgttcctgcctggcaggtgcaggtgctggccatctgcaggtggaaggaggtgggaatcttggattttttgtttttttttgtttttttttttttgaggtgaagtctcgctctgacacccaggctggcgtgcagtggtgtgatctcggctcactgcaaactccgcttcctgggttcaagtggttctcctgccccagcctcccaagtagctgggattacaggcatgcgccaccacgctcagctgatttttgtatttttagtagagatggggtttcaccatgttggccaagctggtctcaaactcctgacctcaagtgatctgcccgcctcggcctcccagagtgctgggattacaggcatgagccagtgcacccggcggaatcttggaatttttatagacagcacctcagtttctgactccagccgcacacctcctgcctctgccagcaggggttgccgccagaccagagccagggccaggtccctgcgtccatcccccccggtaggatggacgtgagccatccttctaggggacttttttcagtgtgcgactcgtctctgttaggtggtaggagccagtttgtgtggcctgtgccacgctccacagtgcgtggctgggctctgtgtgtggcctgtgtcccctgtccctgcaggacccagcaggcatcgtggcgtgacagctgtgtccaagccactgcccgggcatcccatcaccca

SEQ ID NO: 3582 - DNA, 1197 bp, Homo sapiens
gcagctcactgcagcctcgatctcctggtctcaagcgatcctcccgcctcagcctcccagtcgctgggaccacaggcgcacgccaccacgccggctaattgttgtattttttgtagagacagggtttcgctgtgttgcccggctggtcgtctggggttttcgggacagcgcgcgtcagtgaggtgcgtgaggatcgtgtgcatctggcaggttttgatgcagaaagttgccttgggccgccagcatgagcattgtaggctgtagactttggtgtacaggttgagcgtctctaatctgaaaccccaaatccaaaatgccaccaagtccaaagctgagtgctgacaggaagctccagggaaatgctcgtcgcagtgttttctgtttggggttttcaggtgagggctgttgaactggtgaatatgatgcagacgttccaaaacaacctgacattcaaagcactgctggtcccaggcatttggggtcgtggacgctctatgctgtacctgtgtcctggatgctccaggaactggcttttccagatgggcttgggtctcagctggttcgtttcagctgtggcgggtactgaacacgctgctcctgggcattagaacagggcgctttctcacacacattgtcaggaggtggtgctggctggggcctgctggaagcagcgagcctcaaaccataagtccccagcccccgagagccccctgacttctgccctggttctcaggcattttccctgaagatgagatcccagagaaggcctgcaggcgcctgcttgaagggaggcggcagaagaagacgaagaagcagaagcgtctgctcaggttgcagcaggagagaggtaggactagggggtgtgttagtcatggagccggcgtcctcacctgcttgcttctcccctggatgggggtcacctgcagtgtctccccctgaagcatgagtgccgagtcccccatcctgggtgcctgctatccacgcatcccggaaatgccctgtcctcggcatccctcctgtaggcctctccctgcctcccccacccaccttccttgtctgcagctcccccgagctgtgtgcgctgccctccctcccggtctggagacatcctcctggctgggctgcctccttccgtgcctccgtcttagatccaagccccgtccgctcctctcccgcaccctccagagattcctgagt

SEQ ID NO: 3583 - DNA, 1149 bp, Homo sapiens
ggttgtgggtgttgtggatgttggtgttgtaggggttgttggtgttgtgggggttgtgggtgttggggttgtgggtgttgtgggtgttgtgggtgttgtgttgtgggtgttgtgttatgggtgttgtgggggttgtgggtgttggagttgtgggtgttgtgggagttgtgggtgttgtgggagttgtgggtgttgggttgtggaggttgtgggtgttgcggcggttgtgggtgttgtgggtgttgtaggtggccagaactttccaggtggagagagttagttcataacagcactttgggtgtggatcaattgttgtctctagaggtagccacctggtggctgagggttcccctggagctcctgagcacatggttaggtgagcttgccccatcggcagtgtccagtgaatggaagggaaaagggtataattgcatttctaaagggctatgtaggaagtggggaacagggggaaatggagacaagagaagagaagagataaaaataatttagaaacagaaaaatgggggacacttggttacattttagctttgtgtgtctctgtaaatctagcaatctggcagactgctggcttttttttttttttttgagactgactcttgctctgccacccaggctgaagtgcagtggtacgatcttggctcaccgcaatctccgtctcccgggttccagtgattctcctcctgagtagctggaattacaggcgtgcgccaccacgcccagctaatttttctatttttagtagagatggggtttcaccatgttagccaggctggtcttgaactcctggcctcaagccatctgcatggctcagcctcccaaagtgctgggattacaggtgtgagctacccctgccggctgacagctaaatttttaaatgctgtttatacttgtgattacttatgtgtttaacttttttttctttttttgtcttaactttctactttaccatcaccatcgttattacttaacattcttttccttcactttcctgcctgctctgagactgggtgaagtttgtttttatttcctgtttctcctactgcagaagtcacacatctgtccatcatttatattcttggagtgtcgtccttaaatgttaggatgcatgcttgatgtcacaaaagttta

SEQ ID NO: 3584 - DNA, 1308 bp, Homo sapiens
tggggctggccctctttcctcctgctttggtggcgatgcccagggccatggggaagcagggccaatgtgtgcaggacggctgcagggctctcctgtccccagggctggcccctgggccgagggccttcaagtggcttgagtcagctccaggaggcagatgctcagggtgacaccctggggtgcagaaaaaaaatagaatttttatttatatttactttttatcttatttttaattcttatgtttatatgtttcataatgtatgtaacagacatacgataaaacctgtatgtggggcatgtgtgggtgtgtgtgtgttcatgtgggatgtgtatgtgtggtgtgtattatgtatgtagtatatgtgatgtgtgcatgtgtggtgtacgtatgtgcattgt[450 bp omitted]gtgtgtataaattatgtgtttgatatgtgtggtgtggtgtgtataaattataaatgtgtgtgtggtgtgtgtatatgaatcagggttggtgtgtgtggtgtgtataaattgtatgtgtttgatgtgtgtggtgtgtacgacatggggctgtgtgtgtcagggaccacagccagccagtgtgggcctctgggcaggcccctcccctcactgtagacaaagaagcctctgcgcctcggttgttcctcacatggcgtctgtggcaaatcctccccatgccagttgaacctggggccaatgtgaagctgcttttatttactgggacgtgatgttgtcttcatagccatctgctcaccagcatgcggcagaggcttgtgaacactgcatgtgtgctggtgtgtgctgtgtgctgttgtgtactggcgtttgctgatgtgtgtgttgtgcactcgcatgtgatgt

SEQ ID NO: 3585 - DNA, 1220 bp, Homo sapiens
tctggaactgaccaattggcttcaagttggggttcccacaaccccgtttgctggcgtggctcacagtgctcagggaaacatgacgtcagcattctcccccggggagtgggggaccctctcaggagagggtcctgagacccacagtcagaaaggcggggaacattagagtcctgctttggggcaggtaaagggcaggcgggaaggtcagaggctgcccgaggcccgacacagccaacgtcgtaacagaaagctaacaagcagcacgggagttaggagccggaaaccagcgtctgagtctcagcaccgcagcccgggttctgccagctgctccggaaggttccagggcgtgggccctctcgccctggtggcctcctgctgcaccacttcctgatcctcctgcttcctatgcttatttctgtttaaaaaacaggaaaatatgttcacatcaaacgcgcatatgtgcagccatgcccatgtcccttgctgcagctgactgagggtctggagctgtgcctaggaagccccccaggaatagaccctggttgtgaggctgtctgaggaggccttttgtctcccggtaggagcacgtttgccgtggacgggaaagattgcaaggtgaataaagaagtggagcgtgtcctgaaggagttccaccaggccgggaagcccatcgggtgtgtacagccgtgcaggcctcggggagggagggaggagggtgcgtgggcccgcggcctctgttctcagccaggagctgccgctgatcctgaaaactcacagctgcttttcttgttttaactgaggggatttcacacgatgtcactggtgacttaacaggaaggagaggcacagtgcacttccctagaggaggcctggaattctcttggctcccagaggtgtccctaggcagtccctcaggacccctatcctttaccagaccccttctcccaagccccttagccacagtacccccaaccccgctgacttctggccagtcactgcagcacgtgctccatccctgacgccatccactcccagcggcctccctcctggggagccacagccaaccacgcccctttgtccctgctcagacaaagcctgggtcctgaggttggcggcacgagtagggcgcccactccttcatccacgtaagcgccttggcttacgtggcgggtcgcagccccgcagggagtgtgtgctcttcagcgtctgctgccgggaag

SEQ ID NO: 3586 - DNA, 1144 bp, Homo sapiens
taagcaataacagatctgccacatgcagaagcaaatatcaggcctgtcgcacacgggcggcatttaaataggaatttctatttttgaaataagggatggtctatgaggcatacagtagatttgatgtgatccttttctccctcccttccataatggatcgtggtctgtgtgactgaacccacacagagtgtcatgggtgacagtttctggttgaagtagctccacgcctggcttctgtggacagcagattcttttccttctcacaaggggctcatttaaaatttggaggctgggtgctgtggctcacgcctgcaatcccagcactttgggagactgaggcgggcggatcatgaggtcaggagatcgcgaccatcctggctaacagtgaaaccctgtctccactaaaaatacaaaaaattagccgggcgtggtggcgggcgcctgtagtcccagctactctgaagactgaggcaggagaatggcgtgaacccaggaggcggagcttgcagtgagctgagatcacgccactgcactccagcctgggcaacagagtgagactctgtctcaaaaaaaaaaaaaaaaaaaatggaacgcagggcaagaactcgtatttggaaggagatgggggaaaggagcggtattatacctatgttgtatttgcaggcaaatgagatggagccctctctgtaaagaagagtcatttgtgcaagtagacggggtctgtgggtgcaggccctggaggggcacacaattgcctggaggcttctgtgagatcgggagagggaggagaggcagtctcttgacaaaataaagtatttttattcatttgtatttattaaatgaaaaaacaatcccatggtgtccctgttgtgtggtggaacctaatgactgttgaaataaagttctgtgttttccctgccctgcagtgtgtgtccctttgtcgtattgtcagaggagcctgtggccactgcccccagggagcacaccagatcatcccagctgggattcctcacggtgggggcttttctgcagacttgggttagctctggcatgttttcttctgtttctgatctcccttctgtcattctgtggtcttcctctggaattctcaggttagttggggtctgtgagacggatgtgttca

SEQ ID NO: 3587 - DNA, 1123 bp, Homo sapiens
catcgacgtgttccagcagcagacgggaggtgtgccggagagcagcctggcagggcacagtttctagagggcccgtccccagcccgggccgtccatcctcgcattgctgttgaatggtgagcacgtgaccatgccgaccacaaaggtgtctgcggaaactcgaggacattcaccacgatgattttcctctctttgatgtacttcaagtgcaactcaaaactatatctgcagggatgaatctgtaacttaaattgggccaatcagaattgttatctttgttcaggtaaaatgagttgcaagatattgtgggtacttttgtgtgctcatttgtgttttccccccctcctacaacatttttttaaccccaaaattatagcctgaatgttcgcttttagtctggccagggatctgactcctgagttggttgcctctcccctgctcactccagtcacatagagaattggtgtttcccgcagtggggatgcagctgttggacaggtattgggggcaaggttggtagggaggacagactgtcacttgctgttacaggcacaggtgattaaaatgctaaatattgcaaatttaagctttgtcagtatatggaaaagttgaagggaaaatactggaatgcttcttcaaaggttaaaaaataaccgagtcttttggtaatttgaccccacgtgctctctggccctcaagcatgtaacctcggggtctgaggcccaggacccacccccctgccacccctcccaccccactccctgctcagtacctggcgttggtacacaggcaaggattggcacaaccaaaattggcctttttctccctcttaatattgaagaaattcccacatttctcatttggtaatggtgttgtggcctcagatttcttctagtatttgcttctgatgaatgattatggtctatacataaaaaagtaagactaagtattgctgaatttgcagttatgttgtcgtgtataagagctacttccaagtgtggttacaaatgaacccatggaatgatgacttcatgttcttctcgtgggtttgtgccgtgctgctttccaaataggtattgaatttatgcattagtctggtgatttcagttctgtgaaatatttt

SEQ ID NO: 3588 - DNA, 1208 bp, Homo sapiens
gagccgcgcatgagagcctgggtttctagtcggggggcgccgtcgagctccacacctgcggcctcctgggtgcccccaaccctggagccccggcgagggggcacccgggctgaggcctggccctccaaggagccctggagggactgtgctgctagggcgcggggctcgatggggtgatctggagacctggggggatccggggctgccgcccctgcgctgccaacctcccaccccgccccttctgcgaggcgttattaaaggtctggtttcgggagccaggtgcgtgcccgccgccgccgctccccgcagcctccaggcagctcccgctgttccccgagggcaccagcactggccgaccgacctggcttggggcgcggcgctggcaaacccggccttctgaggggacgccacgctgactctagtgcaggcagcccccaaaacggtataattggacgaatttcttgaaggatgccagttaccaaaaaagaaaatactaatgcttattatctgttaaatttgagatcaatttgttatcaaattttctcacacagaaaattccaggcccagagggccaagctggtgaatcctacttagagaagaaataataggaatccagccactcagacgatggacgaggaggggcacttccctgctcgatgtatgggccagcattgccttgatagcaaagtcagacatcaccagacagtagaaccacagaccaatgtctttcatgaaccaagacacagcatttaaaaaaattagcaaatggaatttatatctgcctattgtttacaaaaaaagccaaactttgtaaaatacttgaagagatttattctgagccaaatatgacccatgacacagcctcaggacgtcctgagaacttggcccaaggcggttgttttactgcttggttttattcatttcagggagacataagacatcagtcagtacatgtgaggtgtgcattggattgatccagaaagtcaggacgactccaagtggaaaggcctccaggtaataggtggattcaaagatgtttctgattggcagttggttgaaagaagttactatctgaaggcttggaatcaatagaaaggagtgtctgggttaagagaaggggctgtggagaccgaggtccttattatgtggatgaaatctcataggtgtccgccctcagaggcaatacatggcaaatgtttcctattcag

SEQ ID NO: 3589 - DNA, 1327 bp, Homo sapiens
catgaaagcgcccaggacgcccctgggtctcaccacttcttcctaccatgaggcataccgcacccccagggaggctgcccgagaccccttccctctccgagactctcctgccctttgtgggccccccgaaatctggagctcaagcagcaccggggttgccactgccacctcaggaccgctggtgacccctttctctgtctgcatttagggggtgatcgctgagctgaaggtgcgcagggacccccaggtgagccccatgcactgcctggacgaggaaggcgatgactcagatggggtgagtgacatctggggcacgggtggggtctcccctcaatccctggcacgcggagttcagggccaaggtctatgacaggaaaagtcccaaaatataccacttggggcactgggaagctgcgataccatttctgtgctctcctgtagcacctcagagcccttccttgccctgaactttcccataaaaacaaatacaaagcatgatataaacaccagaaaccaccctccatggcagctggtgagacagaggatgtgaggcagctcagcaaagtgtgtgtgtgtgtctgtgtctgtgtggtgtgtctctgtgtcttgtgtggtgtgtctctgtggtgtgtctgtcttgtgtgttgtgtgtggatgtgtgtgtgtctgtgtggtgtgtctgtcttgtgtgttgtgtgtgttgtatgtgtgtctctggtgtgtctgtcttgtgtgtcgtgtgtgtctgtggtgtgtctctgtgtgtagtgtgtctctgtgtgtggtgtgtctctgtgtgtgtggtgtgtctctgtggtgtgtctgtcttgtgtgttgtgtctgcatgtctgcatggtgcgtgtgtctctgtgtctgtgtctgtgtgttgtgtggcgtgtgtgttggtggggtgtgtggaatcacgtggtacccaaggggagaatcccccagccccaggtgtgaggaacagcagggaattctcactcaggggcccagatcacaacatgccccacgtgaacatggacccacagcctcgctcctgggggcgtgggcaggagacgccgtggacgtggacccacagcctcgctcctgggggcgtgggcaggagacaccgtggctggactgtgggcagtgtgtgaacatccatgttactttcatgctttttctttattttgcccaataagcccgttgtttttgcctggaacatgccagaagacgccagatcgttcacatggcggccatgacaaggctgcgccctgggacagcttgctgggtgcggggggtcgccgaggcgccgcacccctcccctggcctgtcttgccctcag

SEQ ID NO: 3590 - DNA, 1139 bp, Homo sapiens
cagccttgccctgctcccaaccccaccctctaggccccgggctgctgagaccccatccaggcaggagcgggagcttgcacctgtgtgagttcatcctcagcttacactcacaccaggcactcacaccacacacacaccacacgctcacacatggacacacacacactcatgaacacaccacatgcgcacagatggacactcaccacacactcatgaacacataccacacgtgcacacatggacaaacacaccacactcacacatggatatatcgcacatgaacacaccacacacacggacacacaccatgttcacacatggatatatcacacatggacacccactacacatggacgcaccacacacacacggacacacaatgcacactcacatgaacacaccacacgctcacagatggatacaccacacagacacaccacacacgaacacacaccacatgctcacagatggacacccactacactcacatgaatgcatcacatacttacacatggacacacaccacacacacggacacccaccacactcacatgaacacactacatgcttacccatggacacacactacacacggacacacacacactcacagggacacaccacatgttcacagacacccaccacactcacatgaatgcaccatatgcttacacatggacacacaccacacagacacaccacacactcacatggacacaccacacactcacagatggatacaccacactcacatgaacacaccacatgcttacacatggacacagcacacatggacatgctacacgctcagatggacacacaccacacggacacacaacacatgctcacacatggacacacaccacacgttcacacatggacacaccacacgtttacacatggacacgttcacacatggacacacgctcacacatggagacacccacacattgacacactcccaccacatactcagaccacacacactgacacactcagacactgaccctgtgtgctcacagggtcctgctccctggacctgccccctctttcctgcccgctgggaggactttggccccagctcagtaccccttcctgggcttcccctccagggtggcctccgagccctatctccctcc

SEQ ID NO: 3591 - DNA, 1088 bp, Homo sapiens
gggtggggcctcttcctctggactgtgcccaggtgtgcccaggtgtgcccacagcagccctggcccctgccaagacagctgaggacgtttggtgcctgcctgtagtagtctggggcagtgtcctctgaccttgtcctgtaggaggtagcacccccagccccgtgcccagctccacgttcccatggaaggtggatgtgtgttgaggccacaggcatggaagccaggcctggagtgtccaccagcagctcagtggccaaggctgtggagctgggttcccacataacatgtgatggaggaggtgggggtgggcaggctgacagcctgtgctccccctcctgggagggtgcagggcggctacaggggcgtttgcccccctccctgctcctgggttggagtctggccttaaagaccttgctctggggacaagtgtgagatgggagtgcacagcccagggccctctgccctaccccacttcctctctttccccttcttccccttcctgtctttcttcccctgccgggttcccccacgaacagtccctcccacgaacctgctgtccctgatcctgcccttcctttctgtgtcttctgtttttgtctctctccaggaaggatggaagaagcttgtgctggtgtgaatgtgtatgggttacagctgtgttttccatattgtttaaaatgaaataaaaccatgttttgattctattaaaaatagagaagctggctgggtgtggtggctggtgcctgtaatcctagcactttgggaggctaaggtgggcagatcacctgaggtcaggagttcgagaccagcctgcccaacatggtgaaacccccatctctactaaaaatacaaaaattagccagacatggtggtacgcacctgtaatctcagctactcgggaggctgaggcaggagaactgcttgaacctgggaggtggaggttgcaatgagctaagatcgtgccactgcactccagcctgggcgacagagcaagactctgtcccaagaaagagataaaaatagagaagcttagatgaacaggcttgttaataacgattccttctgtggccactgccagctttccgcag

SEQ ID NO: 3592 - DNA, 1087 bp, Homo sapiens
attgtgaaactgatgtgcagctgaggagtgtgctattgggacagtggaggtgctgcccttcccgcgtgcccagctcagagcaccgtgcggtgtgattgtgtctcgtcccacggccagcactgctaaccgccaggctgggtcactttctaggcgaggacagggtcttgccctggctccggctgtcggtggcggggctggggctggagcggcggagccatctccttgacccctcatgaaatgccttctgctcctggccagtccgtccctctccctgccacccactgaccagatggcatctctgctcttagtggagggccactgtccaccgccaaggttatttataggggtgagcattatgtgtggcgtttcccttaaaataacaaaataagaaaagtctctagagcaaaaatgtttaaatcccatctgcctgccctctcatgttgtacattaacggattaaaaagtagattccagaaattaagccattccaccaggccttggatatcatcagagggacgatgggtgcaggtgctctgcgcacctgccacttggtggggcccccgatctcagcccctctggctgcaggagaggcccggggagagcttcatcacgccctccctcctggggcccgacaagaacttcacgcgggagcaggcacgtgggcgccggggtgcaggggcagccaccagtaggtgggcggggagcagcttcgggggcaagggaggcccagcctgccaggactcgccagcccctgttgttgccaggcttgtgtctaggaagttcacgtaagtggtgtcttgtgacccagctttcgcaagttgctctcctgcccaatctgacttgagagacgttccacgtgggttcgaggctgttcttaagctgcgcctcctgggttgaactacaaggtgcttatctgctgctttgctggaggtgattaggggattccggcttctcccactgcaggtgatggctgcaggtagagcacgagctggcagcctcaggcagtgggccttgacccagctggcccgggctggcacttccagttcactcctggggcgaatgctgcttcctctgcagcctgccacggg

SEQ ID NO: 3593 - DNA, 1185 bp, Homo sapiens
tccttccctaggcacctctgtgctgcatcccaccagcctgagcaagacgccctctcggggcctgtgccgcactagcctccctctcctctgtccccatagctggtttttcccaccaatcctcacctaacagttactttacaattaaactcaaagcaagctcttctcctcagcttggggcagccattggcctctgtctcgttttgggaaaccaaggtcaggaggccgttgcagacataaatctcggcgactcggccccgtctcctgagggtcctgctggtgaccggcctggaccttggccctacagccctggaggccgctgctgaccagcactgaccccgacctcagagagtactcgcaggggcgctggctgcactcaagaccctcgagattaacggtgctaaccccgtctgctcctccctcccgcagagactggggcctggactggacatgagagccccttggtgccacagagggctgtgtcttactagaaacaacgcaaacctctccttcctcagaatagtgatgtgttcgacgttttatcaaaggccccctttctatgttcatgttagttttgctccttctgtgtttttttctgaaccatatccatgttgctgacttttccaaataaaggttttcactcctctccctgtggttatcttccccacaaagtaaaatcctgccgtgtgccccaaaggagcagtcacaggaggttggggggcgtgtgcgtgcgtgctcactcccaacccccatcaccaccagtcccaggccagaaccagggctgcccttggctacagctgtccatccatgccccttatctgcgtctgcgtcggtgacatggagaccatgctgcacctgtggacagagaggagctgagaaggcaacaccctgggctttggggtcgggagcagatcaggcctcagtgggctggggccggccacatccaccgaggtcaaccacagaggccggccacaggttctaggcttggtactgaaatacccctgggagctcggaaggggagttgagatactgcagggcccataggaagaagtcttgggaggctccacctttggggcagaggaagaagtcttgggaggctccacctttggggcagagcaagaagagggcggagggcagaggcagcgagggctcatcctcaaaagaaagaagttagtggcccctgaatcc

SEQ ID NO: 3594 - DNA, 1198 bp, Homo sapiens
cgatggtcactgtgggtgctttgctatcaggtggggggccttcctctccactctgggtccagtgtgagtggccgctatggcttcccctccactccaggttctatcgtgagtgggtgggtgctgcgtctgtggatgtcacgtgacctttcctctttagcctatcattgtagttgggagttagttagcccgttgagcgtcattgaatttccagtgttgagccagccctgcgtgcccgggataaacccacctggccgtggtgtgtggccctgtttatgcacgtgggccctgattcgctgatgcctgcctgagggtttgcgcttatcggcgacatcagcctgcacttttcttttctcgtgatctctctggttctggcctcagggtgacgtgggcctcgtagggtcctgtggtggctcctccccagacggtgacatggagtgagcccattctccctcctgggagtgggtcactcaggccaccagagcaccacagggaaagcagccagggaggacacggaggcccttgaagctctggcctcttctgaggcctccaggacctgacagtgagtgggagcagccctggcagaacccctcccctcctctcggccgccctgacacctcatccccgacactcagagctcatcctccttcccagctgtttccaatttcaaagtgaactcgaccttgtggctccaggagatgcagcagggacagtgttaaatcggctttcaccagcccacacggccaggcatcctcctcggccctcctgggcactgggtggacaccactggctgtggcctggccctggccttctccagacagccctgtccaccccaaagcccagccaccctgggcctgcagcaggcctgtggagttctcagttgcgtggggaccagagggtgctggagaaacaaaccagacgcagctgaaggcagtcagggcagggcgcaatcagcgataagagctgcataggggccacagcgtaacctgagctccagtcggtggaaagaaaaggcagagacgttgcagaggccaggtctgctcaggggaagacagttctgggtgtagaggactcacatcccagagaggctgaggaagggtttaccaccgcaagctttctcaggcgggctcttgaggggtggctggggtcttcctggcgacgggcctgcggcactggaagccctactggagtttggcctgtc

SEQ ID NO: 3595 - DNA, 1264 bp, Homo sapiens
aaatgcacaggggaggccgagcataaccaggggtgaggggcaggcagcagttgtagttactgccgcggggcactgctatgtgcagggacagccagcacccagcccatcaccactccctgggctggctggcaggtatggcaccctgggagcccggcatatacccagggcacccctacggctgccgccagtctcatgcccaggtgggtgctctgggctggagcgagggccaggttttgggccgaggcttccccaggcaatcctgtgagctcccttctagcctctgacccagtctggtctggcttgcatggatgtagggcttggggtgggaagttcaggtcctggctttgcctttgcctgatgtggatgagcagctcacatgctcagggccacctgagactgtcactgctctcccctggctactgggaggagtcactgagagcttcgttacccctgctgccttgcccagggcacaccctatacctccttatctgctcttcccctccctgccgccttctgggcaggtagcagtccctggcctctccccctggctgatcactctccctcaggcagtggagatctgcgtctggacaccctcagatcctgtcattgcctgcccagagtccttcaggggcacccctctgccttggtgtgcagtccagggctctcacccaggtgccgcaccctctggggtcttctgtccagctcccttgccccatgtgctgtcactgactctccttgggactcgcctgcctgctcagagccctgcagggcttggtcagctgcctgttcagtgtcaacacttccctgcacatcttaaaactgggctttattttcgctgaaggaactgtgttgggacccttgacatctgtcaggtttgcacatgctgtttttttttctcagcccacgtgttctcccccacgtggggtagcagcaggacagacagtgaatcacagagtctgccctgagcagaggctgctgtccctgggactcctagccatggtcagactgtacaaaacggttttccagaaatgaaatgtaaatccatttttatactgaaaatgttactgaaagtcacttttatgagcatctgccttaataaacagacattgattcccttatcagaagcctgtcacactgtgtttcgtttcatcctggggagaactgcagatttggggtttctggctgtcatacgtcacctgcctgtggggcgagtgggaggcccagcctggtttagggaacaagagtgacgtgaggagtagcaggg

SEQ ID NO: 3596 - DNA, 1151 bp, Homo sapiens
gagttgaactctacgtcaggagtaatccagcccctccagggccagcaggagtaaggtgcgcccctccaaggatctccatgagctgcctctgtgagcctgacctcctacgggctagccagccttcacccaatcactcactggtccagcttcagggtccctacatggatgtgggttggaagacaggacaggcacacaaccatagatactgatggacatgggccatttacagaactgagggcaagagagcaattttggccactgaggcaagttcctgggttagctgcaccgaggagggtgctgacctctgcccctcgggtccacaggtctgggcccctgctgctgacatcccccacatgtcagtctgcctgctagtgggattgactaactcatcaacgtggagtttaatgcccaaccaagtgcagaccacgctcctgttttgcgtcaccctctgcgaagcttcctgcaaacttgactccctgcccagtgcccccagccccaaggtgggacatatcccctgggcaccccctctggtcctgctaaagcccagcccctctgcaggtcacaacccctcctctgtcctaccccttctgctgcctgcaatttcctgaactccttggtaggcagtctcctcaccctgtcctcccagtgtctccccaccctgtcttccctgcttgctctgagggtccctaggagggaggtattaacaccctggaggcagtacacaggtggggcgccctcccctgacacacaggttcttctggactgggtcctgaggctggtggtgcatagggggtcacgactgcccttcccccaggtctgagggttctgcccctctgcctcagctgctgcccacttttttgccttcccatgaagcccagctggccacacctggggatgagtgtttaccggtagcctgaggacgcacagtggaaacctggcaacctggggcctccctgtgtctggcagcctggcaactgtcacgcggcgcccagcgctggcttctggggcactgcagtccagggagggtgtggctatcttcccacagggctcttctcttccctcaggctggtctccaggaggtaaggcccgccctgcaggcaacaccggtgcttgggctcctgctgagcagttctttcctgcgagtaacagaa

SEQ ID NO: 3597 - DNA, 1130 bp, Homo sapiens
tggggctgtggcttgagtttgagcggctgcagtcaggaacttccatgggctccgtgaggagctgctctcccagttctgcacactcccctccacaggcagaggctgggccagacccacaggcagccttcggtggtcccctccctaccccatccacctgaggagaagtgcgtgaggtctgtgagcaggaggcattcttccctttgtccccttagtcgggcttgggtaggtggcttctcatgcccaggtaccctgtcctgctgatgccgctctctcctccctcctgtctctctccgcctgctcagcagctgctttgcctgacatgcattgtttctgatggtggcccttccccttccccttctcagtttttcttcattccctcactctggctatgtggttatttcctcacagtagttccgagtctgagatggaggaggagggagaggaggaggaggaggagcctcgcctgcccccatctgacctgggtggtgttccgtggaaggaggccgtgcggatccatgcccttctgaaagggaaaagtgaagaggagctagaggcctcaaagagctttgggcctgggaatgaagaggaggaggaggaggaggaagaatatgaagaggaggaggaggaggactatgacgaggaggaggaagagtccagtgaaggtcagaacaaaatctctgctccgaactctgccctgccccccaaagtgatctgtttcatgcgtgagtgtaagaggtttctggggctgacgtcacacggacgtgcctcctgcacagcccagggaccacccctcctgacataagacatggggggcagaggggaggacaccgtagcgttgagcaggcggttggcagtggaagtaatgtcccttgtgcacattggtttagaaactggaagtggaaggcagagagccagtccaagtactcatccaagttaggccactcctacttgtctccacctcgttttctctttttgccctgtagtttcagttgaaaaaattaataaggaaagggaatttagctttctagaggattccctgatcctagtctagggtttcggaggtggctatgagcttagtgcccactggatggggctcagttgatggcacgcagggcagcgttttggggaca

SEQ ID NO: 3598 - DNA, 1092 bp, Homo sapiens
tgtccatgaaacattccatcttcttggtgaaggcaaggggttggttcttcaggtcaggatgttaatggagctggaagttcagaaaaagcctggtgaagtgacccttggcctttcacttcttgagaaacatacttctttgctgggcatggtgactcacgcctgtaatcccagcactttggaagggtgaggtgggtggatcacttgtggccaggagttcaaaacctgcctggccaacatggtgaaaccccatctctactaaaaatacaaaaattagctagatgtggtgcacgcctatagtcctagctacttgggaggctgaggcaggagaatcacttgagccagggaggcaaaagttgcagtgagctgagattgtgctaccgcactctctcaaaacaaacaaaaaaacatgccccacaggacagtaccttaattagctagagtagatctgagagggcctcttcttgcctgcactgtgctccccagagctgatctaattctgtatcaataggctgttcccatggtcttgccatgcgcttgaagctgcaggagccttctcactgttcaggctggggtgtggttttcagaaccaccgggttgactactgaaaaccaagtgagccttacagctcttatcgctgggtaaagtgatcttgcctggtgcctcttggtcttcagctcaattttccaggttgtcctggccaagtcttgctctgttacgctcagtgcctctgcccactctttccccgccagcccttccctcccgccctgcaaacttgtcccttggctgtttcaccaggttctgcctgtatccttgcctccttggtacacaccatttcaggttcttccctttctgtgtcccattgtcctagttatgttctgttgtttgtgtaatgcccaaatttttctgctcgtgtggccttgaaaagtaggccagcctcagaggctgctgagctgaaaatggaactgagtaatcaggtgagctggaagggatgtggggggcggggcagacgggagacatgggttttgaaggcagtgaacaataaaaccttagggaggtggcaccgaggccttagcatttgaggagctgaaatgt

SEQ ID NO: 3599 - DNA, 1195 bp, Homo sapiens
aggctgtgggcaaagagagggctgagagaggctgccaagacgtgggtccacctaagctccccagacctccttctctggtctggaaaatgggtggtggtagtagtgtctacactgcaggactgaatgggatgactcactcagcaggcctggcacagagtcctctcgggccttgggcatgcagccaccctctgtggtgagagcagatggcaggctgacgccccccagctccctggcaccgggaccacatccctagccgcccactcagagtgcagggaagggttggtcacattgacacgcttgggcagcaggcatgtgcttgccgcatgaccttctagcttccttcctggtctctccttgcattggcctggagtggcccagaatgtgtggagcaaagacccaatttccttgctgcccatccctccccaggagacaccgagggcctggatgtccgtgagaaccgcacaggcatgccaaggaaagccatggcacgcctatctctccaggcgggagatgagcctcccgaagccctgggaagaagggaccttccaaggaggctgaaccgtgtccctgtcagcccaagacgggccactgcgaaaggtcccctcatctcaagctggcttctatgggcaggcatggagttttgagtgaaaaccctgcatgatcctctcaggggacaggaggggtgaacaaaggagggacagtgaccagctgaccaggccctgaggcattagcgtctgcctcgtccacatgctgtgcaagctcagcgaggccaaggggctgggccgaggtcacacagctgggcagggccctcatgaccggcatgctggtcgtggaggccgagccccaggttgggggtgggggtgggaggtgaggcagcccctggcctcactggaggggggtggtgggctggggaagctggcaaaggatgtgccctacatggtgggtgtgaggtggggaacgattcgggcagatgcccgtgtggccctgctgacccagtccaggcagggtgtgacaggtctgcccagccctgaggtcacagctgtctgcagtctccagctcactcctgatccccagggccacgtgtccagaaagcctgggagcttgcatcagctgggcacagatggcctgtcctcccagcacccctgctggggcttcctaggaactgactggtgtagactccgggcagcagacggcc

SEQ ID NO: 3600 - DNA, 1171 bp, Homo sapiens
ctgaagaaggaggggctcaaggcgtgagtgggggaggggcagggctattgtccccacctcaaacctttcccggcctacctggcctgcccactctgtccccttcaggcctctgtgcctctcacttcagtatctggggattgccctgtgcagggacactgtgctgacctgccttcctctccccgcccctcctcccacccagattctacaagggcactgtcccccgcctgggccgggtctgcctggatgtggccatagtgtttgtcatctatgatgaagtggtgaagctgctcaacaaagtgtggaagacggactaagcctagagaggccgcaaggggaccgccccaggcaccgccagagtgtcctgctacctttgtctcacgattccagtgcagtagtgccaaaaggccccttcccacgtccctcgagctctgtagcctggtctgtgcattgtggctgtcaaatccatgtgtcccccctgtggtctgtgtgtgacaccaccactgtgtcccagtgtctggcccagccatggctggatgtgcatctggcctatgaccctgtgcctgtgtttcatgttctgtgtcacgtgaccctgtgccccgcctcccggggtgcccgtgtggcctgggtcctcggccctgtagccctggcccggtcccagtccggtgccttccaccctgccctggcctaccacagctgcctccgggcctcggcctggcttcaccgcattccaggggctgcagccccctgcttctcccgccattggccttaactggccctcgggccctctctccgccccggacagggtggcacccaccactctcaggaccaccctgccaaggcagaataaaccggatcctgttgcagcctcctgtcctgtgttcgtccctgtatggacccatctatgcatgggcattggtggctgtgcctctgcaggggaccaggccacccccatctgaggacactgcagtagggggacagggaaagcctagtgtccacccagggcagagcagctgtggccacagtgttggctccctgagaagcccagcgccaggccaagaaggatctgggtgcaccctggccttccctgtggcctctgggcaagatcccgtggcatgggtaaaagggtgtgttgacaaggcctaggggtggcctggcagagtgttcagagcag

SEQ ID NO: 3601 - DNA, 1227 bp, Homo sapiens
agaggtctaacatacaggtaactgaagtcctagaagtatagagaaagagacagaagcaatatctaaagagataatggcttagggtttgaaaattaatgaaggatatcaatcttcagtttccagaaacattacagattttaattggaatgtgtaaattaaggcaaaatacacttaggcatatcataatgaaatagctcaaaactagggaaaaaaaacttaaaagaagccagagggaaaacaatggattactttctagggagagataattaagcttaactactgacttctcaaacaatgaagcagaataatcgtatcttcaaagtggtcaaataaaataatgaggttgaaactggaaaagttcccttgtcccccttgcagggcatgcgatgggggtgtagcgcgcttcttcagtgccccactgctcaaacctcgaggggagcgtatggacggacaggctgtagggctccaaccccacaacagtgtctaggagtgaatatttacagctcctgaagccccagtgggcgtgtgttacagggtgatcttttagttttgccgtctataggcgacttgtgttaaccagctcaattagtgcctctacttgtcgcatggacagagggctttctgtatcccgggttctcgccttggtgtaccagaagaatcagatcacatctgagcttggagaatgggtgcaaggttttattgagtggaagtagctcttagcagaagctgaaagggaagtcagaaggggatggagtgggaaggattttccctggaattgcactgctcaccagccctgggctctcctccaactgccccagccaaactccacgttgttcagcttcaccagcatgctggttcctgtcagtgccttcctctggatgtccagctacctgtgtgtcgctcccctcccctcaacgtccagccacctgtgtgtctgccagctagggtctctggggtttttataggcacaggatgggggcacggcaggccagggtggtcttgagaaatacaacatttgggcagaaaatgcctgtcctcacctaggtccgtggggggtggagccctagccaggggccacgccctcctctacccagcgcttcccttccccttttccatagcatttaaagggaccacatccttctctacccagcacttccatgtcaacattaggctgggcgtggtgactaacgcctataatcccagcactctgggaggccaaggtgggca

SEQ ID NO: 3602 - DNA, 1136 bp, Homo sapiens
tgccttttttagtaggctccaaataatgcaaatactagacctccagatcctttcaggattgcgcttgacatgcctcccctcttcttcaccccagtatgaatgctacctctactcctgctgcattgtcaccttctgtgttaacgaccccgtccaagatcgaacccatgaaagcgtttgactcccggttcacagagcggtccaaagccacaccaggtgctcctgccctgaccagcatgactccgacagctgtggaaaggtaggtggtagctgcaggaccctgaaggaccaggcagggtgcaggcatgggtcaacagcacagtggcagtgttcccaccaagcaacctgccttcctgttggggaaaagactctagccactcaatacatgggagcaagactgcagagcccttagtgagccaccaggagaaagaggtggttccttgaagtgggaaggtggctggaaggagtcatgggggaggacgcggcaaaagaaccacaaggtcaaaggcacaaggattggtcagtgcagaggctgaactgagaataatggtgtttggatggagcccagagtttgcacggaagagagcatgagattagttggagaggtggaagactctgatattgatacatcatggaagtgacggccttccactcagaaactgaccagaggtagagagctgcaataaaaatgatgtaagtgaggtctttgtcaagtcagattggcttctgagctcttgtggacactatgctgcttatccattctctgggtctcccctcaaacacagctgtgacatcacgcaggttgtagttctttatttcttggagttttgcagtagtgcatcctcctgaggtggccagagcgaatgtctgcagcctctgccattggcactgaagttctctgcctcctgagagggcccctccctccaagcctagcttgacaaggagctaagttcacatcccagtgagtcagagcctaggagaggagaggcagatgtgggctggactttgggggcttaagagctgtcccttaagagttgcaccccactgcgaggtttatagggctcagcagccctgggcagacacaccctagcctgtgccaccatcagccaagtacaaggacactggtcagaaacttgcag

SEQ ID NO: 3603 - DNA, 1206 bp, Homo sapiens
gatattattttgtttgaggatttgtatgtctatattcatgaaatatgtttgtttgtggttttcttctctttctactaactttgtctggttttggtattgggttagtgctagcctcatcaaattagttgggaaatgttctctctttttctgttttctgggaaaataatttgtagaatagtgttatttcttctttaaatgtttggtagaatttgccagtaaagtcatgtgggctggaattttgatttttttttttccccaaggatttaaactaaaaatgtgattcctttaattgatacaggactattcaggtcttctctttcttcacatagtctgtgtcttccaactttcatttcagctaggtttatttagcttgaatttatttgagttgttcatagtatctccttatccttttaatgtttctggtgtctgtagtgataacccttctttaattattataatttgtctcttctctttttattgttgtcagttcagctagagatttatcagttttattgatctttttaaagaaccgacctcttgctttattttctcatttgttttactattctttaaaaatatttatttctgctctaatcttatttccttccttgtgcttgttttgggcttactttgtcctctttttctgttatcttaaggcataaaccaggtcattgatttggagacctttcttcttgtcgatgtaagtatttaatgctgtaaatttccctctaagcactgttttagctgcatcctacacgttttgatatgtggtgttttcatttgtatttagtttagatattttctaatttcccttgggacttcctcttgaacccattgattatataaaacagtgttgtttaatttccaaatagttggagattttcattatcttgctgttattgatttccagtttaattccatatgatcagagagcatactttgtatactttgtttttttacatttttttttttatcgagacagagtctcgctctgtcgcccaggctggagtgcagtggcgcgatcttgactcactgcaacctccgccagctgggttcaagcaattcttctgcctcagcctcctggatagctgggactacaggcgtgcgctactatgcctggctaattttttgtatttttaggtggggtttcaccatgctggccaggctggtcttgaacccctgacctcgtgatctgcctgcctcgac

SEQ ID NO: 3604 - DNA, 1225 bp, Homo sapiens
accaaactgttttccacggcattcacaccagcaatgcaagagggttcccatttcatcacatccttgctaacacttgttattttccttaaaaaaaaaaaaaaaaaaaagccagctgggcacggtggctcatgcatgtaatcccagcactttggaaggccaagggggtggagcacttgagctcaggagactagcctgggcaaaatatcgagaccccacctccactccatctctaccaaaaaaaaaaaaaaaaaaaagctgggtgtgcggtggtgcacatctgtcgtcccagctacttgggggggctgaggcaggaggatcccttgagcccaggaggtcgagactgcagtgagctgcgaccgcgccactgcactccaggctgagcgacagagtgagaccctgtttcaaaaaaacaaaaaaaaagcacatttcaaacatacacaaaagcagagagaattcccctcggtcctccggcctgcaccccaccgccccccaccacaggggcattcaaaactgtctttttgcctctctgtaaggtaaggggggactcttgacgctccccagaccacacagccaaagtagggcgatcggatcatagggggtcccgagtcggacactgagctggcgtgcccactctcgagtcctgggaccccaaactaaaggagctgttccttttccccatggagggctgacggggcaaaatcccagggctgggaacatccgagcagctttgagtagcacaggtgggtttctacgtggctttctttaaagggaggcctgattctcggcttttcaggacccgccctccattttctcacttgcctgctctttcgtcctgcgaaactgggcagtggccggtgacagcgcagggtcagccctcggatggccaggtgggcgtgatcccaccctcctccgtggctgggtgggcgtggtcccaaagtcaattggatgtggtcccgcgtccctcccggcccagtgggcggggcctccccttctggggcctcccatcccacaccagcgagcagagaggagggtgggcggggaggccctacggggctggggcggggcggagcggaggtggttagctgtcgggaggtggggtgggcaggggccagggctctgttggtggcccggggcagccagtccctctgctcagggcttcagttcacactcacaagggaatcccagcgctcttctcctctggcggttgctggagggccttgtgagg

SEQ ID NO: 3605 - DNA, 1199 bp, Homo sapiens
tgaaaaggccacatgaatccctggggcgtccagagcatgggtgaccagcacgggctcaccacatgaggccaaggggctgcaccatacagcctctcctttggccacccgtgactacccccaactccgggccatggggcttccctacccctgggtgtcctctaagccagctgggagacaacagcctgagtccgtgtctgcttctgtattttgtgtggttttagaggatccctgggctgcctggggaagcacccagggccagggagtgtgaccctgcaggctccacacaggactgccagaggcacacacctgctctgtctacccgagggcaccagagggcacgagaaggctggctccctggcgctgacacgtcaggcaactgaggcacaaggctggcatttctgaaccttgcccctctgcaaacacaagggggcgatggtggcactccaagcaaaggggcgtgtgggtgctgcaggaggagcacagagcactggcgcccctcccctcccgccctgcagatgccggaggccccgcctctgctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcagcatgcggagcccgggaacgcacagagcgtgctggaggccattgacacctactgcgagcagaaggagtgggccatgaacgtgggcgacaagaaaggtggggtccgggccagcaggtgctcagctctgggacagggacccaggaccaggcatcaaagcccttacaggagaagctgttatcaccccatttccagggggctgggaaccctgggatatgcccagatagggctggggggctcctctggagtcccagggtgccagggtccctgatgacccctgcaggccctgctgcctgctgccccaggacaacaggcccccacactcacagggtctgacggtggtgcagttccccttgaactctgttctggccaccatgggacctgcctggggaccagtcagacaggttctcctgggcccgcctcccgcttgaacttcagcctggggcacaggatgtgttaccgggctcacggagtgactcagggaactagtgcc

SEQ ID NO: 3606 - DNA, 1318 bp, Homo sapiens
aggcccagggcccaggaaagctgggaagagtgccggccactggccttgctccagccacactctgggtaaccagaacccagagccctggcccttgtcacagcccctggttctgtccccattgccctcagtttctgcatctctggagtggggatgtgaccacagcccgggtcaggattttgttgtgtgaccctggccaagtcacctgaccgtcactcctagcctcagggcaggcggtttgatgacagcaacccacagggctactgagagctaaggagatcttgtgccccaaggggctggtggcctgaatactcctcaggtggtcctactgggatggcttcatgcggagagggccatttactccccctacatcctggcacagccagagatgggcctcatggaagatggggtggttttgtggaagggaggtgagacggtctctccagcagccatagcagatgtctcacagaaacttgttttgctcgggattgggaaactgcccggtgacagcagtgagtgagtttgctgtcctgggagggttgcctgggtcctggtagccgctggctggggtttggcatttggctctgaattggttctcactgggctggtgcatgactctctgtgtccccaccatgctccgggccaagatacaggtgctctcagcccagcgctgctgggtgagtttgcagtcctgaagaaggtgtgatggggcagctcagaggcagggctggcggctgctgtgacgatgtccacgcgccccacttgcctgtgcagggcctacgaggacacagcagatgatggcggcgagctggcggacgagcggcctgcgttcccaatggtgacggcgcccctggcccagcctgaacggggcagcatgggcagcctggaccggctggtgcggcgctcgccctcagtggatagcgcccgcaaggagccgcgctggcgggaccctgagctgcctgaggtgctggccatgctgcggcaccccgtggaccccgtgaaggccaatgcggccgcctacctgcagcatctgtgctttgagaacgagggtgtcaagcggcgtgtacggcagttgcgggggctgccgctgcttgtggcactgctggaccacccgcgggctgaggtgcggcgccgggcctgtggggcactgcgcaacctctcctatggccgcgacactgacaacaaggccgccatccgggactgcggtggtgtgcctgccctggtgcgcctgctgagggctgcccgggacaacgaggtccgtgagcttgtcactggtgagtgggacctggccatgctcacatcccctgggaagagaagagtg

SEQ ID NO: 3607 - DNA, 1139 bp, Homo sapiens
gtaagggatcttgtggctgtcaggatggcagaggagcaggagttcacccagctctgcaagttgcctgcacagccctcacacccacactgcgtgaacaacacctaccgcagcgcacagcactcccaggctctgctccgagggctgctggctctccgggacagcggaatcctcttcgatgttgtgctggtggtggagggcagacacatcgaggcccatcgcatcctgctggctgcgtcctgcgattacttcaggtgagttcactagagctgtttgtaagaagaataacaaaggtaatcctggctctgctagtaaaggtactggcggtgacagtggctggtctcctgctcacctcagagcctcccctactccttgtggctatgacttagtcaacaagtgtgagagacagaagggggtcttagagttcatttttcattcagtgatcctgtttcttgggctttgcctcctcttctcttccctctcttctcttccttttcttttccttttctctctcttttcttttctcttttctttcctcctttctctcctcccctcccttaccattcctcccctccgtcagtaattattgctgtgtatgcatcaccttctggctcacacctctcatccctcaggtgttagcctctggccctcccagtgagctctgtggcccctctggggtttcttatggcctccttcgtgaccccatcccagcacttggcacagtgtgaggaaccactggcttatctgtcttttccactgggttggaatctgtctcttatccctagcacctgacatggttttcacatattcaaacaatacccatggcttaaatgaataaatttatgtacacagatagcagatcaatacaccatttgccctgttgtctgcactgctctgcactcaaggaggtgggtgtcaccacccttatttcacataggtggcatgagcctgagaaggactgagggccactcgtggtccccagcaaggttgtcatgggactccaagcctgaggtgttccattctagctctgattctgttcaatcattttgtcttcaaggcttagttgtagttctctctctctctctttctctttatctctctctatttttttaattaggaactatcaagcaaaatatgtatgg

SEQ ID NO: 3608 - DNA, 1503 bp, Homo sapiens
gctgaggcaggagaattgcttgaacttgggatgcagaggttgcagtgagctgagatcctgccactgcactccagcctgggcaacagaacaagactccatctccaaaaaaaatgtagaggccgggcatggtggctcatgcttgtaatcccagcacgttgggaggccgaggtgcgtggatcgcccgaggtcaggagttcaagaccagcctggccaacatggtgaaaccccttctctactaaaaataaaaaaagttacctgggcgtggtagtgggcgcctgtaatcccagctactcaggaggctgaggcaggagcatcacttgaacctgggaggcagagtttgcagtgagctaagatcacgctattgcactccagcctgggcgacaagagcaaaacttgtctcataaaaaaggaaaataatttattatagaggagagtggtatattaagaagtttgacaggcactggcttagagtaagatttttctcttagagtaattttctttctctcttaaggtatccaagcccaccaatgggatctgtctcagcacccaacctgcctacagcagaagataacctggaatatgtacggactctgtatgattttcctgggaatgatgccgaagacctgccctttaaaaagggtgagatcctagtgataatagagaagcctgaagaacagtggtggagtgcccggaacaaggatggccgggttgggatgattcctgtcccttatgtcgaaaagcttgtgagatcctcaccacacggaaagcatggaaataggaattccaacagttatgggatcccagaacctgctcatgcatacgctcaacctcagaccacaactcctctacctgcagtttccggttctcctggggcagcaatcacccctttgccatccacacagaatggacctgtctttgcgaaagcaatccagaaaagagtaccctgtgcttatgacaagactgccttggcattagaggtaaaatctgttcagattagctttttgggtcctttgacatttggttttaatttttagttttagtttagtttctgctcatttaagcttatattcatggaattagagcactggatgattttggaagatacgcactgttagcgtttcattttaaaatttttttatagagacgaggtctctaattttaaaagagttgtttgcccaggctgatttcgaggtcctggcctcaagcaatcctcctacctcgacctcccaaagtactgggattacagatgtgagccaccatgcctggcccattattagtgtttcacagcttgttttgttctgtcctattccttgtttgccccaaattctcagccttcttgctctttcttgttcccaaagcctaacagatttagttttgcagttgttggtttttcttccagtaaggaaagataatgattaaggaagacccatgacctagaggcaaaatcaacatatatggttctgtatttctaacattggaatcagttgagaaatatgaaaatgt

SEQ ID NO: 3609 - DNA, 1099 bp, Homo sapiens
ttggatgttaaattaactcactatggtttttcacctgggaaggaaacaaattacgtactagagggcattgactggttaaaaacttgtgtatcccgggaaggacctgcggtacaggagtcagccatgtctgtgctgtgtggaaccacctgatgacatggttaacgaggaagacgatgtgttgaccggctgccgtttgaggactttggtcacccagactagacaccttctgtgctcatgtttggaaagctgaaagggaaggacagctgtgccctcctgggagctcatgtgtccctggcgctgtgctagctttcctttacagctgtttacagacaaggcaggcctgaggcagatggccactgctcttgtgatgtttgctcagaggaatatgaacattttatttttgaaaagggatgatgtggttttttgccaggtgtttataattaatcctttaatattatggttattaacctcttaaacatgaatgaattcttgattgttttaacacagtacctaagactaatgctttctgtggacaccactgagctctgcctcaactccaccctctgcgaccggaggactatgcccctagtaactgctgtcggtgtggacgctgtgctggttctgttttctaaaggagcagaaggacaggtctctgagacaggatcgttgtccctacaggaggaacagtggccttgcttcttagacggtcttcactgtgtgttttaaaacaacaacaacaacaacaacaacaacataaaactcttttgacctgtaacttaaagatcataaacttcaggcaataatattttctgtgtaagcttttaaaattatttttggggatcatagcttgttttattttgtgctataaaattaacagtattaaatgacttatattcttagaatacatcgagtgtcttttcttaacagattagtgcctttttatttttgtattccgttttacgttactggtcccagcatcaaaacccttgtttccatggcctgtttgtatattgtctcaataaaacttgcatcagccggtggtggcggcagcttcggtgtttcagtgtctcctcagtccgcccccactagcctcctggca

SEQ ID NO: 3610 - DNA, 1372 bp, Homo sapiens
tgagggcaggagacgtggtcatggtttacgggcccatggatgaccaaggattctattatggagagttgggcggccacaggggcctggttcctgcccacctgctggatcacatgtccctccatggacactgagcaagcatccttgcccaggtagtggcctctggctgctcacaccctgccagaggagaagcaagcgttcagaccctcacaccagcacccctcctcaccaccataagtagcatgtgctccaagtgccactgtgttaaactgatggtagtccttaagcgtcccctaggctctgaaagtagcaggacttaagcctgagttatttgcaaaagcaaacacaacaagccaacccctgagagtctgagaagccatttcaaagttgctgataactatggcaggtatacggagaagcgcctttttctgtggccaatgtgtgttttctctgggaggttaaggttatctgtccattgccttgtacgaaagtctcaagaaaagtctacatcttaaaaaagaaaaagcaatctgagtgttatttttgggatgtgagggtgatctggctgcgacatgtgtcaccccattgatcatcagggttgattcggctgatctggctgactaggcgggtatccccttcctccctcaccactccatgtgcgtccctccagaagctgtgtgctcaatggaagaggatgaccatccccgatagaggacgatcggtcttcagtcaagagtataagagtagctgcgctcccctgctagaacctccaaacgagctctcagaatgttatttttctgtcttatgtccaacccctcattaaaatgttcatagaaaaaacatattttagaagttgaagcacaaccaaggaaacatgagcctggctttcctccctctcacttctgcgcactgggtccgcaagggctacagaaatgttttcctggctgaggaagggagggtgcacccttctgctttttttttcctggctgcagtctattcccagaacacattccatcacatggttcccagaactcagattgtgcggtggccacgtcatcattggctggggctcacagtcacagcagcagaggcctccctaaacctccctctcctctagccccacccgctgtcccctgctcctcatgcccccatgctgtgtcccctggcctcacttccgttgccatgttttcataatcctctcaggctctgggcagcagcgctgcccacagtaggaccagatcatgtaaggaaaatactgcaggctcatcttggggctgcactggggacctgagaacaccttatcctactgtacgtgcggcacctcatctgacaccagcttctctgctttgcccaaggtccctaggccctgaatgct

SEQ ID NO: 3611 - DNA, 1372 bp, Homo sapiens; identical to SEQ ID NO: 3610

SEQ ID NO: 3612 - DNA, 1171 bp, Homo sapiens
aggagtttgagaccaatctaggcaacatagtgaggccttttctgtactaaaggtactaaaaattaaaaaaaaaaaaaattagccaggtgtggtggtacgtgcctatagtcccagctacttgggagcctggggctgaggatcgcttgaacctgagtggtcaaggctacagtgagccgtcgtcgtgtcaccgcattcccgcctggcaacagagcaagaaactttcccaaaaaaaacaagcatttcaccttatgaggttttccatttatgaagggtttattgggatgtaagtccatagtaagtcaaggagcatctttatatagttagaatagggacagtcaagtgtttcatgcataatccaaatcttcaggaggcaacatcaaggtaacccgagtttagggatattctgcaaaataactggcctgtaaacctcaaaattaagtcaagatcatggaaccaagaaaacactgaggaattgttccacactaaagaagtgtgcagaaacatggcaactccatgtggttcatgattctgaatcggcatgattggcaaaactagaatgtctgaaaattagattgtagtcgtgtatctgtgttaatgattttatttttatcttcttttttttttaactcttcttttttttggtattttcttttttgttttggtttgtccttccttttttttgttgttttttgttttttgttacaaacccttgtgtcgatagctgactgctctgctgtatacgaaaccctgacccagaaacaggttgtctgtgaatggtttagcacaggtcccccgtgaatgtgcattgtgtgacgggcaaaagtgtggccgcctttctactgtgccaagttttccagcatgagaggctttccatatctggtcctcagatatgtggtgtgaatgaaggggggaccagctatccgaggccaaccgaggctccacagttggctgccatgtcattttgcctgggcgggattctgacttagaggcctttggtcataatctgacaggtgagcgttgacgattttgatggtagcattttgtttgtatgggagaatagtctagttttgtttgttggaaatagtcactaaagtattgggggataatgagaaagaaatactggcaaacttactctcacatgcttcagagactaaaagtttgataagctaga

SEQ ID NO: 3613 - DNA, 1197 bp, Homo sapiens
cacacatctaaacaatcagatcttgcaagaactcactcactgtcatgaggacagcaccaagcctcgcggaatccgcttcaatgacccaaccacctcccaccaggtgccacatgcaacattggggattacgtttcaacaggagattgagagaggacacacatccacactatatcaggaggtgtgtgccttgcaaccatcaggggatgctgcaggactgccctatggtccctacacagctgcttagtaagaaccattcactccaaggaacctgtgccctgtgctcaatgatggggactcaggagctgtgtcctctctggcctggcagagtcccctaagcagagacctgtgtatggtctcggcaggtgcttcctcccagggccctcccgagggggaaaccaaaccttcctcctcctcagtctggagtgtgagctaagcttcagctccagggctcagggaggggctgggcagtccttggatggaaacatatttgcatgagcagcccctcctctggcagaggatggagaagaagaggagacctggggcagctcaggcccactgttagggctcaggggctgtgtccaccatggcctggactcttctccttctcgtgctcctctctcactgcacaggtagggaaagtccttataaactgagtctcagtgtccaacctacaccatcccctgtggctcagacctacaagaagctttaccctgggaactgccttatcacccatgatgtctgtgttttcaggttccctctcccagcctgtgctgactcagccatcttcccattctgcatcttctggagcatcagtcagactcacctgcatgctgagcagtggcttcagtgttggggacttctggataaggtggtaccaacaaaagccagggaaccctccccggtatctcctgtactaccactcagactccaataagggccaaggctctggagttcccagccgcttctctggatccaacgatgcatcagccaatgcagggattctgcgtatctctgggctccagcctgaggatgaggctgactattactgtggtacatggcacagcaactctaagactcacacagtgctccagacccatgaggaagtaagacaaaaccctcccctctactctcctggtctagtgaaatcacccctgctggtggctctgaccaaatctagctcagggggtgacatctgtt

SEQ ID NO: 3614 - DNA, 1201 bp, Homo sapiens
ggcgtggtaggggcagaggggggaggttgcttctgtcggaggactgctgcgagttctgccagagagagcagctcttgtcccggaacatgaggtaggtggtggggcttggggacacgcggctggactggccggagaagtcctcctggccggaggggagccaagtgttcctgttccaggactgcagaactggcccagacctctgtattggaaaggtctttatggaccagggagtccggtgtcttttttacgggggacccctgggctgcgagttgcacagtccaattcgctgttgttagggcctcagtttcccaaaaggcacagggacggggggagggtggcggctcgatgggggagccgcctccagggggcccccccgccctgtgcccacggcgcggcccctttaagaggcccgcctggctccgtcatccgcgccgcggccacctccccccggccctccccttcctgcggcgcagagtgcgggccgggcgggagtgcggcgagagccggctggctgagcttagcgtccgaggaggcggcggcggcggcggcggcacggcggcggcggggctgtggggcggtgcggaagcgagaggcgaggagcgcgcgggccgtggccagagtctggcggcggcctggcggagcggagagcagcgcccgcgcctcgccgtgcggaggagccccgcacacaatagcggcgcgcgcagcccgcgcccttccccccggcgcgccccgccccgcgcgccgagcgccccgctccgcctcacctgccaccagggagtgggcgggcattgttcgccgccgccgccgccgcgcgggccatgggggccgcccggcgcccggggccgggctggcgaggcgccgcgccgccgctgagacgggccccgcgcgcagcccggcggcgcaggtaaggccggccgcgccatggtggacccggtgggcttcgcggaggcgtggaaggcgcagttcccggactcagagcccccgcgcatggagctgcgctcagtgggcgacatcgagcaggagctggagcgctgcaaggcctccattcggcgcctggagcaggaggtgaaccaggagcgcttccgcatgatctacctgcagacgttgctggccaaggaaaagaagagctatgaccggcagcgatggggcttccggcgcgcggcgcaggcccccgacggcgcctccgagccccgagcgtccg

SEQ ID NO: 3615 - DNA, 1179 bp, Homo sapiens
gtctgttagcagccccaagaacccagccgatgtgaagggtcctgtggttgggctggtggggacaggggcgatggcagagccccagggtgtgtctgggtggagcccacgcttcaccaggagagctgagtgggccaggctggggcatagcctggtgccccaggggacgggaagctccaggccatgccaggcttgggcctccccacaccctgccaggtcagttttgtgtgctgtgagggagacccctagattccaaactcagactccagaaaccaggaaggagggagcacagcctgccctgggtacacacggggaaactgaggctgcagaggaaagggctgggccaggacacctgggaaaggtgacttgggaagggctcctaggaaggcacagggctgtctgctctgcagagggctccagtggaaaggagggaatgaggagggaaggagaggccctgggtggaccagacggccacaccatgaaccctcccagagactttagacagagagaggcgctccacaacaccccacactccctctgccatctctcaccccctcctctgtccacacaggtcagcccaagactaccccgtcggtcattctgttcctgccgtcctgtgaggagccccaagccaacaaggccacactggtgtgtctcatgaataactttatccgggaatcttgatggtgacctggaaggcagatggtaccctcatcacccagagcgtggagaagaccacgccctccaaacagagcaacaacaagtacgtggccagcagctacctgagcctgacgcccgagcagtggaggtcccgcagaagctacagctgccaggttatgcaagaagggagcaccgtggagaagtcagtggcccctgcagaatgttcataggttccagcccccaccccacccacaggggcctggagctgcaggatcccaggggaggggtctctctctgcatcccaagccattcagcccttctcgctgtacccagtaaaccctcaataaatatctttgtcagccagaaatcctgctccctctcttcatttcttatctctcatataatctaatgcttctcctgggttctcagtgtggcactgggggaatcctggcaccagtgggaaagtagcctggaggagaggatcacagtctcccaggggtgtcccctggggaaataggccag

SEQ ID NO: 3616 - DNA, 1567 bp, Homo sapiens
aggggttcagggaagttccctggatggtgattcgcaggggcagctcccctctcacctgccgcgatgactaccccgccccatctcaaacacacaagctcacgcatgcgggactggagcccttgaggacatgtggcccaaagacaggaggtacaggggctcagtgcgtgcagtggaatgaactgggcttcatctctggaagggtaaggggccatcttccgggttcaccgccgcatccccacccccggcacagcgcctcctggcgactaacatcggtgacttagtgaaaggactaagaaagacccgaggcgaggccggaacaggccgatttctagccgccaagtggagaacaggttggagcggtgcgccgggcttagcggcggttgctggaggaacgggcggagtcgcccagggtcctgccctgcgggggtcgagccgaggcaggcggtgacttccccactcggggcggagccgcagcctcgcgggggcggggcctggcgccggcggtggcgtcacaaaaggcgggaccacagtggtgtccgagaagtcaggcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccaggtttgccgggaggggacaggaagaggggggtgcccaccggacgaggggttccgcgctgggagctggggaggcgactcctgaacggagctggggggcggggcggggggaggacggtggctcgggcccgaagtggacgttcggggcccgacgaggtcgctggggcgggctgaccgcgccctttcctcgcagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacaggtacgcggagtcgcggaggggcgggggaggggcggcggcgcgcggccaggcccgggactgagccacccgctgagtccggcctcctccccccgcagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagactaggagtgcctcggggttccttggcttgcgggaggaattggtgcagagccgggatattggggagcgaggtcgggaacggtgttgggggcgggggtcagggccgggttgctctcctccgaacctgctgttcgggagcccttttgtccagcctgtccctcctacgctcctaacagaggagccccagtgtctttccattctat

SEQ ID NO: 3617 - DNA, 1154 bp, Homo sapiens
tttcttttctttcttctccttttacttattaaatatgtaaggaatacagatattcagattgacaaaatatatcaagacaatggggaaactgaggcaggaggatcacttgaggctaggagtttgagacaagcctggataacatactaagaccgtgtctctacaaaaaaattgaaaattagctaggtgtggtgatgtgcctctgtagcctcagctactcatggagctgaggtgagaggattgcttgagcccagaagtttgaggatgcagtgagctatgatcacaccactgcactcttgcctgggcagtagagtgagacccagtctcaaaaaagaaaaattttttaaaaaaattctaagttaaataacttggtccctgtaactttttatatgccattatcactctagatcttggaaacgtgcgactccaggaaagatgagctggcattacttgtcagttataagatagtcatggcacttttgccatttccctgggaagttcaagtggctgtgccagtgccgtgctcctcccgtccccggggtgcatattcaaggagagatctgactgtgtgtgtgtgtgtgtgtgtgtgtgtgtgtgtgtgtgtgtgtgtgtgtgtgtgtgtgtgtgtgtgtgtgtgtttgccctctgcttgtgtcgcttccaggcagtgatgctggactccacagatgtcaacctctggtataagattggacatgtggccctgaggctcatccggatccccctggctcgccatgcttttgaggaagggctgcggtgcaatcctgaccactggccctgtttggataacctaatcactgtcctgtacaccctcagtgattacacaagtgagtcatgctttgatgctttcttccatgtgccagtggtttttggaacagcagaggaaaggcagtttgggtaaactgaaagccaaagttaacactgaaggggtttgccagactgtcagggagaatggcaatgttcttagatttctgctttattctgcatctctttcttgatttgttaaatgccttgtagtaataaagtagcatgttttctgaatgattttactttttttttttttttttttttttgctttgcaaggttttgtttgcttgacagaagtggctatcttatttcctccctgcactgtcccattt

SEQ ID NO: 3618 - DNA, 1125 bp, Homo sapiens
actctgttgcccaggttggagtgcagtggcacgatctcggttcactgcaagctctgcctcctgggttcacgccattctcctgcctcagcctccggagtagctgggactacaggcgcccgccaccatgcctggctaatttttttttgtatttttagtagagacggggtttcaccgtgttagccaggatggtcttgatctcctgacctcgtgatccgccacctcggcctcccaaagtgctgggattataggcgtgagccaccgcacctggcctgaattatatcttaataaaactgttatcagaaaacccatgaggtgacgaatggtcatttatccttattttcacctctaacacaataactcttttcatttctttgtattctctttcaggttttatacatatacttaggggcttttggggcagagctataatcatggtgactttatcaatactcagttgtgattccaaacatcgatgttctcaggctgtaggggaaaaaaaaaaatctctcattcaccaggttgttgatttcttgctatggaaaaaagaggaaggagactggttaggggacttttgcagatgataagtctgagccagggctggaggaagagtgtgaaagagagctggtgccagagacactccgcctccacagggacctgaggctgcccttagcatggctcctagtgttgccttctgagcatgcctctcccctatcctgttgttaaggccagagatcatgacagctaattagagtagaggacaaatgacccgctgggctgctcatcctgtggtcaccagggactgatgttcttacttgagacaaaaggaatttgatgccaaagaaatttatttttggcatagataagtcgtttgattattatttttattcttttttcaagtggtaaaatatacatataaaatgtactattttaaccacttttaagtgcacagttcagtagtgtaaagtatattcacactgtgcggatctccagaatttttgcatcttgcaaatctgactctgtcccattaaacaatagctccccattcccccagcccctggcaaccaccgttctattaatattatagtttccatttctgtgagtttgactactctagataccttacac

SEQ ID NO: 3619 - DNA, 1184 bp, Homo sapiens
tactttggaaccactaacacctctgcacagggcagttagccagctcaagttctttttcagagaaagggacttggccagtggtttaagtacctgccccttcacctctcagacgaggcagctgacgaggcagctggcccagtcttgggagtctgctcaggacagtggtggagctgggtcttgaaccccagtctgcacctaaaaaactaaaggaaatggatttttttttttttttttgagacggagactcactctgttgcccagactggagtgcagtggcacgatcttggcttactacaacctccgcctcctgggttcaagcgatcctcctgcctcagccccccactagctgggactacaggcacatgccaccatgcccggctaatttttttgtatttttagtagagaccaggcttcgccatgttggccaggctggtctcgaacccctgagctcaggtgatccacctgcctcggcctcccaaagtgggaaatgggtcattttcaaaggggcaacagtgataccatccctgcactcctgggtcctgctcttccaatgcccaaggcatggcatggtggcagctgtgcccccgcccattgctttggagcacagatgactctgggggcagaggtgggctctgtttaggagggcagtgagaccacccagccaaattgcttctcaaccctagacaaagcctttggccaagagggaggtgctgttagttgggcagcccttctgggtttcagagaccggtgttggctctagactggtctcatctccattgccttaatgccaggtggcccaggagtacccatgcacagcagctgtggggtgtgggcatcttcaggtggtgttctggtaaaattgttagaatagctgtatgaaggaaaccagtgggaggaaatgaagttttcaggatggtgggatgtgatttagacagtgcacatgctgttagggctgtcactagggagtggccttcatggagggtggtaacagcacctcagtccagccaaaatgtttagaaacactcagtctctggtcccagaggatggcttctcagggcatgccacaagttaaaggtcaccttcctgaaagatgaatgagaaagctgcccattctcaagactcatctgcctagggagggtcacagaggcaggatgtaagacacactgtgttgcattcttgcacaa

SEQ ID NO: 3620 - DNA, 1150 bp, Homo sapiens
tcccccctgttaaatgcagtggctgtcagctggacgtgttggcttatgcttgtaatcctgacactttgggaggccgaggtgggtggatcacctgaggtcaggagtttaagaccagcctggccaacatggtgaaaccctgtctctactaaaaatacaggaaattagccgggcgttgtggttcacggctgtagtcccagctactcaagtaggaggctgagacatgagaatcgcctaatcccaggaggtggagattgcagtgagccgagatcatgccactgcactccagcctgggtgacagagtgggactccgtctcaaaaaataaaaaaaaaaaaaggcgggaggtggaaatgcaatggccagggtggtgttggaccaggtaacccttcagaacccttctaactggtgtcctagggccctggctactctgtgctatgagcattcaccgaccacactgacctggcctcatattttctcttccctttcagtggccgcaagaggaagaggacgtggaatgggacgtggaaacatctttcaaaagcgaagataattttctaagttgaacagaactttgtccttttttctttcaggttatctgagttcattggagtgggtgcttgtgcatatatgctaggtatcttttgccatctttctctttagatcaggggaaatgtttaagctaaataaatctggggggttttttgttctgttttgttttgttttctttgagaaaataaggactttgtgttcatttgaagtttgctttggctaaattttgacaccctgggggatgtcctgggagaatgccagtactttgaaatagcacagctattgatgagattttaagctgctgttcctggccagttgcaggttaagccccagaaaagttcaccttggagaagctccgagaacacacagattgtgtctcattcatcttcagacacaggcacatagtgtggcactttgttcagttaacatttgtggagctgtcatcagctcagctttaacaacacaggtgactctttcccttgataaagtcataggtaattcaggggctgggtgcggcggctcacgcatgtaatcccagcactttgggaggccaaggcgggcggatcacgaggtcaggagttcgagaccagcctggccaatatg

SEQ ID NO: 3621 - DNA, 1131 bp, Homo sapiens
cagagacaatatatttaagaatcacttggttaaacaatgtttttaatgcaggacttttcagagccttttattatgcaaatatacattaggaacctccagacgtggtccttggcaccctgctgtatttctgagatctcagatgagagaattgttgcagatttgctcactgacttgattggggaaatctcactacactgaacgtacacaccaatggtaagatttccactttcagaaatgctaagtctgggggagaaatgtgcctctaactggaaggtttcagtagcatgtgttgaccacagaattcacaaagcatttcactaggttgtatcttgcataacacacttcaaatgggcctggtcattttgttttccttttagaagtagatagattagcttccatcaaaagactctgttcttcgaattgtctttatatagtcaatgttagttccttcttcctgtatttttatttttttgtttgtttttagagacagtctcgctgtgttgtggaggctggagtgcagtggtgcaatcatagttcactgcagcctcgaactcctgggcttgggcgaccctcctgcctcagcttcccgagtagctgggactacaggcacccaccatggtgcctggctaattaaaaaattttttttcttgtagagatggggtcttgctatgttgcccaagctgatcttgaactcctgggttcttgcgatcctcccaccatggcctcccaaagtgctgggattacaggtgcgagccaccgcatcctgcccctccttgatttttattgggcggagaggaaggtacatgcatagatgtatacatcaccctcagtctagacattggtgtcccttccagatgcaaagatactggcctgagagggccttgagattccacaaggggaactttccatctggtacaggaccccctttatttagagaagagagcctcagcccagacaaagaaacaacttggccaaggtgacaccgcctctttggagcaagcctgaaggcagagctttgccgcagagttgggtttccttttgctgccctcccctgtgactgagtaccttgcatgctgttttttcagcctgagcctggttggcctccagttattattgaaatgagtggatgtt

SEQ ID NO: 3622 - DNA, 1136 bp, Homo sapiens
gatccgcccgcctcggccccccagagtgctgggataacaggcgtgtgccaccccacccagccaataggtcatttctttttagcactaaataatactctatcctgcatgttttgaattgccttttagaggttcatttacagcattttcatggtagcaaaaaaatcagaaataacccgaagttatttaaagaacttacagcacagtgcactatgcagtcatcaaaagaacagggaatctttctattcacgagaagggaaggtgcccagaatttactgttaactgagaacaagttggaaatagtatattttgattgcccaatttaaggcaggaatacctgaaaccttacctgttggttacttctgatgggtgagattttagggcaagttcactgtctattgtttcatgtctgcatctgtgtggacaaaaacaaaaaaacagatctgtgttagctgcttctcctcttgccctgcccccgtcacaggtacatgtactgggcagattggggtgagacgccctggatcgagcaggtggggatggacgacagcacccagaagatcattgtggacttggacatttactggcccaatagactgaccatcgacctgggggagaagaagctctactgggctgacactaagctcggcttcatccaccgtgccaacctggacggctcgttccggtaggtacccgcccagtcccggggcacccccttcccctttgcccccaggtgtccccagtgcttttgaaggcgttccttcttaactcaggccaacagactcttctctgaaactctggggacctgagaaatgcatgacttctcagaacttgaaacagtgtcaggggctgggtgacacttgccccagcacctgtatatttctatagcaaatgtggcatgttcattctaagtagggcagaaaagactgtctgtagcccatacctatgcacagttgttgttttctttttcattattttgtttttttgaggcagagtctcactgtttcactcaggctggagtgcaatggcatcgtctcagctcactgcagccttcacctcccaggctcaagcgattctcccacctcagcctcccaagtagctggaactacaggagtgcaccaccacacccagctaatgttcgt

SEQ ID NO: 3623 - DNA, 1222 bp, Homo sapiens
cagcctgaccaacatggtgaaaccccatctctactaaatatacaataataataataataattagccgggtgtggtggcacgcacctgtattcccagctactcagaggctgaggcaggagaatcgcttgaacccaggaggcggaggttgcagtgagccgagatggcgccactgcactccagcctgggtgacaaaaaaaaagaaacaccacccctaagcgagagtctcgtgaggatgggaggtggtaggaagtagtcaggtctgggtctggccaaggggtggctgtgaagcctgagggaagacaggcatccaggaccatcctggctgggcctgtgcaggagcagtgcggagagggctgtgttagccctgcctgcatcctctgagtgggctggggagtaggagtgtcctggaacacagggcacaggttggtgcttgggctacagatttaggagtcctataagggcactcaagctctgggctgggcgagatgccccagggactgactacaggaggaccccaagaagcagccctgagctgtgtgacaggatgtggagagatagaaagtcagtggcatgtgctgggagtgctcctcccccatgcgggcttttccttggagtgtgcaattttttttttttttttcctggcaacagattctcactctgtcactcaggctggagtgcaatggcacaatctcggctcactgcaacctccacctcccgggttcaagcaaatctcctgcctcagcctcccgagtagctgagactacaggcgcctgccaccatgcccagctaattttttgtattttagtcgagacagggtttcattgtgttgcccagactggtctcgatctcctgaactcagacaatccacccaccttggcctcccaaagtgctaagattacaggtatgagccaccatgcctgaccaacttttgctctgggtactccaagttttaatcatgaccttcaagaaaacttgtttcttcaatttattttttatttttatttttattttttttttgagatggagtctcgctctgtcgcccaggctggagtccagtggcgcaatctcggttcactgcaagctccacctcccgggttcacgccgttctcctgcttcagccttccgagtagctgggattacaggcgcccgtcaccatgcccggctaattttttgtattttcggtagagaaggggtttcaccgtgttagccaggatggtcttga

SEQ ID NO: 3624 - DNA, 1197 bp, Homo sapiens
tgattaactctctgttttgaacaggatataaactccatgaagttagagactgtgtctctttttgttcactctttatcccccacatctggcacatagtaaagcattccacaaatgcggcattggaatgcatgaataattgctgacctctccctggagggctcaaaatagaaaccttctgatgtgagaggacatttcaatgtggtctagaagaataagtaaagaattagactccggtctggcggcagccatcagataagccaagatgggtgcatacaagtacatcctggagctatggagaaagaagcagtctgatgtcatgcgctttcttctgagggtccgctgctggcagtaccgccagctatctgctctccacagggctccccgccccacccggcctgataaagtgcaccgactgggctacaaacaaggccaagcaaggttacgttatatataggattcgtgttcgccgttatatataggattcatgttcgccgtggtggctgaaaacgcccagttcctaagggtgcaacttacagcaagcctgtccatcatggtgttaaccagctaaagtttgctcgaagccttcagtccgttgcagaggagcgagctggacgccaccatggggctctgagcgtcctgaattcttacagggttggtgaagattccacataaaaattttctgaggttgtcctcattgatccattccataaagctatcagaagaaatcctgacacccaatggatcatcaaaccactccacaagcacagggagatgcgtgggctgacatctgaaggctgaaagagccctgggcttggaaagggccataagttccaccacactgttggtggttctcgccgggcagcttagagaaggcgcaatactctccagctccaccgttaccgctaatataattaaagtttgtaaaattcatacctaataaacaatttaggacagtcaaaaaaaaaagaacgggactccatggagaagcggatgaacagctttcaaagtggagggaattgcagtgcgcaaaaggaaatgttgggccacagcaaaagcagtcatagaatggcctggagttgaataactggagcaccaaagtgtgggagtgagctggagggggcaggtcaggttggaaagccttgagtgcccagtgaaggcctgactctcaaaaagcaacagggagccacggaggacact

SEQ ID NO: 3625 - DNA, 1155 bp, Homo sapiens
ccaaagtactgtacctatcttcagcaagaatgcaaaagaaaatattttcaatatatatacctggaacagattttaataattatcagagtaataccattaatggacaaattgactgcaatgtaatactagctggtatgtttcataaatgtcaagctgtggaccaacatatatagccttttattatttttctcttcttttaagtcagtctgttataaatttttttttagtcccataagcagtagactcccacagaaaatttcttcaaaattttttggtgttccaatgaatctgggatgtaaactctgaatgtatttataactatttatttctggatggtcattatcttgtagccaaatttgacaatataaagtaaggagcaaagttacaggccagtttttacttgtttgccctgagggaaaaatccttttaaaaaaaatttctggtttttattggatttttgtattttaaatttcaaatatttttctacatcaaacctagcaaaaatggagatgacggtttctgatttataataaatactagacagttttcaggctcctgttagacaaacacattgatgaagaaattagtcttaataggattgtaggctgtgtagaaaagttggaaatatagcacttcatggagtcttgttttgaagatgacagttttctgtaactacagcttggaaactatgcaaatggtctagattcctcagagctcacatgataggatatagttagtgatgacattttgctcttcttgtgggaacacacacttcaaggaggagatagtgactttgagataggaacagtttaagatgcagtgtgagtctggcctgcgtgcggtgaggaggccccgccaagagactggtggacatctgactgtgggatgtgctctcaagtaggacgtcatcaggacagattctgaataggcatcatgagagtgctggtcagaaacggctgccactttttttaatttaattttattttttatttaaaggaaggaacaatagctaggtaagatttttatcagctttctctgtctgaatccagtttttcctctgtcagtcctggaagcttgaatagaattatattgttgaagccttcaggtcacaaactgtcttttgtaacctcctgtccctcctaaaacacgccaacc

SEQ ID NO: 3626 - DNA, 1143 bp, Homo sapiens
atcacaactcaagttggaggtaatcattagctggttgtctatcagtgagtatattttaggagcttattgtgtataagctcacattcccactggaacaatttagcatcacaattctagtttagaagtaaattctatttgtggggcatagtggaggccaattacctagtatgcctctgaggattcaggaattttactcacacccttatttcactatatatagataaacactccaagggatctcagcttctccctaattctgtatagtgtttaaattagaagatgaggccgggcgttagtggctcatgcctgtaatcccagcactttgggagccggaggtgggtggatcacttgaggtcaggagttcgagaccagcctggctaacatggtgaaaccctatctctactaaaaatacataaattagctgggtgtggtggtgcacacctataatcccagctactcaggaggctgaggcaggagaatcacgtgaacccaggaggctgaggttgcagtgagctgagatcgtgccactgtactgtagcctgggtgacagagggagactccttctcaaaacaaacaaaaaaaattagaagatgaggctaatgtagaattttaggtcctggtaagtggtggctcacgcctgtaatcctagcactttgggaggcccaggcaggcggattgcctgagctcaggagttcgagaccagcctgggcaacacagtgaaaccccatctctactaaaatacaaaaaatttggccaggtgcggtggctcatgcctgtaatcccagcattttgggaggccgaggccggcggatcacgaggtcaggagatcgagaccatcctggctaacatggtgaaacctgtctctactaaaaaatccaaaaaattagccgggcgtagtggcaggcacctatagtcccagctactcgggaggctgaggcaggagaacagcgtgaacccgggaggcggagattgcagtgagccaagattgtgccgctgcactctagcctgggcgacagcaagactctgtctcaaaaaaaaaaaaaaaaactaatttgctaggtgtggtggtgggtgcctgtagtcccagctactcaggaggctggagaatcgcttgaacccaggaggcagaagttgcagtgagct

SEQ ID NO: 3627 - DNA, 1270 bp, Homo sapiens
aatgagattactttttttgatttctttttcagattgcttgttgttggcatatagaaatgctactgatttgtgtatgttgactttctatcctgtactttactgaatttgtttatcagttctaatagttctttggtggagtctttaggtttttccaaacataagatcatatcatctgcaaacaaggctaatttgtctttttctgttttagtatggatgccctttatttctctctcttgtttgattgctctggctaggacttctagtactatgttgaataacagtggtaaaagtaggcaaccttgtcatgttctacatcttagaggaaaggctttcagtttttctccattcattatgatactagttgtgggtctgtcatatatggcttttattatgttgaggcatgttccttctatactcagttttttgaaggtttttatcatgaagggacgttgaactttatcaaatgcttttccagcatcaattgaaatgatcatatgtattttggccttcattccattaatatgatgtatcacattgacttctgggttaaatcccacttggtcatggtgatcttgttaatgtattgttgaatccaatatgtaatgtcttgttgaatccaatatgctagtattttgttgaggctttttgcatcaatatttatcagagatattggcctgtagttttccttttttgatgtgtctttggttttggaatcagggtaatactggcttcataaaatgagtttggatgtattctctccttctctatttttaggaacagtttgatttggtattagttcttttttaaatgttcgttagaattaagcagtgaagccatcgagtctcgggcctttctttaatgggaggctttttattacagctttaatctcattacttgttattggtctgttcaggttttgaatttcttcagtggctcaattttggtaggctgtaggggtctaggaatttccatttcttctggattttcctatttattggcatatagttgttcatagcagcctctaatgatcctttgaatttctgtgatattggttgtagtatctgctttttcatttcagattttatttaattgagtcttctctcttttttcttagtctggctaaaggtttgtcaatttagtttatcttttcaaaaacccaactttttgtttcattgattgtatttttttcatttcaaattcatttatttctgctctgatcttcattatttctctattaattttgggttcagtttgcacttgcttttttaat

SEQ ID NO: 3628 - DNA, 1140 bp, Homo sapiens
ttcagagagttatacaggattcttagttatgattccttatgtaataggggttctttggctcttaggttcttcagagtgacagtagattcaacaaaatgttaattcttaaactgtctggtcattataataatctaggcctagggatctttaaaaaatacacatttccagactctgctcctacagagtctgtctcagtaaatcttgagtagggctccagattctgattttaagctctttgattttgttcagccaggtttggaagataaccttctgcatgagttttcattgtttacacaaaaatacctttcttcttctgattttcccacttccaaattcaaagcaaatggacatgtttcagtctatgtttagttatttgatccttgaaatttcagtgttcaagtggtattgatgtttgttgttagctaataataggcacataggtgctcaatatttaataaatatttgttaaatagataaaaatatactaaaaaaatctcaaggttatattggagagtactacacaataaattcctttaagagactctttctctctgtgtgcctctttttttgtctgttctatgtttgactccagtcagtatatgaagctcttttagaaaagccctgcaggttctttgtgacccacactttgagcatcactgattgctaagttcctataccattattaagggcagttagataaagcaagtcatattgctgagaatttatgtaagtttaagcgttttttgtagcatgtatttttgcttcttcaaaaaatctaatttctagagattctgaaaagggaatgcatgctgattgagtattttgaagttctaagcagttcaactgccgtcattgggggttgaactgtgcagtatatttgatttgttatagcttttttattctacttgctcagcattttcctggcagttaattacacagtggctttagggtacattccataagatgctgaagacacagctttgctgaagtctgacacactttcctccttggttacatagctaatggccactctgggataattagtgagaagaaactccaatggcccaattactgtcttctcaaggttttccctcttaattcttctttgcttaaatcttgagagattgcctccattgtagg

SEQ ID NO: 3629 - DNA, 1152 bp, Homo sapiens
taaagctaatgatagaggggattaatcctaccacacaataaaggataattttaaaaaccaataattaaaacagtatggtactatttgatttgattattatgtgagactttaaatttcatatacataaaaataactatgataagctagaaattgctatataaacaacatgggtttgggattttcagatacagtctaaaagttgtgactgttacttgtcgatgagctatgaccgtgcttcataaagcagaggttttctttttaggtttcttgtaggttggaacggattttaacacataggattgtcattgtattttaagattagactttaaaaattttatctttgtagtggtggtgctaaaatcgttgaggattatatgaaacaacctttgcacctacttttttggcctgggttgaggatattgagaaaagggttatgcactggttgttgatgttttttaaacagttcatggtcatagctgagatatattaggttagtgtaatacatactgttattaagaaaaagattagtttcatcttactcggcctaattagctttgttccatttcattggctcaaatgtatccaaacaagacactgcaagggccgtggtgttctgaatagagtgctgtgagatactgacatattttattttgtcttacaaatgagctacagacaatgataattatagaaatgtattctgtggtcttacttataataaattcatagcatcagtacatgcccataaataaaataaaccattcaactaagactgttttctcaactttttatgccgacattagtttgctagttgtttatttttgttgtctagtatggaagacaagtggtagctcgtgacacatattttaaaaatttatgggccgggtgcggtggcacatgcctgtaatcccagcactttgtgaggccgaggtgggcggatcacgaggtcaagagattgagaccatcctggccaacatcgtgaaaccccgtctctactaaaaatacaaaaattagctgggcatggtggcatgcgcctgtaatcccagctactcaggaggctgaggcaggagaatcgcttgaatcctgggggtggaggttgcagtgagccgagatcatgccactgcactccaaaccggagtcagagtgagacttcgt

SEQ ID NO: 3630 - DNA, 1204 bp, Homo sapiens
tagatcctaaaattaatttgggtttacaaaatgaagatattctaattatttcattccatctgcatttattagatggaaaacatctacaaaacaatgtcaccagctgtttggttacttgtgatgtgattcctgtagaaagacagaatgaatgtttttttcccttattttcctgttttcacagtaatgaattggtttctttacatccttcaaaggggagcagtgatttttaaaatttaattaaaaaaattttttttttgagactcagtctcgctctgtcgcccaggctggaatgcagtggcgttatctctgctcactgcaacctctgtctcccgggttcaagcaattctcttacctcagcctaccgagtagctgagattacaggcacccaccaccatgcccagctaatttttgtatatttagtagaggcagggtctcaccatgttggccaagctggccttgaactcctgacctcaaatgatccacctgccttcgcctccaaagtgttgagattacaggcgtgagcctctgcacccagccaaaacttttttttttttttttttttttagtatcgtgaacccttggacttaaatggatttggtgtgtcaatctgttgtccttttcagtgctcaatctctgggccattaagcctctttaagctgacttctgagtcattttgatgtgactcccctggtctttggaaactgtcttactttttggaatgacaagatgttttgggaacatttcgtgtattttctgcttcagacctggaatcaactattcattagaggaattttgttcatttttggagaaaggaaatttagagaccacagactgtatgctaagggctaattgattcttaaacagactttaaaccaatcctagttttagccctatctcctcatcattttttagaggcacttgctattgctacttcccaaaactttaggagattcttaaatgtgaattggttgtttcatagctttctcctttttgacttaactttcttgaatctgcatggtatcttatcacttgttcattgactttacagcttcaaaaattgcccctttttcccttcctgtttttgtttgtttgtttgttttttggtccttgtgggtttatgactttaaataaaatatctcattttatttttagagtttgtgctaaatacttatgtttaatttgttagctttaattgttatcttta

SEQ ID NO: 3631 - DNA, 1196 bp, Homo sapiens
ccaacccctgtcaagatagagaacaacatgaccatcagcccagaaagttccctggtgtcccttcccaatcagtccccactggggatcttcagtggcatcccagagctgtttgctatggtggcagtagctggagagctactgttaattaatttgagcaacagtgcagctgataaatttgatctagcagggaggtctgggactgccatcctgaactcaaggttctcaaatcctgtagctcttgggtcatattgataggggctatatttttaaaaagggatagttgggcagctggttggaaggaaatggcaatgagttcatctttgggcctgtttactgcccccttttgaaactgggtcgtttccagttccgagtggggaggctgcattgttgttctgagtctcagattggagcccattacctgccaggctcctgctcattcttacttcctcttggagggatccccagcaattccaattccactagtagggtttcccagccgatcactcttccctggctgttctcagtcattctaagtgtagaagctacatcatccttggcttctgcctagtggctcacttaaccacatcatctcaatttatcatgttgctgtttatctttttaacataaagttttattatgtgacatactatctcagtctgttccttttgctctaacaaaatacctgaaactgggtgattcataaaagaaatttatttctcacagttgaggaggctggaaagtccaagatcaaggtgccagcagatttggtttctgctgaaggctcactttctccttccaagatggcacaaaagggtcaactcttcttcaagaccttttataagggcactaatctgttcatgagggaagagcccacactgtctaatcacctcccaaggccccccacctcttaataccatcaccttgggggttaagttccaaagtgcattttggagggccatatacattcaaaccatagcacatgcattatctcatttaatccagagctattggttgacatcccatcccattgggacaagaacacacatgtgatagttgagcttaaagtgtcaaaatatggacagtattcagaggaaacagtgatagtgagctggagggttctagaaagatcatgtggaggcaatggggcaagagctggaccatgaagaatggatggggcagaagatgggcaggcagga

SEQ ID NO: 3632 - DNA, 1105 bp, Homo sapiens
tagctcatggagctgcagggaaagctttaagagctttggtcatataaaacatccattcagctgggcgcgatggctcatgcctgtaatcccagcactgtgggaggctgaggcgggcagatcacctgaggtcaggagttcgagaccagcctggccaacatggtgaaaccccgtctctactaaaaatataaaaattagtcaggcgtggtggcaggcgcctgtaatcccagctactcagaaggctgagacagaagaacagcttgaacccaggaggctgagattgcagtgagccgagatcgcaccactgcactccagcctgggtgacaagagtgagactctgtctcaaaaaaacaaaacacaaataaacaaaaaaaatccattcatttactcatgcaataaattctcctgcaagcttttatgggcactcagtaagtactcaggattggctttatcagccttgccactgagcagctcatggtcctatggaacctgagccaggcctcagtctctccatgattggctcagctaactctcagttcagagtggagagtatcaatcttgtgtttttgcccttaggcagcactatatgagacatggggcctgtggtccttccttctggtgtcccccgtgttaaaagataaaaaacaccccaagggccgggcgcggtggctcatgcctgtaatcccagcactttgggaggctgaggcgggtggatcacgaggtcaggtgatcgaaaccatcctggctaagatggtgaaaccccgtctctactaaaaatacaaaaaattagctgggtgtggtggtgggcgcctgtagtcccagctgctcgggaggctgaggcaggagaatggcgtgaacccgggaggcggagcttgcagtgagcagagatcacgccactgcactccagcctgggtgacagtgcaagactctgtctcaaaaaaaaaaaaaacactccaagggccatccgtgctctctgcccctcctgtggggaccaagtggggttaggaatggctcagtggggaaggagagcactcttgtccccagtcccttgccaccctgtcccttagatagggaggtgggctgcagagattggtgccagaagagggtg

SEQ ID NO: 3633 - DNA, 1149 bp, Homo sapiens
ccgcagcctggctatggactcagttagaaccaggtagaaagtcagcgacaccccacagaaggccactgcggctaggtaaacacctgagaaagaaactgctccagaagagatgacgtgggcttccaggagcatggaggaggtggcacttgaacttttaggaaactccttagatgagataaagtgggggttggaggtggcgaaaagagggtaaccctgggaaagtcagtcagaacccatggcagaagactgcaggagaggcaggggaggggcttcggggaccactgtggacagagctctgaaagcaccctggccaaagcccctcctgaggtgacagagcgtgggaggaggctgcactgggcctgcgtgccatcctcacccctgttccccgctggcgccaggccctgccttcttggtacctgtgccaacaggagagccctcaccagccgatcttgtcactctccgtggtgacagtgtcttggccagctgtggcccctagtttctagcagcgtttctcagtgtccttggcccttctgagaaggcaggcgggaggcacacggtgccctgttcttccccgtttgtccagttgcttgcaaagcagagaatgagtaggagtgaacccgagtgacttcacccgccctgtcccccacgtcaggacaggcttgaggcctctctgggcgtgagcgaggaaaccaggctgctctaacttctgaagagtgggctctggctcaagactccaatcggccagaagcccacagagatcaaagcactagcaagttcagctgtcctggccctcgggtagaacccacgggcgtgcctgggtgcggctccacccacatgccccactgtcagcccaggcaggagccttcctggccgggctcaggatctgcctgcagcccagccaggccatcacccagccccgatgcatcctggcactgcacgcttactcttcacaagcacttatacgcggatggcctccgagaccctgcctccctggtctgctgaggtcaggccaggtctcccacggagccgggcagctccacaccccaccacctggcaccgttaggtttcagatctcccgtgtggtgtttgatgtcggcttttgttcctaccttgggagtttggattgtttcctctggtgtctttgtttac

SEQ ID NO: 3634 - DNA, 1168 bp, Homo sapiens
gtgttgatcacagcacacagacggcctgcaccctgcccctggctgcgtggagcccttggcccatgtcatctcttgcttgccacagaaggcctgcatgggaggctgtgactaacgagcaggctgctcaccgaggaggaggaaggcgtgtgggggtggggaggggagatccaaggcctggaggcaggaagccagggtcatttggaagcggcactggggcctccctcacagagcggagggtgtgcttagggaagcaggagggctgtgcggcagctagtgcctgttgtcagctttcacgtggcacagtaaaggccagacccatttcctgctgagctacagagggcccacaggtttatgaggggctcgcctctcatccccaccctgctcaccccgcagaccggcagatgttcctggccacatggaaggatattcccaatgagaatgaggcccagttccagatcagagactgccccctcaatgcaggtgaggactccgagcccccgaccccagcccctcgcctgtacccaggcccccgcgctgactggggcctctcacggccatgtgaccccacagaggctgcgagcagcaagctgcagagcagcaacatcttcactgtcgccaagaggaacgtggagggccaggacatgctctaccagtccctgaagctgaccaacggcatctgggtgctggcggagctgcggatccagccgggcaaccccagctgcacggtgagagccccggcacccgccctgcagccttggagcctccccttcgtcccatgccagggggtggccctggtggaggacgcggtccaagcgtcccttcaagcctggcttgaactagaatcagtttggtccctgagaaggacctttctagaaagcttccaaatcaaccccgtcaggttacccagataagacaccaattgggtctcggaacagtgagttggactagaagattgtgtaaaattgggccctgtaaggtggtgcagttggtttggcacccctgactgggaagtgacattgctgggcacaggccctggccctgtcctgtgagtgcctgcatgtccagctgggaggacagtggttcccaggagcctgaacctcccagcctttgaggtagacctgttagagaatggcttccctggggcacacagttgtcctggaggcctgca

SEQ ID NO: 3635 - DNA, 2787 bp, Homo sapiens
cctgcaggagagagagagaaaaagcaccctcaggtgggctgttgagtttgggctgcaggaagaggcacctacccgccccctccgcaccctcttccctgcaggtctggctcccagccatgaaggctaaggggctggagatctcaggcaccttcacccgccaggtgggctccatctccatggacctgcagctgaccaacaaggccttgcaggtcatgaccgactttgccatccagttcaaccgcaacaggtgagagctccctgaggccagcgcacctctcaagaggaggcctgtgagagaacccactcggagtctgttctggggactgcaggcaggggtgggggctgtagaggggagggcagtgccccttttctgaaggatgttccccaccaccgctcaggccaaaactctctgaagcactgggttttgtttgtttgttttttcttttggagacagagtctcactctgtcacacaggctggagtgcagcagcgccatctcggctcactgcggcctccacctcctgggttcaagcaattcttccgcctcagcctcccgagtaactgggactacaggtgcacaccaccacgcctggctaattttttgtatttttagtagagatggggtttcaccatcttgcccaggctggtctcgaactcctgagctcaggcaatccgcccacctcggcctcccaaagtgctgggattataggtgtgagtgaccgtgctcagccaagcagtgggatttttacccccaagtggcctcttcatatggactccaaagtaccaggcagagtgggaaaggacgtctttctttttagtttttattttttttgagatggcctcagtgtattgcccaggttggtcttgaacccttgggctcaagcaatcctcctgcctcagcctcctgggtctctgggactacaggtgcacgccaccacacctggccccccttatttttgcctccacagtccaaaggagtgttttacagacagaaacgccctgctccagctgagaagcccacctctggcaaacaccccacataggaggggcccatcttagggaccagctctcagaaggctggtggggagtgggcctgcctaccagcctccccattgtggcagaggattaaagtgtcagatggggcctctgggagcggtagctgcttcaggcccctccccaccgggtccgctacactgggtgtcagtgggaaggttgcgtcatggacccagccagtgaggctaggactccctggggacccctggcagcccctcctgatgattcttcttcctgagcacgctcatgatgagcaaactgagcctctaagaagttgactgaaggggctgcttccccaaggaagcctgggggccagtaggtcctgacccttgggcagaccggggctaggggtggctctaccacttaccctcatgtgaccctggaggccacagaagtgcaccaggctccgagaggtggttccaatggttgcctctagcaaacttactgtgtgctgaatgcttcctgggcacccaggccctgtggcaccggctttgggagtattgtctcacttgagccacttgatggcccagcaaagtcactgccatcacccctttttagtaggtaatgacacctgggctccttggacagctcacatagcgagcagtagtggagctcccaggaaagcctagtgtgctgagccaccaagcggacctggggttccccaaatggtctccctctgtgtcccaggcaggctgatggcttcttgggcagagcacaggctggggtcagacagcccaaactctgattctcagcagcgccctcaccctatggggtctgacacaggcctgctcctccctgagacggtgtcctcatctagaggataggaagaggtgtacctggctctgtttttatgaggctaggagcaggtataatattgaatccgcagcccaggtataccgagccctcggtttgtgcccccagtcccatgccctgtgacttaccttccaagagcctgctgctggcgtgtctcacacccatgaggatcttcctaatttgtcactgtgctgctttgcagagaagcagagctttcctgaatctctctgtggccactgtgtgacctggcaagttctggccaagagagtaaaatctagcgtcttgcttgggatggtcagatcccttctgggagttgaggattggcagcagagacttgggtggtcccagagttttcaaggtagaagcagcttatactccaggcccctggcattagacagagctccttgagggcaggacagggcaaggcctgcctacctgggcccaccagtgcctggcccagaggagaggaacagagctgggcttcaggcctgcagccaggctggggcagagcagagcaattggcctggggctctttctttctgtccagatggccatctgggggaggggacccacagcccatccttctgtccagggtccagaacatgggaaggctggcacggtgagaggctccctgccaaccacagccccagctcccgagtcggaggagctcacctgtcccgcatcagcacctactccccctgccatccctgtggggcttctctctccccagctttggcctggcccccgccacccccctccaggtccacgcgccactcagccccaaccagacagtggagatctccctgcctctcagcacggtgggctcggtcatgaagatggagcctctgaacaacctccaggtgggttccgggcagggcaggcaccccagtccttactcacctaccagccgggccccactggg

SEQ ID NO: 3636 - DNA, 2787 bp, Homo sapiens; identical to SEQ ID NO: 3635

SEQ ID NO: 3637 - DNA, 2787 bp, Homo sapiens; identical to SEQ ID NO: 3635

SEQ ID NO: 3638 - DNA, 1047 bp, Homo sapiens
ttccaatcttttctgtacctccactcagcacagttcatgttcagtagatgctgaacattcttagaaatactgtgtgtgaacttagaaaagtgcaagaagacaggcatgtctttgaccccaggaatgatcatttgctgaagatggtgtcaagtgaacctagattaacagccctccactccagatggatatccagtgattcctagaatgggatatagccagagaacaattctatgcaccctacactgacagactcccttaagcaacaccagatgctctactggtacttgaagtacatgactttgaagtcttgaccctccatgaatacctgaattatcagcaagcgggttttgaagctggtgcctcattgaggccatattagagcaacttgtacatttgacctcttgttatcagccatggtactctacttcgtgtgcaagagataactatgaaagccaaattcaaatactggcaacatttcctaaaggggctcaatatctatcattcgtcttcttttccaaactacacatcactgtatgactcaaccagtagcagttatattgccccttggtttttattcagtttaactactgtttccaagataaatgagctaataagctttaaaaaaaaaaaaaaaaaaggctgaattcttttttcttcatcactggcatatctgcctattctccagaattattatgactattcagctcactttaacagttgaacttcaagcgacaatctttgaacaccccttctcatgtgatttaaaatgaaaccatttggaaaagtttcttctagccagtaatagattttttttttaattgctctgccttgtgccgagagatgttcttttaagatgaatcttttgatgtctgataccaccaaatataggtggtagggagagttggaggctggccctttgagcaggccattagcttacttgctgggcatttccgatagcttattgcctacctttttgctggaaacaaactgatttgaaaaacaaaatctatgaagactgcagctaaggattttatcggtagacttaag

SEQ ID NO: 3639 - DNA, 1198 bp, Homo sapiens
aagggctcccacaagctctcctttcgaggcatgggcactgattcccattctatcccccgtgcgagaccgcctctatcatctgggagtgcatttcacgagtttgccctgagtggagaagcagaggccggggagcgcggtgaacagagttgggctgaaagtaagagacctggattcgagacttcgccaccgacagacaattgtgcgttctgggccaaatctcttccctgtgctgggcctcagttttctcgtctctaaaacggggcagtgtttttcaaaatatggttcttacaccatctgctttgtaattctctgagatgccggctttacagcgcgggactcaattcagacttctggtttagaatctgaacttatgcgtaggggggtcctgtatatactaatgtttgaagctcattgattttaagtgctttcctgctgtgagcactagatatccattcttcgctttgaggcagctggtgccagttcaggaactttgaaagaactggaatggttagctcagtaaagagagcactggaagggaattaactttttaaaaattgaaaatactgttacggcaaagagggcttccacttcatctttaggctaaaagaggcagaactaggactaacaggtgaattctacaggaaggcaagatttttgcttaatagaagaacttaaatggaagaatcgtcagaggtgaccaccgatggagtgaatggattgcctccgtgcctcctttcgagggaggtatataggtattagatgaaggtcctttccaacttgaaagtctgtgattccaaggagttgttctgcatctttctggtgctgactctgctctcaaggcaaatgtgacttttttcttctcttttgacacttccatcactttagcctacatctcctgtaaataaggccaatgcatctgaccttacataatctcttcctggttgtcctgtgcaccatccttcttttcaaggactttggaatgacccaatatctgatagaggcaccttaaatgtttattgaatgaataagtaaactgggtcccaccccatgggttagtagcttttttctaagaacaagttggaaatgcctctgaagattttatgtttgaccaggagaagccagtgaactctgaatcacaaaattgaggactctcagttgaaagcaccccttgaggttgttcagaccagccttctcttcc

SEQ ID NO: 3640 - DNA, 1180 bp, Homo sapiens
tttatgggtaagtgctgcctctgtagcccagagaagagaaaccacttgccccaggcacaggcttctagatatgggcttggaactagccctagaggctccacactgagtaacctttttgaccttgaggttttcagccagagaacacattcacaattctgaacagatgtcaaaagagacagagctgagatgactcttaccagcattggcttccgaagtctatgtctggctttgaactttgagtgtgagacttcattcccaaatgttgggttggagcagagctggctgaccatgaggtttcacctccatcattgcaggctggtgggactcttcatatgccaacagcaagtctttatgactgaaaataagacctcagagagccagtgggaaaggcagtgtgttgggcttgaattacaaggaaactgtgtgtgagtagcttcctggaagtccttaaaatatttgcttaaaagcataatagcttcctggaagtcctgaaaatatttgctttttcggggtatgcgtgtacgtgtgtgtgtgtgtgtgtgtgtgtgtgtgtgtgtgtgtgtaggtaggtgtgtccactagagatggcacagatctacttttggcctaggattcaaagctgctctgttaagttgaactatttcttttctttttttttttctttttttgaactctttattagtgtaagaatttgagttgtcttgcagaccaagtctagaacaggttttctttaaaaacaaaaacaggtgatcaaatgagcaaacttggcagccaaacctgggaggtgatatggtaacaattctgttattgctcagagtgttttgcaaatgccagtttgccttcataccagttctcaagctaaataagaaaatccacctcgttgcttctttataatcatgctttatatttgtatgaaaatgaaagttgtcagccaaggtttttttttttttttccagaaaatttagctccaagtggcttttggctattgacaaagaacagataacatttcaacagctaaaaattggtgccccagatggatagtcaagaaatagagcatctgtaaagttgagcagaaagaatctaaattcaggttcctcctacttactgtgagatcttcagtaagttgcttaacttctctgagcctcagtttctttatctgtggaaaaggatcatacctacc

SEQ ID NO: 3641 - DNA, 1142 bp, Homo sapiens
acaggaagaggcacatacaaagaaaagaatccccgaaagggcggtttgtgatgctcctgccatcgtcaactcacaccattccattctatcccaaccccttgcaccctaggccatttcctagctcccgccttcctccaggaattatcgggggtgaatatgaccaaagaccaacacttccctatgttggagacccaatcagttcactcattcctggtcctggggagacgcccagccagtttcctccactgagaccacgctttgatccagttggcccacttccaggacctaaccccatcttgccagggcgaggcggccccaatgacagatttccctttagacccagcaggggtcggccaactgatggccggctgtcattcatgtgattgatttgtaatttcatttctggagctccatttgtttttgtttctaaactacagatgtcaactccttggggtgctgatctcgagtgttattttctgattgtggtgttgagagttgcactcccagaaaccttttaagagatacatttatagccctaggggtggtatgacccaaaggttcctctgtgacaaggttggccttgggaatagttggctgccaatctccctgctcttggttctcctctagattgaagtttgttttctgatgctgttcttaccagattaaaaaaaagtgtaaattacatggtggtcttgacttttattacagaaagatatgtagtaaatattcagaacagatacacaatgttacttggacatttcagaattatcagagaacatagcataggcagataatttttgtaagggttttctgtttgtttgttttttttttttttagcagcgctctgtcttctaataaaggcctgatttatgaaatgaatgaaaacagagctagtttggttgaactggacttggggtgggtgctttggctacacacctactcaaatccacctcttctctcgacttctctctctctgcagctctttcttgggttctgtggtggaactttctgggctgtgaagcaatgctgttgaaaggccatttggtattagggactcctgtttgtggctcctgggatgaggtggttatgattttgttttccttgtgttttgaacacttagcccctaatttgtaacttaagta

SEQ ID NO: 3642 - DNA, 1173 bp, Homo sapiens
ccatcactgagtccaccgcaggccccaggaagcactgctgaaagggaggatctgtaatttgtctcagtccctgaatgagtggggctacttgtcatcatgcagtttcctctccaggaggctcaggatgggtaacacagggctcctgcctaggaggccagaggggaaggagacttcgtttttcatatgccagtgagggtagggaagacaccccatgtctgcacatgtgagctcactggatagggccttatgagaccagcaggactctggagcttccagtcagcctgggacattcccccgtctctatccaaacattattgcttggttcctagagataacaggcaagagagatgcctcacagtgcgagccagcctgtgttcagagcaggaggttcaagagaagccctatcacaggggatgcagtgccttgagagccaaaatgggcagctggaccatccgactgtcttgactgtgtctttggctttcatcccccaggatattttcaatgccgtcatcaaacaaaaccccttccttgtgtaccagctcccctgcttctggaatgtgcagctgtcagaccacacccgctccgagcagtgctacagagacgtgtctgatctaaaggtagggtcaacacagggacatccctggaggtagggtgaggtgggccgagaggacctcccaggggcatggatggctgggagatttatgtgcaatgtggtgagagagataagggcacaggagagcagaatgagtatgcttttcatctttgtggggtgttggtttttttccacccttatttgggctttctggaaagcctaaagcctcctggcgtaagaaccagcttgtgtggttattattcttgccatctgctgctggctcttttggttcatgccagctccccaaatctattcattcaactcaagcaaaaacatttattgagggcctactctgtgccaggtgctatagatgtggatgtgaataattaacctgcttccaagtcatgtatgacttggaggaggagagaaatgtgcaaagaagtaagtatttaaaaaaggacaaagtgctatgacaggtgtgggtgggtcagtcggggagatgcaagcataaatgtctcattcttcctcacagagggcggacaatgacagaaaaagctttcatcaccactctgtaggtacca

SEQ ID NO: 3643 - DNA, 1134 bp, Homo sapiens
ggttgtggatttgcgaaaaatgcttggggttggatagtgagaatctggacctttcacctccctaggctcagtgctgccgtgttggaattgtagcattgtccttgcaattgacagcttctctgcgatactctgagggtggacttgggttgtgaaatgagttttatgactttttggggaatgggatgggtggctgccctaaggcaggactctgtctttgagaccaacagctcatcctattcttcccactggagcagtggattggccaagagctctgctgggcacgccagcactcccgtgtgtgagagagtcttgtcgtcttgtttttttgtgtgtcttacggaccaaagttttcaagtgtggggttttatgagtccatttggcccacgtcgtaaaagtgccactgttgtgttggaatgatttctgttcattctcagagctaatctttaaggttctgcctgtgacaaacctgttcatcgttccactttatcaagaagttgtcattgttctcgctcttgcactaattactgttttaatgtggcttgtgtgttcattgtctggtctgtctctgtttagaatgaaacatcacagccaaaaagatgtggggagtaggtagcagctttcaaattgtagtcttttcacattagaacccaaaaatccgcttcccaaattttgcttgcctgcaaaccagaaatttcagtacaattttagaaagccatttgctatacgatgtggttaaagtatgcatatgttcaggttgagggcctgaataagtcatccatgtatcatcacccctttatctgccaacatcgattgtgttaactgattggaagattgtcatttcaacattttaatttaattttttatagagatgctatctcactctgttgcccaggctggagtgcagtggtgtgatcctagctcactgcagccttgaactcctgggcttaagcgattctcccacctcagcctctccagtagctaggactgcaggcatgtgccacctcacccaactaattaggggattgtctttatggaagacatttcacagtgtctgagagagtaggacataggatcaagaagttttggcagaacatggtttattgttatttccatgctaatatttcctggctcccc

SEQ ID NO: 3644 - DNA, 1177 bp, Homo sapiens
gctgcccgcggcggctgcagcggccgcccagctccgagcgccgggcgctccgggaagccggcgcatctcggaggcggcggcggcggccaaggccggcgagcgctcccggcggcgggggccgcccgcctcggctccccgcacccaccgcgccgcgatccactcgccgcgcctccgctcccgtgaccttcccggggcgcctcccctagccccgcgcccccggccccgcgccccaggccggggcgaggccttttccggcgcttctttcccgcggagccgcgggcgggcggcgcaggccctgggggagagcgcgccgcggccggttgcagccccccccgcgccgccgcgttcggcgcccggcccggccagtctgctcctgccccgccgccgcgccggagcccgggcgcccgaagctgggggcgcggccgcgctcgtctcgccgggctgttcgcgggcaggccctgccctgaagggacgaatcggcttggagcgcgggaggtggagtcggccccggcggtcgctccctggacccaacccgaggctgacccaggcccctgcccatgcggggcgcccctggctcggaagagtcccccgggccgggagcagctccaggcagcggccccggaggaagaggaagaagggacagtgctcagcttgggggacccggaccctcgccgcggcatttggagccgggggcagtcccgaactctgtgcttggcaccgccgctccgagtagggcagcgcctgccgggaccctgacccggaccccctgcgcctcgtaggcggcggcgccgccgcgccaccctgttcttccgtgtctccctctgcctggcggcagtcacggccaaggtaagagccccggagcgcgagagtcgccgcgggggcgccgtggtgtgtagcgccggacaagttctccgaacctgtggctggtaccccctgtactcgggatgccggcggggaggccgggcacaccctctgctgccccggccgggagccctggagaggctggaggtggaagcccccagtctccgaagtccccaggaccccctcagggcctgctcggcttctgggcacacaggctgctggcagggagcgagccaggaggagtttctggttaacaccacgagggcatgtgaccgatacccgcacccccggccctcttgttagcggtgagcacctg

SEQ ID NO: 3645 - DNA, 1235 bp, Homo sapiens
ggctgaagcaggagaattgctggagcccaggagtttgagagcagcttgggcaacataacgagacctcatctctacaaataataattttaaaaaatagctgggcgtggtggctcacgcctgtaatcccaacactttgggaggccgaggtgggtggatcacctgaggtcaggagttcgagaccagcctggccaacatggtgaaaccccgtctctactaaaaatacaaaaattagccaagcattgtggtgcacgcctgtgatcccagctactccggaggctgaggcaggagaatcacttgaacctaggaggcagaggttgcagtgagttgagatcacgccacttcactccagcctgggcgacagagcgagactccgtctcaaaaaaaagaaaaaagaaaaaaattttaaaaaattagctaggcatggtagcccacgcctgtggtcccgctacttgggaggcagaggtgagagggtggtttgagcccaggtggttgaggctgctgtgagccatgatcacaccactgcaatccagcctgagcaacagagccagactcagtctcaaaaaaagacaccagaaagatgcttaaggaataaatccctagggagtagatgggttacgagttgagactgtctcctgaccatcaaaacatccccttccctatagaaaaaaatcaaagaagagtgatgggattggggttggttttctgaaagcatcttgcaacatttaaatatgagcttcaaaacccttttccagtttttgctttcaccaatcttctattttgttaatagctaaccctttactgtattgagtgttttactcttttatgccagattttggggaacttagtaaaaaactggctgaggtgtggaagcaattaccagaaaaagacaaactggtaagtacattttcttacaaacatatttttcagtgcttctcgccttccaaaatatgtaattcttccatagactagccagccagacagcactgaaaatagtgaagaaaattacaaatcaacagaaaatggtttagcagaggacattaacactgttagtgccagttcactgtacatgaggatttagctatagcaaggctgtcttttctaacctggtctgttttttccagcagtgttacatttgagccaaaagatgacctaagttgaggagtaattaaagtgttaaaagaaagtctaaaatcagagccctttactgcaaacacctagtaatcagtcatggtctg

SEQ ID NO: 3646 - DNA, 1184 bp, Homo sapiens
ctcaacagaggccaaggagttctgtgagccctggcagcaaaaaacaccttggggggtgaagctgtcaatgccaccagttggacctccatacattctgagctaacccagaatctttagtcggcagaattaagtgctggtgtctttcactggcagcatgaagttagccaccaagtcctcacaagccgtgctgcttagttgctcggtggttatggataaactttgcccagcatgatttttgggttcatcttatcagttcccctggtgggcagatacacagtgttctgcattccacatgtaagtgaattgcaaaaacaaaacaaaactcactctcttgtaggtttatttatgtgtgtgtgaatgtgtattttaattatgtgtatttaactctttaaaatctcttagattttaatttatcctgtaaatttctgtatatataatttaataacagaagcctccaccagcaacagcatgtggaagatacagatttgtcatttctcccttccgccctcccttctttccttccttccttccctgtttccttccctctttccttccttcctcctggtctgttccaaaaactctgaatcatctacattttaaggtattttacctcaaaaatgaatcattgtgttaggattctaattctttataaagaacttcatgggcttcaataatgtctagaaagtaaaataaagaggaatgttaccatccccagctgcccttatttccagagaaccagacgtttgtttcccagttggaaagaagacagttgagcacttcaggatggtttttaaatttggtatgagattctctgccaacaccaagctctgagttaactgtgctttcttctcctggccctgacagagcactacagcatcaaagtaaatctttggggacagtgtagcccatctgcatcctatttaatttcttcccttctccccaccagtgttgtcacagggctatgttgcttaaaggtagtctggctgctgaatccctttctcagctcagagcagttttaagatttaattgggaatacagagaaacaggattgtttgagaaccaaaatcaagaggaacagaaatcttaacttgatttcatgtgttagaacattgtaccatgcctcttctgtatctgtggaagtttcctgtttgacacagggtatctaggaggggcggggaagacat

SEQ ID NO: 3647 - DNA, 1191 bp, Homo sapiens
cacacccttgggctgtgccttctgcctggacttctccctcacctttccacctttccaaatgcagcctgcttggaccaccttctggtaacagttcctccacttccagccctgcagcctcctgcacagtgggggcccagaggggatgctcttgtgtattccagtctgccaggtgcttgcacttgtttgtggctctgcctcccgcactgcatgtgaattcctccttcaggatggtgccccttgagcccagtgcaggcctcggagggggccgtgggccgtagacttggagggtaaggagccagaacacatggtttgaatccctgccctgctgttactgggtctgtgatcttgggcaatttacttggcctctctatgcctcagtttccttatctgtaaaatgggagcagggatagttcctgccttttgtcatggctttgatgattaagtgagatgatgctacaaaggaagagccttgtgcctggcagacagtaaaggctcaatccatgttagcattggtgctgtggtcatatgagggactcaggaaaggttgactgaatttattagaactgacaggcaggagagagagagagagagaagagaacagagaaaagagagaggaaaggggaggagggagagagggagaggagaggaagtggggaggaattaatgggtgagagaggtggagagaggggggcttgaggctgaggagtgaaggctgccaggtaattcaagggggaagcagagagagagcagagggcgttaggcagggtctgtggacttgagtgagagctgttccatcaccaggtgctgtctgcagccagctgctctcaaaatagctgccctgctggggctggggctgatggaggagcagggcagggaaccccatctgggcacatcctggatccctcctgggctgtcgcggcccagagcttggcgaggagcccctgtggcctgtgactcgtggttgagatggggatttggaggtccctcctgtggggtctgtgtgcgtggtgggcaggggtaggggaagctgccctgctggcctgggtctgggagtatgctgaagacaggcaggtaatggccgtgataataatgatgacgtttatggcagtgataagcatcatcatccaaaatgaggcagaggccaggcacaggggctcatgcctataattccactgctttgggaggcggagg

SEQ ID NO: 3648 - DNA, 1212 bp, Homo sapiens
catcaagcattctttgtaagcagagtgatatatctgagagggcgttgacctgttgtgtagaatacatatcctttcccccttcagaatcctgtctcgcctcgtaactgggagagaggctgtgcctgaaactaggggcgatgtcaaggaagctagaggcctcgatgcaattattactgactctggggaggaagacagagaataaggggacaccaactgcccagtccactggccatttttaagggtccccccaccccaagccaaagtttggtttgttgctgttaagacaatttttgttgtatgtatataaatattttagttagaggagcggggaatgggatgcgggctttcacagttctagggaatgggggcagggaggattttgcttttgcttttgctttgagggagaactttagctgactaaaaaaacagaagtttggggtcatgatcacaaaggggccattcccaaaagatggcaagccacgtattcagtggagactaggccaaattctaaatggttttatccatagcaggggagaataggagaatgagtttaagagtttttctcttcttttttcctagaaagaggtaaggataatgggaaaggtagagaaggcggctcccacagaccttttaagagaggcagaatcttgagcttgaggcaccttgagtgcatctcagttcagctggttctggctgaggcctccaaaggcaagctctgtgctttccagtggtttctgctgcatttccagggatggtgtttaacaccgcttcctccagctcccttttctaagaaagaataaatggagttctgctttttatgaaagggtctttggttttcagtgtcaacactgagaattggggctcttgcaagcatctggatttcacagtatcaacctccccgtcaccttttgaactttgagactccgtacggtcaacttcaccagaggcaggttgctcgaagcagcactgcttgtctgttcctgactctggttctcactgtattaaaaaagagagtcagaggagtctggcatttcgtgagtttgttagaggatgctggctgataattccagaaaacttactgatgctaaatcacagtacatgcatgattctttttcagctttactatagttcatgacctggactttctgtactcttggaagctgggctccttaaaggaggcctctagtgaacacctttatctccatgtccctc

SEQ ID NO: 3649 - DNA, 1558 bp, Homo sapiens
cagcaataaatgtgttgggctctggtctgagcaccttagaagcagaagttggtttcctgacttcactgcacaaggcaatgcttgatcagttgctttgaggcttcgaagcaggctgtttctagatccctctctggacatttttcttcactgttaatgcttctctcatcaaccttttaattatttttatctctttaattactgcaggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaagattgtgcatttttttctttttttttttaaactgtggtaaaaaaaaaaaaaataatgcatttccatgtctgtatgtccgtgcttagcttattctatcaatcacggaagaggcagtcaaggaggaaggagagacattaggagccgataaatgcatctgatcagaaatcagcagacagaattaccaaagtgtatctggtgctgaatgactgggggacaagcagaagtggaagagatctttctgcaacaggatattcttctagtcttctgagtttctggtctttgacaggcaattctggttggctgtggctggaatccacatgctgatagataggaatttgtgcttacaaagcaggagaattaaaaagacgctttcctctcctcttccctcctgtcttctccgttctttttacaatcatcttacacgcacagcctgagacagctggcatagtttttggaattatagtattgatatttccaaacgtgctctcagacagtggataataaacacctcattaggaaaccgatctcagaatgaactctggagtatgaaaaagatcatttctttttgttcctgtaacctagcattccttctaggcttcttctcctttaattgaaccacagcttagctcatgtattcttttattaacaccctgctctcatgtccataagattcaggaatttaggacccagggacagaaaagtgaataagccagtgaccagatttcccccagatgtcttgaggattagaagtacaaattgttgacagccattaaagagggtgaggaagggaaaaggaatattagaagatctggtatttcttacttttttcttgcctcagaaagtacaaagtttaaaaaatagaataaagaatctgctggggaaagatagagtaccaggtcctaggtcagtagtccctggaagttttggtgatgaggacatggaagggcaggcagaggcactttgtacttgctccaaagccataggaattttcatcttccagagcctttatgagtcacttctctatccacagtcttgagcctgtggctatcccgctgagcttctcactgtcctccaaaaacaccccgct

SEQ ID NO: 3650 - DNA, 1158 bp, Homo sapiens
gtgggactttgcatttgtgttccctttgtctggagtcttcttccatccagatacacgtatagcttgttgccttagtttctaaaaaattatgatcagtgttaccttgctagaccagccttagaaaatagaaattctctgtctctccagcccaataccccgataccctcctcttattttttctctgtagcataccatctgtttattgttttacttgccaatttattatttgtctcttcctactagaatgtaaactccataagggcagggactttgtctttttaatcatcgttgtttcatcagcagctagaacagaatatctgatgaatgatagatactcaataaatatttgatggcaagagttgaagctgaatagatgaagtgtgcaaggggcatgacttccatgcaaaggtatttggacttgagactgtaaacattggcagtctaggattttaagaagaagataaattaactatcagatttaggttttattttagaaagatcattctggcaggtgcttggagagttcattaggttgaggttaagttaaaataaagcagaactctttaaaaaccaaaaaaaatgttatttagatagcctaggtgagagcaatggctcatttttcttttaatttcccatagtacataatgtggactcccacatatagccttatatgtatcttaatagaatgattatttatattgtggtaaggtccctggcagagttggtaaagctattgagagaatggttcctatcttttttttatagacttatactgcagaagcaggtattcaattacctggttaattcaattaccaggcattttctaaagggcacttcctatatgctcatcatcacttcatttggtgaggaagctatgatgaagacgtttatgattcagtccctggttgacttagggactttacttgttaaatgattaaagaatatataagccaccatgtaaccatggttgtagacaaaatgtgttttgttctgggaaagggatagggaaaatttttctctgttactatatgtatatcatgtgaattttctattttaaagaggtagactacaacagaatacccaacaaaatttataaagcataattaaatattttgtaattcagaagacactctactactttgccagtgttttatttgg

SEQ ID NO: 3651 - DNA, 1141 bp, Homo sapiens
tacagtgtgtgttggaattgctattgatctattgtctagcaatccctctgagctctgaaactttatgtttaaacatagtgtgttttagcattgttataagaaatacaacttttgggccaggcacggtggctcatgcttgtaattccagcactttaggaggccgaggttggtggatcacctgagatcaggagtttgagaccagcctggccaacatggcgaaaccctgtctctactgaaaatacaaaaattagccaggtgtagtggcgggtgtccgtaatcctagctattcgggaggctgaggcaggagaatcacttgaacctgggaggcggaggtaacagtgagctgagatcgtgccactgtactccagccagggcaacaagagtgagactccatctcaaaaaaaaaaaatatatatatatatatatatataacttttatatttcttgatttggatgttaaatatgtaaagctaatgatgcattcctgtatgttttatatttcatgtctaagacaaaagttccccctgtaaattatgccttcaagaaatctagtttctgtctttggatacatgtcgtctgtgaaacctcgagctaggatttgtaacttcttccctgtctgcctctgtctgctaagcatggacagtagtacctatgcaacagtgtgtgtgcttaaccaaaatcctcttttttcccccatgaacatgggctatctttctgtttatgttttcaatttctttgatcaacgttttgtagcttttagtctacatatctttcatctcctaaccaaaattcttatatgagaagtccctctaaagtataatggtcaattattttcatcacttatttttatgtttttttagagacagagtcttgctctgttgccaggctgtattgcagtggtgttatcacagttcattttaacctccaactcttgggccccagcgatcctcccacttcagcctcctgagtagctatgacaacaggtatgccactatgcctggctagttctaaatttttttttttttttttttttgtagagacagggacttgccatgttacccaggctggtcttgaactctcggcctcaagcagtcctcctgccttggcctcccaaagtgctgggattacaggtcatcactta

SEQ ID NO: 3652 - DNA, 1188 bp, Homo sapiens
cccatggctctgggcggtccagaaggagcaggccctgggcctccacctctgtgcagggcacagaaggctggggtggggggaggagtggattcctccccaccctgtcccaggcagcgccactgtccgctgtctccctcctgattctaaaatgtctcaagtgcaatgccccctcccctcctttaccgaggacagcctgcctctgccacagcaaggctgtcggggtcaagctggaaaggccagcagccttccagtggcttctcccaacactcttggggaccaaatatatttaatggttaagggacttgtcccaagtctgacagccagagcgttagaggggccagcggccctcccaggcgatcttgtgtctactctaggactgggcccgagggtggtttacctgcaccgttgactcagtatagtttaaaaatctgccacctgcacaggtatttttgaaagcaaaataaggttttcttttttcccctttcttgtaataaatgataaaattccgagtctttctcactgcctttgtttagaagagagtagctcgtcctcactggtctacactggttgccgaatttacttgtattcctaactgttttgtatatgctgcattgagacttacggcaagaaggcattttttttttttaaaggaaacaaactctcaaatcatgaagtgatataaaagctgcatatgcctacaaagctctgaattcaggtcccagttgctgtcacaaaggagtgagtgaaactcccaccctacccccttttttatataataaaagtgccttagcatgtgttgcagctgtcaccactacagtaagctggtttacagatgttttccactgagcatcacaataaagagaaccatgtgctacgagccgtgtctgtagcatttgtctgcggccagggggccctggacaggactaggcctggcttctgcagccaatgccggctctgcatcgtcgggaaccagattggctgaggcgtaggctgagctagctgtgggcggttgtgcagaaaagctaagatggaaaggtgggctaggccagatccaaggaggctaagagcatcttagaaaccttggttcaaggccgagcacggtggctcacgcctgtaatcccagcactttgggaggctgaggcagggggatcacctgaggtcaggagttcaagaccagcctggccaaca

SEQ ID NO: 3653 - DNA, 1226 bp, Homo sapiens
agagttgggggggaccaggtgtgtccccagggtaggcccctcacttctcccgcccaccccgcagagccctggcgttagaggagaagcggcgtctggaggcccgcatcgcccagctggaggaggagctggaggaggagcagggcaacacggagctgatcaacgaccggctgaagaaggccaacctgcaggtgggtgccaggacttctcccactctgggctctggctggagccaccacggcagagctggccttggacccagccggcagaagcacaggccaagtgccagctgctccccaggcgcttaggggaaaatgtccaggcacctggacctgaaaggtccccctctggcttctgtgttgggtgttcagaagtttctaatcttcccttttctgggagacccaagactctggaccccaagggtttggtgggatcctgctgccaccttcctctggccctgctcatgccctccagccagggccccagccctccccaaggtcactggcccttcttctgcagatcgaccagatcaacaccgacctgaacctggagcgcagccacgcccagaagaacgagaatgctcggcagcagctggaacgccagaacaaggagcttaaggtcaagctgcaggagatggagggcactgtcaagtccaagtacaaggcctccatcaccgccctcgaggccaagattgcacagctggaggagcagctggacaacgagaccaagtacgtgcccctggccccgcccaaccccagctgtcctggaaaaaactctggcccccctgcagtcctgcccaaatctgggccacaaccagctctctgtctcctgagcctggggctgtttccctccctcctgatggggccctcatcccttccacaggttgggtggttgggggagcttgtggggtttgaacaggattctctgttccacctctaaagccaggagttttggtggctgtgtctgagagtgaatcagagcaggaggtacaggggggtcctgcccactaggacagttgtcctatgggctcagcaggactgagacttccttggagggaatggggtttacagtaggcccccagacctcttttccagttacatagatgctctttgaggtgtgtcgcttcccttacctgagcccatttcctcatctgtaaatggggctatttgcagtgcccgtcgtaagaagccgggtacacataggtgtctagcaaaggcctccctacgtga

SEQ ID NO: 3654 - DNA, 1178 bp, Homo sapiens
aggaatctatttctgggagtctctctgaaccctctagtttaggaggctgcccaattaaaaaaatatatttaaaaacagaatatatttccaaaaagatgaaactgacacatactcagagaaaatgtgaacattctaaaaagacaaagaaaaaacaaaaattacttgtcttatgactaaaaagaaatagtaacattttgttgtccttccaggattgtttttctttgttcatattacctaaaaattttaaaaaagctgaaacccagcacggtactgtgtggccaccatgccatgtctagagccaggctcccgttgttggccatgccttgctttgaggctttggctctgcacgagacgccgcagagaacgtcttgatgcctcgctccccttatcctcaccacttccttcttaggggtggaaatgctggatcaaagggtcttcacgttttctgacttttccatgcatggggttagcctgtgctccggagaccctgtgagcacacatgtccccagcgcagcttgtgactcctgcctctctgaccccgccaggtggattacaaagctgacgagtggctgatgaagaacatggatcccctgaatgacaacatcgccacactgctccaccagtcctctgacaagtttgtctcggagctgtggaaggatggtacgccctttgcccttcgccccctgcctcctcttggctgcggctggtcatcttcccacctccacagtgggccgagctgccaaacaaggggtacacatgtgccccctgacataggccaggtggtctctgccctctgtagctcccatgagagagggctcctcggaccgaaacaggaggccactgccttgcgcacacaccgtggccgggtcctcctgggcggagcgctttccgtgtgtgggaaagtcaagggcagccccgagcctcgaagcccagggtcccagccccgcgccatgttgcattcccgcctctactccttggtaggctggttgctttgagtggttctttttaattctttctgttggtttctccttttcctttgcctgggttttgctttaacctctctgttgcagagatgcagagcactcagagagcctatttctatcatcgctttcctattctccacctagaaccaggtgactggccgcccgagtggtgtctcttgtgtgtgtggtgcgtcc

SEQ ID NO: 3655 - DNA, 1187 bp, Homo sapiens
ctgtgttgggcgcccttggcaatccctggaaggccagttattgggcagagctggttcaggcgggtgccctggtttgagccttgagagtggtccaggaagaaggtcctggcatatggtaggggtggcagtttgggatcaggcccgatttgagtgcctagctgattatttactgagcaagtgacttcacctagcggagcctcaatttccccatctgtaaaacagggttaacagcacttccttggcagggctgttgtgagaattccgtgcagtgaggctcaggcgctcagcacatggtgggccgctgccaaggccccatgaccaggtgggagggaggcagttcaagggacgcctgtgccagcagagctgagtgtatcccctggagtgcgggccgcagatcccgtgattgggagctgatgggccctggggtatgtgatgccccacccctctcatcatcaggcacatacctgtctatctggtacatccattgtgcagccgggcccaggactggggacatggtggtcatctgtctgtgtatgtataaatgtgtgggctagaccgcagcccctggggggatcatgcagacattctcatgcacacacccggcctggagaaactcgtgagaactcctgcttgtgggactgaatcagccttggacagcatctcatccagctcccgcgctgtgtgcatgaaacagaggtccagagaagggagaggggttgctctgaggtcctccatgagttgggattatctgcagtttaattgctgggtggggccttttctcgctttctttttttttttgagacggagtcttgctctgtcccccaggctggagtgtagtggcgcgatctcggcttactgcaagctccgcctcccggattcatgccattttcctgcctcagcctcccgagtagctgggactacaggcgcttgccaccatgcccagctaattttttttttttagtagagatggggtttcaccatgttagccaggatggtctcaatctcctgacctcgtgatccgcccacctcagcctcccaaagtattgggattacaggcatgagccactgcgcctggccgccgggtggggcgttttctaaaaaatgctgccataagccctacctgtggtggccccatcgcttgtccacatcctatgggtggactctctacagagcacgttcctctatct

SEQ ID NO: 3656 - DNA, 1236 bp, Homo sapiens
agctcctgggacagagatctagatccagagagaacattcgtccttccgatctcagctcagctctgagagccctcccagagagcagctcccgagggctccagagccctccgaaagccctcccagagagcagcccccacctcccaggctgtctgcacttctccttgctatgctttgctctgtaacattttgcaacagtctgcagtacacggggtttgttaatctgagtattcattgtttctcttgctgggcagtgaacttgaggagggcagggattttgtctgttcactgctggagccccagcacccagaatacttaaatctgagttggatgaatggcggccagccactgggattccagggctttgggccccctgccataacatatggcccagggcaggcgccacatgctgggtcagtccccagcctcctgtccacagatccttctctgttctacctcctgggctgtgtccttccacaccctcagctcggtgctcaggcgtgggcagaactggctgggaaggggtggtccttagaggtgggctgtggagaaatgaagatcgagctctggctgccgccatggccttcccatgcaaaaagtattttgtcatccaaaatcaatattttggtcaggcacagtggctcatgcctgtaatcccagcactttgggtggccgaggtgggtggatcatttgaggtcaggagtttgagaccagcctgaccaacatggtgaaattccatctctaccaaaaatacaaaaaaattagctgggcatggtggtggacgcctgtgatcccagctactctcaggaggctgaagcaggagaatcgtttgaacccaggaagctgagattgcagtgagccgagatctcgccactgcactccagcctgggcaacaaagcaagactctttctcaaaaaaaaataaaaataaaaaaatacaggccggacgcagtggctcacacctgtaattccagtactttgggaggccgaggcaggtggatcacgaggttaggagatcaagaccatcctggctaacacagtgaaaccccgtctctactaaaaatacaaaaaaaaaaaaaattagccgggcgtggtggcgggcacctgtagtcccagctactcgggaggctgaggcaggagaatggcgtgaacctgggaggcagagtttgcagtcagccgagatcacaccactgcactccagcctgggcgatagagcgagactccgtctcaaaaaaaaaaa

SEQ ID NO: 3657 - DNA, 1087 bp, Homo sapiens
ccgcgtgtgttagttggggccgctttccggcagctccaccgggctaggggaccccgcagcgggccgggagcagagcccccggtagcctcaggggagagctttgctacggggggtttcccgcaccgaggctccctagccccgcagagccagccccccgcaaaggggaaatgtgccggcacaccagcggtcctcggcgccgtttggggtgcgtggcgggcgcggggggcggcggccgggccagcgggccgcccggcggggaagcccagggagccaggcagcggcccagggcggcggcggggagcaggaaggcccgggccggggggaaaggtcggatttgctcggcggaagaaacacagatggcggcggcgcagcgccattccgggccgggagcaggcagccagcagccctgtcctcaccgcggtccgcccgccgccgctaaatacccggatgcgccgcccaagcgccagacgcggagctgggaaaagggaggcagaggaggcggaggcagaggcagaggcagaggcagagcccgagcccggtgccgagaccaagcgacagaccggcggggctgggcctcgcaaagccggctcggcgagctctcccgacacccgagccggggaggaaaagcagcgactcctcgctcgcatccccgggagccgcactccagactggcccggtagtcaggggctcaggagcagatcccgaggcaggctttgctcagcctccgacgagggctggccctttggaaggcgccttcaacagccggaccagacaggccaccatgaccgagaattccacgtccgcccctgcggccaagcccaagcgggccaaggcctccaagaagtccacagaccaccccaagtattcagacatgatcgtggctgccatccaggccgagaagaaccgcgctggctcctcgcgccagtccattcagaagtatatcaagagccactacaaggtgggtgagaacgctgactcgcagatcaagttgtccatcaagcgcctggtcaccaccggtgtcctcaagcagaccaaaggggtgggggcctcggggtccttccggctagccaagagcgacgaacccaag

SEQ ID NO: 3658 - DNA, 1221 bp, Homo sapiens
agcctcccaaagtgctgggattatagacgtgagccactgtgcccggcctgaggagctgagtcttagaggaacccagggtgggtgggtttgttctggtgagggggtgtgcaggccgggttctggcccccaatacccacttggggataggcaggacagctccttgtcaaccccaaggaggcagcgcctttcctgagctgtcagggcagcaccatatggttcctttcttttcctttccttcacctcctctaccctggtggcagggaagctgctggtgtagccacacgcgggtgctgtgttctgtgatcgtactgttgcgccattgttcggattggctctgtgcagtaggagtcactctccccatttgatggaggttcagtgaggttcatggcttgccctcagcacttggcttaaaactggaagcgtccccgggcccgtgtgaagcgggagccagctcctgtcccactgcattaggtggtctgcctttaggtgatggctacaggtctcaaatcttcagccaggttgggacctcctgggactccaggatctccacctgcttcaggacccctttctcatctcttggcagctggtgtctcgccacccagaaagggccttgcaccctgttccccgccgtctgtagcacccactccagtggaaccagaagatgtggctcaggtaggcagatacctggagaggtgggagggccaggggtggagggggcgagttatgtggacgactatcattgcagtgactgggtcatgtgaggaagttagccctgacagtgttcagagggtgcttgttctctgtccctgccctattggctttgggaacaggtgtccctgactggggcagtgaggcatgggtcaggaggccagtcccgttctatgggcagggagccctacctccttctccaggactcaggtggggtcaggagatgccagctctggcaaggggagagagggcagtccacaatgctgacttcaccatcatgggactgtcaggagttacacacgtagtaaagcaaagattccccttgattcctgtggagacagctgtaaacttcccggcttgatttcctttaatcctctcaacaacccagggaggtcagcattatgggccctggtatacagatgaggaaactgaggctcagtgaggtttagtcatttgtccaaggttacttagtaaggaagtgggggccaactgccagtcacctgtttgaagggc

SEQ ID NO: 3659 - DNA, 1180 bp, Homo sapiens
acaacttctcacctgcctaccagcagtacacgcagcagtccaccctggagcctgggcccacctggcgtggtggcgcccacggcctctcccgctcccacagcctcagtggcgcccgcgacaacgagaagactctcctgctcagctctgatgatgaattctaggtgcgggctgcagtggcggaagtgctggcgccatagccacggtcaggctgtgccccacctccagcctcaccaccaggccaggaggcagctggcacagtgctcacgccgcctttatttattggaccagaaacactcacatgtcacttccagaggaacgggggacagccaggctcgcccatgggccttcaggaatatttatacatggcccagcctgcactgcccgggcgagggcagaggacactgggagcaaggcttatgcccctgctgcccgtcctgtgctgggggcatgctgggaccagccgcacccaggccccaatgcttgtgtgtggaccagcggctgcagccttctagcccctcctccccgcgagactctcaggctgaggtcggcaagccgtggctcccccacacaccgtgcaataccctgtctgacctgggctcttcccgcctgcatccctcccctgtccacctttgtccagtgctagattcacctcaccccgggcaggagtggggatgtgggcgctctgtggtcctcccctcctgacccaggcctctgtggcatgctgcaaggatcagagccagacaccaggagtcacaggccccacccaggaagggcattcagggcccctgggcaccgcttctgttgaagcaggggcttctgggcccctgggtatccccacctgtcgtggccacacctctgcctgcctcatgccccttccccctggcctaccaaggacagcccacagcccgcactgccggctcacttgggtccttcctcgatagctttgggcagagcccttgcttcctggctgcttcagggctcaggggctcccagccctccttcccaggctgatgctgggtcctctctctctttggggcttctccctcccgtttcaggggaaaggtctgagtctccacgtttcagaccagcttctgggggaaggcagtccggcagggagaccgggaggggtggccacacagtggggagctgggaggtggggggaatggtcccagactcctct

SEQ ID NO: 3660 - DNA, 1207 bp, Homo sapiens
agcagggcacctgggggcttagggtaccccttctgctccagctttgcctgctgggcctcttcttcctccgtggggaacgtggccccattttcttctccagctccccttgagcttctgtcccaaggcaggcggtgtctgtgggttccctgggcctcctggctgtggcctccactgcacctgccagaagccattgccaggtcccggcagggggaaggacagctccctgatgagaagagcccctggctaggtaccgggagagctggtctgagtcctagcccagccttccactagttttgtgactctgggcctgttcttttccccctctggacacccctagccagtctgctagaggcctctaaacagctttcctgctcggtttagcaaccttgagtagttaagggctcttggtacacagaggggggccagggcaggcccagccccaggtcaggagggccaagaggtgctcttgatcatcctgggcgcattagttgtcctttctctggctccatcccaggagagcagggcagactgacctccctctgcccccagactcctgctttctccttcctctggtggttgtgtggcttcgtgtctctgtgctgtgtgattgtgggtcttggcttcccgcgcttgtcagggaggctggagcagaaggtttctgagatatccacctggcctccctccccttctgtgccctgcagggctgctgggcccagagcaccctggcctctggggctgactggtgtcttttcttgcatccctgcagggtgcagcccggaatcccgaggatgtggaccgggagcggcgagaacacgaacgcgaggagaggatggggcagctacgggggtccgcgacccgagccctgccccctggcccacccacgggggccactgccaaccggctccgcagtgccgccgagcccgtggcttccacgccagcctcccgcatccagccggctggtgagcagggactcaggcagtgggctgggttcagggtgggtggggggctctgtttgtgcctactctgagggtggcttcccactctccctccaggcaatacttctcccagagcgatctcgcgggtcgaccgggagaggaaggtgagtatgaggctgcacaggggtgcgcccgccaacgtctcctcctcagacctcactgggcggcaagaggtctcccggatcccagcctcacaggtgagctgcccccct

SEQ ID NO: 3661 - DNA, 1203 bp, Homo sapiens
atcatgccactgccctccagtggccaccacatccggcaaggcagatgggaccatttccttcatccagaacgttctgtggacatcactgctctaggttcctcccttatggagtctcacaagactgtctagccagcaagatctcttttccaaccaggccaggagcacctctccacccactgctgctggtctgaccgccttcctggaagtccctcttgaggcaggccctggagttagaagctgggcagaggcacccacagccttatcctttgccaatctctgactcaatgccacggccactgtagtgagctgaaccacctccagcagtcccctggcagaagcacctggaaaacatgcaatgggaaccttcaccctgaggccaggcccttcccatgctacccaacagtagacaggacaccctgtgttgttggctgcaccggggtgctgggatctgtggatccctggggcctggaagccactctcagcacatacagccactgtgttccgaggtccagtcagctggccgggaaggaattcaacacagccaaggacagaggtccatatgatgacgggtggatgctcgtgtgactttgctgaccttttatgttttctatgggcaataaaggccaagagagctccctgctgtgtgtttcttgcgtcctatgggttggatgggaccatggagagtcgcccacttcttgcctcggggctggcaatggcctgagcctgctgggctcacaaagggcaggggctccagccctctgcttggctgctggctgcagggctccacaccttggagtgagtcactcagcctctgtatcccaagcatggaaatgagattgacctgcctcacagggttgatgtgactctgcccgcagaaggttcggcacggaggtgccacagctcgtgttcctccccaggctttgctgtggctctggctgagtcactgttggccagcctgcaaccgagtgggagcccagggtgaggaccggaggtcaggagttagagccccggtggtcccaggcctgcctgagaggcttctgggtgggaggatgggaagatgcatcttctagagtgttctaaggcaagactctgaacagtgacctcttggggtgcagagagcagagtgggactaggtggcagaggcctgggttcagaccctagctctgccctgagctgtgcaaccccgggcaggtcacaaggcct

SEQ ID NO: 3662 - DNA, 1207 bp, Homo sapiens
cgccccctgcccgcgaactcggccggccggcccgcgctcccctccccggctgccgctcggtctgcgcgtgggtcttggggtctccgcgcgtcccggccgtcccgcgccgctccccgcgggccgcccaactttcagcgctgccccgcgccgcgccctcggcgccgcctcggcgtcagcatcgtcgggcccggccgggctcacagcgcgggggtccgggggcccggggcgccccgccgcccgcgccccccacccccgctgcaggcgccctccccgccgccgtcccccgctgcgcccagctccctcgctgtcacccgctcctgctcgcgcgctctgcccccggccctgcgctccactcccggccccgctgcgctcggccccggccccgcgacccctcggcctcccggcctggggtcgccctccccgcccccgccggccgggctctgtcgccacctccccgaccgctctcgcgtctctctcctgccgccggggtctccgccgcgctcgcgtcccggtccctctcccggcctccctgcctcctgcggccccgctcgccctctgcccgcggggtctccgtctccgtcgcggtcgcccgccggcctccccccgcctccctctgcccgcgctgcctctctcccctgcgcgtctctgtccgtctccctcgcggcccctgtccttctctgtctctccccctcccactctccgtgcggccccctctgtctcggaccccggcccccgccttggccgcgtccccggctcgcccgggagcccgagctcccgccgcccgcggcgcgccgagaactcccaactcgcggcacgccgccccgctttgcgagactttcgcccctcctcacacgtgacccgcgccccactgcggaggccgcgcgccccccagcccgggagccccggctgcccgcgggaccccgccctgcccgcccctcggcctaacccggcctcaagccccctcccgcggggcccgcggcgcggagcaggggctggggcggggggctgctggccccgctcctgccctggatcctgcccgggttttcctcctcgccccaggagcgctcctcccagaacccgttcctggatccgctcccgggttttgtgccccccccccaaaagggggcaggtggagagggttcctccgagccgggaaggggggtgggtgggagctggtccctctggggtcccacggagtccgcccctc

SEQ ID NO: 3663 - DNA, 2696 bp, Homo sapiens
gattagttagaattcactgccaggtttcttctgcccaccaaaatgatccagtctggaataacattttgtaaaaaaaaaaaaaatatatatatatatatatagctgactggaagagattaatttcttcccccaacttcttgcatgttgaagatatttgagctatttttcatctaaaagagtaaggtattaggcccttttgtgggagccccatgttttgtttttctgagttggtggggagggagggagggggagggctgaattgttttgcagaggaagatggcatctgtgctttaaatttctcattactgggttagaaaacaaagagggattgccctgcacattttcttttgtgcttttaaatgtttcttaagttggaacaggtttcctcgggcctgttttgactgattgctggagtgcatttgatagttaaaaattactaattggttttatttcccttcacactctgcctccccacttctccccccgttactgaaaaataaccattttagtgtcaggctagaaattgaattgctgagttttgtgtatcctttaaattaaaaaccacaagtgtttattgtagtggttaaactgtagcatctcagcatctgggtggaagctgcctatatttcttcccagtttaactggggaccatctgtgaaattaattttccatccagacagctgctgtgagcaaatgaacataaatgctcgctggaaatttactaaccagtttttatattgacctgcagtgtaaaaagcacatttaattataaacaatatattcaaaatgggcaaattttattttcaaatgcagtgtagagctagattaaaagcaactctttgccacctactctgcccttttggcaaagttaccttgaacaaagaatcttaagggtttattaagaactctttattttcttcataccctgttctctgcagtgctttctaacagcttctgggtgcagattttcttcggcatccttttgcactcagcttattacaggtaggtagtgcttaagaaaagtcatggaggactaaagcctaagtccttttcacttttcctccatctgaaggtaggtgagttcatcctcttcatggtaatgctgttttaccaagactttatagcagatggacccagaaagaattttctgctattgtgttcactacaacaggatagggacatcagacagccccagaaaccccttccagatctgatatgggactattaatttttatgctgttaattggtattcattcacaatgcagttgaagggggaaggctccactgcattctttggctaaggcctgaatgcttgctcatctgtaagatctatactcgaggttttgttttccttttaaaattctttagggagagagggatggtttctgaggggttctgaaagtatgattcaatgtgcaacatacaggtaggtcttcagcataagctgaaatatatgcatgtaaaaactttgacatctttttttttaattttccactttcttcttaactttacttctctttttgtcccccccccatcttacagaagttgaggccaagggagaatggtaggcacagaagaaacatggcaaactgctctgtgctttcaaaccaaagtgttccccccaaccccaaatttgtctaagcactggccagtctgttgtgggcattgttttctacaaccaaattctgggtttttttcttctttctttaaacatagaggtaccaccacaagggatgccctactctctcgcagctcttgaaagcatctgtttgagggaaaggtctctgggcaagcaagtggttatttggattgcttgcttccctttttccacctgggacattgtaatcataaaataacagtaaattccaaacctcaaaaactattatggcctgagcacagctgaaatctagcagagtttaactcttctgcctccatgtctgtcacttataattcaggttctgctgttggcttcagaacatgagcagaagaatcgttttatgctagttattgcattcatggttgaaactcaacttagggaaagggttccaatgtattaagcaatgggctgcttctccccaatcctccctaacaattcgttgtgtggacttctcatctaaaaggttagtggcttttgcttgggatcagtgctctctattgatgttcttgctggtctccagacacattcctgttgcattaagacttgaaagacttgtagatgtgtgatgttcaggcacaggatgctgaaagctatgttactattcttagtttgtaaattgtccttttgataccatcatcttgttttctttttgtaggtataaataaaaacactgttgacaataaggtgtgagcttttattgcttaattctctgaataattcaacgtagacgtcttaaaacagtttttgtttcaagacaaagatgggggatattggattgactgattactttcgcacctaaaactgaaaggaaaaaacttaatacaagaattggaattgaaaaccctagcaggatacctagtaggtaagggtttggatatatctgtatctgctcataagtaaaacagtgattgtgcaaatggtactcgcctaagtaccattaggttattggtattaaggtactaagtacaaggcaggtatcagccactggtttgaaaaaattcaaaccagtaaaagatgagtcacaaaactcctccagcca

SEQ ID NO: 3664 - DNA, 1118 bp, Homo sapiens
gtactgagtgctggctatgccagatacttttatagtacattacacattattaggtcattttctcagcagcctctgaaataagtggtattatttctactttgcataggaaactaaggtgtgtggaagttaaataattctcttcaaattatacagtaagtggcagaataaaaactcaaaccatgtctggatccagaatctgtgattgtaatccctaggatgtatttctctcaataaagggatttttaattttttgcctattgtagctatattcataaacagtatttattgttgggtagtaagggaggttttacacatttctccatacctttaaatcacagcaaataaaatggtctttttggaggtaggctggtagtatccctagaactccatcctttttgaatattcttatggcatgtacgatacgttgctttaaaaatactgatgaactaactaaaaattctgttcctagatttggagcaagaggtggtggtggccttcccccgaagaaatttggtaatcctggggagcgtttgcgtaaaaaaaagtgggatttgagtgagctccccaagtttgagaaaaatttttatgtggaacatccggaagtagcaaggctgacaccagtaagtttacatgtgtgttttaatgtacagattattgaaccaagtagatatattggttagagtttattcatacgctactgttgccgttttacattttattctagtgtggtgatatttttcttaaaaaattttttggttaatttttttttttttttcctttttgtagagaccgggtttcgccatattccccaggctggtcttgaactccctagctcaagcaaactacctgcctcagcttttcaaagtgctaggattacaggcgtgagccactgcacccagctgatttttttttttttttttttttttttttttgagacggagttttgctcttgttgcccaggctagagtgcaatggtgtgatcttggctcactgcaacctccgcctcctgggttcaagcgattctactgcctcagcctcccaggtagctgggatcacaggcacccgccaccatgcccggctaattttttgtatttttagcagagatggagtttcactat

SEQ ID NO: 3665 - DNA, 1175 bp, Homo sapiens
gaatgagtgggagccctgagcttgttttcctgcaactagacagtcctgtctgggggtgatgggagacagtgacagatcatcaggcattagattttcataaggagcttgcaacctagatccctcgcatgcactgttcacaagggtttgtgttcctatgagaatctaacactgctgctgatctgacaggaggtggagctcaggcagtaatgtgagcgatggtgaacagcagtaaacacagatgaagcttctctcacttgcctgctgctgatctactgctgtgtggctcagctcctaacaggccatgggccagtgccagtccacagcccaggggttgagggctcctgttgtagcacctgagttgaccaacagttaatgtgtgggtggggattgggatcgggcccatgctcttttagttgtctgactgtgctttcagtattatttttgtagacgttggccccatcaggtatggtgagaataagctctctaggcctgtatgatgccttacacccctccttttcttttccagatacttctaggacctaacacagggctctcaggaggaatgccaggggctctaccctcacttcctggaaagatctagattgttattgctgtttgagctgtctcagtgggataagtttgaaattcaagtgtttgaactgctgataatttggatttttttttttttttaactttggcacattgatctatctaaacctggtggggagaattatccccacattgtctcatggaaagactcaacttgcaactgtgccctccacactatccttacttctgtctccactctgataccagagtgcagccatgcagatggttattccagctctggtcacccgactcctttcaccaaattgctcctaactggaagatctcactttccccttgtggggtaggaaccgatgccagtgggagggatgtgcccctgaccattaacgactgttttttttttttttttttaaagaatggagttgttggggcaggacatgcacacaatgtgaaacagacaaaatgcattacacctgtagtgtaaagtggccactatgaatccctatgtatgagaggagggaggcaggctgcagcttcagccacagaatggggactatggaagacagcaggagctcatttcctctgcacattttggctgttagacctgt

SEQ ID NO: 3666 - DNA, 1191 bp, Homo sapiens
gagacagaggggaggtgctgcatgcagagtgacccagtaaattcctggtcaggctagggtgaggaccacgcagcctgctcacgcatcttccgtccctgtctccccgctgctcagcacctctgctctctggccctgctcctgatgggccagtgcttctcaagctccttctctctctttcagcctaagcccagcagtggaggccggcgacgagggggccagcgccacaaggtgaagtcccagggggcctgtgtgactcctgccagcggctgctgaaccttcccctggcccaccctcaccacccaaggggtcatcatctctggccaccactccaccagatgggcagagcagctatgaccgccacccagccctcccgctcaggccacagccggagcctccgcattgcccccacccccattttccaggggggttgtaatttataagctgacgaaggtagccagacttccggaggactgaccatctctcactgtcctccccaccttcttcctcactcacacattttttgtacatctgggcccttagtttttattctgtttattatatgtctctgtctctctctattgtgtgtgtgtgtgtgtgtgtgtgtgtgtgtgtgtgtgtggtgcaggagtgccacccccagggccctgtcaacctctcttttctcctccatggctgtctgcctgcgtatctgtctctgagaatcctcggggcggtcaggggatgtcaggaggggaaggagccgccctccctatcttgctgctcctcttggcactcaggggcaccttccatggagccagaccgggtggaggggcttctgggatttggtgtctgctgctgccagagcaggaacccccagtctaggacttgggcattttaacagggagaaagtagtggcttcccttttctctctctcctcctttttccctttaagcccacagattcaggtcatgccaaaagctctctggttgtaacctggagacatgtggaggggaatggcgatgggattataggactctccccatctcgggccctgaccctgacccttgccaccaacccaaagacagctggtgggtttccccttggagacaatcctgcgtttgcctgggccggccctggctgccctcagctttcgctgatctgcccggcctggagcctcccatcaccccgcttcttgttgggcctcaggcactg

SEQ ID NO: 3667 - DNA, 1729 bp, Homo sapiens
aacctctctgagcctccctggcctgaaaggggatgcaggcttcaggaggcaagaagctgggcccctgggggtggctggggagagggaatgcatttcccttgccacaggtggtctgcttctgctggcctgagctccaagtggagcagcccgggccagccttggtgcatgaagaggcaccaggcacaccgccttgaggtgggcagtgcccatgggggcccgagtggatgggaccgagggtgagtggagcctccttcctcccctctctagtacccccgcctcccacacacttgcacggatcggcctcccttgggagatcagcctccatgggcccctcgtccacccttgctgctttccatttgcctaattaccaagcagaagttgcaatctggtttgctttatttttgtatgtgaaataacccccaaagcccaatctcctcctacgttcaatattggttggggcatccgtcatctccccttaagtgcgccccctccccacccaagtatcataggaaaccggtgaggtctggtgtctctggtttgagacggtaagttgggacccatccctgtctgggtgcccactctgacctttagtttgcccttctgtgaaatgggtgtattgggtagcaagccctcttcagaaagcgctgctggtgtcagagcagctgcccagtaccaggtggggggtcaaggttgctggtactggggcccccagctgcccacaacccctctttgttctcaccctgcaaaggggtcaaggtcaaaatgagcctcatccttcctatgatctgggaagaggtgatgatcaagtccccaacttcagtgtgaggtggacagagttggggggatggcccctttttgaagaggtgaaaatggttttggagaagcgcagctgcttcactgggggaatgcggcagggactggggcccaggatgctttggcctatggggaaaagccctttaaaaggcagggcccaggccctggagccagcacaagactggcctcgagcccctgagccaggaggtcctggaggagagccaggccggtgggcccgcccaaggctggagggtcagccccaacagggagctgggttggccagggggctggactgctaccagcctctctggcctatggggacccaagaggacacatcccccttttgcccactcttctgtgtcattttgttgttttggtttgtggtggtttttcttttttcttttgtttttcttttttctttctttctttttttttttttttttttttttttttgcacttcgcccacacaggacagtggagccccacctggtcagttccacttccgggctcccatgcacttgcccaaggcggcctctttgggacggggatggtttgaggaaacacttttaaagaaaaaaggaagacattgaaaggttttagtttcttccctatctgcatgtcctctcatatagaaagcccagaattaggggctagaactccaggagagggtctccccgactcatctcttgctgacggtcaccaggatgcagaaatagggagatggttagtgggggccaaagatgccccctcccaggccttcgtggttccctcctccgccccctgcaatctttggaggagtcagtgcctcactccagcagtgagtgcctactgtatgcaggtagtcagccaggcaaagagagactaacggtctcatgggggaaccctcttgcgggaggccgggtagctggagcgaagc

SEQ ID NO: 3668 - DNA, 1238 bp, Homo sapiens
actggtgtggctggggatactagtcttattggtccctgatgccaccaccaggggggtgacaggcctgtgttgtacagcaggatctttagttttagcccagccgccttacagaaaggaacctggagggccagccagctttttgctctgaccttgggatacgctgtgactgggactgaggcctcagctgccttctagcgtgctttgcaggtcagcacactggcatgtctgggttatttgtccctaatgccccagccttacacccttcttgttcattcagatttataagattggccagggctaccttatcaaggacggcaagctgatcaagaacaatgcctccactgactatgacctatctgacaagagcatcaaccctctggtaagtaatgggtgttctgctctgtgaggccatcccaggcctcgtgcttttggggataggctgcttcctaggggctgctagcaggatcgttaactgaagccaacacaacacctagctgtgtcccttgtaagtggcatgttgtcatctgagtccactcgtcggggttggctggtgagaagtggggtctcaggctcagctgttcagtgatgaggcctggaatgtgcgctgggcacagcgcccgagacagactgcggaaccgttccttgttgccttccttctgagaacagccctgtggtcagggagggcctgaacctggaggggtcatctgcacgacaatcccctcctgggcctgtgctgatccgatgctcgttttccagggtggctttgtccactatggtgaagtgaccaatgactttgtcatgctgaaaggctgtgtggtgggaaccaagaagcgggtgctcaccctccgcaaggtgaggcaggtcctgacttgtcatgggggggctcttgtagagggaggatccaaggccacagacgctggtggccctgtggtgggagaggaaaggaaggagagggtgttggcagtcctttcacactggctttgaagtcctgagatgaggaaattcccagtctggccttgctgggctgtttgctgctttgagtgtgtcctcatctgccggatggtgggggaggctgaattgatcgtgtggcttcccagatgcaggggcgctgtgaacagtgctgaggaaagcctggctcctcgtaatcctaaatcccttcccctcttggcccatagtccttgctggtgcagacgaagcggcgggctctggagaagattgaccttaagttcattgacacc

SEQ ID NO: 3669 - DNA, 1238 bp, Homo sapiens; identical to SEQ ID NO: 3668

SEQ ID NO: 3670 - DNA, 1227 bp, Homo sapiens
ggctgaggtaaaaccactgcagtaccccaaaaggaactgacccaaaggacagccacaggaacattgggctggtaggggctgggatctggttgtttgcctgtggtgtgggtcttgtccgctcatcctgacagtaactcaggcaccagtatccaaagttaagttgttgctgttggcaaaaatgaaagttccttcctcttggtgaggttcagtgacttgttcagagttactggctttttgccgtgtgcttgacatcaatcaggccgcatggagctgcagttcctctgctgtgggaggagcgctggcagctggagctgagctgtgtctaccttctcctagatgcgcctgcttcctctgcgccagaagaaggcccacctgatggagatccaggtgaacggaggcactgtggccgagaagctggactgggcccgcgagaggcttgagcagcaggtacctgtgaaccaagtgtttgggcaggatgagatgatcgacgtcatcggggtgaccaagggcaaaggctacaaaggtgagctttgcggtggcttgagttgctgtgcaaacctgggggagaagtggtttcaggcccagctgttcgttgatgaggctcagagtgagcgctgggtacagcgcccgaatcggacagtgtagaaccattctctactgccttccttctgagaacagccttgtggtcagaagtggctgggatagcggagggccaggggacaacttcttaacacgttcctggaccctttgctctttgtagcctactgataactgcaaaggggagcttggaattatgttagtcagtccctgtgaatgggggagcttaaactaatggatgccttaaaaagcacccattcagaattgagttcagggtgacacccccagagcctatccagcttgacaggggagacctgtgggtaatgcacatgaaataatcttatcactccctcagatgacccagccatggttggtaattgctgagtagcaggaaggggtcagtgggaggtgctgggcgctgaggtgaagtaatgtgtatccattccaggggtcaccagtcgttggcacaccaagaagctgccccgcaagacccaccgaggcctgcgcaaggtggcctgtattggggcatggcatcctgctcgtgtagccttctctgtggcacgcgctgggcagaaaggctaccatcaccgcactgagatcaacaagaaggtgaggttctgagagtggctc

SEQ ID NO: 3671 - DNA, 1227 bp, Homo sapiens; identical to SEQ ID NO: 3670

SEQ ID NO: 3672 - DNA, 1083 bp, Homo sapiens
ctgaggctggcataagaactgcctcattcatgtttttttcacctgaaagcttgaataatggccacttacctgtgtgtgttctacttagagatgtctaacagcactggttgctgagccatggagacattaatgttaggcagttgatactgactaatctctgagctcagagctattgttagggcactgaattttccagataaatagcaatcttgtctgcctccagaggtttctgtagaagagaattgaagctggacaggtatttggctgtctagggtcctgatattttttgtttgaataacataaatgtgctttgaatgagagataggcagtaaggacagccctgtgagtccgtactgcaggtgtggggcccagttgcccttccggcctaaatgggcactttgcattttcctagaaaacattacaccccttgcttgggctcctgccaagtctgactactgctttttttttgcagaggtgaacaagaaggaggtggtggaggctgtgaccattgtagagacaccacccatggtggttgtgggcattgtgggctacgtggaaacccctcgaggcctccggaccttcaagactgtctttgctgagcacatcagtgatgaatgcaagaggcgtttctataagaattggtaagggaggaggccatgcagtccctagcttgggagcttgggagctggagagcagggagcagcgtgtgcatggtttctcagctctgtagcaggcagggagctgctgtcttgggtttagtttgcctctcgaacagaaaaatacctgggatcagacttggccagccatctggtttcagccggaagctaacaccctcattctgagtccaggctagtgggtggtggctgaggacccagttggttgaggagtccaactagaaaccaggagaggtagcagaataattaaacccctataggggtggcaagggcctctggccctgggtggaatgtcccatttccttcatcactgagtgggcttccccagggcagaaaggtttgtcccggagcaagaattttgtttgaatgcgtgtaacttaaattaaccttgtggacctctgctcagctc

SEQ ID NO: 3673 - DNA, 1154 bp, Homo sapiens
ggggcggggccagatttggctttatatagcggacccgtaaggccgaccggcctctaccggcgggatttgatggcgtgatggtatgtgttgtaatggcggccgtttcattgtcaccggcgtcggcacggctgaatccgcgacgcatcgccgccatcccgtcttggccggcgccgggggtttgctttaggggcacgggcgacccagcggggacttcagtctggcctattttctggaaagtcgagaggcttgtgaagagcgcttggaggactggctttgggcctgcaggtcggccagagagaggccgtaagggtgggagcaggcttggaggcccggcgtttttaaagccatgagtcatttctaagtttcgacctcaccaattctatcattagttgggattagggcccataacctgcttgtctgggtagaaggaccttgggtggaggttctcggcgccgttctcattgggaggtaaagaagcttgggggaggggagtgttgtggagtcctcctgaatatctggggccgctggtgcactccgaaggcctctggagctcgcagaaaccacagatgatgaacttattgacgggcggacagaaactgtgtgctgattgtcacgttctgatttggctctgcggagttctttggcctgtgtgtatcagtgtaattagtgtccgggcaccggaggcagcctatagcttaacattgctagctgctacccagcgtttgtcccgggagtccctttctttagcggtcaaaaccttgctaattggcatataaagctgcctgttaagcagtttttagtgccactacttagtgtatttttgtgtggttagataaaaaaaatgggtcgttttcttacaggttgagaggatttgaaataagattcagcttaaattttgtcgaatacaaaagcattcttgacacgtgcgagcctggaagagataatgacctttttattcggcttgctgggtgtctggtcaggattcttcagtattgctgagatttggaacttaagcagctgggaactagagaagggggcactgctttggtttgggtgctgacggtgatttttttcccacctagtctcacagaaagttctccgctcccagacatgggtccctcggcttcctgcctcggaagcgcagcagcaggcat

SEQ ID NO: 3674 - DNA, 1154 bp, Homo sapiens; identical to SEQ ID NO: 3673

SEQ ID NO: 3675 - DNA, 1117 bp, Homo sapiens
gggaggtctccctagaaactgaggcaggtgcgatttttggtcaggtggctgatggtcccagcctacttctcgtattttcttgtgggcccatctgctggtttcattcagtggaaggtttcctttcattcctcacctcggtgtgatgtggggtggcttcctgtggtgtccttgcttgaggacattgtctggcctgtactggcttgtcagagcccatgctttctggctaatgtgcttgattttagctttgaagtgagttctctggttttggggcagggggcgaggtagaggcaacagcctgagggggatgcggccaggccccctccagccgcagacctgcctgacaggtctggagtacaccccacccccttcacttccttagaatgtgcactccccacaccaggggacccagatctggtttccacattccagccctgcatggaatgatagagatgccacacccagcccactctgaggatggagtgcgcaggatgtggccaattagaaaggccctggaggggggtgggcggcctgcatgcctctgccccatcagggggccttcctttccctctgcctctgggttgtggatgctgcgactgctgccacggggctagaaaggcctgccaggccgagcaagctccttgggcatcctgagtgcagtaggggtggcctctccagcacccctgccgggctgcctggaggagtcctccagctgtgtccacaaagcagagtgtgagcgctgtggccctagacaaggcaggacaacccactctcctcccctgcctgtgttcctcactcctttcagcgtctgagccatagttggtcccaccatgggctggccctgtgctggtgctgggcagcgctaacaggcagttccagctgtgatagaaggtgggtgcccgtccccacccagctgatgagaagagattgaaggggaggggggcgaaggaaggttttctagaagaagacaccttgcccgccctgctgagtaggtcctgggttgggacgggtttagagagatggtaatggacagtcggtggttcagcttcacccgaggaacttcctgtgatgacgggagtgctcgcgtgggtgctgtcctgtcacggcgtctctagccact

SEQ ID NO: 3676 - DNA, 1158 bp, Homo sapiens
agcagtagctcacacctgtaatcccagcactttgggaggctgaggtgggcagatcacgaggtcaggagatagagaccatcctggctaacacggtgaaaccccatctctactagaaaaatacaaaaaattagccgggcatggtggcgggcgcctgtagtcccagctactcgggaggctgaggcaggagaatggcgggaacccgggaggcggagcttgcagtgagctgagatgcgcccgtctctccagcctgggcaatagagtgggactccatctcaaaaaaaaaaaaaaaaaaaaacaaaaaaacaagaaaaaaacaagttttggtgtggttatggaatagcaggagcttttacttttctggtgggagtgtaaattgttgaaaccactttggaaaagagtgtagcaatgtctagtaaagttggaaaacatggacactctatgagccagcagtttcagttgtgggctggtaacctaccccacagaagagctgtatgcatgtacaggaggcatgccctaagatgtctgcagcaatgtggcttgtcctggcaaaaattggaaaccttaatgcccatcagtaggcaaatgtataaatacagcgtggtactctttacatttacatgaattttagggacatagcattgtgtgagaaaaacaagttgcagaagaataaagtaataaaattccacttaagaaactcagaaatacaactgaaatgttgtttaggttaccaagcatggtgtggtcaatcaagggagtgctaagttaaggggaagttaacgcttgtggagtagggaaaggtgggattatacagggggcttctgagtaccggaaaggttattccttaagctgagtggagggtatataaaagttattttgtatgtattaaatatgtaataaaaatttttctccagaagttttattattttttaagagtggaaaaataacacaaatgtcatctccatccaaaaagtaattcaggcactgagtacttatttttaaatgcgttttgaattctttgccaatgagagatgcctgaaacacggaaaggaaagacctagtgatccttgtttgtcccatgacattggcattgagaggcgtctgcctctgtagacatgacagtgtatctcaagagcagcctgaaggaggttttagtggcat

SEQ ID NO: 3677 - DNA, 1185 bp, Homo sapiens
tgggaccgtcgctctcgccgccgcggccaccacagacactgccgccgccggctcctctcagccacggaagctgcgggcccgcccaccacgcccgcctcccgtcctgaagactgtccgctggagaagtgacggcggcgctagccaatcagaggcctgatcggggtcgtgatcggcggactaaagggcgggcggagaaggaagcggcatgaagaaggcgaaaacggcggcctgacttcctgtgactgacggcacggcgcagccaatgggcaacggggagatgacctcatctctgaggaaagtctggaactggctgagctgcggcgagggggttggcgacgagccgggggcggagctctgggccttaaagaggccgcagccctgtggtcaccctgtgaagggaagggcggtggaccctgccggatcttgcgaagttgccaaggggtcaatgcccaggcgcgagtaattactgcattaatcccagaccccatcccgattcttgtcggggactgaagggtctccgcctggggctccgaagtcgatcatttcacattcacgcttcccaaaacgagacacaataaattccgctctggcctggagccttgaattcccgttacggtcccgccccgccgaggcccgtcgccttgtttctctgagtcagtttccccaacggtgaaagggaggacgctgacacctgcctgcccctccctatctgccgaggccgtggagatcagcagcagcgaaagcgctctgggcttagaagaggaaaagggctgcgtgagcccaagagcttgcatcggaaggctccaggaagagcatctgcaaaaaagaggattccacgggatgacccccgacaactcttggaattctaaaatcctatacccttgcccgcacccattcgtgtagtgaaggggcgcgcgttaggcgcagaggccacacgctccgcaagtgaacccgggcacctctctgaacctattccgggctgagggcggggagcgggtggctgcccgatttaaaaacatgtatatgtatgtgtatgtgtatgtgtatgtgtatgtgtatgtgtatgtgtatatgtatatgtatatgtatatgtatatgtatatgtatatgtattatgagtgaagtccatgactgcaacagggagaaaggagaaaggcgaaaggggagagagcaacaaggtaagcc

SEQ ID NO: 3678 - DNA, 1128 bp, Homo sapiens
ttagcttgtagtccaatataaagataaccacaataataattttagtaatgataccaacatgtgttgaccattatatgccagccactttgacatgtattatctcatttaatcctcacagctttactaggtaggtaccataaagatccagtattacagaggaaggaattttaacccagaggttaacttacttgccccaaaccacccagttactatcattcctgaacagcatgttcttctttctacttcacaggcatttatattccagaggatgacaaagatgccccagagaagtttcggggtcttggtgtacgaattgaggatgatgtagtggtgactcaggactcacctctcatcctttctgcagactgtcccaaagagatgaatgacattgaacagatatgcagccaggcttcttgaccttcactgcggcccacatgcacctcaggttcaaaatgggtgtcttctggcagccctgcacgtgtgctttctgagtgtctctgtgtgtgcattaatatatgcattccatttgggagcatagcagctgtgtgaatgtatgtaattgtgtgtggggggttttttgttttaagtagttagaagtctgggaaaatgaatttttgaatagtatgttactgcagctttggtaacattaattctatagaattaatgatcagagcaagtttaatttttaaacataaaggtcttggttacacatgtccatgcattccagttaacacatttaaacatatagaaaattcacttcttctttcaagtccttccctttctatacttttgctgagatcaacccaatatcataagaagtttgtgtgatgcctgtatttttagctaattaccaaggtctctgcctatgcaaaaattcatctttcggtgattgtgggcggccaatacataccttctgtaactcctccctacctattctagatcctgcatatctactggagccatatgagccctcaggggcactggtgtcctgcagtcttactagtcagccacagtccaggttccagcaacactagctacctaccaaacaaaacacttctgagcttttcttgccatttggttgcctgggacctggaaagtgtttagattcttgataaagatggaaatgga

SEQ ID NO: 3679 - DNA, 1232 bp, Homo sapiens
caagtttgtgccctttttttttttttttttttttttttgagatggagtctcactctgtcgcccaggctggagtgcagtggcacgatcttggctcactgcaacctccgtcccccagattcaagcgattctcctgcctcagcttcccaaacagctggtattatagacacccgccaccaggcctggctaatttttgtatttttagtaaagataggattttgccatgttggccaggctggtcttgaactcctgacctcagtgatcggcccgcctcggcctcccaaaatgctaggactataggcgtgagccactgcacccggccagactaaattattttaaactataggaaacaaattaaaagatgacattaatttctgtgttcatatactcagccttttggagaatagaacatacgtgtagtctactgttgtctttggtataataagattaacgtaatatccaaaaacttttgtttggtggttccctgtggccaaagagatgataactgcagctgcagcctgaggtcctaaagagtatgtgtgtgtgttacaagcagaatgcactgttccctctttttgtctttgcagtggaatgcagtagccctctgggcctgggatattgtggttgataactgtgccatctgcaggaaccacattatggatctttgtaagtaattggaggaggatgggaggaagttgagaaggttgcagagattgtggctatcttgatgtgactgattttcttcttcacacgaggagatagcaagcctactctgagcactcggtcttctgtatctagtctgttggtgtgtttgaaatagagtagtttttttatgatgtcctggaggcatacccagctctcagaataaatctactcaatctaaagatggcagggacacatttagaattaattgtggacgacaggcactgttgatttttcctgcatatcttccatcttgtacctagactcaaaggtagaaatagtgaaaggaggaaaataaactttgagctaaaatattctgaggccaagcgcagtggctcatgcttgtaatcccagcactttgggaggccaaggcgggcagatcatttgaggccaggagttgaccaacctggccaacatggtgaaaccctgtctctactaaaaatacaaaaattagctgggcgtactggtgcatgtctgtaatcccagctacttggcaggctgaggcaggagaattgcttgaacctgggaggcag

SEQ ID NO: 3680 - DNA, 1241 bp, Homo sapiens
gacagattttgaaattgaaggctgatcaattgctattctcattattagctttaccctaaacatgcctgagtactggagttcaggtgaaaataggccgccatgatcagggcagcccgaaagttcaaactgtctgagcccctgttgggagtgagcaggcggagctccctttcacaaccaccaatgacttttccctctcacctccctaataccaccaggcagctactggcacctgtcaggtgggcatggttgagtcagagggagagcctgtccctaagagggggcagtaggcaagaagtcctgtaagatggggaggggaaaggggaatcacagcgacagccaagctagtgtcagtgtcgtcacctaatcctggagcacactgtgatcacttaggttctaactaaagttgcttatgtgtttaagcaggttttatgtctcaaacaggaaattatcttggaattaatcagagtaatttactttgtctttcaggtatgggcactaggaaaagacttcttccatcaagcttaattgttttgttattcatttaatgactttccctgctgttacctaattacaaattggatggaactgtgtttttttctgctttgttttttcagtttgctgtttctgtagccatattgtattctgtgtcaaataaagtccagttggattctggaacggatgctctctcttgtgtatgtgaacaaagtgaacataaatgaagagtctccccttccaaggctgaaaactcagcttttgaaagtgaaatgtttgttcatcggggccagagcagggttgtcctctgagcgcatcacttagtgacgaggaatccaacagctcaaggcagagtgtggatcaccggctcccgaaaacagcagtcagcccttctttctcctgtgtgacagcagtgggcagctgaaagagggaagaatgtgggattcagtcatcaaacccagttctgagtcctggttccacagcttgggtactgatggcaatcttggccaagttgtctctctactctgaactttcctcctctgtactgtgggcttctgaggactaagtggcatcatgtgggcacagagagaagctttgtaaaatgtaaaaccgctatacaaatgtgacctttggttgtgtatgacagcagtccccaacctttttgccaccagggattggtttcatggaagacgatttttccatggaccgggggtggggcgggggtgtgcttggggatggttttggaactg

SEQ ID NO: 3681 - DNA, 1172 bp, Homo sapiens
gagcaggcaacaccctgggagaagaaggctgtgaacagcttcaggaggtgctggagggcttcaacatggccaaggtgctggcgtccctcaggtagggaactcggggtggccccagaggtcggggtcaggccattcctttctttctttcttttgttcttgagatggagtcttgctctgttccccaggctaaagtacagtggcgtgatctcggctcactgcagcttccacctcctgggttcaagtgattcccctgcctcagcctcccaagtagctgggattacaggcacccaccaccacacctggcccctttatttgtttctacttgtatttattcagaaacgttgggtgcactcctgttacgtactaggtcatacactaggcatcagggctataaggatgggacagtcagggcttctgtctcgtggggtggagacagaatgagttgtccgttcaacagaggagctcgtacgggctgagcggggccaccctgtagagtggtggagttggggaggcctctgaaggggtgaggccagatctcatcctgatgtggtggggcctggggagtgatgggggtgggaggtgggggcagccagaaggggctgcactcgggattgttcttaagacgctgactctagaaaggaagagaccatggggcctggggagtctacctggaggtgaaggtgggtggccggggagtggccatctcctggatccaagtccggttgggccatcagcatcgggctccctgtgcccctcgcatctccaagtcggcctcattcgtgtgtcagatactcagtcgtgtctcctcggtgctaggccctgagctgaggctaggaactggggactccgaggtgggctgaacctcacaggtcccactgtccctgggaaatggtccagccttcctatggggcaaggacacccctactcttcttcctcccccacacctgtagcttcctgaggtcatgtggatgtgggcgcccctgccctggcatctcaacctgggcagtgttcctgccaagccctgggctctaggtgtgacaaagctgtcttcgttttctgtctctccatgaaacctggggctccttgaggacagggacaagatctgatttttttttgttttttttttttgtttttttgtgggggatggagtctcgctctgttgcccaggctag

SEQ ID NO: 3682 - DNA, 1153 bp, Homo sapiens
tacccatctctatctcttccctcccacatgtcaccctactccatcctgtaccagccagactcaactttttgtttcatgtaagttttggttttgttcagattatacaattaatgcaggtttattatagaatacagaaacattcaaagaacagggaaaaaatatatcctcactttcggccgggcgcggtggctcacgcctgtaatcccagcagtttgggaggccgaggcgggcggatcacgaggtcaggagatcgagaccatcctggctaaaacggtgaaaccccgtctctactaaaaactacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcaacagagcgagactccgtctcaaaaaaaaaaaaaaaaaaaaaaaatcctcactttcatataaccccagggatataactactattactttcagggcattttatttctaacacagtctttttttttttttttctgagaaacagtctcgctctgtagcccaggctggagtgcagtggcaagatctcgctcactgctacctccgcctcctgggtcccagttcaagcaattatgcctcagccttccgagcagctgggattacaggcatgcgctaccatgcccaactaatttttgtatttttagtagagacggggtttaccatgttggccaggctgttcttgaactcctgaactcctgacctcacgatccgcccgccttggcctcccaaagtgctgggattacaggcgtgagccaccgcgcccagcctagtctttttttttttcctgaacatagctgagttcattttgttttgtttgttttttgaaacggagtttcgctcttgttgcccagggattagtgcaatgccacgatctcggctcactgcaacctctgcctcccaggttcaagcaattctcctgtctcagcctccctaatagctgggattacaggcatccaccaccacacccggctaatttttgtatttttagttagagacagggtttcatcatattggacaggctggtctcaaactcttgacctcaggtgatcctcaggcctcagcct

SEQ ID NO: 3683 - DNA, 1193 bp, Homo sapiens
atcatggccctggccattgatgtgtatgggctttctttccctcatgcagccccttcttccccaggctggatgttgtgggtagggaggggtgtgtgtgtgtgtatttggtttgctgtccttttttaaaggattccaagccatgtgaaacttcccttctggatgtgattctgggtcgcaagtccttatttatatgtgaggctggggaatgggctgggggtattggcagtccttttgcagggcagtgtgtgtggtggggtgacaccgctgtggcttagcccaagacactcccagaggaaaacactgcagaaggaactggtttgcagactgtggaaggatctgcagttttgtttttgaccaaaaaaataataataagttagctctgaagggcagagggaatacccaagcccctgatgcctatgagaagtccctggacttcaaccctcctgttgtttggccttagcccagagggagctgctcacctgagcacccttgggggtgggcagagaggcagggtgggattttagagttagtgtctgtgcgggggcagccctgagcctggagttgagactttggggtctcttagtttggaggtgttgagtgcatttgtgcccctgcctggttgagagcttcttggtacctcttgccaccccttctcactgccctgacccaaccccactggaccttgatgctgcgaggagtggtgtcctgacggactcagcactcccgcctgatgtattggatcataggagagcacttgctctcctgcctctgccaggagagggcttgttcctccaactctaggaggccaggcaagcatggacaggagccaagggagcagggtcattaactttttcttctttgcaaagtgggcacttggcatcagggtcccaatcaccagaaagcaccaaagcccctggcaccccacccactccatcctacccagggaccccaagtaggcaactgttatggcagtgggtccagcccaggccagcactgccagcctcctctccctgcagtaggcaccagctctacctcccccggcaggcaatgtcctggcttctcagcccagcaccatctgttcccctagacttctcaggggccagcccagtctgggccaccctttgtttccctcatcctcggctcccacacaggtgacagacccagcagatagcttctctctgggaaaggttgga

SEQ ID NO: 3684 - DNA, 1177 bp, Homo sapiens
tgaccactggcattgcccctatcaactctgacccaccttgtagtagcgggcagtgtcagggacggggccaaactcctgagtgacggcattgcgcacggagttggccttgccgttttcaatgttgatggcaccaatgagcaggttgttggagatgttatccaagtgcccacggaacttgagccaggggccagcagctgagatgtggtcagtggtacacttccctttgaccttgggtggtaagtagagaggacagaggtcagggcatggccctggaggggtggatgacaagccctccagaggcaggcagcaggccccggggcccaggaggggtgacagaggggtgagaggcaggcaagtcttcagacacgtgttctgtggtcctggtgcttccaccctaaggccacatgggctcaggccaggccttcatcccctcaaaggcctctggctgctcagtctcccttatggggcagaggccgcccaaagttgggacaggtcaatgttcgctcacccttcaggcctcagctgcaagatcagccacagacctcatgctggacacaggagcccaggacatgcctgggtcctggctgatgactgattagtctcttctgtcacaggggtgcctggagaccccttaataagcagcataaataaatatctgacacagattggaggcctctggccacaccaaaaaggcttgtttttggtcggtgccaaacacaagccatcccatatccacgggtgcccaactgtgggggcaggagttgtccatggcttccagagcctgtgtggacgtgccaggtgtggagcctgctgtgcaatcacacacactgtcccagcccagcctgagctgtactcacctgcccacacccactggaggtggctctgatcagctgctgctggatggctgagggccccagacggaggctggccagatctagctctgcccagttcggggccacagagaagggggacgctggactgcgttgcgataccctctctgctctgcagccaaacctcccttccatctcccacctgcgtcttgactgtgctcacttcctccaggttcatggcccttcccgatgctcaggggacggggggccctggcagggtggggctgtcctgccgtccccatgctgctgaccttgatgaggatctgcaggtcctccaggtccttgcc

SEQ ID NO: 3685 - DNA, 1188 bp, Homo sapiens
tggagtctcgctctgtcgcccaggctggagtgcagtggcgtgatctcggctcactgcaagctccgccgcccgggttcacgccattctcctgcctcagcctcccgagtagctgggactacaggtgcccgccaccacgcccggctaatttttttttgtatctttagttgagacggggtttcatcatgttagccaggatggtctcgatctcctgacctcgtgatccgcccgccttgggctcccaaagtgctgggattacaggcgtgagccaccgcgcccggcccacctccagaactttttcacggggcagatatggtggctcatgcctgtagtcccagcactttgggagtctgaggcgggcggatcacgaggtcaggagttcgagaccagcctgggcaacatgctaaaaccctgtctctaaaaaatgcaagagttttactctgtcgcccacgctgcagtgcagtggtgcagtctcggctcactgcaacctctgcctcccgggttcaagcaattctgcctcagcctcccgagtagctgggattacaggcatgcaccaccatgctcggctaattttgtatttttagtagagatggggtttctccatgttgatcaggcttgtcctgaactcccgacctcaggggatcatcctgccttggcctcccaaagtgctgggattacaggcgtgagccacagcgcccggcctgctcagctaataatttttgtatttttagtagagactgggttttgccatgttggccaggctggtctcaaactcctggcttcaagtgatccgcccgcctcggcctcccaaagttctgggattacaggcgtgagccactgcgcccagcttccttcctcttcttgatggtcctttagactcatcctttctgactttccaggcatcccctctgcaggctacacatccctagacctccaggtggggctcttgtgagatgaactgcagatccagcactctcctggctgaccagcctgttgctctgtgtccttctgttttttcactgagatataattcacataccacaaaattcaccctttcaaagcatacaatttagtggctttgtatattaagagttgtgcaaccatcaccactatcttttttttttaattacattatcaccattttgcaactccttatgaagacagatctcatcaatgatcattaacttttta

SEQ ID NO: 3686 - DNA, 1180 bp, Homo sapiens
acaaaagttctccacgtcccaactagattagctagttacagagtgtggacacaaaggttctccaagtccccaccagagtagctagacacagagtgtcgactggtgcattcacaaaccctgagctagacaggctgctgattggtgtgtttacaaaccttgagctagatacagagtgccgattggtgtatttacaatcccttagctagacataaaggttctccaagtccccaccagactcaggagcccagttggcttcacccagtgcatcttgtaccggggctgcaggtggagctgcctgccagtcccgcgccgtgcgcccgtactcctcaacccttgggtggtcgatgggactgggcgccatggagcagggggcggcgctcgccggggaggctctgtctgcgcaggagcccacggcagagggtaggctcaggcatggcgggctgcaggtccgatccctgcccagcggggaggcagctaaggccctgtgagaaatcgagcgcagcgccggtgggccggcactgctgggggacccggcgcaccctccacagctgctggcccggctgctaagcccttcactgctcgggccggcacggcctgccgctctgagtgcggggcccgccaagcccacgcccacccagaactctagctggcccgcaagcgccgcttgcagccccggttcccgcccgtgcctctccctccacacctccccgcaagccgagggagccggcgccggcctcggccagcccagagaagggctcccacagtgcagcggcgggctgaagggctcctcaagcacggccagaatgggcgccgaggctgaggaggcaccaagagtgagcgagggctgctagtacgctgtcacctctcatcacctttcatagttctatcacgtggggtttatatcctcattacatataaagaaactgaagcccagtgaggaaaggtgacctgtccaagtccttgtagttagccaggaccaaactgcagttctcctgattccaactccaatgatctctccaggacaccatagctacccagtcagaaaaacaagaattgtgcctggggatctggtgcggtgggtcaggcctgtaatcccaacactttggtcacgcctgtaatcccaacactttgggaggctgagtcgtgaggaccatttgaggccaggagtttgagagcagcc

SEQ ID NO: 3687 - DNA, 1174 bp, Homo sapiens
tagccttaagtgtgcgaatccgaggagcagcgacagactcgagaccacgctccttcctcgggaaggaggcggcacctcgcgtttgaggcccgcctgcgtttgaggcccgcctgcgcttgcggcccgcctgcgcttgaggcctgtctgcgtttgagatctcattgggcgtgattgaggaatttggggaggtttttgggcggtattgaggacgagggggtccgttagtcagcatagaatcctggagcgggaatccctcaccgtctaaatggcgtcgggggcgggacctccgggatctggcttccgcgggccgccgccggccctgaaacgtgagggatagctgagatgaggcagctactgggatggcccccatgcgcatttacatgcagtccgactgccgagctttcgaggcagcaggatttaccgtccacattcctcactactaaccaagcttttagaacagatctcacaagaacctagaggtcggtattttttcgatttaaatttgcctgttactgacgttaacgtctttcgcctagtgagcagtagccaacatgtcagggtgggagtcatattacaaaaccgagggcgatgaagaagcagaggaagaacaagaagagaaccttgaagcaagtggtaagtgacttcagcatgtagtgccattcggtgtgtggaagaaagaccttccctgcctatctctgctggatggactttgctgtttgatggcctgcccttctcctcccagataattctgaaattcttttcttcctttgaacttcgcagagctaccctaggctcttatatgcagatcttactctagtgtgccctaagttttttttggacactggtagtttgacatcttttggtccctgataaatggccatgaccataggtattttttgtcatcttaagtggttcaggtgagacccttctcatccaggaaagtagtgttaccattccaggacctcagtgtaaaaatgcccccaccctgcaataactacaccaaccaaagaataaacgcaagcaacacagttacaggaaagtgattgattccctcactatagcctccacgtttgggagtgtatgtgcaggcaacacagtaacacataaaacaaaggaagagaaataggggtacatgtaatcttcatactggttaatttaactcctgagcagaaaa

SEQ ID NO: 3688 - DNA, 1216 bp, Homo sapiens
caggctggactgtagtggtgcagtctctgctcactgcagccttcacctcctggggtcaagcgatctttcacctctgcttcccaagtaactgggaccctgtgctgccatgcccagctaatttttttgtttttttttgtttggtagagatggagtctcactatgttgcccaggctggtctcgatctcctagggtcaagtgattctcccacctcagcctcccaaagtgctgggattgctacagatgtgagccactgtgcctggcctgaatatacgtattgttaattctctgatttcaatggcagggactgcttatacttctaatgtatacttactgcattctggtttttgttaaaatttgatatttatgcccattactttcactgattcattacccctgaaggtagggatcttgccttattttagtgccatatacaaattcagtgcacatattttgagcaactaataggtactgagcacttatggagcttccatttagtggtaagtaaatattaattgaattttttttttcagtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtcagtaatattttaagatcagcttttcccttatatatgagaatatcagtactctgatcaaagaggactgtggagaaggaagcaagttacatcttgtctaggagtatgctttcctccataaggggaccttgctcgatgtggactttgttaaatgggttaaacagctctggggtgaaaaagggtccttctgttagtcttgtggtaaaggcagccactgacattcttctgatttttctttccatttgactccctgcctctgatcaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggtgggcatatttccccgttctcttaaat

SEQ ID NO: 3689 - DNA, 1204 bp, Homo sapiens
ttgaggataagtggtggatttaatgtagggcttgagaaaatgccattgtgtatgactgactggtgtttgaatcctttatcatatcccagggccggtctaggacacataattgtgtgtgcctaggcattcttcccagtttgttgtggctgccctgcccaagcccacatcacctattagcttcacgtccttctctccgcagccaccaaaaccctcaacaggggcatctctgagttcatcgtgatggctgcagacgccgagccactggagatcattctgcacctgccgctgctgtgtgaagacaagaatgtgccctacgtgtttgtgcgctccaagcaggccctggggagagcctgtggggtctccaggcctgtcatcgcctgttctgtcaccatcaaagaaggctcgcagctgaaacagcagatccaatccattcagcagtccattgaaaggctcttagtctaaacctgtggcctctgccacgtgctccctgccagcttcccccctgaggttgtgtatcatattatctgtgttagcatgtagtattttcagctactctctattgttataaaatgtagtactaaatctggtttctggatttttgtgttgtttttgttctgttttacagggttgctatcccccttcctttcctccctccctctgccatccttcatccttttatcctccctttttggaacaagtgttcagagcagacagaagcagggtggtggcaccgttgaaaggcagaaagagccaggagaaagctgatggagccaggacagagatctggttccagctttcagccactagcttcctgttgtgtgcggggtgtggtggaattaaacagcattcattgtgtgtccctgtgcctggcacacagaatcattcatacgtgttcaagtgatcaaggggtttcatttgctcttgggggattaggtatcatttggggaggaagcatgtgttctgtgaggttgttcggctatgtccaagtgtcgtttactaatgtacccctgctgtttgcttttggtaatgtgatgttgatgttctccccctacccacaaccatgcccttgagggtagcagggcagcagcataccaaagagatgtgctgcaggactccggaggcagcctgggtgggtgagccatggggcagttgacctgggtcttgaaagagtcgggagtgacaagctcagagagcatgaactgat

SEQ ID NO: 3690 - DNA, 1208 bp, Homo sapiens
caggccaggcctcaaggacacgaagatgaattacaacaagtcccctggctttgaggtgtccataagcccagggggagaaagtatccaaacaaatgatcatgttactctgtgaccagtgctctgatgggcacaggaggggtcagggagaaacactgtgtgatggtttttgagccaggccttgaaaggaaagaaactcctagaggagggtgaggggcatcctgggcagagagggtgcagcgcgagcagagaggtggaggctctggaacagtagaatgcttgtggagacggcaggaagaccacagcaaagggaaggcaggagccaggtctggaggcttggtttcaggcttctgggtgtggagcgccatgggaactggatgaatagtgcgttgcaggtccatgcacttgtcagtttgttcatttcctggaggcttctagccctgggtgtccatggcccttgcagatacttgctggtcaggaatgagccttctgaggcaagactgctggattgtccaggcagggctattgatgccagccccttaacttaattctgcccagacaagaagatgtttgaggtgaagcggcgggagcagctgttggcactgaagaacctggcacagctgaacgacatccaccagcagtacaagatccttgatgtcatgctcaaggggctctttaaggtgtgtgcaggcagggggcagctcatggcaggtccagtctttgatctaggcactgatgggtaaacaggagttccctaacgggttggtgttcagggacaggggaactgcgcacacgtaagacttgaagtggggtttaaataaatggggatgggagcagtctgtgatgggcactgcgaagccactcagccctggcgggattccctcaggtgctggaggactcccggacagtgctcaccgctgctgatgtgctcccagatgggcccttcccccaggacgagaagctgaaggatggtatggtctgccctgccccgccctgtcctccgcaccacccgatcttctctagctgctccttctctcctgttcttgtcactctttttttctccccggaagtgccctcttgtggcaccttctaagtggtccccttgggcagatgggcgtttcgtgagtggcctccctaattaactggctactttttagcaatagcatttctttttttttttttttttttttttttgagacagagtctcactc

SEQ ID NO: 3691 - DNA, 1160 bp, Homo sapiens
tcttggggtggcagggaggctaaagcatacctcaggacagtcagtggtgggtccagcttcggctggaggttctttctactgaataacttctacgggctctgtcattagcaggatttgtataatttgaagcagagctgggcaactgcagagcaatggggaagccagcccagtgtggtggcaagacctgggcaacttgggaccagcctgggctgtctcttgccagctgttgttatcagaaccaggctcttcacactcagatccttgggccccccatctcagaatgcccagtggttgaaaggatgaaacctggaatttaagtgacttctcagtgatgtgtgcccttctctgacggttccttgttcatcccatgtatttactgactgcctgctatatatgcagagccaaagagtggggcctggtcttgaactatctcctcatctgccccttctggcacctccttcctcctgggctctttcctctaataccgtcatcctctctccaacctggttaatcctgtcctttctgccctcaaatgggcaccttcaaagaaacaaatagaactactccactcgctccctctctccctccctttactgccactattgattgttatagtcacttgctccaggaagtccacttgctgagtcttactgcagacagagcccaccccctgagctgtaaaggccctagggcacatgtttgtccagctgcctcttgcagctgggattgttaggtcactatagcgctaccaactgcatataccactgtgggagtcgtgctggtggcggtagtggtcacaggtaccaggggcagcagtgaaggggtggctctaatgccaagtccagtgaccagtgccagggtgcccagtggtggcaacagtggtgttttcagtgtgatcttggacattgctcctgtctactcagctgctagtctgtgagctccctgatatcctttaagacagcgttttccagcagcggcactattaacgtttggggctaggtaatcgttgggtgtgtgagtgtgaagagggctgtcctgtgtgttgtaggctattttagcagcatcccggcctctccctgccaggtgcctgtagcagtcccccagttacgacaaccaaaaatgtgtccagacattgccagatgtccactgggagggaaaac

SEQ ID NO: 3692 - DNA, 1100 bp, Homo sapiens
gcgggggtaggcagctgggaagatgacgtaatgtgctcccagccaggcctggaggcggccagcggtcgcaggtggagggtggcctgttaacccttcactcccaggccagtggacggacttgcgtgtggcgcagatccaacggagaaggcagcggctcctttaaacaaggcggagaaggttaagatgatgaccggacggctactccaggcattcgctccgaggccgcggggggagggacctcactatgcaaatctgagctgctgatcgatgacgcgccatcaccccacgcaccgcttcgctcgcccattggctgagatgagcctggtcccattgacaacaaacaggggggcgcgcggcctggaggcggggccgcagggggcgcgggctggggcgggggaatcccgccccgccctttctgtgcggcgcccgggcgcaacgcaaacatggcggcgggtggcacccgtcggtgaggcggtgccgggcgggggttgtcgggtgtcatgggcggtggcgacggcaccgcccccgcgtctccctgagcgggacggcagggggggcttctgcgctgagccgggcgatggacgacagcggcgagctgggtggtctggagaccatggagaccctcacggagctgggcgacgagctgaccctgggagacatcgacggtgagtggtgggtgggtgggagtgcgggggccgcgcggggaggaaggggttacggcggcgcgcccgggtgcgcgtgcgcccaccccccgacagccccggttcgcgcgggaagaaccccgtgcgcacggtgcccccggcggtcctcaacccttccggcgctgcgagcgtgagcccgacccagctgcgccgctccgggaggccgtgggatctggggcgccgcggggccgaaagcggcgcgagggtcgcgggttccagagcgcggggctagggacgtcgcgggggcgtctcagggagcggcctaaggagagcgcgtggccgccgcctccctcgcgcgcccacacgcggtttccgtggtccgctctcccgccgcccgcgaccgcgcgtcgcacctgtcactcccttcctggccgcggggacgtctttgggattcccggg

SEQ ID NO: 3693 - DNA, 1209 bp, Homo sapiens
tattatactttgagttttagggtacatgtgcacaatgtgcaggttagttacatatgtatacatgtgcagtgctggtgcgctgtacccactaactcgtcatctagcattaggtatatctcccaatgctatccctccctcctccccctgtatttttttagtagagacggagtttcaccgtgttagccaggatgatctcaatctcctgacctcatgatccgcccaccgtggcctcccaaagtgctgggattacaggcgtgagccaccgcgcctggccttcaaagtctgtttttaatagagcagtcatttaaaaataataagtgggataagagagacagcctttcaaacatgggatgacaagaatctgatgtctgtgttttagcattaggcaaggattggagtccctggctgcagcaagggtggggctcttgcatgggtcgggactctggttgattgcagcatcgtagagcctaactgctgggaggtggggcaaccccagcgagaaactcctaggaggaagcacctccctgtggtggttggggcaacttgtggagcagggtgcttgagaaaagagcacagggcttagaggaaggagtaaggctcctatctctgtctgctactcgctccccacctgcctgagatggtgtgcaggtcaccccctctttggacttggacttttcttcctgtgtaaaaaccaccaccaagaccgcttttcaagcacttactgccaggcactcactatcccaggtgatttacatatattaactcacttaaaacagtgcttgaaatggctacctcacagggtgattttgaagattatataacacagtgtgtgaaagtagaagtgttaaaaggaaaaataagggagccacagtgttaatgaagttattttccagtaaaaaaaatcatgtttaaactttgtatatgaatatatacatacgtatatatacactgaagtaaatagtactgaaaacagcaacaacagctttttaagcaacattccagcaggttcctcttgtaccatgtatccctttttatcctaacactttgcatgcagtcctggcagatttattatttatttatttatttatttattttttggagatggggtctcactgtgttgcccaggctggagtgcaatggcgcgatctcagctactgcaaactctgccttccagattcaagcgattctcctgcctcagcctcccaagta

SEQ ID NO: 3694 - DNA, 2104 bp, Homo sapiens
gggcgaccggcgctcctgcaacgactgccagcagatgattgttaagctgggtggtggcactgccattgccgcctcctgaccaccaggctcagcccacccctccacctctctctcgatttctctctctccccctcagcatcttcccgctgagagtggtggggaagagccttgtcttcttagctgtcacctgccgaggcttctgggccactcaggccagtgcacccctgggcagagccccttaaagctgctgtcactagatgcccatggtccagggcctggtgggcgtgagaggataggtggcagggcagaaactgggcagccctgacttgatagcagcagggggagctcccaagctgccaagcccctgcctccagccttcctgagtttctctctcctgaaccctactctctcctttttgcttcctcagtttttatcaggctttctctgggggacagcagtctctgagcaccagggagcagttgccctcaggcctgtgcccagcatgccctcccctttttatacgaatgttttctaccagtgtgcttgggtttgccatgatgcgaggctgagttgctgtagcgtcttgattctctccctgggtctgcgttccctcccctgggcctgactgagcctgctcattgtttttccctttattacacaggacagccaggggaggaggggggcccagccctgggaggctggtgggaggcagggggcaggcctgcggatgcatgaaataatgttggcattattttttaattttttaaaaaataaatggtatcttatttaattgtcctgttccttcccactccccgcctcctaggatgttagcccaagctcagggtaggcccagggggctgggagaaatgaagccacccatggggactggggaccaggggccttcagcatggcttctaggttccctcctccccctaccccatctcctacctccacagtacagactgtccccaacttaacagtggttcaacttaaaccatgtttcaactttacaattggtctgttggggtattaaatgaatttgtgacttaggatattttcatttatgatgggtttatcaggaagtaaccccatggtaagttgaggcatatctgtatatatttaaacctaattaattcttgagctgaaaataaataaaccaggatggcagggaccaacccctaatccctccccagcggcaagcccctcttttcagagtgggcagagggttgcctatggtgggcactaggaatgaggtcccctgcctcgatgcgggtcctaggagaaaaagtcctacttttctgggtccccaggtgcagcacctcccggagactgtttctcccatggcctcctgagtgatgggccctgcctccctgtgcctcatcctcaggctggttggagcagagggtgggcaggagccccagcacagactggggggtgctcacagcagggccaccttgatgcaggctggaatgttatccctggggtgtgcttggaccccacctgctttctttctctcctgcccctcccctactctcactgtaatttatggaccctgcccgcctgcgtgttgtgtgtatgtcctgtgccttttctcactattgtttgggtgtgggagggggtggtttttcactgaaaaggggggtacacctatagctttcttgatgttcaatcaatcagtcactgtgtcccagacatattcaataaacacagattggtaccacccagcacgaggtgtgtgagggtctgtagtgcgactgctgtggtgcccagccaaggggctgcgtgacttggcaggcaatgggccagggactgagggcagccccccaactgctgagagggcccctggcttcagtctaatgggcctcccttgtccaccttccttccggtgcctggcgcaccctccagcctgggataaaagggctgtgggtggcactttgggggtcagaggtcactgtatccaggttccagcttgttccctggatgtaatgcaggctggctgacagatttggggtgctgaccctctcccccactgggtaaactgctccttagtttctccctccctgaagtcagtgatcctctgagccaggaggctcactggcccaca

SEQ ID NO: 3695 - DNA, 1349 bp, Homo sapiens
ctgtgtcctctaggacccacctccaggacctcaaggaagtgacacacaacatccactatgagacttacagggccaagcggctcaatgacaatggaggcctccctccggtgagcgtggacacagaggaaagccacgacagtaacccatgacgaccacttctctgtgtcatcacacatacccacttcacacacacacatcccaaataccaccaccaaccaccttcttcctctcaactctgtcccacaggcctgtctggtatttgtggagcatcttgtctgtgtgtgtgtgtgtgtgtgtgtgtgtgtgtgtgtgtgtgacagagagagagcgagagagcctgtgtgtgtgcatgcaggggtgaggtattttcactgccctccctggagagtcccttgtaagtttggctcctccatgcctgtccattatctgtctcctttccttgtgtcccaaaacaaagctgtttgcctcactcaggagatctgggggaggtttcatttaaaagtgctgggagcaggtgagccacaggcaactcttctctcggaacctgcacacaaactggggctatagagattctccaaggacagatggcagtggagctagacctgagtagggggcagggagttcaggacaaccctcctgtaagttgggggtggtctgggggtaaggctggggcttcctgggaaaaggaaggccatgagaaggcagagaagtaggccagagctgggttcttgcagaaagcatcagtgcctacaaatggagctccacccttcagtctgtgtcgtgttcagtgtcacaaagctaccacctgtcaccagagcctactgctgctctccactcaactggcctctgctgccaggccactgcctgtctctgcttccgactttgtcttctttctccctttccctccttccctcatacattgctttctctccctctcctgcgtgtctctgacatctctcacttccttttagatgaatctactttaggttcattcctatatttagcatttatgcccagtctacttccagaaatgactttagactgcctttcacataaaatcacaaaactacaggacagtacaaacagattgccagagaaatctgggtcaaagaaaggaataggaaagaaagtttctgtagtcaagcacctgaacaggccctgagctcacaggcagccaatgtaaagagggaaacacagtgagttatgcagttcccagtgtccagttaaaggaagcacacatgctagtcatgtgagacaaccttttattgggacatcaggttctagaactaattctaaagaagtatcagaaacaatatacataatttgtctttcttagtaatttggcttca

SEQ ID NO: 3696 - DNA, 1154 bp, Homo sapiens
ccagccactggataaaactgatgccaagaacaagtctttttacccttacatccatgtagtaaataagtgtgaacttggagccgtttgtacaatcatcaatgctgaggaagaagaacagaccaaattagtgaggggcaggaagggtcagaggtcactgacccctccacctagcagcactgaaagcaaggcgctcccggcctcgtcctttatgctgcagggacctgttgtgacagagtcttcggttatggggcacctggtttgctgtctgtgtggcaagtgggccagttaccggaacatgggtgacctctttggacctttttatccccaagattatgcagccactctcccgaagaatccacctcctaagagggccacagaaatgcagagcaaagttaaggtacggcacaaaagtgcttctaatggctccaagacggacactgaggaggaggaagagcagcagcagcagcagaaggagcagagaagcctggccgcacaccccaggtttaagcggcgccaccgctcggaagactgtggtggaggccctcggtccctgtccagggggctcccttgtaaaaaagcagccactgagggcagcagtgaaaagactgttttggactcgaagccctccgtgcccaccacttcagaaggtggccctgagctggagttacaaatccctgaactacctcttgacagcaatgaattttgggtccatgagggttgtattctctgggccaatggaatctacctggtttgtggcaggctctatggcctgcaggaagcgctggaaatagccagagagatggtgagtatgagaaatctcttaccagcttgggatttttatttcatttggttccttttcttgcatgtttttgttcttacatgtcacatgattattcctccaaattaaagtgcctatgcccatgtgatggacagaaaatgaaataggtaatttggaagatttgtatagacttctaaaatcgtttttcattttttgaaatgtataatgcttatgaagcatattattatatttcaagtttcttgggccacatcttttctaacgcacactttccagttaggatatttattctttggatctgtttcataacttatcctggggcagatcatcaacatcatcatcttcatttctttctctc

SEQ ID NO: 3697 - DNA, 1128 bp, Homo sapiens
taacagcaagaatgtccccacctgtctccagtgagagagcaggaatatgccgggcacagtggctcacgcctgtaatcccagcattttgggaggccgaggcgggcggatcacctgaggtcaggagttcaagaccagcctggccaacgtggcagaaccctgtctcttctcaaaatacaaaaattagccacgtgtggtggtggtgggcgcttgtaatcccagctgctcgggagactgaggcatgagaatcacttgcaacccgaaggtggaggttgcaggactccagcctgggctacagagcaatactccaactcaaaaaaaaaaaagagcaggaatatcaacctccatattgtccctggggaacaggtcggaggccatggtgcccacagtctcccggcttgggcagatgtggctgtggctgagtccttcagcggcgctggacccctggcagcgccacccatggtgcagggaggctttgggatggccctgcggatgctcacacttggcttccctctccctgcggcaggagagcctgtcccgcctcctgtccacctgtggcctcgtccagtctgtagagttgcaggagaagccggacctggctgagagcccaaaggagtcaaggtcgaagttttttcatcccaagccagttccggtgagccgccaagcccggggttccactagagtgaggggggtggggcactgtccccagtgtgttgggggagctggcagtgggacatcagagcattctctggtcctgagcccatcctcaccgtgtgtggtgtaagagactgtctgggtgacaaagcctgcgattctttgccagatttgccacatccttgcacttcctgcctggctttttctgtcccgtgttaaagctcacggaccgtctctgctggccacctgcagggccttccccggctcccctcctgcttccccactgagggagctccttccccaggcttgggggccgggtctccaggagcactgttgttcacagctttcccagtggccctggagcccacacctcctccccacacagtggcatctggcatggtgtgtgcgcccaggcctggcttccaaaaacctgccctggcccagggcgacccctgtgtttcaccgcatccctcccgt

SEQ ID NO: 3698 - DNA, 1137 bp, Homo sapiens
aaaaatcaaacaaaaaccactaaaaaaccatacatatatgatataccaacaagattttcttggtggggggcctaaaccacctgattctcaagttcacgtggaaaaattacacaggtaagaatagcaggaggtcaggcacctgtaattccagcactttgggaggccgaagtgggaggatcacttgagaccagcgtgggcaatggagcaggaccccatctctacacaaaaaaactaaaaaattagccaaggccaggcatggtggctcaagcctgtaatcccagcactttgggaggccgaggcaggcgaatcacgaggtcaggagttcaagaccagcctgggcaatatggttaaacctggtctctactaaaaatacaaaaattagctgggcgtagtggcaggtgcctgtaatcccagttactcgggaggctgaggcaggagaatcgcttaaacccgggaggcagaggttgcagtgagccgagatcgagccactgcattccagcccaggtgacagagtgagactccgtctcaaaaaaaaaaaaaagatgtgagggtgatctggctgcgacatctgtcaccccattgatcgccagggttgattcagctgatctggcggctaggcgggtgtcccctcccttccttaccgctccatgtgcgtccctcccgaaactgtgcactcggtcgaagaggacgaccatccccgatagaggaggaccggtcttcggtcaagggtatacgagtagctgcgctcccctgctagaacctccaaacaagctctcaaggtccatttgtaggagaacgtagcgtagtcatcccatcaccctttgctctcttttcggactcggcccgcctgcacccaggtgaaataaatggccttgttgcgtgtacacacacacacacacacacgcgcgcgccgagcatggtggcacactcctgtagtcccagctactgggaagactcaagtggaagggttctttgagcccaggaggcagaggctgcagtgagccgagatcctgccactgcaatccagtctggccaacacagcaagaccctgtctcaaaaaggaaaagaaaaaagactagtagaaaaactctgtaaaagagccatgaagggagacggtcccgtcagatgcgaaaatcc

SEQ ID NO: 3699 - DNA, 1282 bp, Homo sapiens
cgcggctgtggtcgggggcgggcgcacccggtcctccgcgtcgctcccggatcgctacctcccccgcctcgagctccactaggccgaggaccctaaaccccgaagaaaggaaaggcctctcaccgtcctttcgccgccgccccgcgcttcctgatgagttcgtccagggagatgtccgccatcttgctccgccgagcaagccgaaagcagtcgagaccccgcgagcccgccccttcggccgctagggagcgacgaactacttccggcgtccgcggaccaactctcgcgacagccagctcaaagcaggcaagaaccggaaggggcggggacgttccccgtgagccttcgcggtgctggctgctcatctgcatacggaagttcggcacattatgaattatttattttcctcgagggaaaaaattaaatgaaaagcaacaaaatacattattaacaagtgagacaaacttcaatggaactggatcatgacctcaacagtcaactacgatagtcatcatacgcctaatgagaatagaattcattacctaggaaataaactaaaaacgtccttatgccttaaacttatgagtaaggaaaataacgattcggggtgacgcccgaatcctcactgctaatgtgagacgaatttttgagcgggtaaaggtcgccctcaaggtgacccgcctactttgcgggatgcctgggagttgcgatctgcccgaccttattcacgcctaaaaagtagactgactgtggggtggtcgtgttttttgtttcttgttggtaggtggtgaatgcgtttttttcgttgttttctccgttactcaggctgccagttgcttggcagtcttgtcgctggctgtggacgctctgcacttcatcaccgtccccagctgcgctttgagccggtctaaggttgcccacagtattgacgttgggacccacgaaactggcaatttccatgtgtgcggccttacccagttctcccaaacttctgcgtataaccgcttctctgtgcttcagaaagataagtccggccccggcctcacacagcagctcagttcgtgacagcgtttaatatgtaaaatggagcaaataatttatagggcgttgggagagttaaagagactaattcatttacgtgttaaatacagggaatggcttttgcattgatataaccccagcctccagcatgcgccagacctgacgtaggtgttcggcacatattttgtccaatcactctaaaaatacactccatgcccttagaacaggtggggttatgtcc

SEQ ID NO: 3700 - DNA, 1473 bp, Homo sapiens
ttccacccccagaggaggagccgctggtgctgatgtgtggccccccacccatgatccagtacgcctgccttcccaacctggaccacgtgggccaccccacggagcgctgcttcgtcttctgagggccgggcacggtcacacggccacccgccccgcgcaccccacgccctgttcacgctcacccagtcacctccccacatcgcacactggggccccgggttcagcctggcctgcccgtgccctggtgaatcacctggctgagcagttcccctggagccccttcgggagcagggctgtgtcccagatgggccacggctgagccttcagagtacgtcctgcctggcacttactggtccttaccagagacgcccagccccatccctgtcctcatgacccctcgtccaccccccacacacactataaggctgagggctgccagcagccccgtctgcccaccattcccggccgtggaccatagtcgggatgtcagcagacacacatgggcagcccaaagctgcaggtgccagggcccaccccagcctcgcctgtcacccccactcccgcctcagggccaggcccaggcctcaccacctgacgctgcatgagacattgacaccagaaagccctcttgggggcactgctccctaccccagggccctggccagccgggagcttggctctcctctggctagagtgggaagagggggctggccatggggccctcccagaacctcagcatttccttccagcccatccaaacactgaggcagccttggggaaccccgagctggggggttggcagcccactgcaccgcctcagggttttggggtcctgggctggggccaccatccctgatggcagaactcccacaaccacatgtatttattcctctgtcctaaaccgtcccctccttccctcacccccagcacagggggattctgagcagtgcctcttgtctgagggacatatcagtgacctcgacgttgcctttagactacagttgtgttagcctcttgcgtattggctttttcagagtcatttatgagcagaaaaaaaaaaagtaaaactttgctaatattaacccttctctagctcctcgagggtctgtgacctgcaacacaaggggtggggtcaggaaagggctggggaagacctagcattttttttttcttttttttttttttttgagacggagtctccctttgtcacccaggctggagtggcatgatctcagctcactacaacctccacctctcgggttcaagcgattctcctgcctcagcctcccgagtagctgggactaaaagtgcccaccaccacacccagctagtttttgtatttttttttttttttttttgagacggagtctcgctctgtcgcccaggctggagtgcagtggcgggatctcggctcactgcaagctccgcctcccgggttcacgccattctcctgcctcagcctcccaagtagct

SEQ ID NO: 3701 - DNA, 1196 bp, Homo sapiens
tacccaggaaagatggggagggggtgcccagctccgcctatgggaggaaggtgggctggggggagtggagtctcctccgagaagcccatcctttcccgtgctgctttgcagtttagcatggggcctgcatcaggctctgcactcccacgctggaggccagagattcatgtgaatttccagtcgtgggtcatggccagagcatcctttattctctttcccaaggtcgggctctctgttcaccctcttctgcctctgggagcctctggactcatttcttccctcctgcgctcctcagcgggaagtctccatctccttccttcctgtagattcctcttctccacgagaaagttttagaggcttttccaatcccccaaggcaagactttgaattacctttagttttaggccctgatttatgtgggtttgacaacaggctttaaaaaagtttttttttggtaaaatgcacataaaatgtaccatttgaggtctacagttccgtggcttaaatccatttacactgttgagcaaccatcaccaccacccatctccagaactctttcattccgaagctgaacctgcacccattaggcactcactcccaattcggtccttcccagcccctgcagccactgttctacttcctgtcgctattaatttgactcctctaggtgcctcatctaagcaggatcatacagtatgtgtccttttgtgactggcatatcacactagcatcatgtcctcaaagttcatctgcgttgtaggctgagtcagaatttcatgtatatacgcatgcatacaccacattttctttatcccttcatgtgtcagtggacgtttgggttgtttctacctttagagacaggttttttttgttgttgttgttgttttgtttttgagacagagtcttgctctgtcacccaggctggagcacagttgcatgatctcggctcactgcaacctccgcctcccaggttcaagcaattctcctgccttagcacccccgcccgcctccgagtagctgggattacaggcgcgcatcaccacgcccaactgatttttgtattttagtagagatggggtttcacatgttggccaggttggtctcaaactcttgacctcaagtgatccacccacctcaacctcccagcatgctgggatttcaggcgtgagccaccacgcgcggtctagagacaggat

SEQ ID NO: 3702 - DNA, 1139 bp, Homo sapiens
ttgaaccccacaccctcctgactccacagctcaagcgcctttccaggcctcagtctaagagcttgagggtggaagaacgaggcagcttgcagcagctggctttggggtgtcctttgtgatgaaaacacccctccttttagggagctcctgcaaactgatgccagcagggccaggcgagcatggatcacgtggacacggaggccctttgtcctgcttcgtccgtccaaccctatgccagtgagctccacgaagcagtgacgcctgcagagactctggccacaggaagtgtcagtatcctttggtgcagctgtgaatggtgcccaggagctgagcgtcttgtagtgcctgaaggtaacaacaaaaaacagaataatgggactcttatgtcaaagcgacacagagccaagtcagagagcccccagtggccacagctggagcagtttgagctacaaagtcaataaagtaggacaggttgagtattcctcttccaaaaatctgaaacccaaaaaaatctgctctgaaacctgacactttgagtagtgatgggacactcaaaggaagcactcattagagcattttggattttggattttggggttagcgaggctcagtggataagtataatgcaagtccttcaaaatacaaaaaatataaattccaaaacatgtatggtcccaggtatttttttttttttttttttttgagatggaatctcactctgttgactaggctggagtgcagtggcgcaatctcagttcactgcaacctctgcctcccaggttcaagcaattcttctgcctcagcctcctgagtagctggcattacaagcacgtgccaccacgctcggctactttttgtatttttagtagagacagggttttgccatgttggccaggctggtctcgaactcctgacctcaagtgatctgcccacctcagcctcctaaagtcctgagattacaggtgtgagccgctgtacccagccttatcccaagcatttcggataagggatactcaatatgtgttgcatcatagaccaagtacagagtaaacatttcttagtccctgctgatgcaaataaatgattcaataaatgaataaagacgagacaaatcttccatgcagaagagtttcaaataa

SEQ ID NO: 3703 - DNA, 1154 bp, Homo sapiens
agacgtttacaacagccagtcactcagagcgtctcataaatggtggtatgtgttaatgggaaaacaattcaaattataaaaataaagtattcgcaattttcctaaaatatattactgtatataccaatatagtgtaattcgaggcagagatacgtaatcctacatgaaatcgattctcaggtggttctgggtagtcttgaacgtctttaggatgccatggctaatgtcataagtgtgtgctctttctctgctccattgcatgcttcagatgcatgagaggagcttcatttcctgacgttgtaaaagctctttcatgtagaattcaggttaacgggttgcactgccaagaaaggaagtaggtacagaggaagcatatctcagatccaagctagagattaggtcttgtgttttgtaattaattaattatattttgcttaaaaattgtatttcttatttgacaaaaattatatacttatggtgtacaacatggtcttattttcagatgcataatacatttctacctgcctgttgtacagtaaacctcttgaacttcaggtgttttttttttttttttgtctggtttgattttatgaattgccttgactggtgactaggtggtagacgtaggtgttgagctgagtgatatttgatggctctttcactgggaagatacatggggggagggacagtttaattaaggaggaaatggttggtcttggaaatgctgtatttgaaaggccttggtacactcaagtggagtgccctggaagaccactaggtatacaacaggaattatggcaaggatgggcacagctccggcagctttcgtcatgtgggggattgaggccatgggaatgggcgacaggaggcatgcaggtggagggtcctacgaggagtgagaaacaaagctcactgcagaagccaagggaagccattctgaaggaggggcagtcacctgtgcaaccgaaggaagttcaagaggtagaaatagtacagaccataatctacaacttaagctgaagggatgagggaaggagagggcaggagcccttgggcaactaagggaaattaagtgtaggtggataatagaaatccacagataattttagctgtaactcttagcctgaagttttcatatattaggacaattaaat

SEQ ID NO: 3704 - DNA, 1111 bp, Homo sapiens
ctttcccaaaggctcttccaacccgtgggttttggggtccaccgccaccacgagagaggcttttgaacaggtgcctggctgtgttcagaaggaagctggcctgtgtgcttctctccggtgggctcagccgacgtgtgagacttgttctgttaccaaatgaaccgggctgccacgctgtgacaggcgtttgtcctctgctttatttttactttgaagctcaaatgcgagtactaagtgttcacctcagcgttcgaatcattggcctgtaaccctgtgggctgcttcacgagaattcaggacctgcattttcattctaaaaagaaatgaacagcttgtgaaggagttttttggcttcatagtttctattcatgaggtagtgttacttctttatccccctaaagacaaaatgaagataaagggggattgccaggaatgggtttaaaagcacaaatgtggtagcttatcatctacaccatggagagtgaacccttacgaaatgaaagtcaaatgagaccatccgagaaaaagatgcgcataggcatttgtaccatgatcaaccccacgcacatgaaaactgtgaccaagtgacgtgcctgggagctttgacacacgagccgtgtgaattcactaggaaacatgtaataaagtcatggaagagaaaatcgtgtgtaaactttgcctttaactttagaccgcagtatattataatacatttgatatctgaaatatctttacttttttaagagtaagattccatatgtctgtctggaagggagccatggttattcacacgaatatccctgtcacttctccagaggtgtcaggtaactaacacgagcattctttgaagactctgggcacatgaatgatacacagaattgaatgtttaaatttccactgagtcctcatgaatcatttgagactagtaccagctgatcttgtgtacaggctcagggtcagtgcccaagggctcccgcgtgtgtgttctgatcttcagtgcgtagcacattctccatttagaaaagagtggtcagaataattgtggacggtacagtggctttttaaaactacagtctttaggtgtaaggtttggcgccgggagcaattttat

SEQ ID NO: 3705 - DNA, 1201 bp, Homo sapiens
atgttgcccagactggtctcgaattcctgggctcaactggtcttcccacctcatcctctcaatgtgctggcattactggtgtgaaccactgtgcccggccaagcctttctaactaaatgctaattgagctccttctgtatgccactggggcactgtgtatttctctctctgtgtctgtgggagcagggaaggggaggctcaaaggtgagagcacccccacccccgaggatctcgtgccctgggccccctgcgcacagagccttggcccagcccacccctcacccacaggatggtgcaggagcagtgctgccacagccagctggaggagctgcactgtgccacgggcatcagcctggccaacgagcaggaccgctgtgccacgccccacggtgacaacgccagcctggaggccacatttgtgaaggtgagagccaaagaccatgtggggtcgctgcccgtccccactagtcggcagacccaggccctcccagccaagcggcactgtctgtcagcgctccctgcctcaggccacctttctttgtgagcagctgggggttcctgggccaggagggaggtggaaaaccccactgtttctccccctccactgtagccgtaaaccccggaggacacctggggccgagtctcccacgaggccggggggtgaagtgagctggccttgccctgagaaccgcctgtctccaggcattgggcagatgcagaagtcaaagcagggctcctcctgggcttccagaatcttcttctcaattcagggtcggcaccctcaccctacccaggaggctctcaggcttctctacccacagactcgtcagggtccagaggtaaaaatgggccctcactaagacctctgataagatctgacctctataacgaccctaaaagaggaaactgaggttcagagaggcccagcctccaaaatggcctctctgcagtcctgtcagggacccagacgggatcctgccctgaaggtaagctgtgaataaatggcatagtcctcttccctgagtgctcctaggaccctacgtgctagcaggtcactcaggaccgctatggccgtggaagggctgtgtctttgcaagaggtggaaaggtgcctgacagcattgcctacaggcagtaaacccaaggtgtccaggccatccctcccttaccacccagccagcaaggaaaacaagcccggccag

SEQ ID NO: 3706 - DNA, 1193 bp, Homo sapiens
tttcaaccatttagggcagcaattttcagaaaagaattttctagttagaaatactacaaagattctagtaaagactttgtggccaagcttaactaaggccagtatttctgagccagtcaagattcagattgcaactagtacatatttttctgatgttttactttaagtcgttaaagagttcatcaaaaggtgtgatgctattaaagcctagatctttttacatcttttgcactttgtgtggactgggactgtttttgccaagaatgcatggaatggggtaaaatacaataaagcaaagaatctgagtcatgggaaacttcaggaagtactcaaagaaagctgttggaagcagttagctctgcatgtaaatataacctctactgctagggttgctatatttttcctgtaaagagccagataataaataatttaggctttgtaatctctgtcagatttctcagctctcccattgtagtgcaaaaacagccatagacaatatatgaatgaatgaacatgtctaattttgtcttttttaaaaaacccaggaacttggatacgattggtgttgctgttgatttgattcttctgtttcgtgaactgcgagtggaacaggaatctctgttgacaggtagcatgcaatataattcatggattatttatatctttataaagggttcaaaaccagtactttgagtattaacatcattcattgaaacacatgttctgtatttcatgagatagggaaactttaatagtgaattattaaagaattataaagttgtatcaacttcccttcctgaatggctgaattttgttcctttcacatttgtatgttgaagtctgtctgttccagttgctataacaaaatgccttaggctgggtagtttataaacaacagaaatgtattgcttacagttctggaggctggaaagtccaagattaaggtaccagcagattgggtgttttgcgggggctgctctcgtcttcatagatggtgcctcttgctttgttctcctgtggtggaaggtggaaggcagaaggcataaacaagctctctgggccccttttataagggcactaatcccattcacgagggctgcaccatcatgacctagtcacttcccaaaggccccatcttatactagcaagttggggattagatttcagcataggaatttcggaggggcacagat

SEQ ID NO: 3707 - DNA, 1329 bp, Homo sapiens
gtaaagtttcacagtaaagactaccaaatgagtggttaaagcacctggctcagggcacagattgaatcctagcttagactctcagtggttttgtgacactggacaagttaattaacctcaccaagccttatttacccacctttaatgtgaaactaatggcagtacctgcctcatggagtttttgtgaggattaagtgatacaatgtgtgtaacatgcttagctccgtagaaaatggtgaatgaatgttagcccgtttcactttgctgttgctagtgtcgtcgatgtgttcatacaaaaaactgagcatgtctaaaatgtccaattattttaatgttgaaagtaatggacataaaaggtgcattaagcaattctagtttctgtggccaagacacatcaaagaaatgaagaatttaaaaaataggtgattgatgaagattaactttattcatgtttttcctagctagacattagaagcaaggtaaggaatttaaaataataatattcccttaaagttgctttcctaggtatttttagcattgtataatttaagtattatagattcatgcagaaatcctttatgttttacagagttacactgttagaccttatgatagccaagataacgagtgatgagccactcaccaaggatgacatccctgtgtttttgcggcatgctgagttgattgcaagcacctttgtggatcagtgcaagactgtgctcaagctggcctctgaggagcctcctgatgatgaggtaagggaggcagatttcccaatctcgggtaaaagagaatggacagattttctaactcagccaagtcctgtatgagaattcttttttaaaagctttaaaaaatattatgtaagtaatgtatccatatatgagaatagttggaaaatttagataagggaaaacagtgtccttattcctaccatccagagtcaatgacttaggcaaattctggttaattttctagacagatgacatcagatacatgcacacagacgtagacatgtgcacatatgtatctattaaaagtggagcctttctgtgccttctgtttgcaggttcccattttttcttcggaatgtaagctctaggagggcagaaattttgactgttgtgtccatagtactatgtatatggtaggcactgaacaagtatttgctgaatgaataaataaataatacattgtaaatgtctttttaaataaatgccaacataggctgggcacggtgcctcacacctgtaaccccacttctttgggaggccaaggcgggaggatcgcttgagcccaggaattccagatcaccctgggcaacatggt

SEQ ID NO: 3708 - DNA, 1181 bp, Homo sapiens
tagcattttcaaacagtactgtctttctaatctaccaagatattgcatagaagttcatatttacccagaaattatgcaagttcttaaagccagagttttttcaaccacagcattttacaggatttctgtggacaagaaattaatgtattttatgggatatttgtatctttaaagtggaatttgcatgctgggaatgctttaaaaagaaagtatttgcataaatgtcatgtacatagctagtaattttgaacatttattccactgttggaatgtctttttgcttgaataagaacttttctgactctttgctccaagaagacacataatgacacataatcttgcattcttgatggcagatgtctgctgttagtgaaaatgatgagtcgtgtacatatttcatacttctgttttgttcttcatagttttgtttttctctttgacttattacaagcacagactctttaaatttattgaaatattttattctcttacagttatttataacagttaaataatttctcttaaaatatgctaaaaagttatgttttcttttctttctaggaggcactggctacaattaggcttctcgacgtcctgtgcgaaatgactgtgaatactgagctgctcggctatctgcaggttttccctggcttgctggaaagagtgattggtgagtgaaatatcacacattgtatttttagctaagaaatctttggcttgtcatactgtaatataaatccaaatacaaatccttaattttcagtgtactttgggaattttgtgaatatatttttttgagaggaatcacagtgttgtaacagttcaggcaggccagataaacctgagcccatgtgtttgttcagccacttcccttctgttaactgaagattccttctcagtaatgtgaggataacaatgcctgttatgcatatagtagatgtttcatcaatataggatgtgatgaagaaggtggggcaggcaggtttgcgatgatgattgtggttttatattactatagctttgtaaaatgtggcagtaaatttttcccatttacatttagtgaacacatagaatggtgttttatacatattatatatacaaatcttatgagaaaaaggttttaaacaagaaaccattgttaaaagtattaccaaccttgctaaaaagctgtttgcaaaata

SEQ ID NO: 3709 - DNA, 1132 bp, Homo sapiens
ccatcctcactgataagagccccagtgtgcggagtggattcctgagccagttaaaaggttgctacagcagtggaggcctggttggagggtggtgataagcctggaaataaaaggacatatgtgagagacagtaatttgataaagagtaatgaaagaggaagctttctttcaggtagcttattctgtttcattattgttgttttccttttgggaaagaagttgaattttcattgttggcttatgttttcaagggtgacctcagtattttattttattttatttttttgagacggagtcttgctctgtcgccaggttggaatgcagtggcgtgatttcggctcactgcaacctccacctcccaggttcaggcgattccccagcctcagcctcccaagtagctgggactttaatgtttttatattggtgattttgagcagagactgtattaccatctaaaacactacaagcctagcatgtaagctccatgtctgtttgctcctcattctctccagggcccctggcacagttccgggcccacagtgagtgctctgtaaacttttagggatgaacaaatgaatatttttaaatctgttcattgttttcacagttaaacttttctaagcacttatgtaatactgtgtttacttaattttcatttctcaccaacctttatggaagactaggtgataactggttaaattgtaatacagtatcataggtataatctcgaaaaggtaaaaatcaaatgtaacgaagcattataatccagtgactggaacattttatgcaagcctttgctctttatttatctatttttttatcatacacttcttcccagtttttgcttagtccttgttagcagttacattaaaatctgttttaagttccacctcagggaatatcaaaagttggttacttttctaaatgggcctttaattaaaattttaaaaaattagaccattgtgttagattttttaaaatgttggctaaaacagaaaaggttgatttcagtgcagttgggctgaaactatacttaaatagattaaagtataatctggcttttaaaaaaaacacatctgactgggatgaagtagttgtggtcttaactgaagcaggtgaatggaccatattc

SEQ ID NO: 3710 - DNA, 1180 bp, Homo sapiens
gtgactcatgcttgtaatcccagcatgcttgaagacatagcagtagggactatcgacaaagaaacacacagagggaaaaagaattccacatttgggaggctgacgcatgaggatcacctgaggtcagaagttcaagacaagcctgggtaacatggtaaaaccccgtctccactaaaaatacaaaaattagctgggcatggtggcctggggctgcaatctcaactacttgggaggctgaggcatgagaacctcttgaacccaggaggtggaggttgcagtgagcagaggtcatgctactctcaagcctgggcaacagagcaagaccctgtctcaaaaataaataaaataaaatagcccaatcaagcttcattgaaaactgtaatgcatgatatgaaaaatgcattagatgtaatcaatagaaaattagacattgcagaagaaaagattagtgaacttgaagacatagcaatagaaactatccacaaagaaacatacagagggaaaagaattccacaaaatagaggacatcaatgagctgtaggtcaacttcaagcagcttaataattggaacctctgaaggagaggaggtaggaaatggaaaaaaatttcgaaaaaataatgatcaaaatttttccaaaacaatgaaagctataaacccacagatctaaggagtctacaaactccaaacacaagaaccatgaagaaaacaccaaggtacatcatactagaatcgctcaaaaacagtaataaagacaacatcttaaaagcagccagaggggggaaagacgtattacatagaaaggaagaaaataagaatggcaacagacttcttatcagaaacaatgcaagtgggaagacagtgaagcaacatctttaaagtactgggatcaaaaactgtcaaccaatacccgtatgtaaagcaaaaatatatttcaaaagatattttcaacaaaaatatactcagtgaaatatctttcaaaaccaaaggttaaataatgacattttaaaacacaaaagtaggggaaaaaacatattggcaacacatttgctctgtaaaaaaaatgttaaagaaagtcctccttgcagaggaaaaataacagatgggaatgtagatctacacaaacgaatgaagaacactgaaaatggcacctccatgggtacgtatgcaagattttcaaaa

SEQ ID NO: 3711 - DNA, 1180 bp, Homo sapiens
cgggcaccagacggagaccagacagaggccagtaccaggcggggctgagaagttagccggagcatcctaggatgccaggaagccttccagaggtggcagccccgcagcccccgctccttcccacagctgacctccagggctgcagctgcagggcccctgcgtccagccctcggacctgccacgtcccagggccccactgccaggcaccgccccgtgccggccctgtacaggccacatctgctgcagcagccatgccagagctccgcctcccgggctccgtccccatggaaaccacggtggggggggctcctcctgcatttggcccgctgactggtttccattagagccggcctgctttccctgagctctgcccctgcagttcaaggcttcccctgggggtttcttcccacatttaccgagcaccagccgttccgtgccagggaacccagcggtctgggccccgcccgccctggccagcacccaccggtggtgcctgatgcccggcaccgtggctgctcccctgtcctttcttatcgaaggccagctgctgctgggtcctggtgtcgtggactcagccctggatctgagtcagggcactgggctcccatcctggctgggccgtagaatcactggtgggcacttgaataagccccttcctctctccgggtctcagtttacccatctgtaaaatgaaaagctccatctatttcttgagttccttgcaatgccgagaaagaaagacaaagagaaaatgaagccacagtacactgttgctgccgggttctcagaactgggatttttgtttgctttcaaagagggttttttttttctagggaaagagtcatggaatttgaccagagatgattgtttgaggggccaagagccagccagagcccacggacatgcagcatggaaggtgtagccagaagcctgggcagcgatacccgccggtccgccttggcatctgcttggcacccagtgacctggctgtgaacacagtgagcggaggcaggaagtgtgcctgcgccggaatccgaagggctctggaaaactccccaagaggtttccggaggtcagaaatgtgggcagaaaatgagatccagcttttaaaaacctggccgactcatcccccgggagcctagggaggcctgggaaggtgcctccaccaccacgtggctga

SEQ ID NO: 3712 - DNA, 1198 bp, Homo sapiens
gactgtgtccaccctcaggtcagtacagtttgtgaatgttgatgaaaattggggctccccacatccctcccttctggctccaccctctgccgggcgtgcctgaaactggacacacacacacacacagcacacacgtgtatatgcaccagccccagagctctgggggccaaggagccaggcaggtgcttgctgcccattggcacgggctcagctggatctagcccggcctcctgctccttgcccctaccagcctctttctgcggccaccagcctctttctttctgcaactgagggaccagggctccaagcagctgggtttggtccaggtctggccctgttttttgggctcccttctgcctgagttgggtgacactcctgtttgcaaggatccagctgtctcaagggccctgggaggggaggccaggggcagcctaggggaccagtgactacagggcaatttgcagtacctgctgggggctcagcaggtaagatgtcccctgcctgctgctgtctgtcatggctgtctggtggccatggccgggggcgggcttgtcatgctgggaactgctcagaggctgcggccagcctgaggcccctcgccctggcgagccagcccccgagtgcagactgtcgccgatgattcttgcctcctggggcatccgtgcggccatgtgggttgggcaggactggcattctcccctccccaccgttgccatggccaggggcgggcccacctcccgaggctgtgcggagaggaccccaggctgctgcatgtgagcagagcagccggtgtctggcccggacccctctgccatctggggcccggcgtgtttacaggtcggccttgcccgccagactctgcagacgctgccccggggcctttgtgtctgcacgcagggctgagccaccagccgagcggagagtggggagggacacaggtggggagtagggggaggcccctgggggaatcagggaggaggggcaggacagaagagaaaggggatgaagggtaacagaggaaggagaacagcgtggggacaggagaggggcagggactggggaagaggagacacaaggcaggacagggcagggcagcccttggaactgtggggctgtcacagggataccagcctgggggagcagctaaccccaggcatctgacagggacctagtgggtcttggccaaggcgatctggtc

SEQ ID NO: 3713 - DNA, 1244 bp, Homo sapiens
gtctaccgtgctgaccagggtgaaggcacggcgagggactcctcccagacgtgcctcttgtgtgccagctggctgtggctcgggagcagacgcaggcctctccattgtccaggggagcctggcggcgcatccctcctctcccacctcctggcacttccagctgggtgtcccacatgttggattccgtccccaccacacttccagagaccggagaactgtgcagggcctaaggccgtttggatgaattgtcaaaacaagatgcttccagttacagcggcaggagcgggactgggagcacgggctgacggctgctggtgcctttcttcccacctcgcttgcctgtttccgcttgacccttcctccagctccgatgagaagagtataaagcatcttcctaacgggtgtgtttgctatacgaacataatggacgtgaagtggggcagaaacccagaactcagcattcaaggatgcccaggagagctgtccctgttttaaagagctgtgttttgttttgtttcgcatttagagagcagacaaggcacccttctgctgcgctgatacgtttcttacactgggccattttagacccccagggaaacagccttcctggagcgttgtctggaggttccagggacagggcagcctcccagagccgagcaagagctcaaggtacaaatgagagatttgctataccgtgagaagtcaacaacttagccaccacttccccgcaatggaccatgtaacaaatacctcagcaggccctgcaaaaggccatgctagagctgaggcgcacagcctgtggcctctgtagttagggcaggtgggatggagactccttgagtgcacacacctgagcctgcccacacacaggggagcagcatctcgtatgacgtctggaaggaacttcggttgtgtaaagggagccttgaagatacgtgcaaaaggtgctaccccaatttggtgaaactgacattgggcacgtcttgggcttaggagaagcggccgatggtcccggcctgcagtgacaaacccccctccccgcaccgcccccagcaccccctctcctcttcacctcttcctgctggccacgaggaagccacttcctcagagagaccctaccagatgcggatggaaacagatgcaccaaagcaagccctgatgaaaccgcgacttcctaaggtctgtctcctctgaacttgcacctgggcctctctgtgtttggttccaagcacttcccacctcaa

SEQ ID NO: 3714 - DNA, 1211 bp, Homo sapiens
gattttaatatactttgtgagcttagtaacatttttttattcctcttaagataaactttttgaaaaaatatttgggaactaggccaggcgtggtggctcacgcctgtaatcccagcactttgggaggccgaggcaggtgaatcacctgaggtcaggagttcaaaaccagcctggccaacatggtgaagccccgtctctactaaaaatacaaaaattagccgggtgtggtggcacatgtgtgcctgtaatcccagctactcgggaggttgaagcaagagaattccttgaacccaggaggcggaggttgcagtgagccgagatgacaccactgcattccagcctgggcgacaagagcggaagtgtgtctcaaaaaaaaacacaaaaaacaacaaaaaacaaaaaacaactaatattaaagagcacagtctaaagtgtagggctggaatgaatgaatgagcccactaggcaagcaaaggctttcagggcaggtgtccctccgtcccacgagccaggcctccgcaggctgagtactgagtgctgtctgtctgaccaggacgtcatccactcgggcagcgccctcctggccccagccaccagggcggcgtgggagcagatccagcggagcgagggcggcacggcacagctgctccggcgcctcgagggctacttcagcaacgtggcacgcaacgtgcggcggacgtacctgcggcccttcgtcatcgtcaccgccaacatgagtaaggcgctggctgcgttgggggtggaaccctgctaccatcaggggtgtgccccagagctaggcccccatggggtgaagcaggtgggctcccggcccccccttggccatgctcttagaaaaatgattgtgaggccgggcacagtggctcatacctgtaatcccagcactttgggagatcgggacaggcagaccacatgaggtcaggagttggagaccagcctgggcaaaatggtgaaaccccatctctactaaaaatacaaaaagtagccaggtgtggtggtgcatgcctgtaatcccagctactcaggaggctgaggaaggagaatcacttgaacctgggaggcagaggttgcagtgagctgagattgcgccattgcactccagcatgggtgacagagcgagactccatctcaaaaaaaaaaaagccgggcgcggtggctcacgcctgtaatcccagcaatttgggaggcca

SEQ ID NO: 3715 - DNA, 1184 bp, Homo sapiens
gagaagtctccccacagccccacgggaggactgccctcgatccagggggcttccagctgctggacccaccctcgcctgtcccggccatgtagcatttcctcagctctgtccatctagtggcattattgctttaaaaatgagatgcttcctgggccatcagctctgcagagagccacaaagctccttttgggtccgtgtcagaattctgctccccagacggagatggcctcatgggctgctccagcaccagcctgtgcaatgtggtccgtgtggccagagagctggaggctaggggcttggcattcctgggacccagaagcggctaggagactgtcggggcctgcagcagcatgggagcagggggtagcagatggagggtccaagttctagggcaagctgaggccaggagacctgtccctagccccccacctgccaacgccagcgggagccaggacagcgggacatgggtccttcaggggacagcaggctggaggatgaggaggcagagactcaggctggaggccctgagaacccctgtcaccaggcggccacataagccacatcatcccctcaagcacccagaaactggagagacggcagtggaggaggggagggatctggggtctgatgtcacagggctggcctcggttttttgttttttgttttttttttagatggagtctcactcagaacgcccaggctggagtgcaatggcgtgatcttggctcactgcaacctcctcctcccgggttcaagtgattctctggcctcagcctcctgagtagctgggattacaggcgcatgccaccatgcctggctaatttttgtgtttttagtagggatggggtttcaccatgttggtcaggctggtctcaaactcctgacctcatgatctgcccacctcggcctcccaaagtgctgggattacaggcatgagccactgtgcccagctgggctggcctcgttttgtgcccactgcccagcagaaggggctcaggaggacactcagagggttacaggcaaagcagagaagctacaccttctctgggcatgtggggcatagagggaggtagagtttttttggaccctggaaatgtggggtccgtccccctcttatttcccggaagagccccaatttgttaccatgtccacaccccaaaattagaggggagattctgatttac

SEQ ID NO: 3716 - DNA, 1194 bp, Homo sapiens
ctgcagtgaacataggtgcgcatgtgtctttgtaatagaacgatttatattattttgggtatatacccagtaatgagattgctgggtcaaatggtatttctgtctctaggtctttgaggaattgctacactgtcttccatgatgtttgatctaatttacactcccacagacagtgtaaaggtgttcctttttctccataacctcaccaccattaataatcacaattctgactgatatgagatggtatctcattgtggttttgatttgcatttccctaacgatcagtgatgttgagctttttttcatatgtttgtttggctacaggtatgtcttttttttttttttttttttttttttttttgagacaaagtcttactctgcacccaggctggaatgcagtggtgcagtcttggctcactgcagcctccacctcttgggttcaagtgattctcctgccttagcctcccaagtagctgggattacaggtgcatgccaccacgcctggctaatttttctatttttagtagagatgggatttcaccatgttgcccaggctggtctcgaattcctcacctcaaatgatctgcccgccttggcctcccaaagtgctaggattacaggcgtgagccactgcacctggccttttgaaaagtgtctgttcatgtcctttgccccctgtttaatggggttgtttttttcttgtaaatttaagttgcttatagatgctggatgtcagacctttgtcaggtgcatagattgcaaaggcagtttttaaataaagggagatgtacatctgccctatgacccagcagttccactccttcacacctgcctaggagaaatggagacatacacccacaaaatgtatatccacaagagcgttcatcgcagcctatttatggtaaaaatcagtgacacagaagtctaagaatgggtgaatgtgtaaacaagttgtggtatattcttagaatacttttactgcttgtaaagaatgaactactggtactggcaacatgtgtgactcttacaaacacattctgagcaaaataaataggacacaaaggatatatactgtctgtactgtttatatgaattgcaagaacaggcaagtcccgtctatggtgatagataccagaaggcagttaactgggagtgggggccaagaacgactagaaaagggcaatagacatgttc

SEQ ID NO: 3717 - DNA, 1158 bp, Homo sapiens
tggttagagtcctcccgacattagtgttcctttaggaagcttggactctttacaccgttaattacactgttaatttcacttaaacatggaggtggcccagtttgctgcccatgtaagactacttttacttttttgagacaaggtcttgctctgtcgcccaggctggagttcagtggcatgatctcagttcactgcagcctccacctccagagttcaagtgagtctcatgcctcagcctcctgagtagctgggattataggcatgtgccacgactcctggctctctctaggacttctttaatgtcataatagaagctgatggttttctccataaaagtctattagatttatttctaggcacttgttaatatagtacttcttaaaattagcatttttgtttttagctatgtgttgtagatggatacaacatgttgtaagattcttttggatcgtctttgtggacagtatctgtgaagaatgactcctgcctcagtctcccacttgaacccaggaggtggagcttgcagtgagccgagatcgcgccattgcactccagcctgggtgacagagcaagactgtctcaaaaaaaaaaaaaaaaaaaggagcagactgtgctccttgccataggattttatccatgttcttttatttctgcctctcaaatactgtttaatcttaacgtatttttaaattttgtgtgatttttctgtttttgagaggaatttttgatatgttaatactatagatcttagtatattttaaaaactgatgatgtttgatacatgccaaatcatgtgtggaccataaatgtaaatagcaatgcccacaaacccacccatagcctaggaattgggagactcagcaccgccggctgaattcgcctgtgcggtgtgtcccattccatccctgttctgccgcccgtgggggaattttgtcagcttcactgagacacttagtaccctccccttacctgtggttttgctttccatggtgtcagttgcccatggtcagccatagtctgaaagtattaaatgggaaattccagcagtaagcagttcataagttttcagttgtgcaccattctgagcagcgtgatcacagtctccctgtcgtgtcctgcctgccgggagcgtgaatctaacctttgtccagtgcaccc

SEQ ID NO: 3718 - DNA, 1188 bp, Homo sapiens
gttttgcatggttatccagagcagtctcttgaattttggttgtctttgacgcagctgcatctggagatcctctatgtgaggcatgtttagagaaagagaaacattgacccctggaattgatattcttccaagaaatcttttagtcttgttggtaaaggcagtcctcagatggtaccggtccctttgttagtggtgagcctacagagatggtgcctggtgtgcagagcgatgtggttggatggaggtgaacagagcagtctagggcccctgggccgcctgctggtcctagcccatcacagcacagtcattcagcagacatgctgcaccagctgattgtttgagcttgggcttggtgcacatgatggagtttgtctggatctcctgtcttggtattccataggaagatgagttggtccagcccatgtcctaatagatgttgttagcaggaagtctgaacttgaactatctcacatgaagaaagttccttctgctgcctctttttatttctctttggcttcatgaacagtcatgcacccccagtgccatccttttgagctccccaaggcctctgccagacacatcacctccaggggtgactccttgacccaccgtgccatcaccactggctctgcaccccttctgagccattcctggagcttgaggcactgtgaggtcaggggaaaagggtcagcgtggcaaggagagatggtcacccaagctggggtcatagagcagcttatggatttcctggaagtcagtgggaactcatttgggaacccccaaaatgagtccctgtggggtgtctgaaatggtggcagaaggggcaggaatggggtccggcagttctcttccctcaggtcctggcggatggatagcaaagtcctgtgtagacaaggtcacccacaggtggtatatgccggctgctaagggccttgggtggcgggccttggcccccgcagtccagagagtgtctgtttactattccctgcagggtaggcaccttgggccccagaattcggaaggcacttttttcctacctggactcacttcctgcagtgttggaggccacctggccctagtctattttatagagacagggtctcactatgttgtccaggctgatcttgaattcctgggcttaagcaatcctcctgcctaggcctcccaaagtgttgagattacaggtgt

SEQ ID NO: 3719 - DNA, 1193 bp, Homo sapiens
tgcctgcgtgggtgtctgtctgaggctgtgccacatggggggccccaagtgccagctgtgcccaaggccccagctgcttccccggggaggcctcgtcctgggcgtcccgtactactcctgccagccctggggctcccacagccccttttccaccctgactgtcccgtcaccccccaggcgcacacggactccttgaacaccctcgtggcactccaccagctctaccaatacacgcagaagtactatgacgaggtagggtcaggcccccgggggcgggggcaggtggggtgctgggcggtcccccggtgtgctctgatgcgaccctccctcagatcatcaatgccttggaggaggatcctgccgcccagaagatgcagctggccttccgcctgcagcagattgccgctgcactggagaacaaggtcactgacctctgacctacaatctccagtgctgccttgggacataggtacctgaggtacctgagagcccctcaggggaggaggccgagtggctgtggctgaggcccccaccctcccctggaacgcgccccaagccggagtgggtgcagccggaacccgcccagcgtctagactgtagcatcttcctctgagcaataccgccgggcaccgcaccagcaccagccccagccccagctccctccggccgcagaaccagcatcgggtgttcactgtcgagtctccagtgatttgaaaatgtgccttacgctgccacgctgggggcagctggcctccgcctccgcccacgcaccagcagccgcctccatgccctaggttgggcccctgggggatctgagggcctgtggcccccagggcaagttcccagatcctatgtctgtctgtccaccacgagatgggaggaggagaaaaagcggtacgatgccttcctgacctcaccggcctccccaagggtgccggcactctgggtggactcacggctgctgggccccacgtcaaaggtcaagtgagacgtaggtcaagtcctacgtcggggcccagacatcctggggtcctggtctgtcagacaggctgccctagagccccacccagtccggggggactgggagcagttccaagaccaccccacccctttttgtaaatcttgttcattgtaaatcaaatacagcgtctttttcactctgcgggttggctgagtgttcctcctggggctgc

SEQ ID NO: 3720 - DNA, 1182 bp, Homo sapiens
tgcagcgggaggcggcctccggaaaaccccactgcactccagatccacttcctcctagaaacccagatgggcacaccagaggctccacgctcaccaggccccgtgtgccccccgcccacttgcggcacagtctcgtgctcagcacgtcccaccgcgttgcccctttgcccaccgagacccacacatgcacctggaagccccgtgtggtcagggccagggtgggcggggacgggagggcggaggctgcagggaccacccctgccagccgagcccacgaaggcactgccctccgcagtggtggccgcagcatcaacgtcacgggtcagggcttcagcctgatccagaggtttgccatggtggtcatcgcggagcccctgcagtcctggcagccgccgcgggaggctgaatccctgcagcccatgacggtcagtcctggcgtgggctcagctctggcaccggcccatgggatcgtgcccaggaagggcggggtctgcgcccgggggctgacagctgggacttgcctgcaggtggtgggtacagactacgtgttccacaatgacaccaaggtcgtcttcctgtccccggctgtgcctgaggagccagaggcctacaacctcacggtgctgatcgagatggacgggcaccgtgccctgctcagaacagaggccggggccttcgagtacgtgcctgaccccacctttgagaacttcacaggtggcgtcaagaagcaggtcaacaagctcatccacgcccgggtgaggacggtgcagccccgggtgtctgggtcctgctcgggtctgggctgagagctggtccacctgtccctggttccctcctcctcaccccgaccactgccgcctccccagggcaccaatctgaacaaggcgatgacgctgcaggaggccgaggccttcgtgggtgccgagcgctgcaccatgaagacgctgacggagaccgacctgtactgtgagcccccggaggtgcagcccccgcccaagcggcggcagaaacgagacaccacacacaacctgcccgagttcattgtgcgtgagcggggactggcggggggtgcccccacgggaccgcgctgaacccggccccccacacaggtgaagttcggctctcgcgagtgggtgctgggccgcgtggagtacgacacacgggtgagcgacgtgccgctca

SEQ ID NO: 3721 - DNA, 1184 bp, Homo sapiens
ggtggctgggggaggcagaggagtgagcgcagggtcaggcagcatcagctgtcttgattttgacttgctgagtttgctcacaaatgtgagactttcagaggggagatgtccagtgttcactcaggacagaagacatccctgacacatgggagagacacctgggcgcattcgcctaacagaactacagagcaagcaagagcattgaggggcatgtcgagcacgctggtgggtgggggacagtgtggggaaggagggcaaaggagggggttagcccagaggagaacctggggaggcaggtcctggagctgggggtgcagcctcagagctgttgagcagctgggaagtctgctaactttgtgagcccaacctggagaggtctgatgggaatggttactggggagggcccccaccatcctgagctctgggaatcttgtgtgttcatgctgcagatggacttccaggacttgggtctagtgttgctgagggtggatctgcagaggtgagagaaatgacccctttggacttgggtctagtgttgctgaaggtggatttgcaagggtgagagacgtgacccctttgccctcgtttgcagctctgcggccgtcacgatgttctggaagtttgacttgaacaccacgtcccatgttgacaagctgctggacaaggagcatgtgacgctgcaggagttaatggatgaagatgacatcttgcaggagtgtaaggctcagaaccagaagctgctggacttcctgtgcaggcagcagtgcatggaggagctggtgagcctcatcacacaggatccgcccctggacatggaggagaaggtccgcttcaagtatgtaccaaagctgtgacgggccagtacgccaggcagtgctgcaggcaggccgcaggcagtgtctgaggatggccatagttggggatttctgatgaagaagcgagccgtaaaaatccaccccatgtgagaagtgaggagggcactcccatggggtctgaggttgaagagtttggagattgggtgcagtggctcacgcctgtaatcccagcactttgggaggctgaggaggttggattaattgagcccagaaatttgagaccagcctgggcaacatagtgcgaccctgtctctattaaatttttttttttaaattagccagatgtggtgttgtagacctctggttcca

SEQ ID NO: 3722 - DNA, 2233 bp, Homo sapiens
gaatccaccgaccttctttgttgctgtcctcaccgacatcaactccgagcgccactactgcgcctgcttgaccttctgggagccagcggagccttcacaggtcagcttggggcctctgggtacagcatgaatgaagctgcatccttgggccgtggccaactccccctgcccccgtctccccctgacccccagcaggaaacgacgcgcgtggaggatgccacagagagggaggaagagggggatgagggaggccagacccacctgtctcccacagcacctgccccatctgcccagctgtttgcaccgaagacgctggtactggtgtcgcgactcgaccacacggaggtgttcagggtgaggccggcagccggggcggcgaggcacgacgagggtgcttccatcggctgtcccaccactccccgctctggtcattgcagaacagccttggcctcatctatgccatccacgtggagggcctgaatgtgtgcctggagaacgtgattgggaacctgctgacgtgcactgtgcccctggctgggggctcgcaggtgagttttggaggcagctggtatctgcacagccacaggccctcctgctggggccctggtaggtatttggagcccagccagagccacacacagctggaggccttggatgctccctcttgcgtcctcgtgccaccattgcccccaacagtcctggcctgcttacctggccctcgcacctgtgctctgggcctgtgtcgttcagcctctctgtccactcctttgatggtgtgtgcctgtctctggatgttgatgtcagcttgtttgtctgctccctgccctgtgcctgggtgtgttggagtgtctaaccgtgtctttctgcccgtctgtcctgtgcagctggactctgttgaggaaggagcggtatggattctttgtttcttccgcccacctaggccccatccctacccccaagtcaaaagcagccactcctgtcctgagttttctctgcagctgcttgggacaacagaggcagggcatggcgtttccctcttgccatgttgcccatcccagccagtcccacctcgggtctgtcagtacaccagggtctgcctggggacacagagctctgggctgactctgggctggctctggccaaactactgagccccgatcctttttttgctgcagaggacgatctctttgggggctggtgaccggcaggtcatccagactccactggccgactcgctgcccgtcagccgctgcagcgtggccctgctcttccgccagctaggtgagcctgtctgtcccacccccgcatggcttcccctcggggactggtagttagggatgtgggttctcactctgcctgggtgggggcccagggtcctctccaagcttctcttcttcctttaggcatcaccaacgtgctgtctttgttctgtgccgccctcacggagcacaaggttctcttcctgtcccggagctaccagcggctcgccgatgcctgtaggggcctcctggcactgctgtttcctctcagatacaggtgacccctgcccggccctcccagccccttctcctggcccctttgcccagccgcgtcccctggctcactgcatcctctggggcctgcacagcttcacctatgtgcccatcctgccggctcagctgctggaggtcctcagcacacccacgcccttcatcattggggtcaacgcggccttccaggcagagacccaggagctggtaagggctgtgctttgtgtccacctcacggcccaggcctgcaggtccctgactgccggctcccttggtccgcagctcgatgtgattgttgctgatctggatggagggacggtcaccattcctgagtgtgtgcacattccacccttgccagagccactgcagagtcagacgcacagtgtgctgagcatggtgaggggcaccatgggcaagcgggagccttgggggcctttgggatgtggctacctggcagcacggggagcctagagccggggccagcgtgcagctgcctgctccattctgtgctggcaggtcctggacccggagctggagttggctgacctcgccttccctccgcccacgacatccacctcctccctgaagatgcaggtgggggtcgttgctgctcctgcatggggaccccaggcacttaggctgcccccactcaggtctgctgccactgacacacagggccccacccccaggctggccccggctcc

SEQ ID NO: 3723 - DNA, 1198 bp, Homo sapiens
gccccgaggtgcactgacctgttgtggtagctcctagcgtgggaaaacaaagcgacgtggctggacatccccgctccgccccgcccacctcccagaccccattgtggccctttcccgcttcctggcaaccgcactgactgcctgcccccccaacctgggtccgcctcccccttccccaccacccagtgccgccgctgggcctctgtgtggattctgtggcacgggtgggatagtagcctgggccacccagaacgctggcctcacccttacccaagtttcagtatacccattctggaataggacaaatctgcagacaaaagcaaggatgggaataaaggaactgaataatgcaaagcacacactccatttaattatgtgtagagagaggacttatctatttaagtccatgaaatattcgcaaaaaaaatcatgtattgggccacaaaataatcacacaaattgaaaaaaagatgtgacacatgatttgattacaatcaaatacaattctaggcaaacaaaatgtaaaaaaaagaagaagaaaactcagcctgggcaatacagtgagacccatctcgacaaaaaactttaaaaattagctgggtgtgatgatgtacatctgtattcccagctatggggtcggtggctgagtcggcaggatctgttgagtctgggagttggatcctgcagtgagcagtgatcccaccactagactccggcctgggtgacagagtgagaccttgtcttaaaaaaagaaaaaaaaagggagagagagaacaggaagcaggagcaaacaaatattttgaaattgacaaatctttaaaaaaaaaccctggatcaaaacttgtcagaaataatctggttacaaactgtagcaggaagagccgcagacaaaactcctcagacaccaggttaaagaaggaagggatttattcggccgggggcatcggcaagactcctgtctcaagagccgagctccctgagtgagcaattcctgtcccttttaagggctcacaactctaagggggtctgcgtgagaggtcatgatcgattgagcaagcagggggtacgtgactggggtctgcgtgcaccgggtaatcagaacggaacagaacaggacagggattttcacagtgcttttccatgcaatgtctggaatctacagataacataaccggttaggtcaggggtccctctttaa

SEQ ID NO: 3724 - DNA, 1111 bp, Homo sapiens
agccccctgctgctgggcacaggcaaggtagggccggtgacccctgatcccagatccttggcccctgtcctggccttcccctggggtgagtgtgggcagtgcctgagagtctgtgcctcagtgcctcctgcactgagtggcatccaagtggcgccacctctcaggttcctgggtgggcaagaagcggtgcacgtccagggcctcccaccagggctggcagccccaggtatgtgcagtgcttggggcctgccccgccccgtgacccctgactctgcccccagagccctcggcagtctctcttcttctacccgtcctacccagacgaggtccgtggggtttttgctgtgcggactggaaagtacaaggctcacttcttcacccagggtaacccctccccgtggatccctccccccgacctgctgacccctccccggagccctagatccctggcccctcctctcgcccttgccctgtgcacagaattggccccctccccaggctctgcccacagtgataccactgcagaccctgcctgccacgcctccagctctctgactgctcatgagcccccgctgctctatgacctgtccaaggaccctggtgagaactacaacctgctggggggtgtggccggggccaccccagaggtgctgcaagccctgaaacagcttcagctgctcaaggcccagttagacgcagctgtgaccttcggccccagccaggtggcccggggcgaggaccccgccctgcagatctgctgtcatcctggctgcaccccccgcccagcttgctgccattgcccagatccccatgcctgagggcccctcggctggcctgggcatgtgatggctcctcactgggagcctgtgggggaggctcaggtgtctggagggggtttgtgcctgataacgtaataacaccagtggagacttgcagatgtgacaattcgtccaatcctggggtaatgctgtgtgctggtgccggtcccctgtggtacgaatgaggaaactgaggtgcagagaggttcaggacttgtacaagatcacccagccagaaagaggttgggctgggatttgaaccctggtgtcgtggctctggaagctgccctggc

SEQ ID NO: 3725 - DNA, 1237 bp, Homo sapiens
atgtcatctttcctacaattttaagtcatctttttaaatgtccatttttctttttgattgatatttcctccattgatttattaattacacagatgtttgaatgcttaccacaggtcaatccctgtgttaggtgcattaaacgtggtaatgaacgagtgaaagtgttcgccttcatacagcttacggttttaggtagtcatggaaatcggtgatggttcacaacaaaatgattttggtgaaaagaaatacctgttatatgatttaaagaatcaaagcataaagacataatcgaaacttggatgggccgggtgtggtggctcacacctgtaatccccgcactttgggaggccgaggcgggtggatcacgaggtcaggagatgagaccatgctggctaacatggtgaaaccccatttctactaaaaatacaaaaaattagccaggcatggcggtgtgcgcctgtagtccgagctactcgggaggctgaggcaggaggatggcgggaacccgggaggcggagcttgcagtgagccgagatcgtgccaccgcactccagcctgggcgacagagcgagactccatctcaaaaaaaaaaaaaaaaaaaaagaagatcttggataaacttggtaaatatgaaacgcatgactagttttgtgggtagcaatgatgtttaaatgtcacacactaacctttttaaaaaactatccgaattggctagtttatgtcaagtaatattcatttttcactggttgggattgctctcagaatattctataacagaacatggatattttgtcaatgtagtttctctaaacttgagtatttgtagtctgtcttataaataatagaacatagattaagacttagctgtatttgtatcactaatccagatttagcattaatttacttatttagcatcactttggaccgctgatgaattcattagaattttaagggcatgagagggaaacacatgcacgttagggcttccagttctaagattccgcgaaatatactccagggtgcgcaactagatgagtcgtatttgaaggttttccttgaaagtactaatgtgtacagacaggcaagctttgaggaattcagactactctgttaaggcactgcagtcttgttttggtttgctgcctttacaagaatgctgttttttttttcatctagtataagtgccaattcaggaattgcatttgatgaccattcggaatgtcttgagtcagtaatt

SEQ ID NO: 3726 - DNA, 1194 bp, Homo sapiens
gaggtttcaccgtgttgcccaggctggtctcgaactcctgagctcaggcaatccacctgcctcggcctcccaaagtgctaggattacaggagtgagccaccacgcccagcctctctctgttttcattgtactattggtatgactttccaggctgtttggcaatagctgatttattcctctgcctcttttgctgaatcgtgcttcctggaggcaaggactctgtctattcctcattgtctcttcagcactttgtagagtgcctggaacaagatagatattttataaatcttagctaaatgagatgctctcaaaccatcctctcaaatatgctattatccaggcattattataaccatttccctcttaccaatgtggaaattaaggctcacagatattaagtgctacattcagagtctgacttgaacccagagcttctgaactcaaggccatttttcttttcagaacatctggctgtctccttcatggaaaagactgataaaatttataaaattttgttaggctgaattatatgaaatgggaggttaaaaatgttcaaaaatgggtaagtgcatatgcttcattgtggcctttatacaggatgcgactttttattaaaaaagacttacaccccatacttaaaaaaatggactgaaagtctcaatggacttagttggtcagaacaaatgtacctggaagtctggtgagcagaaactcagacccatgaacccttgcagtacagcacagactttaatgaagtgcttcataggatgagtttagtttaatggctgtgtatggatattaacactctggattgaggctttttttctatcaactcatggaatcatgagttggaagtcaactccatcaacccatggagtcatggaagcctgaagtctccaacttctcgtggagtcaggtcatggaatgaatagttgaaagtcctgaatttaggttccagagaagtcaccaccttactgtgtgaactcctgaaagcctgtcatctctgtgaacttcgctttctttatctgcaaaatgggagaacacttcctgtttaaccagattactctgaggtttaagaaaagacattatccattaaagccctcacaaaataaaaagtagtatacagtcatatgatgatttcgtagtggctttgccctacctagaagaaaaagagccagcaggctcaataaacag

SEQ ID NO: 3727 - DNA, 1219 bp, Homo sapiens
cagcaataaatgaggctggtgctgtacagtttgtagtaagaagcttgttctccatcctgagggcagaggtgtctcttgggagattttgaaaaggggactaatggagtctgatatatgcttttagagaactaacaataccagacaaagtttgagttgtgaaataagagatgtgaacactaagtagtttgaagatgggaaacatcaccaggagttgtggtcatcgcagcaaaaacgacagaagaagaaagatattggaaactgaacaaccagtggaagagcaaaaggtgaggaaaatggtcaaaaaatgtgaaggggacatgttacagagaccactttaccagctttaagcattcccatatgtgggggtgtttaaaagatgagaaagagaatttgagtccttgaatgtcaggacagtcatttattatggctgtagtaatactgtgtaaccaacaactcccaaatcccagaggtttacaacaaggaattcattttttttttctcactcatgagtgtttgggtcagtgccagcagctctgcctgagactgcggcttgagctcagggtcactcgcaggtcttcattctgctgccaggctaatataataaggactgccgggggcatgcttttcttatggtagagcacagaaaggaaatccttgccagcagacctctgtttgcatcgtgcccactcctgtccccttaggccctaaaagtcacacagtggacaagtatatactctgctgacgtggagaggtactgcaaaggctggaatatatattcctattatgggaagcgaagaattggaaacagcaaattcaatccattgcagctagtcagagaattttaaatttatggtacaagcaataaaaatccatgacattttgagcatcagaatggcaggcattggaaatattttagcagagcaaagataagaagttggaagagttgggaagcaagtgcaacactttagatatatggtaatagcataatgtaacaacaatgatcaaggagaacaaattgctggggaaattgcctgatgggcaaattaagaggtcttcaatgactgactggaaatgataataacaggcagaaggatgccaggataattctggtgtctctggttttgtggagcagaagctctaagtgacattgatcacttaaaggacaggagctatttgaaagatgggaaaagaacagagtgttgtgtgtaatatggcgtcc

SEQ ID NO: 3728 - DNA, 1544 bp, Homo sapiens
ccaccaccctgatgagtcagtagccatcgttaacgttggcgtaagaccctccaccagcaaaaagattgttagcatttttttagcagtgatgtatttatcaattatacataatgctattgtacacttcttaatagactatggtatagtgtaaccataatttatgcactgggaaaccaacaaattcatgagattcgctttattgtagtgctctggaattgagcctgccgtgtttctgaggtatacctgtgtatttagtatgttccttgtatataaaaccccattttatagggtaggaaactaaggcttagagtttgagcaattttcccatagataacaccaataaattgagggctgcagagaccacttaagtggttctcttaacagtagtctagacatgacgtaatgagatttggcttaggagtgacaatggtaaggaagttaaaggattcaggaaccaaataccagttattgagaagaaagaatggcctcaaaacatcacttctcaaggaagccttgataccctcacccttactacactgtatcctccatttgaatgttgtcaagagctcttctcacaattgtaaataataattgtgtaattttgttttttttttcctactttaggttgctccttgagggcaggacagttcttatggctttatccgttgcgtaagcacagagaggtctgcgaggtcaaaactattgtcatgatagcaagatgcctgtctttttcatttattctcacggtgtgcagaggctacatgatgtgtgatgacatcctcattgatgttaatgaatggtgctatacttgaattttctaaggtgtcattaggtaggtttaggtatgcatacttgtttttagaaattatttttttcctttttcccatttttagaaatcaactcattttttaggttatgccttcagtaatctttgcaacctcaatattgtgtaatggttactttaaaatactgtagttttctttgtgcctaagtataaacataagtacattttgttgttttgtttgcaatagtggtttaaatattttcccaaaatatccaaatttaaaaattctacaactttagaatttaataaatttattctaaaatatttatatattttttcatttaagaatggatcggcttaaaaagactgcttctcatttacttactggctataccatctgtatactaataaaaaacaagatttgatttggaaggactgactcaaactaacgaaaatatgaaacctgtctttctgctttggagatatttacctaatcatgttctgcagtagaataatttagttcttttgtctttttttggagatgaggtcttgctgtgttgcccaggctattcacagctgccatcatagtgaactacagcctgaaactcctgggttcaagagatccttctgcctcagcctcctgagtagctggaactataggcatgcgccaccaagcctgggcttttaaaaaaattttaaaaagaattttgagacaggatcttgccatgttgctcaggctagtcttcaactcctagccctg

SEQ ID NO: 3729 - DNA, 1227 bp, Homo sapiens
tgaatttagggagggctttcttttttttttcccactgaccatggagtagaattggggttacacaaagaaagacagaatattgaaagtgttacgtcaggcgcggtgactgacgcctgtaatcccagcactttgggaggctaaggctggaggatcacttgagcccaggagttcaagaccagcctagacaacatggcaaaaccccgtctctgccgaaaataaaaaaattagctgggcgtgtagtcccagctactcaggaggctgaggtaggaggatcacttgagcccaggaaacagagattaccgagagctgtgatgcaccactgcactccagcctagatgacagagcgagattccgtctccaataaaaagaaaaacaaaagtatttataggactctctaatgtctctgtttaacttattcagagacaatatcagaggaagttactgtactgatattttaagagggtgaatggataatgtaactgaatttcaagggtactgagacaggcattttggttgtttctttggagcagtaattataaagtggactgtgcctgtcacaagggaaaccggaattgtcctatacaaaaaaggaatcctaatgctacagaactgccactcctaccacctcctccaagcctacccaccattggagcagagactagacgtagaaaagcacgacggaaagagctagagatggagcagcagaatgaggcttcagaggagaataatgaccagcaatcacaagaagttccagaaaaagtaactgtatccagtgatcatgaggtaatcgcccctggtcaaatgatgatgctatggcatcaatcctccaaaggaagaggaacccgggttgccgcatggtttaagtaggggagctatagtaacacttagtgccctttatatcaatgtgggtttattgtgttcatacatttctttctgttttacaaagtcaaaaacatcctttgctggttttgcaccagagaataggggttagttatcatctgtgtttaccatgtggcctcacatgagttaacagtttaaagcactagagattgttatagagagttttaagctaccagaataaaacagattgattttttctcagagcttgagtacagctgaatattgcctctatcttaaaggaagtagacaatccagaagaaaaaccagaagaagagaaagaagaggttatagatgaccaggagaacctagctcatagcaggagggtga

SEQ ID NO: 3730 - DNA, 1214 bp, Homo sapiens
cacaggctgtgtgcccatcagcttggagtcactgtcctgcccctgggcaagtcactgatgaccatgggccagaacaaagtgtgacattcagttgtgcagctttgtcactccttggggacacccttaggggccctgccccctcagcagctatctccataggtgggtctatgtctcagtctttggaatttgccatggtttgatgaggctaatgccaactccttctcacgctgccaccgcctgggggctgacaagcctcataggacaccttaagcagtgacaaagggaggcagaagagagtctttggcctccctaaggccaaaaggaggctgaaaggctggcttgctctctgcccacctgtgccctggaggaagagaaatcttcttgacttacacaaagatgatgtgtgggctagaggccaccttggaagcatcctctccttcctgttcacccaccctgctcagcagggcagggagaggctgccttaggccctgctacccacactggcctctgtgtttctgtctcctcctgtctccccagtcccgcatggtccagaatgagatcccctacttcatctggaccactcggcgggatgtgctcgactgtcgcttcctctccaaggatcagatgataaaccactacgcccgggctggctcctttaccacaaaggtgggctccctagaggagcaggcagggcagcttccgaccccctgcccttgggctggcagctctcctccctgctcaccttgttagtaagaggaagttctcaggacaaggggaagtatacaattcagaaaatttggagtctgaccagtatctggcaagttcaaatccagcccctgcaccgtatccggcatttgtagatatgatgtctaaaatgggtctggaggtagaacaatcaccaaatccaatgatagtgagcaaacggactcttacctcctaagcagaagatatctggctaatggacccattctgtcttacctgggtttctttttttttttgagacagagtcttgctctgtctcccaggctggagtgcagtggtgcaatctcagcccactgcaacctctgcctcccagttcaagcaattctcctgcctcagcctcctgagtagctgggactacaggtgcgtgtcaccacacctggctgatttttgtattttttagtagagatggggtttcaccatgttggtgacctcaggtgatccacctgcttcag

SEQ ID NO: 3731 - DNA, 1199 bp, Homo sapiens
aacaccagtctctttttctcagatatgtcttgtcgttcaagacttgcaacactaaacgagaaattgacagcccttgaacggagaatagagtacattgaagctcgggtgagtttgatgggcaagggcattccagagagaatgcacatttccacttattgctgaaaaaaacctgaaagcagaaacagtcttaggaaacttaagcactggccggacatggtggctcacgcctgtaatcccagcactttgggaggccaagacaggtggatcacttgaggtcaggagttcgagtccagcctggccaacatggtgaaaccccatctctactaaaaatacaaaaattagccaggcatggtggctcacacctgttgtcccagctactcgggaggctgaggcaggagaattacttgaacctgggaggtggaggttgcagtgagccgagatcacaccactgcactccagcctgggtggcagagtgagactccatctcaaaaaaacaaaagaagagaaaagttaagcatgttgcctggatttgaaccatgtttctgtgacttcacagctatcttcttttctgctatttctcactgcctaggatctaaagatttttttttagacccctctaatcttttttaatttatctaaatgtcagttttcctttcctttcacaggtgacaaaaggtgagacactcacctagaacagtgccgtgctgctgctgggaagttgctttacacaacacaggccacatgggaaaggccccagcagccttcagctccttcctttctccttaaagagcaacagggcttattcttgtttttcttttttcaaaagtgtggcctttgggctctgccatctggggtgtggtgtggtatgtgggaagaagttcagaggaaccgttggaaacgacgttaggcattttaccttttcagtaacattttatacatctacttgtcaatgtatttgagacattcacagccaaaagcctgggactctttgtgaaggtcctcctcacctctatctttctttctctctctctcaaactttccttaaagttctcattgcctttgcactgcttctgtgaacagtctttgtctcctccccacctttggtgggaagtgcggggcagtcctggtcaagacactcatgccctggcaatgtggctgccagagaatgttgttgctaacccaccagtttcttgttgatt

SEQ ID NO: 3732 - DNA, 1195 bp, Homo sapiens
gctcagccatgttacattgtctatgcagaataagcaggcctggtgtctgcaaatgtaccagtccttctcccgcatctcctgggtgcccccttggctttgcctctcctgtgtcctgtctttctgcgttttagaagtgagagcctctccttcaccttttgagcaactgagtcatctcaagtcctgagctctgctctgccgcctgctggtgccttgtaaaggtatactcgttacaggccctagaggttctaatggtccagggttaagtgagaggagactgtactttgtttcaaaggatccttcaccctgatctgcagtgaggtggatagatcacctggagtccctcgtctgtggtcttggaggcttaaattgtaaaatacatcccttatggaatcctaaattcctctaggtgtttttggaaggcgcatttgagccttgtgagctaaaatggaatggatttaatatttcctatctggcatttccatcttgcccctggtacacaagtcactggcctggaactcagccttgattcactgtccgtcttcacggattagctgtgctgttatgttgtctgtgctgcagattggcccatgtgggaagtcgggggggacctgatttcctgcttggaagacttgggggactgccgagcatatcaaagtgtttatagtcaccaagtgaactgcagcacaaccatctcctctccagcaagccctgaagtcagtagtgcctgcaggtgaaaccaaccagccctgtgttagaggaggaaaagcggagatgacatggaagtctccaagcctgtgccatccacctgccaaggaaaagcacaaggtgctatctacttttctctctaggatttagattatcatttatgtgctgttgcacagtgaaacctcacctgtgtgggcgtgaaagctgattggcattgtttttgattcagctttttggatggctaattgttttcactgtgctgtgggaatgcctctgtattttttcccctctttggccatctttttctgaaaataaagtgatggatcctctagccaacccagtctctccgtgtttgtatagacttacctgagtgatgcagtggtttagtctggttgttggccagcattgtaacccaagaatccaggtagctggagactttttttctttcttttttttttttttttgagaaggagtcttgctcttttgccca

SEQ ID NO: 3733 - DNA, 1239 bp, Homo sapiens
tttttgtttgcttttttctttttcagagatagaatcttgctctgtcacccaggctggagtgcagtggcggaatctcggctcactgcaaactccatctcccaggttcaagcatttctcatgcctctgcctcctgagtagctgcgactactggcgcaagccatcatgctcggctaattttttgtatttttaatagagacagggtttcgtcatgttgccaggctggtctcgaactcctgacctcagacagtctgcccgccttggcctcccaaagtgctgggattacaggttatgagccactatacctggtctgttatgagtttcaaatgaaattaaatgagataatttatgttcatcacttatcaagtcttttgtaattaataagccctcagtagtgggtagattttatcatcattagcttttataatctaattacacttacatgcaaaaaataaattttaaaaagttgagcaaatatggaattagccacagcttgaaatatatgtgtcttttaactctgctctttcattccttgaaacctgcagctggtcatcaatgctgctttgggatttgacacatttgttgtcatgagacatggtctgaagaaaccaaagcagcaaggagctggggacttgtgtccaaaccaccctgtggcatctgctgacctcctgggctcatcgctttttgccaacatccctggttacaagcttggctgctacttctgcaatgatgtggtggccccaggagatgtaagtggatttctctatagttccaaatatttcctatcaccaacttgtacactgaggcagaccgacttggccctttcatttatgactatttaaatattatcttttaacaaagagaagaattctccaatttggggaggatggcattatctcattatgaaccttgactggcgtcatcaactgtacacctgttccttgttcaccaatataaacgcggctacaaaccatatttttggaaagcttattgaggaaaccacagcagactagtccctgatagcactccgtattgtctccggtgcttctcttagtcaagataacattacaaatcaggagtctaaagaccagattccatcaatggcttgacactgcctcccaggtagttctaaaaagtctcttaggttccctctacctttgcaaaataggagtgatgtgtaggcttgtcagatttagtaagtaaaaatataggattcccagctaactttgaatttcagttaat

SEQ ID NO: 3734 - DNA, 1111 bp, Homo sapiens
ggtcacagctgctcctttttggtcaatgagcgtttctatcccctccccctggggtgtgctgtgtcccacctggcccaccagaggctcacgacgatggcacctgaccaggtgacgtgggcgtggtcacctcacctgcaaggctttgtggactctgcacaccgtatgacccccggttttacagtttttagctgttgaattttggaaattggcactgggtgaaaaggtcggaggactggctcttgtagtcacagagtggctgcaggcctttgaaaagtggaggaaagaaaagcccttctccttgccccgcacacatttcactcccactgtactgggcttccaagctttggcattcaggcccctatattttctgtaggaaaaatcgttgagaacacttttctatatgggtgattttgagaccatcgttacgctgtgcgtaaagaatgtacagagaaatttgtaggtattttttgaagaacattaatttgttaatgatatgtagctatttaatttttccctttcctattgtaatcattcattttttttgttgttcggaaaaaaaaagttgatctttttttttgtcgtagatttgtctgtaaaagtgcaggaacagttattctatgagaacactgcatctgcattcatagccacgagtttgttattgctacaggctactgagcgtcgtaacaggaaaaccacccacagctgaccggctcggtggaggacactcctgggacaggtctctttgtcagtgaacaagggcgtcactctgggaggggtcggcggtgctggcggccgggtccctggtgcactgacctatctgggataggcagtaccctggaggggggcctggggcagaggaggcagcagaaaaccaaacatttcactgagaaagccccctccctgctctaagaaggggctccgtgaagttcttcccagagccgcgctgcctgcagtgcgctctgaccttctcttcatgtgtgtaaatctgtaatataccattctctgtggcctgtttttcctggaagaagaaaaaaaaaggtttggcaggccatctttttttgtacttaaaagtagccttaagaacaataataaagtgctcttaaaccacata

SEQ ID NO: 3735 - DNA, 1203 bp, Homo sapiens
atctttatcatttgaaggtgaaattgaagtttataaagtagtattttccccccccacccccaaagaaacagtgaagaagtagagaggatagggaggtagctttggggagtgtaagacttctttagcttttcatcatgttaaatgaatagcttctttctgcccaagtctttttctgagaggatggtgaaaagaggaaggcacactgtggaccatgttcagagtcagtattttacttgattgaagcagtgggacaagatgaggaggaattatgagttaatctttgaatagtaggatggaatctgctaaggagaaccttgaatacaaagctcacatattttttctttatcttgtagtcagtagaaagttgtgaaggttttgatcaggggagtgagttgataagtgctgtacttaagaaggtttatctgaagacagtgtagaaaatgggctgtggggggcatgggtggagaacttgtgcagtcctggagaccaactaggagcatgttttggttgtccgtctgtgaggtactggatgtttgaactagaaccgtagcagtggaaaagaaggagtggatacaggggtgtcttgagagtgtagtcctggggtaaaggagctttggggaccttatgaccctcaatctgttattgcttccaaaggtttgttttctctgtagacttttaaaaaatcaaagtataaaactgacatacataaacgtgcagaaatagtaagtttgtaactcattgagtttttagtataaaattataaagtatgacccaagatgagatatgcatgcaacattaccagcgcctgctaagccttctgtccatcattacttcctttttttttttttttttttttttttgagacagagtctcactctgtcgcccaggctggagtgcagtggtgtgatctcagctcactgcaacatccacctccagggttcaagcgattctcctgcctcagtctcctaagtagctgggattacaggtgcatgccaacacgcccagctaattttttttgtatttttagtggagatggggtttcaccatgttggccagactggtctccaactcctgacctcgtgatccgcccatctcggcctcccaaagtgcattacttctttcaatcttgacttcttctccctgaacagataaccactattttgcttccttcagcatatgttaattttgcctacttttgagctt

SEQ ID NO: 3736 - DNA, 1148 bp, Homo sapiens
acatttgtttataagttttatctcatttactggatcctaagagtcttgagaacaggttagtgcctgccacatcataacgtttagtaaatactgacatttacattatctgtgactaaaaattaatgtgttgggagttatgtatgaggtttacaatcttattcatgtttaaatccctagtctctagcatagtatatcattgatagtatgtatcattgatagtatgtctaaatgttttagaaaacatttagctaaataaatgaaagaataattatataattcagggctgtggctactatgctgattattatatagcatattttttcaaaaatcatgtgtaatttagttttcaaattttttgtagttttaataacatgatagagaacagatagggtcttctagtgttttttttaacagctgctttaaaagtggaattttgcgaattgctgatttacatcaatatcttcagtattttttcctcgtataaagaaaggatcactagactaggagataaaagttggattcagatcttggcagaggggtctgtatgtttgtgtgtgtgtgtgtgtgtgtgtttgaggggtgaggactagttggattaatcttttacattccagtgtcctgtgctgctatttcctatactgttcaactgttcaagcatactatttcatataatcatgtgccttatacattttgatttcagatatccagcagaagtattccagctaaaggaaaaaatacttgaaattgggcatcagagagattagccatttcctccagatatccagacggataccaacagttgctgccaagacaaatttatctttggaattgaaagtctgttaccctgggactatctaatgctaatgtttttcttcctgtttgagtagatttttaacctgtagttatgagtgatggatgtcgttgcagtataataacatttgctcggtccttattgatgatctgctcaaaaaatagattagtagatacttaacccatcagagagcttgtcggtgtaataatgtcactgtaatcaggctgcataatgtaattctctgcttagttcagttgctaatggtcatccggagaggtcattcccatccgagatgactcatgtggaggcttctggaatatggtactgtactttaaag

SEQ ID NO: 3737 - DNA, 1165 bp, Homo sapiens
gatgggagccatgtgtataatttcagattttctggtaaccacattaaaaacattttttaaaaagcaggtggtattttaatacagtattacacagtttatttaacccaacttattcaaagatattgaaatagtttatattctctcttttttttttttttcatactgagtaggaagtcagtgtatattttacacttagagccactctcagttcagactagctatgtatggctggcagctgccccactggacagggcaggaccagaccttcttgctaaattgctctgctgggagtgaaccgagatcacgccactgcactccggcctgggtgacagagcgagactctgtctcaaaaataaaataaataaattgctctgctgggggaactgcattttcttcactgcttcagctccacacttagtatagatgttggtgccctggctgaacggagagtgaatgcatacatagtaatgctttttgtttttttgtaaataactttaggagcctttaacgatagtgaagctctggaaagctttcactgtagttcagcccacgttcagaaccacctacatggcctaccattactttcgaagcaagggctgggtgcccaaagtgggactcaagtacgggacagatttacgtaagtaattcttggcgtggtgtgtgtgagaatagagtttatatcagattcaccctagaatatcaaattgatcttgtgtgctgttgatgatgttttctaagaaggtatcctttgggtttagataagattattggatatttggattgggttaagggtaagtgcaaaaagagaaaaggcagtctagggagaaggcctaggagtagaagcttgcaacgccagttcaggctttccctcttgtttgctctatgatcttagaaaagcgttctggctgagcgccgtggcttacgcatgtaatcccagcactttgggaggccaaggtgggtggatcacgaggtcaggagatcgagaccatcctgactaacaaagtgaaaccccttctctactaaaaaatataaaaaattagctgggcgtggtagcgggtgtctgtagtcccagctactcgggaggctgaggcaggagaatggcgtgaacccgggaggcagaacttgcagtgagccgagatcgcgccattgcaccccacctggacga

SEQ ID NO: 3738 - DNA, 1147 bp, Homo sapiens
gcctctttttccccaggtaaggctcagggctgctagaatgtgattaaagcatgggttggttcgtaaagatggcaatataaggtgggagtgttttgttttgttttatagggaggggacccaggtcctctacaagatggtggggggcagggtacatcctgtgtctttgagacacagctaatgagagcattcttgggctttgtttcagatcctgtcttccattgagctgctccaacactctctaccgaagatcaaccggagcgcttccgagccatccttgcatcgggcagcccacactgaggatatcaatgcttgcacgctgaccacgtccccgaggctgcctgtcttctagttgactttgcacctgtcttcaggctgccaggggaggaggagaagccagcaggcaccacttttctgctccctttctccagaggcagaacacatgttttcagagaagctgctgctaaggaccttctagactgctcacagggccttaacttcatgttgccttcttttctatccctttgggccctgggagaaggaagccatttgcagtgctggtgtgtcctgctccctccccacattccccatgctcaaggcccagccttctgtagatgcgcaagtggatgttgatggtagtacaaaaagcaggggcccagccccagctgttggctacatgagtatttagaggaagtaaggtagcaggcagtccagccctgatgtggagacacatgggattttggaaatcagcttctggaggaatgcatgtcacaggcgggactttcttcagagagtggtgcagcgccagacattttgcacataaggcaccaaacagcccaggactgccgagactctggccgcccgaaggagcctgctttggtactatggaacttttcttaggggacacgtcctcctttcacagcttctaaggtgtccagtgcattgggatggttttccaggcaaggcactcggccaatccgcatctcagccctctcagggagcagtcttccatcatgctgaattttgtcttccaggagctgcccctatggggcggggccgcagggccagccttgtttctctaacaaacaaacaaacaaacagccttgtttctctagtcacatcatgtgtatacaaggaagccaggaataca

SEQ ID NO: 3739 - DNA, 1197 bp, Homo sapiens
ttggagacggagtctctctctgtcgcccaggctggagtacagtggcatgatcttggctcactgcaagctccgcctcccgggttcacgccattctcctgcttcagcctcccaagtagctgggactacaggcgcccgccaccacacctggctaattttttgtattttgtttagtagagactgggtttcaccatgttagccaggatggtcttgatctcctgacctcgtgatctgcccacctcggcctcccaaagtgctgggattacaggcgtgagccattgcgcccggccagctccattataatcttatgggacaaccattgtatatgttgcctgtcacttaccaaaacatcattatgtgacacaggactgcatttgacctcgaatctttgtattaaggtctacttctaggggaaccctgaggtactgcccaaatccaccagggcccaggagctgctcagcaatctcctccaccctccctgtgcaggttcatggccaccagcgacctgatgtcggagttgcagaaggactccatccagctggacgaggacagcgagcgcaaggtggtgaagatgctgctccggctcctggaggacaagaacggtgaggtgcagaacctggctgtcaagtggtgagtgtcagcctcggtggagcaggagagggggccctaccttgtgtgggagcatcctggggaccgctgtccctttggggtacagcctcgcagaggagacctgctgagcagctctcgttgaatggtaccttagtctgagttttcccagaagatgctgagacaaggattcaaatctaagtttatttgggaggcgctcccaggaaacatggtagaggagtagggaagtgaggcaggaaagggaagaggaccaatcaagggtatggtacgaagcaagtgaccacagtgggcctgatgagcttaaccccatggggacctctgggacacagtataggacatgtcccttggacttttcccactcaaagggtaagggagctggggtattaatccaccagctccctggtagtcattggttaagggctgcttctggggtaggatggagggttgtccactgcctgccacctccagccagagaaagccctcagacagatgtaaatgctgggaaggtcaagctgacacacatcaaggtggtaaaggcttaaaggctgggtgcggtggctcatgcctgtaatc

SEQ ID NO: 3740 - DNA, 1299 bp, Homo sapiens
tcatgggccagaaggcagagtcgttttgaatacgtggttcattgagtacccactctgggccagttgatggctgcgaagagagcagaaggggtgctgctgtaggaaatcaatggctcggaagaccacactgaggaaggtgtgagttgatactggaagatctccaggtttgaggcatcttcagaggtatatggtggttttgtgtgtgttgagggtgtggtagcgcagcagctccctagggaattagaaggttttattgaacatttaccctgtgacaggcactgcaggcattcagcgcgcagtgtcatcttcattttacaggtgaggaaaagactcaggttcaagtagatggtcaaggccagtactaccggaaggaccatctgggggttcggacactggtggggtgggatttgctgccccttgcaaattgagagtgtcttggggtcagttttgatttgctcagctgttggcattctttgggctctgagtgggtgaggtgacccttgacctcctgggatcgcatctggagagtgcctagtattctgccagcttcggaaagggagggaaagcaagcctggcagaggcacccattccattcccagcttgctccgtagctggcgattggaagacactctgcgacagtgttcagtccctgggcaggaaagcctccttccaggattcttcctcacctggggccgcttcttccccaaaaggcatcatggccgccctcagaccccttgtgaagcccaagatcgtcaaaaagagaaccaagaagttcatccggcaccagtcagaccgatatgtcaaaattaaggtatgtggtcctgggatggaaatgggtgtggggtgaagaaaagagtttccaacagtttctgacatcacctagtcaggattatctttgaccgatgaactggcttgtggaagagctttctgtagaaatacaggtctcccccagtgtgccctagtgctggtacttatgtctcttgatgtgtgaagcgaaactttaatgaaaagggacatttggccgttttgatgtgttcagagggctttgcatttgtgtcctgtattttgggttgccttgtgacagcaggatccctattttatagacaagaaaactcaggtgctgagagcagtgtctgcagctgtgcttgccatctcagtatctacacagtcccctcgcatcccattggtgcctcctccattgcttgggagtggcaatggtgggggtgccttcatccctagtggctaaagccacgagctcctggtttttcccaccaaaaaagtaaggaaatagtgaagtcc

SEQ ID NO: 3741 - DNA, 1299 bp, Homo sapiens; identical to SEQ ID NO: 3740

SEQ ID NO: 3742 - DNA, 1138 bp, Homo sapiens
aaaaggcgacagaattcgctgagtcagtaattgctgagcacctgctgtgtgccaggcactgctctgggctctgggggtgatcagcgacccagtggccaaaactgctgtcctcagggagctggcatttgcatgtggatgatggacagtgagcaaaatcaatgaggaaggtatatgggatgtcagaggatggtgcacttcacagagaaactgaacccgagtgggtggggtgctgagtggaggggttttgcagggtcctgccagctgcacatgtggactcagccatggggtgtgagaagaacgggcatgggggctcctccaggagcatggtggggtcacgccccacggcccggtgtcgtgttcagatttcccgcttaccagaagcttctcacctctctctcctctgcagcgtcgagggcgaggcccccagcagtgagactggcacatccctggacagcccctcagcctacccccagggccccttggtgcccggttccagcctgagcccggatcactacgagcacacgtcagtgggagcctatgggctgtactcggggccgccggggcaacagcagcgcacgcggaggcccaagctgcagcactcgacctccatcctgcgcaagcaggctgaggaggaggccatcaagcgctcacgctcactctccgagagctatgagctctcctcggacctgcaggacaagcaggtaggagagcacagcccctcaggccacacatgcaagcgcagggcagctctgcccaccatgtgtgcccccaccaggcatggtggcagatctctcccatagacttgagttggggtgcatgtgggctaaggctgagggctctgccccagttccagctccacctgtagctgctctcaggagcctcttgccccagctggctctggctggcgtgtatgaaggacctgggttgtctggcgttccttctggggacttctagagagttgtcttcacatgaggcctttgccatggcccgggttccatgacccgcatggcccagatctggggggccatgataggtgtctgagcatgaggcccagtgtcatcgggacacactgggtacgtggccggccactgaggttctaaagacccaggagagggctgagggagggaggtccattgac

SEQ ID NO: 3743 - DNA, 1177 bp, Homo sapiens
ctcggtgtccttgtctgtaaaattgggatactagtttctgcctcaagtaaatgaataatcctcctccagtgctgaacagtgtctacatctcacttctgatccgtctgtgcctttctggatccatttgcccattctcacctgacccagatgtccagggtcatgagatgtcagaggtaaaaatcagggtccctccttctgtcctttcctcccagaagtccagagggggaaacgtcttgcccaaggtcacacagcccctcgtggcaggacccacagagccgggtctcctgactcatgacatcactcgctcagcttctctggctgggccctggcggccccgtccctccggtctccggtctcgccgcctccgggcaccagggggcgcctcgtcccaatcgcagcccgccacctgacgccctcgctccagaccggcggggttccggctgcgggagagaggccgccgctcccggcccggcgttcagggcttccggggcaggtctgctctgcgacccaccagggagggcactcgcgcgtcctcgctttctccttaggtgcacccccgcgggcgcgctcccgcccatatcccttccaggcccagcctctgctatctgcgccacttcttccccgtctttgggctcccttccgattgtgcccaccccattctctgtaacagtcgccaggccaccagggcccgtcccagcatctaaatcgaggtcggctgagggatgggggcggcaccggcaggcccaggtccccaccccgtccccaaacagtcaggagggtgtgtcctggaggggacgcggaggagcgtggtgcagctgtgcgcctctgggccagtggcttccctgctgtgggcctcagtgttcccatctgcgaactggggacggcggcgggggtggggcgtttcggccggggctgcagctttccctcggaggagccgggggacttggcctgaggtgcgtttgttcgctgtttattgggggtctggggtagtctgagggaaatgccgggggtcgcagtgcccccggttccgcgcctggaccccgcgtaccccgctctcctgacccatccgctgcagcggctgcaccgacctgagcgccctccactcgtccaggctcgggtgacgtcggcggccggggcggcaccgtcctccccgccccctagcacagccgcgcacgca

SEQ ID NO: 3744 - DNA, 1197 bp, Homo sapiens
tcaaacaatggctcagggttttaatttttatttattcatttatttattagcgataaggtctcactctgtcacccaggctggagtgcagtgctgtcattatagctcactgcagcctcgagatcctctctcctcagcctcctgagtacctgggactgtaggcacataccacctcacctggctaatttttaattttttaaattttttgtagagatggggtcctgctatgttgcccaggctggtcttaaactcctggcctcaagtgatcctcccgcctcagcttcccaaagtgctaggattataggcatgaaccaccacacccggccggccaaggtttgtttttttttaattaaaagttgtagatgttgaattgttacaaaatatgcataacataaaacttacccttttaaccagttttccagtgcgcgcaaagtggcattagcacacttaccctgttctgcagccgtcaccatcatctgtttcagaactccttcctcctcccaaactgaaccctgtccccactcaacactaactcctcactccccacccgcagcccctcggggcccccatccaactctggtctccaagcatctggctgcgctggggcctcttcgcaacgtggtcctgcaggcttcgtccttctgtgtccggcttatttccctcagcatcaagtcctcagggttcacctgtgtggtaccacgtgtccagtggctcagttttgcctgtgggcacacggctgggaacccctgtgggtgggctccgagggtttgtcctcagtaagtggggtgctgcttggggggcctcccccatggaccatctaggttccttgctgcgtcccaaggggcgggcagctttggtgaacgctgccccaagttgctgagagtaagagcagagaccttggctttcccagggcctcacggccaggaggacccagaacacgagggtctttctgtctcctgtgtccgcggctctgatgcctggatggaaaagggtgtgaagcaggcccgagatggtgaggaccacgcccggcggtgtgccaaatccatgggttcctgtcccgcctgcctcttccagatctcagccaggccaggaggcaggggctcaatggggcagcccccaaagccctcagttcattccgcactatgtgcctgtgctgtgggtggctgttgcctgtggagtgggcccagtggactgggactg

SEQ ID NO: 3745 - DNA, 1157 bp, Homo sapiens
actgtgcacagagccacttgtatcattattgtttcttctttctctgttgagaaggaaagtgattttagaaagtcatggaatttagaatcaggtgacttgggtttcagcacatgtctcttatctacccacttctctgcatagttaatgctgctgattttgaatccaaccctttgtacgatgtgttatctcaatccctttaacgctgcagcctcttcacatgttttaaagttgtggagtcttaattttattaaattgaattagggcctccccgacaaaaaaggaggagcctggaaagttccatccccctcccacagcccatgacatgctcacatctctgtctttactttctgtgaggctttactcttacccagctcagcagttgccggacatcgagatgtgtaaaaatccgccacctaaaaggggtgtgcggggtgactctgaccatcccctttgaccctcacccctaggttggcctgcttgccctccctggcacctactgtgagccagtctctgggctaaggagtcaacagatgcccccgtactggggcttcaccaccaccaactttccctttcaccagacgatcctgcagggctgtgatggaccacatcaaataatgggaacaaaggtgtcttgaaagtgtaatattgtacgaatgaatgtctctcacctagggatggaatgtgaggggttgccgccacccctccattgttgatgagcaataatagcaaccttgatgactggctatttattgtaagcacttgccatgattctgtgaagtggggagcattattatctccatggtatatatgggggaactgaggcaaaacaaagcaagggtggttgggaaggttgtggtatgagcaaggatcagccaagcatatccctatcagagctgtcatctagacatttttaggggactcttagtttcagtccgttttgttcagagatcatactttgtgtgatttcagtccttttaaatttgttgagacccattttagggtctgagatgcagtctatcctggagaatgttccgtgtacacttaagaagaatgttttctgctgttgggtggactgttctgtacatgtttgataggcctagttggtttgtagtcttgtttgtgtcttatatttccttgttggtctgcctacctgctct

SEQ ID NO: 3746 - DNA, 1637 bp, Homo sapiens
tcctgggtgaggcaggcgcctgctgaatgctggctgtaactgaagagtgcgccgctttccctggctctgctgctaacatcgtctctcttcccaccctagatttcgctgcctcatcacccacatctcccaatgcattgcctcctgctcgcaaagccagccctccctcagggctgtggagcccagcctatgcctcccactaggccgcgtgaaggttcccggaggatgggtctcagccgagcctcgtgcacccccaagatggaacatccctgctgcattcacactggaacaagcccctccagatgagtgccccggccccaggccagcttcactgccgtctcttcacacagagctgtagtttcggctctgcccattagctcattttatgtaggagttttaaatgtgtgtttttttcctttcaagtcttacaaagctaagactttttggctcattcctttttgcatggttgtctagggtttctggacaatgtgctgttgcatttttattttcctagccttgctaaaatctttcccttctcaagactttgagcagttagaagtgctctttagaagttgtctgtgggtgatgttactgtagtggtctcagggaaaggattgtccagttactttagggggtttttggtggggtttttccccctgtgaaaacttactttgcccctagtctggctgctgctaggacttctgaggagcaatgggacatgagtgtccctgtatctgcgccactgccgcaagggaagcctcaggaaccagcacctggaggccaggatagccaagccctgggtgagcgagaggctggagaacacaggagctcacccagggctgctgcccaaccatgggccactgtgaacagacttcagtcctctgtttttgtttcataagccgttgagacatctgatggacttggcttaggccctgctgggacatcccacgtgtgatccctttcactccatcaggacaccaggactgtccttaggaaaatgtccttgagatggcagcaggagtcatattttctgtgtgtgtgtttcggaaagccgctgtgtcctgcctcagcacaaagacccagtgtcatttgctcctcctgttcctgtgccactccagaacctcagcagatctgagccaccgcctgccagtgtgagaggcggccactttcatggcagctcatcaggcgcagggccccagacagcttcccagcaggccctagagcccggcctgggccaatgatggagggcggccgccagcccagggcctgcccatccagaagggactccccagggcctgggggaggagacccttggaaaagtcctctcttcccagctcctgattctggatctgagattctcagatcacaggcccctgtgctccaggccgaggctgggctaccctcagggagatccagagactcatgcccatggccatccatgcgtggacgctgtgtggagagtccaggatgacgggatcccgcacaagctcccttcagtccttcagggctgggccatgtggttgatttttctaaagctggagaaaggaagaattgtgccttgcatattacttgagcttaaactgacaacctggatgtaaataggagcctttctactggtttatttaataaagttctatgtg

SEQ ID NO: 3747 - DNA, 1198 bp, Homo sapiens
aaaggtaatttttgggtacttctgcctgtttttaagactttctcttagtcttcagttttcggcagttttattttgaaatatttgtgtaggctttgaaaaattgtgcttgggatttgttggaatttttgaatctatagatggatttttttcatcacctttggacaattctcagccattttatcatcatttattgcccctctatctcatagcttctactggattccaatgaaatgtatttagaccttttactgtgttctctctgtcttttattccctcatttgttttcctctcacagttttatctcattgtgcttcatttaagacattttctttttaatctatcatctaacttaattctctctttagctgtgtctaatccactgttaacccatccttgtgttttttaatttcagtgtttatattttgaaattggggaatttatttatatttagctcaaatctgccattcattttttaaaatatagttttcaattctctgctgaaattatcaatcttttctgttgtctcctgggacttataaacatagtaattgtaaagacttttcctgatcatctcaatatccagaacctctgtgtgtctatttctatcgtctgttgactgctggtttcattcatgttgtcttgtctcttcatttgcttagatatgtttagctatttggtagatattttatatgctaaattgtttgccaaaataactcgaggcctaggattgtaggtattctctttcagagaatatttgtgtttgcttctaccggtatcctagtggacactagaatttggcatcacctcaatgcagtttcacagattgagagcttctgggtgtccagatgactggaagctggactcgccaacttcctgttcacttctgcgcatcagatctttgttaatgcaatccacatatacagtttgctttttgaactggtacctcccatgggccagttagtatgagttaaggtgaggcaggggcagcaccaggggtgggagaccataggacagagccaacaccagcagacttggcagggagggaaccaaaaggagcagcttccaatttagtgtgagaaagattcctccccctggagctgtccagggagggtttcccaggtgggaggaagcactttaccatggcaggtggggagcagggtttgggtgctggaggaagtgcagaggggaatttgggcat

SEQ ID NO: 3748 - DNA, 1199 bp, Homo sapiens
caataagagttagaactggaattcagacccatgtttggctgtccaaatcccatgttcttttctctttacagttagggtgaaaagaattatactgtggccttatctaagatgctacagattttagccaatacatacatacaaccctgaaggatagctggttgatcactgtctgagctggggacatcttgatgtattggttctctagctggtgacttaaccctattagattacaggatttctatcatatcattagcaaaagaggggggagaaaaaaaagcaaaatttcttattctgtttaagggaaagaaaccttccaaggaaagattgactgcggatccaggaggctcctcagaaacttccagccaagttctagaaaaccacaccaaaccaaagaccagcaaaggaaccaaacaagaggaaacctttgctaagggcacctgcaggccaagtgccaaagggaagaggaacaagggaggcagaaagaaacggagcaagccctcctccagcgaggaagatgagggcccaggagacaagcaggagaaggcaacccagcgacgtccgcatggccgggagcggcgggtggcctccagggtgtcttataaagaggagagtgggagtgatgaggctggcagcggctctgattttgagctctccagtggagaagcctctgatccctctgatgaggattccgaacctggccctccaaagcagaggaaagcccccgctcctcagaggacaaaggctgggtccaagagtgcctccaggacccatcgtgggagccatcgtaaggacccaagcttgccagcggcatcctcaagctcttcaagcagtaaaagaggcaagaaaatgtgcagcgatggtgagaaggcagaaaaaagaagcatagctggtatagaccagtggctagaggtgttctgtgagcaggaggaaaagtgggtatgtgtagactgtgtgcacggtgtggtgggccagcctctgacctgttacaagtacgccaccaagcccatgacctatgtggtgggcattgacagtgacggctgggtccgagatgtcacacagaggtacgacccagtctggatgacagtgacccgcaagtgccgggttgatgctgagtggtgggccgagaccttgagaccataccagagcccatttatggacagggagaagaaagaagacttggaggtaaggccttggctgcc

SEQ ID NO: 3749 - DNA, 1106 bp, Homo sapiens
cttgagtccaggagtttgagaccagcctgggcaacatggcgagaccctgtttctacaaaaagaaaaagggaaaaaaaaagcagggactgtcattctcatctcctccctggggtatccacaggaatggacattcaaatggttgtagcctggtggggtagaaggcagagaagactacccagccagtgaagtgcagaggatagacataggaaaacattccaggcatttggagacagctgaaagtatccatgctgactttcatgatttagaagtctttaactgaattattaaaattgccttttttttgtgctgtacaatgtctactgtactgtgggtcatttagatgagatgaaaaacttaattaaatctgaagtgtcagaggcgcttagtaagccttagtaaagttgtgattgaagaaacttaatacaaatgaactagaggtttgtaatcatgccactcactaacgattttatttctgtagcagaatcattttttctatgtaaggtgttaatgtgtgtgtatgtgctttggttgtaggaaaacttgaaaattccaaaatccttattttcctatttgagaggctggttcagcagggtgtgtgtgtgtgtgtgtgtgtgtgtgtatgaatggtatatttattacattattttgaaagagaattagtgtgttatgtggataatgttatatacagccaaagtggatgtttctatttggcaaggaaggtaggatttctgaaactcaggccttaaccaataggttggaagacaagaccaattgaagagttaggaaatgtgagtttttgttacttctgttattccagtcttggtttcattgtctcattctttatttttaaaatcttgtgcctaaaagtttttttgcttaattatgaagtagacatgcatgtttacatttatgtaaaatatttgctgtgtaaagtattttttgtttattctcttaaaagatcactatatttaaataaaagtgaaggtcagcaacacatttcttgtcttggtgggtttcattttcttttagaaatcaatgagcaatatagggttcttttaagaaccttctgtgcttaagcctaaatagctaactaaatggattccttt

SEQ ID NO: 3750 - DNA, 1313 bp, Homo sapiens
gagtctactgtccaagggatttatctcccagaagcgcatggaaaacatcacaacactacctctataaattggactcatggcaggattccaaggaattcagtatgccatcaacattaagcaatataatcagaactaaactcaacaaaatttttctttcagtgataatcctaatttttggtaaattatcggggaacctgcccccaataattcaaagtgagtccttttctattttccctaagtgtcggctggtctgagaaataaagggaaagagtacaaaagagagaaattttaaagctgggtgtctggggagacatcacatgcccaagccgcaaaaccagcaagtttttattagtgattttcaaaaggggagggagtgtacgaatagggtatgagtcacagagatcacatgcttcacaaggtaataaaatattacaaggcaaatggaggcagggcgagatcacaggaccaggtgaaattaacattgctaatgaagttttgggcacacattgtcattgataacatcttatcaggagacaggggccgggcacagtggcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacagagcaggtcaaaactcccgtgctgatcaggagacagagtttgtgagcagacaactggtctgaccaaaatttatgaggtgggaatttcctcttcctaataggcctgggagcgctatgggagactggggcttatttcatcccttatctgcaagtgtaaaaagacagacgttcccagagcagccattttagagacctccccctaggaatgcattctctttctcagggatgttccttgctgagaaaaagaattcagcgatatttctcctatttgcttttgaaagaagataaatatggctctgttccgcccggctctcaggcagcctgacctaatggttatctcccttgttccctaaacatcgctgttatcctgttctttttttaaggtgcccggatttcatatcgttcaaacaatttgtgcagttaactcaatcatcacagggtcctgaggtgatgtacatcctcagcttacaaagatgatgggattaagagattaaagtaaagacaggcataggaaatcacaagaataatgactggggaagtgatgtgtccatgaaatcttcaccatttatgtt

SEQ ID NO: 3751 - DNA, 1277 bp, Homo sapiens
gagggataaatgtaatatggaatatatatatatatatactttagaaatgttctggaagattgtgtatatgttatgtaacagttaatccactcatttaataataggtgacttgctattttgaagaaatgcattgtaagttatttttaaaatagtgatatggtttggatttgtgtgcctaaatctcatttctagttataatccccagtgttggaggtgggaccttgtgggaggtgattggatcatgggggatttcccctttggtactgttctacattctcgtgagatctggttgtttaaaagtgcctagcacccccgtgtccccattttgctcctgctccagccatgtaagatatgcctgcttctcctttgccttctgccatgattataagtttcctgaggcttccccagaagcagaaaccgctatgcttcctatacaacctgccaaactgtgagccaattaaacctcttttctttataaattacccagtttcaggtattttatagcagtgtgagaaccgactaatacaaatagagtcccttaataaaacaaattcccattcagttaatcttttattataaaactgaatttctgtatatcatcttcacttaaatttaagtgcagtgactgtttaactattacagattatcaatacggagattattttacatgtcttggtgtattattggttttagaacctcctatgttttaactattaaagtatcgcttttaatgtcactaatcaacctgttcatattgttgtctccttactaacaatattctgccttataagccttccagatccattacaaaatcacatgaaccctttacctgctcaccttcttgttctgttacctccttggagccttagttttgaaattgaggtgttttgttttttttttctctgaccacaacttttttcattgtcagttctcccacttctttacctacagtgaatctgaactctgctgtattggaacctacttcatctaatctgtttggttccctttcgccacaaactgacctcttgagaagtcttgaccttgtgatttgagcaacattatgtataatagtgttttctgaagtatgggacagtttttactaccggtatatttcttgagattttgtttgggtgaccagtctactttaattactagatattgattgatacttctttgctcacagtccagaatcagtccagactgggtgttgtaggcataattatcccatgcctgcattattctgggctatttgagggtctcccagctcacttcatatc

SEQ ID NO: 3752 - DNA, 1174 bp, Homo sapiens
aaatcctgccaaagcccaagatttgattgtcttaatccttaagtcctgcagtaaagttaaagcatgcataactaagaaagagataccaaatttatcctctaacaccagaggctatagtagtgacactgagtgttctggccccacccatatccctctggtcttatagctttagctttctctgaaaaaaagttccaactgtcagttatctgcatttcttcacctgggtttctttttttttttcttccgcgaaagccaaagaagactgctttatgatgtggggaaggccagaaaagccttggaagtcacattccccagaagcagtcctcaattgatgactgacaggagttggtgtataaatacctcagctccctcacctctcccatgggatagctctgaggtgcatgttctacaccattccccacagtgtaccatgggattaagctctagtcacccacagtggtagctggcttgataatgcatctttaactggctacattcccttctccacttccttactagtgtttcctgggctcatcttccaagtaaaccacttgcacacaaatccttatctctatgtctcctaatggggaaacccacccaaacacacatggcttgtcccaacaaaagcttgcatctctaagagttatctttcttatcacagtttaagctttgtttcaccagtagtctcaacccatgcacaagataaccccattcccctgagttgaacttatcctacaaactgcaaggccacagtatgggcttctaggcagctgtgcccaaaagaaaagagtctgggggaggggcaagatagttggtccttatcccaatctttttttttttttttttttgttggagtctcactccgttgcccaggctggagtgcagtggtgcgatcccagctcactgcaagctctgcctcctgggttcacaccattatcctgcctcagcctcccaagtagttgggactacaggcacctgccaccatgcctggctaattttttggtatttttagtaaagacagggtttcaacattttagccaggatggtctcgatctcctgacctcatgatccacctgccttggcctcccaaagtgctgggattacaggtgtgagccaccgtgcctggccggtccttaccccaatcttattataacattagacatccttcctccct

SEQ ID NO: 3753 - DNA, 1158 bp, Homo sapiens
tgtccttttatccattgtcccatgactaacttccatacagactcaaagactcagcccacacacgccttgctccttaaattttcccctgatccttgacactggaaataattgaattctcatagcacttctgtttatacacagtctatctagacttgagggcaggatctagacttgagggcagtgccttcaatccctcatatgtggtcagcagtcaagcaggtgatggatagacaaatgaataagtggagatttttattgtcattagttatacgtaagttaatgaaactaggaatagctttctttttctttcattgacaaatctctttcagatctctagctcatttctctccctaatacttctttaaaaaaaaaaaaataagctgttctgattattctatttgagcttggtgttgctttgggaaacaaaaatcttaaaattccttcctgtttcccagagatagagaatttgtttttgtcaactgacgtttagtattttttttcctggctggagaagtgcctagtaatctgtttgtgtttgtcaccatttttttttgattatttctaaatgaagcaaaaataaccctactgatgaactgcacattctctctccttttcataactgcctgttgtcctgggaaaaagaagacatcgtttaaactcatggtctttgaagagatctaagggatttatgagccaaaatgggatttattacatgtttattatttaaaagtaatgtgtatcatagtttttagtcacatgcttattttttagaagtatagtttataatagtttttcgacaggcaattgttttttagtggcctcattttagatcttcccatgagaccaaaatgcatattcaacttactacttggcactttgtcagtgatttgagggttaactgttttgcctgtgataattaccaatattgaaagcactcataagtgttagcagtacttgttacaacaatgctattttaatgtcttaggaaagggttaggtcccaccactgtgagagcagagtgaggggctgtttaaatgggtcagacaaggccgggcatggttgctcacacctgtaatcccagaactttgggatgccgagctggaggttcacttgagcccaggaatttgagaccagcctgggcaacatggcaaaaccctg

SEQ ID NO: 3754 - DNA, 1146 bp, Homo sapiens
atgatggacctgaatattggctggtttaggcagaacggaaactgtggctatgtcctccggccagccatcatgagggaggaggtctccttcttcagcgccaatacaaaagactctgtcccaggggtctcacctcaacttcttcacattaaaatcatcagtgggcagaactttcccaagcccaaaggatcaggtgccaaaggtgatgtggtagatccttatgtctatgttgaaatccatggaatccctgctgattgtgcagaacaaaggacaaaaacagtgcaccagaatggagacgctcccatttttgatgaaagctttgaatttcaaatcaacctgcctgaactggccatggtgcgctttgtagtgctggatgatgactacattggggatgaattcatcggccagtacacaattccctttgaatgtttacagacgggctaccgccatgtccccctgcagtccttaactggagaggtccttgcacatgcttctttatttgtccacgtggctattactaaccgaagaggaggaggaaagcctcataaaaggggcctttctgtgagaaaagggaagaaatccagggaatatgcatctttgagaacactgtggattaaaaccgtggatgaggtattcaagaatgcccagccccctatacgggatgccacagatctgagagaaaacatgcaggtgcgtgcttgtgtttaatcatttactcaatggttttcctactttgtacatgtccatagtttataaatatattggttttttaataatagtatatttaagtagtttttaaattctgattagttcttagaatgtttgccactagtctgttttttatcatttaacttcctaaaggtacagttgatgttgaaaatattgattacatattgggataagtgagtctcgttgctgtgttacacaccttcatcccagtccctgttaatgactgctgaacagttccttgtttttttctaatagtatacatgggaatctctgggatttctgaatattccttacctggaacacaaattgatgatctatcaaaataaaaaggatataggtcaaagtaaaatggatgtgatccagtcctttcttacgaagctgtaatgctgaggagatgggaaacctttaaatgagccataa

SEQ ID NO: 3755 - DNA, 1174 bp, Homo sapiens
tgactgtctgggcccacacagttaaccagcccatttctccacactggtacagtagtcacctgtgaaaaaaaaattggaacttactaatttgggcttttcaaaaacattctttgtttagaaggagattctaaagttatttatgatgcttagccatagtattcaggcaaatgttcatttctcctggtacctgtatttaaaatgtacattccacattttaataaattaaccacaagaaaataatcccacatatacaaggtcaggggtggggaagagtattaatggtatcttaattatacccagtctggttttttttttttaaatggggtaaaaatcaaatgcaaccccatcttgttttaggaattttgagaactaataaatgcaccttaatggtcagtgttcctttcaaacatgtgagttctttaacaaaaatgaaataaaccaggtgtctgtgatttctaattaatcaccgctggccattacacaggttttgttgtttggggtggggagggggcttttgttcccttttgacataatatagtcaatgcactaacaattatgtatattcaaacttgattattttaaattcgatcttcagctgtactgtaaatagggtactgcattgtagtctccatatctgtattacttttctgtaatatttaagagttgcttaaaagcatacaaaatgtactgttactaaaacagctaattatttctctctccccctttgacaggaaggggcttcagttgttcctccatggctagaaccataataaacaatgtacccgtaatttgtaacataaagtattgcaatatgttagtaacaatcttgcagccttcctttccaaagttcattttattttgatcagttcagtatattgcactaattattttaggtattttcattatatgaaagctaccatgtgtcagagatgatttaatctatttaagtgttggactgctaggagaacttgtacatttatgataatgcagaattaggaaaacggttcaccagtgtttagttttatattgaggtgctcaggttggaataaagtggtataaaaagcaagtatcggcttttctcttttccttttttttggcataaaacagtgaatatatataaatgatactatatgacctagtatccgcttttatattttctttactatgttcataa

SEQ ID NO: 3756 - DNA, 1153 bp, Homo sapiens
atgttctcttccgtgcttataaacatttcactttagtctctatgagattgtgtgaatttttctgtggtcgtaggctacattttcacactacataaactatgcccctggttatagaatgcacatgcattctgcagtacaccaatgtatttgtttgtagttggctttattatttattcgtatgtgtatatttaaacattcctgacttggttcctgacaccaagaatacatacatgtatattttcttggaaatactatggaatataaatgagtattagcatcaccctgcgttgatcaggtgaatttgatagaaatgggaggggaaattttcttaataagtcctaaacccaagaataaacttttatatttttttttctgcttcatagctgtggaaaattattgcaaccaaactattgaaaccattcttaaagttaaaagaattgttattttaggacaaattttgaagataatacttttttgggggtggggaacttctgctgttattgttgctgtgctggaggaatggtgcttattcttttggtagcataactagtggtctgacatgaaaaactcttaaaacttaccctatattgggtctttaactgctattttatgttaaaaccttacatattagtatgtatatatatatgtgaatgcatacatatacaaactacattttcttatttttaaaatatcttaaggtacatgaaggagttaacatgttcatgaaacattgtgacatggaaaggtacttaggacttagtctaaaatggaaaaaaaaaagcaagacgcaagactgaatatgtagtatattcaatttaaaaactttctggccaggagcagtggctcacgcgtgtaatcccagtactttgggaggctgaggcaggtggatcacctgaggtgaggagttcaacaccagcctggccaacatgatgaagccacatctctattaaaaatacaaaaattagctgggtgtcgtggcactcacctgtagtcccatctactcaggaggctgaggcaggagaatcgcttgaacctggggaacagaggttgcagtgagccgagatggcgccactacactctagccggggcgacagagactccatctaaaaaaagaaaaaaagttctgaagtgaacatgtgtattacttttaaag

SEQ ID NO: 3757 - DNA, 1227 bp, Homo sapiens
gctctttgtatagatgaacgtgttgagaaccacctttatccctcacagcttccatcttaaaatgtatttagaactacctttatccctcacagctttcctcttaaaaagcagccaaacaacagaaaatccatccaggtctggattctagtaaagtcatttccggataccaactaggtcgctttgaggtggagtttcagcacctaaaaatcccctgctttgcagtgaagggtaagatgagagaaacaggcaattggagtcattctgttttttcctttttgttccagggtagttacatgtacttaatttgtttgaaacatgcaagtagattatggaacattaatataagctgtctataagttatccaacctatccgagaagcattcaacagtagtcactgtgtatttgggtgaattagaatataattgacttctctagtagacttttgagctgagttcatccttctggtttgttgactcctcacctggttctctatcgaattcatattttggaagtcatacctctttttttattgttagtttttaagggtgaatccagaatcttctttaatttctaatgctaacaagggcatagtcttaagttttctgtttactttattctgaactgcaaaactaggaaggagaatcggggtataagtgctctctgttctgtcagctcacatgcttcgtagcataagcaggtgtgtgatgattatttcagagcaaaaggaaagacttagtaaaatttgtatgtatgtattcaatttgattatagcttcactaaatatacaagtgaatataatgaaatggaatttcatgcaactcaattaaattagcttctttaccaccatattaattatccaaattttattaatttgaaatattttcttacattgttactttaacaacaaatgcgtcttcaaattaatcatctcttctgtgtattgaagaatagttcttttgattgttgtgctctttaagactttttaatgcattttctatatttagttatttcacaaattagtataatggctataattataataatttcttctagtatatggcagaacttaattttgcctatgaatttgtaaacatttccagaagatagaatatcttaagaatggatttaaaatttgggatttgggccaggatcaaagttcttgacctcatagtttcaagcatttattttttatatatatatatatgtatatatatacgtatatatata

SEQ ID NO: 3758 - DNA, 1160 bp, Homo sapiens
caatcttaattggatttctggttatatcacaggtgataagctatcacaggtgacaaactgtaaaatgttcaaacttatgctcctaactggttgtcccactagtaacctgtagcagtggttcccaaatgcaaactacctgcttaaaggtcattgttgtgggtggggcacttaaatatatggattcttgggtcccctctagatattctcaatcatcgggcctggggtggggtctagaaatctttagtctttaaagttccatcgattattttgatgcacagtgaaatttgggaatcaccaattttctgtacaatccataaatctgcatgtagtgacatactggtaaacctttattttttttgtatactaaaggaccagcagaattgggcccatgccaacatgtcacctctagggcctagactgccctcacttttgtttttttctaggttggtttcttagcactaccaagttgaacatgaacagtacgactcctgcctctaggaggcagcttggaatattgtcagtactggattttagagagcctggcttctgtgaatgaactcttggccttggttcctcatctgtaaaaagattttagagtagccttttgcctttaagtgtttaccataaactagataaaagagcattcccctttatctgcaacccctgtattagtgttattttcatatatagtccacttttcattaactgcactccaggtgtcatagctgtatcagccagtgtctctagactttcttcagtttgctataacaaagtaccatgaattggatggcttataaacaacagaagtttatttctcacagttctggaggctagaaatatgagatcaaggtgctggcagcttcaggtctggtgaggatgcgtttcttggtttccagacaactgtcttcttgctgtatcctcatatggtagagaaaagttagagagcttttgaggttctctttaagaacactaatccttttcatgaggatttctaccccctaacccagtaccttcaaaggctccacctcctaataccgtcacattgaggattaggatttcaacataaaagtttcgaggggatgcaaacatgtaggcaggtaggcaaacttatgatgaccaagaaccggttctaacctcaggaaatgaagcaataatggtaa

SEQ ID NO: 3759 - DNA, 1124 bp, Homo sapiens
tttgtctgtcacagaagagagctgcttatgattttgaaggggtcagggagggtgggagttggtaaagagtagggtatttctataacagatattattcagtcttatttcctaagattttgttgtaacttaaggtatcttgctacagtagacagaattggtaatagcaacttttaaaattgtcattagttctgcaatattagctgaaatgtagtacagaaaagaatgtacatttagacatttgggttcagttgcttgtagtctgtaaatttaaaacagcttaatttggtacaggttacacatatggccatttatgtaaagtccctctaagactacatactttttgtttaaaacaaaattggaatttgttttcccttcttggaagggaacattgatatttaacagagtttttagagattgtcatctcatatatataaaatggacacgtggctataaaacaccatataagagatgagtagtgcgttttattttatatgccaatctactttgtttaaaaaaggtctgaatcaggacttgtgaaaacctgtagtgaaataccttaagctgttaactaactgtaaggcgtggaataggagttgctcagtggattggttctatgttgtggactacttaagtctgcatttgttactgtgctaataaacaatattaaaaaccacctaataaacactgctgtgttcatttacttttcttttgccttttggttgccattcgcagattcttctgaaatcgataggtatctgcttctaaaacaagctaaaaataatgcatatttagtaggtattagttagttacctatattaggatctgtactttacacagctgtagatgaggtatcctagaaaaggttaaataatctaccccatttaggcttcaaagacgaaccctactgcatctttttaaaagcattttctgacttgcagatgctgtagtagcaagtacatgagaaatgggttccgtcatggataaattggtaccctgccttagggggcattttggcagtacatgtcctgacccagcagttctgtttctgtatgtctctttcagagaaacttatctggatacacatacattcattacagaatttaaaaagaattggtaactgtttg

SEQ ID NO: 3760 - DNA, 2537 bp, Homo sapiens
attaagcaacttttctgattgtacttaggtgagctgtctcgtatataaaacagggtttgtgatttttactaatcttggtgaagagtaattgcttgaaagacttgtctttgttacaaatgcgtgtgtatatactggaagtacttgtggaacctaagctttaaagcggcaagaatatgcagaagagaccaaatgtggcctgcacagcctaaaatatatactaaatatttttaaagctaaacgttgctgagctctcagttgtatggaaaaagataaggtccccaaaccctaaattttgttacccagatattaacatattcctgccctagtcaggaatggagtattaagagggaatgatgtgtttcagtctatgtgtgttgttttagcaagtctacattatctcattacacttgtgatagtctagggagaaatgcttagtaaataacttgagtagtaaaagactcttgtctggtggtgaactagagttgagaattaaaattctttctgacttgctgctataggcaatgtgggagattgaccttgggccttttttcctattctaggagcgagctggacgccactgtggggctctgagagtcctgaattcttactgggttggtgaagattccacatacaaattttttgaggttatcctcattgatccattccataaagctatcagaagaaatcctgacacccagtggatcaccaaaccagtccacaagcacagggagatgcgtgggctgacatctgcaggccgaaagagccgtggccttggaaagggccacaagttccaccacactattggtggctctcgccgggcagcttggagaaggcgcaatactctccagctccaccgttaccgctaatataagtaaagtttgtaaaattcatacttaataaacaatttaggacagtcatgtctgcttacaggtgttatttgtctgttaaaactagtctgcagatgtttcttgaatgctttgtcaaattaagaaagttaaagtgcaataatgtttgaagacaataagtggtggtgtatcttgtttctaataagataaacttttttgtctttgctttatcttattagggagttgtatgtcagtgtataaaacatactgtgtggtataacaggcttaataaattctttaaaaggagagaactgaaactagccctgtagatttgtctggtgcatgtgatgaaacctgcagctttatcggagtgatggcaatgctctgctggtttattttcaagtggctgcgttttttttagtttggcaggtgtagactttttaagttgggctttagaaaatctgggttagcctgaagaaaattgcctcagcctccacagtaccattttaaattcacataaaaggtgaaagctcctggttcagtgccatggcttcatggcattcagtgattagtggtaatggtaaacactggtgtgttttgaagttgaatgtgcgataaaattattagccttaagattggtaagctagcaatgaatgctagggtgggaagctggtgagccagtggccattagataaatacctttcaagtgtgagcttagacgtcaaccctaaaatacttaaccgtaatgctaattgtgatcattatgaatcccttcagtcacattagggggaaagtagttggctataagtacgtcattcttagtccagtcagtcttaaaaacatcttgggttacccactctgtccactcccataggctacagaaaaagtcacaagcgcatggtttccaaccatatgtgttttctgcagttatttctcttgttctggccaaacaaccctaaaaatccttaccattccacaaagttggaccatcacttgtgcacccactttgactatgagtataccaccacattgcatttctgtttgcaccatgtcttccaggagactagactactgttgtccagggtcaatttgagtgtaaagaaaatgtagacaaggaattgcccaattttaaattctgactttgctgacttaatttaaatgctcgttctgaaccaattttctcctatcttctctaggggtttcaaaagactcagttaattgatttccaggaagtactcatagcaagttcataaaagttcttgagacctaaatttcttcacaaaaaaagaaaagatcttaagtcatacattttaattgtgtagaggttgttcaactgaaggaataaatgtctattaaactaaaacaaatggaccttctgttattttttgtcatcttacagtgctaatgtactttaaagcaaaccaaatgccctaaccagcaaaaaggcatcaaaatgtgattatagaaataatataatttgagatagcataaaatgtacttattctctcagttctttgatcattgcatgaattaggtttttatctaaaactgttcagctgggtgtggtggctcaggcctgtaatcctggcactttgggagacaagctggaggatttgttgaggccagcctgggcagcatagtgagacctaaaaacaaaaaaaatccttaaacatgactaatttgggaaggaga

SEQ ID NO: 3761 - DNA, 1250 bp, Homo sapiens
gatggggtcctgctctgtctccaggctagagtgcagtagcatgatcatggctcactacagccttgaactcctgggctcaagtgatcctctcgctttagccttctgaatagctggcactactagaggtgctgggtgcaaaccacatgcagcaagtttttaaatttttttgtagaaacagcattaccttatgttgcccaggctggtctcaaattcctaggctcaagcgacaatcctcccacctcagcccccaaagtactatgattacaggcatgagccagtgtgccgggcctatctccctttttaaatcagtgggagttacatgtgctttgaactttgcggaagcaggacgaataatgggaaataaggaaatactttattttttgcttttggtgtaagcaaacatttcatatcagtatcctgtttctaaagttaatggctttactgttgagatttgcaaaaataaaaaatacgtattatcttgtatctaattatgtgattttcctcctattttctaggaggtgtgattgcctatatcagttcttccagctcagcctcaagccctgcctcttgtcacagtgagggttctgagaatagtttccagtcctcctcctcttctgttccatcttctccaaatagctctaattctgataccaatggtaatcccaagaatggtgatctcgccaatattgaaggcatcttgaagaatgatcgaatagattgttctatgaaaacaagcaaatcgagtgcacctgggatgacaaaaagtcatagtggtgtgacaagtaagttactttggttttctaaagattgctgccattaattgcaaatggggcttattttatcagcttttcatttaggtggccattatgtttctgggtacagttttcactccttgctgggtaatcatacatcagtagttagggaagaaatcagtgatgatgatagaagttataacctaggggctgtcattaattcttgcctcagagcaagacatgtgattatgtactctgcctgaccctggtccctctagggtaccctcttttactacatttcacagttacttttcttctgaactactagaactaagtcttgtttctagaacagagtacttgctcattgtgggaaggggttacgttagtgaaactggatttgggaatatttgggatgaggaaatgttggattgggataaccaaatgagtagggggatttggacctatctggcctctgtaggtgaagtaaattgacacagc

SEQ ID NO: 3762 - DNA, 1244 bp, Homo sapiens
ttgaatttttactaatctgggcattgtgcatactttttgggtaatatataatttcagaaataaaggtgttacatttttcaggctagaacttggtaaatatgaaaccaccaaggtggtgaattactgtatgtaatctttttcctccaaaaaataagataactggtcttacacttaggttagcattatgattctaattttaaaagcaccattatttgtaatacttcctaaacataagcgaagtttaaggagtgatagttcttaatactagtctttacttcctttcataacttttaaatctattgaaaaaaaatctagaaaccgaagaagacatcttttgatcaggattcagatgtggacatcttcccctcagacttccctactgagccaccttctctgccacgaaccggtcgggctaggaaagaagtaaaatattttgcagagtctgatgaagaagaagatgatgttgattttgcaatgtttaattaagtgcccaaagagcacaaacatttttcaacaaatatcttgtgttgtccttttgtcttctctgtctcagacttttgtacatctggcttattttaatgtgatgatgtaattgacggttttttattattgtggtaggccttttaacattttgttcttacacatacagttttatgctcttttttactcattgaaatgtcacgtactgtctgattggcttgtagaattgttatagactgccgtgcattagcacagattttaattgtcatggttacaaactacagacctgctttttgaaatgaaatttaaacattaaaaatggaactgtgttctctgtctctttactgaagataaaggtgtagtaaaagctcccacacacctttaaaataaatatattttattctttgccaggagactccatggaaaaaggtaaacagtatatgaacatagaaagcattgttaaacaaacaatctcaatgtacaaacagagccagtgaaagtacatcacagacttgctaatatatcaaaaaaaaaaaattccactagtgcttaaatgagaactaagaaactgacacttgtatctgttaaccactctaccacagctttcactctgcttcatagtgattgaacaaggtcaaaggaggcagattctatgcctgtttctttgggagttgttaatattaattagccccttggcatcaagaaggctggaaaaaaaaatcccaatatcaggcatgaatcaggaaggacactagagttacatg

SEQ ID NO: 3763 - DNA, 1197 bp, Homo sapiens
cacacccttagactatcaaagaaacaggcatttcagcgctatgttgaagacaaccatcatgacacaaattattcaaaaaagaaatagtgtgttgtatttaacattacaatttaggctcctctcagtttgtcttaagagaaaataaaagatgcttcttgccttcttgtcttttttttgttttgttttgttttttgccattgtagctactgccaattgagacattctgtagtttttctcagattcagagaagaaaatatctcacaagtttgttcatccaacattgtaatatgagttcttcagattcctagagaaagctcaaaggctgtccaaatccccacagctatggccatctctagtcttttgattttaactatacaaggaaattcttattatgaaatctttttatgaattatttttaaacattttttaacatttgtaatgttagtttttccaaggaaaactttgttgttagcagcaaatttttccagaataaaacgctgacaaaaaaatcagtaactttttaaaaaggctttatttagtgctttatatgttgctggcactgtttgatgagacgggtttgtgtgtgtgtgtgtgtgtgtgtgtgtgtgtgtgtgtgtgtgtgtttcacatgaaatatgcacatacacatttattttttatttaatttagctactttagctcatttaatcttcatgacaaccctacaaggtgcatttgcttatcataaattatcattcattttatggaacagaatgaggcatagagaggtaaagtatattgcaaaaacgtacacagctagtaggtggcagagcaggattcaagcgcctgtaggttgtggtataaacattttcctcaactgcctcacaacacttgctatgtagcctccacaactgtatgactctaactgatgggatacgtacacatgaaaaatggttaagaggccatatacagcaaaaaagtttgtgctgtacgactgcttatatgcacctaaaacaaacaaacaaaaacactggtgtgcttaccttaaaataaacttgagactttattacagttctggaagaaaaaattgtttttcacagacctgagctaaatttttgacaatgtataaacatacatgagggctagtagcacagtggggatgccttgcaagtgtaagttttgctagtctatgattgcattgggctgggatacagaaat

SEQ ID NO: 3764 - DNA, 1231 bp, Homo sapiens
cattgttgttgttgttgttgttgttgacagagcctcactctgttgcctggctggagtgcagtggtgctatctcgactcactgcaagctccgcctcccagattcatgccattctcctgcctcagcctcccgagtagctgggactgcaggcacccgccaccacaccgggctaatttttgtatttttagtagagacaggatttcaccatgttggccaggatggtctcgagctctagaccttgtgatctgcccacgtcagcctcccaaagtgctggaattacaggtgtgagccatcgtacctggccttaaattcgtttttaatgaaaactttctattagttccataaatgaaaaagtggtatcacttgccataataaaagagaaccatgaaagaaaatgtgttcttatgtggccctgggatgttattggtaggcccaaaatctaaggcccactctctacattagaaaggagagaattagcaggtgtcaagagagctgttaaacacatgctggcacaaaaatgaaatcttttttcttgaaatattcataagggtctatggccataccaccctgaaggtacccaatctcgtctgatctcagaagtaagcagggttgggcctagttagtacttggatgggaaataatcagaaggatcaaaagataaatgaaaaggaggccatttccttctctgtgtgattcagtgttgttcattgttgtgcccatacactacctaaatcatagtatgggacacatgaacagctctatcatttgaagggcccattgcaaaatgaaaatgtgggtccttgtttaaaaaattattaatatactcaaaagaagacacacaaatggcaaacaggcatatgaaaaggtgcttaacatcactgatcatcagaaaaatgcaaatcaaaactaccatgagatatcctcttaccccagtttaaatggcttctatctaaaagtcaggcaataacaaatgctggtgaggatgtggaaagagaaccctcgtccacggttggtgggaatataaactagtacgatcactatggagaacagtttggaggttcctcaaaaaactaaaaatagagctaccatatgatccagcaatcacactgctgggcatatacccaaaagaaagaaaatcagtacattgaagagatacttgcactcccatgtttgttgcagcactgttcataatagccaagatttggaagcacctaagtgtccatcaacagagga

SEQ ID NO: 3765 - DNA, 1215 bp, Homo sapiens
gtgtaatttttctttatcttccttttctcattttcttatgtacacacaagtatgggcaaaattggagtatgttagaactccaaactcaaggataagctagactaagaccctgttttgataaaaaaaaaaaaaaaaaaaaaaaaaaagttagtgggatcagtaaaaaagttacctacagttaacattgttaaacattttgaattttaatcattcttgtttcatattctccctgatctttttatgtattcctccagatatgagctagttctttgtatgcaacacaaaaaggtgtgggtttttttttgtagtttataaagaaggcaaattgttttgagatgttgctttcaaacttatgtaaggtaaacaaaatgtaatgatgaagagtacatacattaatatttttgtgtctcattttatatgtaattaaattttccatttttttcttcctaggtttacccagggttgatgataaccgctggccttattcattggattttaaatacattgaacataactgttcacataagagacgtatgtgtgttccttgcaccaacttttagcggccttacatctatatctactttcctgcttacaagagaactttggaaccaaggagcaggacttttagctgcttgttttattgctattgtaccaggctacatatctcggtcagtagctggatcctttgataatgaaggcattgctatttttgcacttcagttcacatactatttatgggtaagtgacatttaatgttttgctgccattattactcgtgacctttctcctgaaacactttaggctgtacgcagatttgtcttttacaaattatgtagttgcgtacagagatctgtattactgttcataatcaatttaataatggataacattttaaaatatgttaggcatctctcaagttatgtgtaaatatcctttttaaataagtcagaactccaaaagaagagctatcataaaacaatctgttgatatttttgtttctttgttttggggagataggtaagaaatagttacccaggaaagttgaagcatggtttgatggctaagaattttaaattgtttctgaaactagcattatttattttgctgctgccaggctatttaaacttaatgattttttcccctgtgtatgaaatatgatgctacttgggttcactttagagcttgcatttatttatgtatttattattttagctt

SEQ ID NO: 3766 - DNA, 1181 bp, Homo sapiens
aaagtacctcaacataatgaagtccatatatgaaaaacccacaaccaatctcataatagtgaatggctgaaaccttttccagtaagatcaagaacaaacaaggatttttttttttttttttttttttgcctccttccttcaacacagtatttgaagttctaggtacagcaattaggcaagaacaagaaataaaagacatccaaatttggaagaagtaaaatctgttagcaaatgacatgattgtatctagaaaatcctagatcccacacaccccccaaaaaactgttagaataaacaaattcagcaaaggatacaaaaccaatgcacaaaaatcagtattatgtgttttttacgaaatgaggtcttgttatgttgcccaggctggagtgcagtggctattcacaggagcaatcatagcatgctgaaatctcaaactcctgggcccaagcaatcctcctgtctcagcctcctgagtagctggaactataggcatgtgacactgtgcctggcacttacacttttatatgccaacattgaacaatccaaaaaggaaactgagaaagatctacttacagtagtaccaaaaagagtaaaatacttaagaattaaacttaactgaggaagacttgcccagtgaaaactacaaaacatgctgaaagaaattaagacagataaataaatggaaagatattctggttaacagattggaagacttactgttaagacaatgctactcaaagggatctacagattcaatgcaatccctatcaaaatcccagagttttttgcaaaaatagaaaatttcatcctaaaattcacatggaatcttaaatgaccctgtacagacgaaacaatattgaaaaaagaataaaaaagttggaggtctcatacttcctaatcttgtaacttgctacaaagctacagtaactaaaagagtgtggtactggcataaagactgacatcgaccattggaaaagaataggccataaataaacattcgtgtatatagccagtgattttcaacaaggtaccaagatcactcaatggggaatgcagagtcttttcaacaaatggtgttggggaaactggatatccacatgcaaaagaatgaagttggacccttatctaacaccatatataaaaaccaactcaaaatggatcaaagtaccccctacccccca

SEQ ID NO: 3767 - DNA, 1169 bp, Homo sapiens
cgggagacggaggttgcagtgagccaagattgtgccactacactccagcctgggtgacagaacgggagtccgtctaaaaaaaaaaaaaaaaaaaaaaatcaccaggttccttgacatagagctctttgtggaatgccatgtgctctttgacatattgacaagtttgatatcatcgtgtgacttgaggactaggaaatcacagctcatatgtatttatgcagaatgtgatcacaaactcatgcccctgaaaaattaagctttctatgtaggcaagacagtgattttgttcagagtaattggtatttccttcatttatgttattaatatttgacagacatattatacttcctgtgtgccagatactattttaagcattttacaaataacttacttcaccctcattgaagtcctgtgaggtagatacttctattactcgattcctttgttgcttatacttttgttttatattccggtggcagcctataggcagatgcttgtagctgcctccagtttaagaaaaattccttggagaaaacctcagctctgcctcataactgatgctctcctctcccagaaagttgggaaagttccaccttgatttgaactcgctggccaaacaccagctatctctgtagacacagattttgacaggttcagacccagattggaaatgattttgattcaggttgcctttgagtctgtggagagtcagagtttatggcaatttcagcccgctctatcctctgtttgggattatgtgttcccagagagtaaactgtgtggccccagagtcaccctaggaggatctgagtgaccctgggttttgtgtttttactctgtggatgttgtggtcacgctggatcatgttgtgtggaggcttgggagcatgtgttggaggaacagttgagattttaattttatttttggtggcttttttggtacatccaaccctttcaggttaattaaatgccaggtagagctagcccacaagtggattttgttttgaaaatgtgcctgttttccaggagccctttgtggcagcctggtctggttgcccagatatcattttggcttcttggtgccttagtgcctgggatgaattggcctgcctgctgcagtctcttctcctcagccctgatatccgccaactgggtggctttgatgcctct

SEQ ID NO: 3768 - DNA, 1194 bp, Homo sapiens
caaagttttaccttactacccccaacccccacctgcctctttctgtaaccattcagtgacaattactaggacttgatgtatccactgcctagcccaggggcatcttgggagatgagtatcctgtcaggcagtacccctagaacagtacatgctggaagaaaagctcccctacgtaccccgtgtgacagagagaacaggaactgcgggctcactgggagagctggttacacaagcaggaggcagtcagccttctgtgactgcactgccctctgcagaagctttcatttgtttaggcatgttcttgaactggtattgcagtcagaaaatcctagaatgaaaacaggaaaaaagttttgcttctttcagaaagcccactaagggccaggtgtggtggctcatgcctgtaatcccagcactttgggaggccagggtgggaggactgtttgaggccaggagtacaagaccagactgggcaacatagcaagacccccatttctaaaaaaattttttttttcaatttttttaacgagaaaagataggtcatttcaaagaggtcttgtgaggctgtgaaaccaagagctcttaacactgcgaccaaagatggaagttctctataggatgccatggcatttgatggtgctatgttttcttgaggagatataagaaaaaagaaaaagaaaaaaaatgataaaagagaatccactaggcaccagaaattgctctggggagagtgcagatcaacctccacccagttgtctctcagcctgaggggggaaatctgacacttcctctgcagcggagggagagaagaacagcccacatatctgcccagtgacaatcccaggccttgaaagagctcactgcttcatggaggagtgaaaacagacttcatatatcctaggaaagactctgcaacttaagggaaagggagcattgtcctgagatcttagagagaaaacactgctgtgaaatgtttttatatcagaacagagaaagattttagaaaatatccacaatttatggagcaatgtaccagagataaggaagttgtaccaagagagagttccagagatctgcagtgttccctcgagcctttgcaaagtatggctttccacagtcttaggaggaagctacatgagtccagggaaagagcccttagaaagatgtggataagcacaatctaaaaagtcagaa

SEQ ID NO: 3769 - DNA, 1148 bp, Homo sapiens
attagaaatgatacactttcctcagatgcactgccgccgtattcactcctaagtgaactccctgaggttatttgagcaaaactacaggctttcagatgttctccgaaataaaaacagcataaccagaaatcatttgagaaggatagtaattgaaccaataaagtagttttagatggcaaagcctggtatcaagaaaaggtagtgagtgggtgattcaatggaggtgaaatgataacttttgctaattaggatgtgccctaaaccccacttctattatgctttgttttctccagttctttgccttcctggtcaccatctgctacgctggaaatacatatttcagttttatagcatggagatccaggaccatacagtgatttaccattttgataattaaaaggaaaaaaaaaggaagactctcactgtaaaaacagctgtaggtataatgtatattcccagagaattgtatttaactaattaatgttttttatattcttaaatttgctcacaaattgtggtttgttacaattaaactggatacttatttgcaaagtgttgtagcttataatgaactcttaagtatcttattaatgtattaatgtcttcatagatcatattttcttagacaatgtttaaatagataaattgctaatattgagaatgtgtcaagtttgtaaacctaacttttaagatgccagattcttttttgattaaatgttgcaaaatcccaagtaatgttgtgtttgattggagaaaggagacctacctgttgaagccagaggctaggctgtcaaggctggtgggaggctgggaagtctccctcttcacagggctgcatcgtatgatattgtcaggtgacacttatccatagtcttagggcaaagaggcgggagattcatctccccaattctggggatcatagatcagtgttcatgattttcatatgctaacaggttgccccagaaagcatctattcagacctggccttggacatcagtgataagctcatgggaagttatgctactaagtgcagtgactgacgtgcttgtgatattttttctaatatgcattataaaaaaatatataactattaaaaggataaatatctgaatatattgaatatatcttaaaattatcttgctggctgg

SEQ ID NO: 3770 - DNA, 1190 bp, Homo sapiens
gaagtgttcaagatagctattatcattaaagtattatgtgttcttaattgttttgctttgactactgatttttcacaattcctgtttttattgttatattttttaaactgctgtataagttacaaaggagttgggccgggcatggtggcacacgcctataatctcagcattttgggaggccagggtgggcagatcgctttaactcaggactttgagaccatcctgggcagcatggtgaaatcttgctctacaaaaaatacaaaaatcaaccaggcatggtggatgcacctgtagtgtcagctactcaggaggctgaagtgggaggatcacttgagcctaggagatcgaggctgcagtgagctgagatcttgccactgcactccagcctgggcaacagagttgccctgtctcacacacacacacaaaaactatatatatatgagttttatttctagtgtattactgatcaagaagtaatggatgaagctgggcacagtggcacacacctgtagtgcaagttactcgggaaattcaggtgggaggattgctggagcccagaagttcaagactagcctgggcaccatagactctgtctttaaaaaaaaaaaaaaaagtagtagtaatggatgataatagtacagcattttaaatccatcactatagagatggtctgatcttactctcctcgatttagaagttggggaacaaatggaattatttgacaggtttacacaatcaataatgacagtgttgcagttagaaatcacatttctaagtcttcacagttctaatctgttaattgttgttattattttttttttttttgagatggagttttgctcttgttgcccaggctagagtgcaatggtgcgatcttggcttaccgcagcctctgcctcctgggttcaagggattctcctgcctcagccttcctgagtagctgggattacaggcatgcaccaccacacccggctaattttgtatttttagtagagacgggatttctccatgttggtcaggctgatctcgaactcccaacctcagatgatcggcccgcctcggcctcccaaagtgctgggattacaggcgtgagccaccgctcccggccccctgttaattgttattatgaagttgatggagattacattctattgttgagttagagatctatcagggagataaagcagtat

SEQ ID NO: 3771 - DNA, 1229 bp, Homo sapiens
tcagttctcctgattgttctgtatctcctcggctctctggaagttgtgtattctgtttctttagtgactctgggggtggggatagaggactgagggagaatagttcgcagattcgcatttttctaggcttagctcctgaatcatttataggagaaatttctctatatagctctttacatgcgagataactgaagtttggcttatacgatgattaaatttaaaaactttggtatttggtgtcggctcaataccagagttttttgttgttgttgttgttgttttggttatatccatctaaaaacaggaaacaagaagtcaaatactacttgataggctgcgtggttaaatatgaatgtttacatagaaaaaattacttttttaatagactgctgccaagcaagaatatatgattattgatattctttaaagctacatggagctagttgaaaaattagtttttacccttgtttttaatgtggttgaaagcacctactgaagattagcctggattgagtcactgccctatcacatataagccctaggatcttaagcaagttgcttgacatctataaacctcagtttcttcatctttaaaatggttgttatagaaataataatacttgcctctagggttgtggcgggaatcaaatgagttaatgtttgtatcgtggtaatatttgcaagtgatactttgtcatggatttatcttaaactgcattagaaaatatttgtgatcagaactttttaaaaaattgaattagtgcctacataagtgatattcatagggcaaaaataaattaggatccaaaagcaaaaaaaaattgtataatatatttttagtttactaatttaaacaaattactactcatttctaaggtaaaatggatttaagctcatatgacctcattgaaattgattctattttaattaaatatttggaaacactgtcatggtaaaggtaagattcagtagttttgttcttattttatacattttgtccagttatttctgcacattagatattgtgtagatgattctgtttatggtaaaacaaaagtggcagttttgttcattttttggtatacctaatttgcactgaggttgtgccattttttttttaacacccctttgacactgggtctgtgcatgggactgagtgttcttagaggtcccagcctccttcactccaccatacaagaatagattaaatttccttttttatgaactta

SEQ ID NO: 3772 - DNA, 1195 bp, Homo sapiens
tgtatccacatggtcttagacctccttttaatgattgtattaacttacaagctcaggtagtatttttcttaagactctatctcagagcacactgactgaatgttgatgtgtgtagcaaagtgtttactttctttaaataaccagctctgtaactctgtaagttctttgtgtttctagcagtctgtgtagttgtctttcttcagaggaagatttttcacatttctggggttttcttgcttttagggtggtaagattcctttctttttttcccttttctcctaaaatcgatgcaggtaagggtgggtgggtaaggggtgttgttttttaactagcatgttagttatacttgggtgggtgggagggttgttaaactgaatcttgcttaatactgtccattagctctcatgccgggtcagcaaaatgctttaatttttaactgcagaacatgtgactcggttgagtctttttgtcttttttttttttaaataaacaattgggggaattaatgtgggcaagttgccttatgttagaatgactaagttaaacctcttaatttgtatttgtccaaggcagacatgatataaggaatatgcactaccgtagtaactcccctggccgcagaaaccacactgcaagcctgtccggggtggggtgctgactgccatttgccacttttaaatgggcactgccgtggtaatgtgaatcccatcaatgcagtagatgggtggggaaatgaagatttccccccaaacctttaggcaaaagtgagtttttgtttggttgattttgggtttttttcccccctcctcttttggctttcacattttaaatcttaaatgttactattgcaggccgcaggcatgacaggcaatgagcaggtgaagaaccaatggaaaagtgttcaaaaactcctgtgttagctaacaggcttctgaatgtatcactgtggtccacagagaaggctggaggaggtagcaaggagatgctgtatcagctactacagccttaaaacaaagttggtgtctctttggactttaaaattgttcctatgcagcttattttatttttgtttaatcaaataaacgagggtttttccatggctacagtgtgtctgtgtgatcctttaatccatagtaaataagggtatgtgcactgtactggatggaaagggagtccctgaggtagacagtccagg

SEQ ID NO: 3773 - DNA, 1199 bp, Homo sapiens
tctaacagtttgtgtgtgtgtgtgtgtgtgtgtgtgtgtgtgtgtgtgtgtgtagtctttagggtttcctacatctaagattatatcatctgtgaatcgatcattttacttctcctttctaatttgaatgccttttatttctttcttgcctagttgctctgactaggacttccaaaactatgttgagtagaagtggcaaaaacagacatcttgcctttttcctgatcttagaggaaaagcttgcagtctttcactattgaatatgatgttagctatgggctcttcacatgtgggctttatgatgtggaggtagttttcttctattttgcatttgttgagttgttggtttttttaatcatgaaagggtgttgaatcttgtcatgctttctctgcctcaatttagattatcatgtggtttttgcccttcaatctgttaatttggtgtattatattgattgatttttatatgttaaaccattcttgcattttaggaataaatcccacttgatcatagtatataacccttttaatgtactgttgaattcagtttgctagtattttgttgaggatttttgcatcaatattcaccaggaatattattgttctgtagttttcttgtagtgtatttgtctggctttggtattaggataatattggtctcatagaataaatttagaaatgttcctcctcttcaacttttgtaatagtttcaggaggattggtattaattcttctttaaatgtttggtagaattctccagtgaagccatctggttctaggtttttctttgagtgtgtgtgtgtgtgtgtgtgtgtgtgtgtgtgtgtgtgtgtgtgtgtgtgcgcgcatgctgagacatggtcttgctctgtcgccggggctggagtgcagaggcatgatcttgggtcactgcaacctccacctcccaggttcaagcgattctccttcctcagcctcccaagtagccaggaccacaggcacgcgccaccacacccggctaatttttgtatttttagtagagacggggtttcaccatgttggccaggctggtctcaaactcttgacctcaagtgatctggccgcttccccctcccaaagtgctgggattacaggcgggagccaccgtacccggcctctttgaggtttttgatgactgattcaatctttttaatagctattggtctgtatagattttctgt

SEQ ID NO: 3774 - DNA, 1241 bp, Homo sapiens
gtactgtcacaggtgggcaacaccaagcagagaggctggaggtgggagttccaacctcaggaggtggcaaaactaggcgactttccaaatcccctccaacccagaggctccaccatcctttgggttttccaggtctggtttagctgtaggggagctaacctagatctggagactgtggtcccatccagatgggatccagacactctaggacccagatgagacacctgtttgctgagcacatcctccctatctccctcagccccaggacaatccagctttttccagctgcttccagggacctgagaccagctcaggtcaccagagctggaagtggaacataggcatttctccataggcatgtgcctaactagaactaagtttcaagcctggcctccaggctgccgtggagaccccatctgtggcctgcccacccagggctgccagtcggccccaggctctctgaagaaggactgtggagaaggggcttgttcatatggcctttttgtttagaagcagagaaattatagggtgtggtttgctgatttcttcatttgtcttttcttcccaaccctagtgaacgacctgaagaatgcagccccctgtgcagtcagctatctgctctttgatcagaatgacaaggtcatgcagcagaacctggtgtattaccagtaccacagggacacttggggcctctcggatgagcacttccagcccagacctgtaagtctggtgcaccacaccttcccttttctcttcattcttgccttctggagactacctcgtgccttaagagaaagggttattttggaaataaaggggctgggcgcggtgactcatgcctgtaatcccagcactttgggaggccgaggcgggcggatcatgatgtcaggagttcgagaccagcctggccaacacggtgaaaccccatctctactaaacatacaaaaattagccaggcgtggtggcacgtggctgtagtcccagctacttgggaggctgaggcagaagaatcgcttgaacccaggggcagaggttgctgtgagccgagattgcgccaaaaaaaaggaaatcaaggaaaagtcatttttttctgtagttttgtgcatgtgtgtgttttaacattttactgcttcattctgatttctgaatctgtaaaaactctacaaatttcaaacattacagaaatattttactttgaaaacaaaattctctcataatcctacaccttctttctctctcgg

SEQ ID NO: 3775 - DNA, 1099 bp, Homo sapiens
gttcctatgcgtcactaggtaagagaactgattatggaaaattgtaccatgttctctccctgatctctgtgaagacaagttcatataccttaatcatttctattcattcttgttatttaaggatagtccatatgttttaatataattctatattgcggacacacttctgaggaatctgagctgccttgtttctccttttcccttgttctcatcatcgtcttgatcaaagaaacaattcttgaatccatgattgcctgtagaattttcataactgcacttctaccacatctagccactggtttctaagggggtttgggaagggaattggcttgtatctaactttcctgttttctttctcctacttctcttctcttaccaagaatgtgaagccttttggagatctgggagaactgcaaagctctactctgtctaaccaaaccctaaacatatattccaaaactctattcagtttgatttcttcatgtttttatgtctatcaaattaaaaagttgacgttggtttgcgtatctcttcttcatgcttccatttttttcttttgggtagtactgctggaacactaagcaggcagatcgccagaacacaatacaggttgagcatacctaatctaaaaatctgaaatctgaaatgctccaaaatctgaaactttttgagcaccaacatgacactcaaaggtattttggactgaggcgggcagatcacctgaggtcaggagttcgtgaccagcctggccaaagtggcaaaaccctatctctactaaaaatgcaaaacttagccgggcatggtggctcatgcctgtaatcccagctacttgggaagctgaggcaggagaatcacttgaacccaggaggcagaggttgcagtgagccaaaatcgtgccattgcactgcagcctgggcgacagagtgagactccgtcaaaaaaaaaaaaaaaaaaggtatttcggattttggatttttgaattagcaatgcctagggatgctcagtcatttaagtatgaatgcacatatttcaaaatctgaaatctaaaacatttttggccccaaacattttaaataaggagtactcaacctgttagaag

SEQ ID NO: 3776 - DNA, 1099 bp, Homo sapiens
attttctgatagttctggagcctggaaatccaaggtcagggtgccagtatggtcatattctggtgagatttacagatggccttctctctgtgtcctcatatggtgaacagcaggaggaagccctctggtgtctcttcttgtacgggaactaatcccctatgaggccccaccttcatgacctcatctaaaccccattattttccaaaggtcccatgttcaaataccatcacattaggagttagggattcaaaatacgaaatttggggagcacagtcccgtacatagcagcaggtatatcttaaataaattaatagaaatgggattgccaatagcaaaatataaatatgtctgtaatttgttacatatttggattgttgatccacttggaatttatcctgatgtgtggtgctagatatggatccagtttttaaagtcttcttccaaatggctagcccattgtccccaaaccatttattttataatagccttgtttacctcactgatctgacattctgactttatcacacattagattcacggtatatattgggatctatttctgcttttattgtttcattgacttgtttatctgttcatactccagttccatatcattttagttatttatacttgagactgttttaatgtctgataggtattatctctcattttttgaatttttctgcctgtccttgcttgtttcctaaattttgtcattttctgggttttcctgactattcttgcatgtgtttcttcatatgaattttcttttgtttaactatgatggaaaacatatataaaagtgtagttgtgtaactatgatggtcaaacatatataaaagtatgaatcattgaacttctgttacccaacttaagtgattatcagtatttcgctattttgtgttttagttatttctcctttcctcatttttttggagtattttacaactatctcacgtatcatttcattcttaagttttttagcctgtgtctctaagagataaagatttaaaaaaattaaaaaacaaaaatttaaaaaattaagaaattttgctagatgggtcattatcccaatctagcaaaattaatattaatatta

SEQ ID NO: 3777 - DNA, 1240 bp, Homo sapiens
taatcaattgtgtttctatacactaaaaacgagcaattaaaaaaataaatttaaaaagaaattaggaaataagcacttcaaaaatgaaattagtaaacagtgtggacattcctcaaaaaattacaaataaaactatcacacgactagcaatgccacctctagggcacacatccaaaatttgatgcaatcaggtgcagcaaaatctcacaaatcaccactaaaggacgtactcatgcaaccaaataccacctgtaccccaacaacttatgaaaaaactaaataaataaataaataaattttttaaaaatcgatgcaatcccatttacaacagcatcaaaaagaaataaagttaacaaggagacaaaaaggatgtgagggtgatctcactgcaacatctgtcaccccattgattgccagcgttgatttggctgatccagctggataggcaggtgtctcttttctccctcactgctccatgtgcatctctcttgaagctgcgcactggtcgaaggggacgaccatcacccatagagaagtactggtcttcagtcaagggtatacaagaagctgcattctcctgttagaacctccaaacaagctctcaaggtccatttgtaggagaatgtagggtagtcaagcttccaagactccagacacttccaaatgaggtgctgcatatagcagtctgcctttcttttgaaaaaacaaaaaaacacaaggagacaaaagacttgcacaatgaaaactataaaacgatgctaaaataaataaaagaagacataaataaatggaaagacatcctatgttcatgaattggaagacttcattttgtgaaaatgtctgtactgcccaaagtaatctacagattcaatccaatccctattgaaagcttaatcacattttttgcagaaataaaaggaatatcccaaaatttctatggaatctcaaaggaccccaaatagccaaaataatcttgagaaagaagaacaaagctgaaggcttcacacttcctcacttcaaagcatattacaaagctacagtaatcaaatatttacataatattttaagtgtatattatcataataacataatcaaatatttacataaagccaaacatatagaccaatggaacagaaaagaaagcccaaaaataaatccataggtcaaatcatagcaagggtgccaagacaacacaacagagaaagcatattgtcttcaacaaatagtagttaaaaaatac

SEQ ID NO: 3778 - DNA, 1106 bp, Homo sapiens
ttccaattcctgaaacctttacagatctcattctgtggattcttctggattctaattcatggggcattttttttgttttttgttaattcctcatactttatctgtggggaattacttgaagcctgggttgacaatgaaattctgcagagagaatttgcatttgattctactggaggaacagtcagccccgatatcagtttaaattaaaatctctgcttaaggttttcaggcaacctgcttagcatgaatcctggctggaaaagcatgtgaggaccagtttatgattacacattcacagggtgtcatgttttcttccaacaccaatgctagaggtggcagttttgcttactgcccttggagggacaggggagtgggcatgggcatagtagtatggttttccttttcactgggggtgcagcccttggagtctcagcttaatgtgttggggaagtggtctcctattagactctccatttcaaaccattccatgattttgtcctccttttgccaccttccgagcctgtaaaaactaatgtttgtgattcctgaggtttctctaatgtcttttaataaagttgacctcagagatctcgttacctctctgagttcctgctttgtcttagattttgatccttgagtgttctttaatcttttagcaattccttgttgcatgttaaaagattagttatattttattcctcatttgtgttcgttttcaccaggaggctcaattcaggcttctttgcttacttggtgtctctagttctggtgcctggtgctttggtcaatgaagtggggttggtaggattctattacttacctgttttttggttttattttttgttttgcagttctccgggagatgttgcataaccactccttcgtgggctgtgtgaatcctcagtgggccttggcacagcatcaaaccaagttataccttctcaacaccaccaagcttaggtaaatcagctgagtgtgtgaacaagcagagctactacaacaatggtccagggagcacaggcacaaaagctaaggagagcagcatgaggtagttgggagggcacaggctttggagtcagacacatgtggtttcaaatccaagttcg

SEQ ID NO: 3779 - DNA, 1165 bp, Homo sapiens
ttattttgagacagagtcttgctccgtctcccaagctggagtgctgtggcgcaatcttggctcactacaacctccgcctcctaggttcaagtgattttcctgcctcagcctctagagtagctgggattacagacatgcaccaccctgctcggctaatttttgtatttttgatagagacagggtttcaccatgttggccaggctgcccagctatagtaattttaaatggttaagtagaatttctgctgatggcagctttctgaggctaatattataatacacacagattgctgtgggtagcatagtgaaaagaagtaggagttttagtaattagtataaaattaaatattctaaaatttattggaataatttggtagtgggaagaggtatttggtgactaatttctctgttaaaagtgaatatataaatgagcatgaaaattgcacaaagaaataccttaagttattatgtttttgtttacttcagggctgaaaacacagttaaatcactttcaaagttaaaagactattaagaacacaagatggggactcctgcttctggaaggaaaagaacacctgtgaaagaccgattttctgcagaagatgaagctttgagtaacattgccagagaggtatgtttggtaaatcccctctcaacactgagttgcacagatgtattgtaaaaatgccgatttgacagagatatagacgtttactcattgaactagtttcagatgtttattatgagcaagatgttatagctagtctctaaaatagtgtgttagaataaaatatagttggatattatcaacagaaatcaaatatagagatgaatctctgaacaacacattttatttgagacagtagaattgtaatttgggcatacacacagactgcattggtctttggtatgtccaaagaacaaagaaaagattgaggtttttattagagaaatgttatgcattgttttgaaagaaaatgcattggcactagcgaagtttttgggagctggcatgctctgatttgtgagtgactgtggtaggtaaaactagtcttagagttatagcagttcgtttccgcagctactaggtaaaactgatcttaaggttatagcaggtcatttcagcagctggcttgccagataatccctgggcaggtgcttgtgcc

SEQ ID NO: 3780 - DNA, 1099 bp, Homo sapiens
ccagccaccagctggctaccactgagtaacctcagctgatgccacatgaaacagaactgaattgcccagccaagccctgcccacattactgcccacagaagtgtaagatataataaagtaggactgaggtgggaggattgcttgagcccagaagttctagtccagcctgagcagtgcagcaagaatttctctctaaaaataaataaataaataaataaataaataaataaataaataaataaataatattaaagtagttgttttaagccactaagttctggggcagtttgttatgcggcaatagataactgaaacacttggcatataataaatgcttaatagatacaggtcagagcattttgatgtcaaatttcattacccatgatcagtatgtaagagtatccaagtttgagagattactgccctgatcccaccttctatgacctcctctgtctctacccctgggattctagcaatgctgggacttatttttccatctggtgcacagtgtgccttcatctgctaaaaacctcataagtccttgttaaccatctgccttctgcataaaggacaccacaccaaacagcccccggactactttttttttgagacagagtcttgctctgtcacccaggctggagtgcagtggtgtgatcatagctcactgcagccttgacctcctgggctcaagtaatcctctcacttccacctcctgtgcagctggaaccataggcatgtgccaccatgcctagctaattgtttaattttttgtagacatgcggtctcactgtgttgtccaagctggtcttgaattcctgggctcaagcaatcctcttgcctttgcctcccaaaatgctggaattataggtgtgagccgccacatctggcccaaaccatttctaattctacctctgccatcatctccatggataaccttggatctaccttctggccccatttctccatttttatttttatttttattttattttatttattgagtttttcaaaacggggtctcactctgtcacccaggctggagggcagtggcatgatctcagctcactgcaacttccgcctcccaggttcaagtgatcct

SEQ ID NO: 3781 - DNA, 1101 bp, Homo sapiens
tataaaaaaagtttcaggctcatcttgttttttccttggatcagccttgtaatcttccatttatccaaggggccctgacttctctgagtgggagagatgtttggatgctctctctggatgctcattgctactgggatgatgctgttcccagcccctttcagtgggctgagctgggaatatgtaaggatatataacaacccctttcagtgggctgagctgggaaatattaggatatatatatacatatccaaatatatatatgtctgtatcaatacacacgttacctttctatttgtctgtctgtctacttctccatgtgttgaaaaacatgagttcaaccctatacactctacttccagtccaacaccatggggttcattctggctttcttccttcccatatttgtatcttatcctaacagtgacaaagttgattcttctgacccctccagattgctgcctccttgacatgcaagccccattttggcttctctgcttacccttacctgtgttgtctctgtgtcgtctctccagcagcctcttgaatctgccccactctggttatgtacttacatgtggcccttgagccacttctgtttgcctatttaatggctttttagagaaggaagaagaaaaaagaaaggtaggaaggtagacaggcaataaatatttttaaagggaagggtccatttacatttaatgtaattattgaaatgattggatttaattgaatctatccatttattttttatttttttaatccatccatttacaaaatggattacatatcaatttttctttttcttttcttttgttctatatgttcttttttctttcttattcttttcctgtcttatttttggattaactgagcaatgtctagtattccattttatctcctctgttggctttttaaggtatacactttttaattgatttttaaattgaaatccttaatttgaaaagtctggtttgcactaatattatacacttgaattttttacgaacatgcttgcactacaagaatgactaaaggatgtcttccgggctaaagggaaaatcataccagatggaaagtcagagcttcaggaaggaatgtaga

SEQ ID NO: 3782 - DNA, 1208 bp, Homo sapiens
gggaggcagtggggggccctcgagtgcccagcctggccagactgtccattgagcaatggctctgaggctgtgaggtgctgcttccacctggaaaaactggccctgagggctcggagccagcctctatcccccaggacagctgccccagggaattgtcaagcatcagtgaggacctgtactgggttcccagtggctgccttgacactgctgctgcctggggatgggagcacattgctggacctcgacagcgccacttagtgggctcagtgggcactggggggaagaagaggcctagatttgtggggtttgggagcagcccctcagcaacactgttgagccttgacattgagtgtggtgtgtggaccagtagcatcagcttcaccaggatgttgtaggagtggccgaatcttgggcctcaccccagaacctatgtgtagcaaggtcccatgtgcatgccaccctagggcagttgcttccaaatgctaatctgagggccatctcagtctcacctgggaagtttgtaaaaatgcaaaattcttagctctttccagaccagaatcaccagtgtgaggcctagaaatctgtaagtgctccatgatttttttttaacttgaggtatactacttcatataccataaaatttatctttttctttttctttttttttttttgagatggagtctcactctgccgcccaggctggagtgcagtggcgcaatctcggctcactgcaacctccgcctcctgggttcaagcgattctctgcctcagcctcctgagtagctgggattacaggcgtccgccaccacgccgggctaatttttgtatttttagtaaaggtggggtttcaccatcttggccatgctggtcttgaactcctgacctcgtgatccacccgcctcggcctcccaaagtgctgggattacaggcaggagccaccgcacccagccaaaatttaccatttttaagtgcacagttcagtggtttttagtatattcataaggttatgcaaccatcaccactatctatttccagaacatttgcaccaccccaaaagaaatcctgtgcccattatcagtcactatgcatttctaaagaacatcaggtctcatgttttgaatggtgaacttttgctgtgcttaaatttttatgctcattcaaacatctaagttccacatgtgcaaagttctgtgcaacgccctttggga

SEQ ID NO: 3783 - DNA, 1307 bp, Homo sapiens
gtaagtacaaattttgagcttgctattctcgtggttagttctgggtaatttctttctatcttccttaaatgaagccagacccctacgttgaaaacatactttaaataaatgttcttgttattgagagaaaagatttctgctccaggggaggaatatgtcagttgtctgagttacgggacttgggttgggtcatgaacatgagaaagttcattggctgagtttctaatagctcgcatagtgccttcaacttcataggtacttacacaggctattgaactgaattttgagtggaaagtggggtaagaggtgggaatgaacaatatggtttggaagaaccagaggatggaaggcattaagttggctaaggcacttacttattttagagataaagctaccaaggacttgggagtgacatgctgtaaaggagttttaggatgaatcttgcatcagtgcagattataaaagggaaagagtggcagaaagccaggaagtggattattaagaaccaatgatggaataagtacagggaaagagaaaggaaagatggatttagccaactgaatctaggctgcacactattaaagctcagggtggaggccagtcttggctcatgaacttctgagtgtcggaagtgtgctatatcaatggcaggattttcgctaacaccagtagagcttgcctctatgactggagtttggtagtactcgctgccacatagagtaaacttgagaagaatgtttgcacagccaggtcaagtgttacaaatccttctgccctcacttaggcatctatatcataaatctcaagaggacctgggagaagcttctgctggcagctcgtgcaattgttgccattgaaaaccctgctgatgtcagtgttatatcctccaggaatactggccaggtttgtggaacagtggttagtttttatattatagaaataaagcttacagacattgtgagacatagaaagacataagaaaacagaaataactcaggccgggcgcggtggctacgcctgtaatcccagcactttgggaggtggagtccggcgtattacgaggtcaggagatccacaccacggtgaagccccatctctactaaaaatacaaaaaattagttgggcgtgggggcgggtgcctgtagtcccagctactcaggaggccaaagtggagaatggcgtgaacccggtgggcggagcttgcagtgagctgagatgcgccactgtactccagcctgggtgacagagccgagactctgtctcaaaaaaaaaaaaaaagaaaatagaaaactcaaactccactgtta

SEQ ID NO: 3784 - DNA, 1307 bp, Homo sapiens; identical to SEQ ID NO: 3783

SEQ ID NO: 3785 - DNA, 2062 bp, Homo sapiens
gcatctagattgggccaggtagtgttgctaggtgctcgggatatatagtagaaaaacaagcctgtcttttttaatgtatgcaggaaatctctggagaagtaagagaggttaaggaaagctgggtatgtgcctgctttacatggagtagtagtgattaagttggccagtgcccagaagtgcttactgggtgccaggattgttgctgtggaatatcgagtaccactaacttttaaattcttcaaagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaaggtaatgattttaggatctagagtttgtgaatgcgtgctctagaaaaaacattcctgtgcacattgttagagcttggagttgaggctactgactggccgatgaactcgcaagtgtaggtagtgtgctacatgaggggcaagttttcgctaacaccacaagggtctctggcccaatgagtggagtttgatagtaattcttgctacaagtataacattactgcatgacagctttgtggagaaatgaaaacatttggaaaatagtgtgttcttctgcctttgtccatgtttcttgctcaggcctcaggcacttggcctttgttttcacaccaacttgatgggttctactataagatgctaaaaaggtgggttgtgtgtggttcagattggttgatttgtaaccctagttgtgcataagaattgcccagatattttttttaaatgccagtgtccaggcatttttttttcaatccctatgattccagtgtgcagacaaggttgaaaatccctatttataatgctccctgttacaattgcttttcaactaagagatgtctgtacttttggtacctagatgatgtaagagccaggaaggtgcttgctgtttgggtttgaccaagtgtcactttttaataatctgccactcttggcagggagctcactcagtgggtttgatgtggtggatgctggctcgggaagttctgcgcatgcgtggcaccatttcccgtgaacacccatgggaggtcatgcctgatctgtacttctacagagatcctgaagaggtaagcttctccaaaggcttgtggttacataagcaaattggacgacttggactgtgcttctaggaagcaaaacttgtcagtccctgtaagtctttcctcttttttttttgtaacccagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactggtatgtatcaggatagaggtgaatcaagctgatattttgcaacttctcagttttattctaactttaatgatctctgtgacttttatactagctttaagaggttttcattccagtgtgctacagcatctgatagactgctgttgggagtggggtaaggaaaaatactacattgaggacagagctgatggctttttttggtattctcttaacagaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttctaaaagttgtcttcatttagtttgctttttactccagatcagaatacctgggattgcatatcaaagcataataataaatacatgtctcgacatgagttgtacttctaaagcccactgtagatagtgtatattgctttt

SEQ ID NO: 3786 - DNA, 2062 bp, Homo sapiens; identical to SEQ ID NO: 3785

SEQ ID NO: 3787 - DNA, 1208 bp, Homo sapiens
tgcctgtaatggtactgtgattgaacatcctgaatacggagaggttattcagcttcaaggtgaccaaagaaaaaacatctgccagtttctcttggaggtgagtgattgggtgctttatgtgtaaccttgagattgcttttaaaattgtatttaaaggcaacatgatttgttttctactaagtaaaaaatcatacgaatgaaggaaattaggtgaaataaagacatggtagttatttggaaagcaaagacctttatctggtttattttgtcattagagtattctgatcatttctttatatacacacacaggctatttcttggcatgtaaagtattcaaatacgtgttgaattgttggctatcagcagtgcatgccacagacaacagtgttgcagtaagctgttgatagtgattctttttaattactcttccatgttttcttaatgaatttttatatttctcagagttattttgctaaattagattttattttacaggttggcattgtaaaggaggaacagcttaaggttcatggattctaaaatgaacctaaatacgtggagaatttcttgaatagttttgttctctaaacccggtttggctgccttgtgaaatgattccctgcagtaaacggacttttcatttatttaatcattcaaacttccattcacatctgcatgattacagaaaacatggggtatgtagactagtaacacataagaaaattgcagtaagatggtaacaaaacctcatattgtctttacatgtttccaatggaaaatgttttgagtgtttattgttcagtttattacgtttcacttgattaaatttttttgttgttgtattaaaccatgtacgttgcagcttaacaataaaaaaaaatctatgaatctttgtgagcaattatgctcccaaatctaagcaagtaaaatacacattttgtctttcttaattggagttctctcattctgcatatattccttctgattagcttcagctgttacacccagcgcttagaggagaaccttatatccagtgctagagaacctttgttatttgtagcttgtgtttttcatgtactgatttaagaatagaagcaggagtagaaattcagccagagccactagtcatggcaaagcaagtaaaagttgtcaaagaatttatcagattgtagtattaaatgttgttaaagagtatgaagtttaacagt

SEQ ID NO: 3788 - DNA, 1197 bp, Homo sapiens
gatggggtttcaccatgttggccatgctggtctcgagctcctgacctcaggtgatacacccgccttggcctcccaaagtgctggaattacaggtgtgagccactgtgcccggcctgcaaattttcttataaaaagtaaactaggaaaatagggcaagtataaaaattgcaggttgagcatatttctaatccaaaaagctctaacctctgaaactgagctatgacactacaatttaaaaatccctagcctacccgcatggtgggttatggtcaaaatacaggtacacagcactattcagtgtccctgaggaagaaatagttaaccttcagggtacatgtatatgaagcataaatgaatttcctgtatagacctaggtcccatccccaaagtgtcatgtatatgcacttaactccaacatcagaacacatctcgtcctaagtgtttcagataagagatacttatcctgtgtatagtaggttggacttctgtttctctctaccacaagatacaggtaatttggggcagtaaaagatcctggatagatttaaaaatactacaaagctgtacatgaaacaggattacttttttttttttttttgagacagagccttactcttgcccaggctggaatgtagtggcacgatctcagctcactgcgacctccacctcccaggttcaagttgttctgcctcagcctcccaagtagcaggggttaaatgcgtgtaccaccatgcccctctaatattgtattagagatggggttttgccatgtcagccagactggtcttgaactcctgacctcaggtgatctgtccgccttggcctcccaaagtgctgggattacaggcgtgagccaccgcttctggccaggaatacattttaaataaatttgtttcctaaccaaaagctagcttcaggcgtcactggggtaaaggaaaaagcacattgatttgcttgataataggcaagtggtatggtgtaataaggaaaatatggatgatttcggattacctgttctactctgggaggtagagaattgtctagagaaagtggcatctatacctaaaataagaagaaggtggtgtaaggggaagaatgacacgagataggaaataaacgaactgatagtgtagaggactggctcgggaccacatcaaggaagtaggttagtggttagatcgtgtaggggaacacggg

SEQ ID NO: 3789 - DNA, 1189 bp, Homo sapiens
acaacctgtgatggtgtccttcttccctgagaagctggaggtggttttagtgggaagcagaaagagagagacacataatgaagaggacagcattggcaggtcagacagagcttaggtgatcagtgggcagatttctgcagaaggatgggagattgccatcctgtcctggagtgaagtgtgttaggagacaaagaagtaacactgcacatcaccttcaagggagaactattaatagcttctgataaggcaagatgatagaaaggggagaaatatccaggatgaaaggaactttatcctcatgaaatcactcctctgtctgtagcagaagatgtagaggaggaagaccagaaagaagctgggtggagggccctgatacgtgcttcaggatggatggaggcagggtgaaagacggttacctgctgtggtcgatttagaaagcatgccagaaaaatatacctggcctgtggaaccagacatgggttgacatgatcaccaggcagagaacaacaggtgctgggctgtgtacttaggatgataatattagggccccagaggtatgcacatggaaagttggaatgctggctcggggctgcccctgctggggtcctgtgtggctctccttgccagtacaaaccttccatggggctcagtgccatggattccagtaaatttatccctttcctggaattcaggcctctccctctgttcttgtgcagggcttgggcaggaacctgttgtttcaggagccagtaacctttgaggatgtggctgtgtacttcacccagaatgaatgggccagcctgcaccctacgcagagggccctatacagggaggtgatgctggagaattatgcaaatgtgacttccttgtgtaagtcctccttcctctctgaaactcagcttctgcccttgggagctcctagattcctccttagcagaactaggatctctttaataccatcagaattgatgccctatgggctgagctccctaatccccagtgccaggggtagctggatggagaaagagctcggttcactttggtgtttaacaggacttttctcttccctggttcctaatggagacccaactgcagggggctttcctctggatacagagagaactgagaaggttcctggtgcactgtcttcattccttccatcttccagttccctggagctgatcttggc

SEQ ID NO: 3790 - DNA, 1175 bp, Homo sapiens
taacttctgctctctgaaagatcctgttagcagacgaaaaggcagcaacatgaagaaaatacttgtaaaccacatatatgacaaaggactcctataaaatatatttaaaatctctcaaaactcaacagtaaaatcacaaacaatcccattaaaaaatgggcaaaaggcatgaagagacatttcactgagaagaatatacagatggcaaataagtacatgaaaagatgttcaatacaactatccattagggaaatgcaaattaaaatcacgataagataccattatgcaactattagaagagctaaaataaaaaatagtgactatcaagactggcaaggatgcagagaaactcataaattgctggtggaaatgtaaaatggtacagccaatctggaaaatatttggcagattcttaagaactaaacttacacttacagaacaacccagcaatcacactcctgggcatttaccccagaaaaatgagacttatgtccatataaaaaccagaacatgaatgttcattgccgttttatttgtaatagctgaaaccaggaaacaaccaaaatgtcattcaatgtgtgaaaggctaaacaaactgcagtacatccataccatgaaatactaaccattgataaaaagaaacaaactattgatacacacaacttggatggatctcaatggtattatgttgagtgaaaaaagccaatcccaaaaggtcacatactgtatgattccatttatataacattcttgaaatgacaaaattatagagaaggagaacaaattagtggttgtcaggggttagaaatgatgagtgggaggaggtgggtatgattatgaagggttagcatgagggatatctctgtggtaatggaataattctgtaccttgattgtgatggtggttacaacaatttatacatgtaataaaatgatatagaactatatatacacactgtaccaatgtcagtttcctggttgtgataatgtactatagttatacagcaactaaccattaggagaaattgggtgaagggttcatagaacctctctgtattacttttacaactttctctgaatctataattatatcaaaatagttttaaaaatgaaaaaagtaaaacactgtatcgtatgagtttatattgatactgtcaattcaaatttaggattaca

SEQ ID NO: 3791 - DNA, 1155 bp, Homo sapiens
gaatgatcattttatggtatctgtttttaaggtggatataattaggaaaattaaagggccaaatgatgaggagttaagtgccagttctggttcaaattttcagtgaatcagttttgatataactttcatcttagggcattactcttgcctaccaacatagtttctaaatttttttcttttggtgtgatcactgtgggaagaaggaaattgggcccaaactgatacattgtttggaggactgggatgtctgaatttgagtggaatgctttaaaaggacaagttggatagggccccagtatgggggtctgagtgatggggtccaggaatacatttaggtccaatggcaagctggctgaaattcttgtataataaaataggttggtaatatggctcttctcagacatgtgatcaagattccttgactaacaagatatatatatatatctttctagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtaagtatatgtatctattctgagtcttgtgtatagcatctgcagttctaattagattacttttcttaggaaaaggtggtagaactttaactactgaaaataaatggtcctattcagtttgcagccaagatttacattcagagtacctgtcatctggattgtagctaaatatttaaggctagtttaggtagagttcttattatccatcaaaaatgatggcatatgttttgcttaataaaatttgtttgtaatttcagttttgagtaaacctaagatttgctaacagagctgtgaatttataggagaaaagacaaattctaatatagtacagttttatgtaaagtgattgctttattagtagatgctcatgagcagtttttgttttgttttaacttttaggttccgggtaatgtgcaggcttgttatataggtaaattgcatgtcacaggggtttcgtgtgcagattattttgtcacccaggcagtaagtattgtacccaataggtagtttttcagttctttacctcccacccgtaagtaggccccagtgtctgttgtt

SEQ ID NO: 3792 - DNA, 1191 bp, Homo sapiens
aaaggagatgtcttggaacattggaatgttctcagatttctggttgttatgtgatcatgtgtggaagttattaactttaatgttttttgccacagcttttgcaacttaatactcaaatgagtaacatttgctgttttaaacattaatagcagcctttctctctttatacagctgtattgtctgaacttgcattgtgattggcctgtagagttgctgagagggctcgaggggtgggctggtatctcagaaagtgcctgacacactaaccaagctgagtttcctatgggaacaattgaagtaaactttttgttctggtcctttttggtcgaggagtaacaatacaaatggattttgggagtgactcaagaagtgaagaatgcacaagaatggatcacaagatggaatttatcaaaccctagccttgcttgttaaatttttttttttttttttttaagaatatctgtaatggtactgactttgcttgctttgaagtagctctttttttttttttttttttttttttgcagtaactgttttttaagtctctcgtagtgttaagttatagtgaatactgctacagcaatttctaatttttaagaattgagtaatggtgtagaacactaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcattcgattgtgtcactctttctttttttcttgtcattaataaatggtttgtgagggtggtaagtaagtttatccaactcaactttatcctgaactttatcctgagatagatagatacatagtgaagtaatttgttgtagcgatagagagggccctacttctctagatgcaatttgccaagtttctttagcatttggccctggattacgctggacccctaaaaaagtgtttcagccttgca

SEQ ID NO: 3793 - DNA, 1205 bp, Homo sapiens
tgggaacctgcatattaaaccagctccccttgccattttaacttttaaaaattgaacttaaaagtaaacaacaacaacaaagacctttaatctagtccaaccatcattgttcacatggggcccctgaggtgcggggtgcattgacttgctaagccttgcacagccagggtatgtggggccaggaattgtgtgcaggtctcctcaccactctagagttgtgtccataaagtagaacctacagtaatattattatacccccattttcacctttgctcattcacttgtgtccacacggtcacagacatagcaagcgtttatacggttggttttatggggcaacgaacctcatgttttttactcatgcagggctcatcccaggagagtgggaatttgctcaagataaggcatgaggacccggagtatctggcatggagtttaactggaatccctctacctccaccactgtacctggaggctcctgtctcccctcatcctgtttgacccttgagcagggccgacacagtggtcgctcccttctggtcactctcctggcttggctcccagtgcctcacttgcccccagagttcccttttgtctctctggacagtctttccagcctctttcaccagttctttctttttcctcttcctctgagcttccaaatcagtggctgtcaaccctgatgcacctagagctttaaaaaatatagtctgccaggcgctgtggctcatgcctgtaatcccagcactttggtaggctgaggtgggtggatcacctgagatcaggagtttgagaccagcctggctaacatggcgaaactccatctctactaaaaatacaaaaattagccaggcatggtggcgtgcacctgtaatcccagctaacttgggaggctgagacaggagaatctcttgaacccgggaggcagaggttgcagtgagccgagattgtgccactgcactccagcctgggtgacagagtgagactccatctcaaaaatgaacaacaaacaaataaaaataaataaaatttaaaaaaaaaatacaatccttggccaggcgtggtggctcacgcctgtaatcccatcactttaggaggccaaggcaggcagatcatatgagcccagaagttcgagaccagcctgggcaacatgatgaaaccccatctctacaaaaaattaaaaaaaaaaaaaaaaaaagctgggt

SEQ ID NO: 3794 - DNA, 1170 bp, Homo sapiens
ttccgagtcccccagcccaccagcatccccacccctgagcttgtgtgagatgggcctgttctgggatccccaccctgtgctgacctcccagggctgaggtcacctgaatgtggggccagttggttcccctagcttgtacgttgctttgaacctcgtgtttcccacgagggagggggccccttctctggtcatcgcaaagacctgctccagaatgggcccttttccttcccattccctcctttggtgcctttctcagagtacatggacttccttctgccagactggggagagaagtctccatccccagctcctagggaccatgcagctgacctgctccaaggcacactggcagccccagcaaaatcctggagccggcaccagggcatgtcccacgagactgttaggagggctgtgcatctttgccccttggttgctcattgagaagcagtatagggcttccatgcctgtttggcctcccctggatccctgtagcagctgttaaaagagaacctttccaagctttgcacagtggcagtatcatagccaatgaggtttattactagttgaaaattttccccaataccccgccgtgacgacttgagatagaggcagcattggcaatttttgacagtttttagggatactgaattattaggttggtgcaaaagtaattgcaattataaaaaaaaaaaagaacctttcctgctttttaagcagacaacaatgcattcccctctgctgcccttctggaaacttttctgtcctaatggactccacgactggatcccaactgctggaacctagcaagtccctagtgagcacaacacgagtgaatgaacaaatctttctgctttccttccgtaactcaggccccacacatttcagtgggcctttccctgggtagcaccgttgatgtagatctcttcatatgtgacatgtctccccgcgaccctctaactccactggttagaatggatttgggcaaggatataaagagggttaagggcagcacggtgcagaggaaagggctctgcacccaggattcaggagctcacggccacaactgactggatgggcacagcctggcctcagtccatgcactgtggccaaccttacccttcctaagataaggagtatctcatctcccagagtcctggttcacgtcttgct

SEQ ID NO: 3795 - DNA, 1235 bp, Homo sapiens
ttccttgttcttttgttgttgttgttgagacagagtctcgctctgtcacccaggctggagtgcaatggcactgaggcttactgcaacctctgcctgccggattcaagtgatcctccagcctcagcctcccaagtagctgggactacaggcctgtgccaccatgcctggctaatttttgtatttttagtagagacagggtttcaacatgttagccaggctggtctcaaactcctgacctcaagtgatctgcctacctcggcctcccaaagtgctggcattacaggtgtgagccactgcacccaccccttccttgacctttcaacagcatttgtcattgctgtcctgtatgtccttttcagtcactgtttaaaaaaaaaaaaaaagccataacccccactctcctggttttcctcttcctatatctctagtctctttctcccctcagtctccattgcagcttcttttcctctgccataagagaaactatcacattctccttaggcagtcttatccactacatagttccagtcagtttctacaagtgatgtttctcaaagctgtatctccaacctagcctttgtccctgagtttcagccccaaatagccacaagcctcaacatcgtttgacatcacctcacactgtacatttccacaactgaatatatcaccttcatttccattccagcatctcccccactgttccctgcctacataaggggcatcaccagtttctcagttgcttaacccagaaccccagaaggcatccctaatttcccttttctttccctccccacttgatcactaaggcctgccaaatctacttctaatgtctttcaaatgcacacacttcttttctcattgctcccactatctctggcctgcatgcttgtagcagccttgtcactgttctttttgtttctcatctgggcgtcttccctaactttcaccatgttacagccaataaaactctaaatgcatctcaggcttcatcattcttctgcctaaaaccatccatggctcccattactcctaggagagtacagaatctggacacctgtgtcctgcttaacctccactttgcctttatactgcctttataaaccttttcttctggaggtctttccctgtatgctggaacaggttggtcccctataacacctgcctcaccctaacaccatctcatttttttttacctgatagaaactttaatgatgttaaaaaaccaatcagtccag

SEQ ID NO: 3796 - DNA, 1153 bp, Homo sapiens
ttctgttcccttgcacccttcctaataaatttatggacagtctgggtcaggttgtggctggatttctatattgcttgaagacttggaaaattctgtgtattatttcatacatgcttctgtatcttttttcatttcccaatgggttattaatttcacatcagagaaaagagtctagttgtggggttttttttcccctaaaccaagcaatttctttgaataaaagttgaaatttcgtttttcaaaggtttgtatgttttcttttgtatattagaactatgactgtgtttattctcataatagtagcatctgcataaatctaactattgcacttgccccaaaaagccttagaaaagtcagttgcagagatttgtaatgaaatctaatattactaggttttaacgctataatagcttcagtgttataatagtcttttatatttcctttgggggaaaatggattactactctttttcagaagcctgttcccaaggtaatcactttttaaagttttctgtgtttctgtttgttctgaagaagatttgtttgtatgaatgttaaaaggacatataagttagttttcaaggatattcctgctggaattaaaataactctaagtgatctttatcacagatttttttttcctttgaactagtaggaaacagctatttagctggttctgttatgtagcaatttaaaactaatgctgtaggccactttgtggttgttccttgtggcagatacttttgtaccttaaaattgtattttgctatttaaatttttgtttcacagggctttcttccttagataattttgtgatacaattgagtatacacatacttaatttagatatgttcctgtaacttaatataacataatttttttgtcttacagtctagcttcaattaagttgaataataaatttaccgtataaaaattaaacacctaaaaagattattgaacttcttccatgtatagcacattaggcaagctaattggaaatttggaggaagtaagctagagatttttctaaaattttattagttttccctgaaagttaataatttaaatatcatttagccaaagtatgttactactaaaagtgactgttctaaggctgtttgtgtgaagtattaaatatatgttcttttcctcaa

SEQ ID NO: 3797 - DNA, 1198 bp, Homo sapiens
tagttctaaagaagataacaggccaatcctgaaggtactccctgtttgctgcagaatgtcagatattttggatgttgcataagagtcctatttgccccagttaattcaacttttgtctgcctgttttgtggactggctggctctgttagaactctgtccaaaaagtgcatggaatataacttgtaaagcttcccacaattgacaatatatatgcatgtgtttaaaccaaatccagaaagcttaaacaatagagctgcataatagtatttattaaagaatcacaactgtaaacatgagaataatttaaggattctagtttagttttttgtaattgcaaattatatttttgctgctgatatattagaataatttttaaatgtcatcttgaaatagaaatatgtattttaagcactcacgcaaaggtaaatgaacacgttttaaatgtgtgtgttgctaattttttccataagaattgtaaacattgaactgaacaaattacctataatggatttggttaatgacttatgagcaagctggtttggccagacagtatacccaaacttttatataatatacagaaggctatcacacttgtgaaattctcttgtctaatctgaatttgcattccatggtgttaacatggtatatgtattgttattaaagtaagtgacccatgtcaaatgtcttttatttatttcatgaggaaaagctttctgtagaggaacaaatttgagaacaagtttcaggaaattgtcttttttgttgttgttctctaatcatgttctcctttctgtttcaacgattttaaaaatattttactttatggtatgttttattttttttccttttgtgggtaatttttgttctattgattatccatataaattttttttttttttttttgagacggagttattctctgtcatcttggctggcgtgcagtggcacgatcttggctcactgcaacttccatcccccaggttcaagtgattctcttgcctcagcctcctgagtagctgtgattacaggcatgcaccaacatgcctggctaatttttgtatatttagtagagacgaggtttcaccatgttggccaggctgatcttgaattcctgacctcaggttatccacctgcctcggcctcccaaagtgctaggattacaggcgtgagccaccacgcccagctgattatccatata

SEQ ID NO: 3798 - DNA, 1211 bp, Homo sapiens
aacttgtaactcccaccctttatattatgaaaaacttcattatctctttactccttcccatagttccatgagttgggttttttttttttaaaccaagccaattacatttattaaatatttcctttttttcatttttattaaccaagtgcctatagctgggtctgaaataaaaacatacacttcagatagttgtatctatatgatatttgattcagatggttgatgtttgttaacccgtggatctttaatatgaagagacagttccattaacattttttggaaatgattataataaggtcccctgtacatttcgctccattacacccccatcccccatttacggtttcagtgatcccttgcagtcttaggatctcaagctgaggctgtggtctataccttaggagtttgtagttttgttaacacggtttttttttttttcttatggaaaaagataatttaaaatattctctaaaatgaatggtttttcttttttcttaagagatggggtctggctatgtttcccaggctagagcacaatggctattcacagatgtggtttagcacactgtggactcaaattcctgggttcaagtgatcctcccaccttaggcttcctgctagctgggactgtaggcatgcaccactgtgcctggcttaaaatgaatgttatattaagacaggtaccacttcccacccccatttgtggaggaatatggtggataatttttgttgatgccattcttagtcctataataccagatgtctagttctggggacccaagctcctgaatcatcacctttttttaaaaaaaacctgaattactaagaataagaagctttccctgtttcttctctctcccatctcaaactgtgttggctttgtgcctgcttgaacttacctactgtctgtttcccacatctgtttcactaatttccactggagcatccttagtggcttgggaggcttgtaagggcaagggcatctcttactcatctctgtctgctatgccaagaacagtgcctgccacagatgaagcagggcagggcagcagcagccacctttgaatgttttctctgtgctgaatacttagcatggattctgttttaattcatttaatgtccacagcagctttacaagaaagtagattactattagtacttccattttaaagattgggaacacattttaaaataatttggttaaagtcgta

SEQ ID NO: 3799 - DNA, 1204 bp, Homo sapiens
ggcagctctattcaaaatcacaaaggctggaaaaaaaatcaaaatattcctcttctacagaatggaaaaacaagctgtggtatatccacacgatagtacactactctgcaacaaaaaaggaacaaactattgataaatgcaataacatggatgaatctcaaatgcattatgccaagtgaaaaacaaacagacttaagagcctatgtactatatgattccatttatatgatactctgagaaaggcaaaactcgtagggagagagaacagattagtggttaagggtagggagagagtttgacaatggagggaaatttggaaaggaggatgaaactgttctatttcttaattttgattattattacatgaattaatacaaaaacacacaggtctttacaccaaaaagtatgacttttcctgtatgtaaattttttaaaaaacccttaaaatttttaaaatgaaaaaaagtcactgatatggtgggtagggggaaagggtgataggactgttcaagtttaaaagacaccaaaaaagagggtctgaagttatcacagtgagttatctcagttgatcgttcatggtcagttacagatcgaactccttgttccactctttccccacccttctcactactgcacttgactagccaaaaaaaaagacagagagagagaccaaagaggcataacaaccaaatgcaatgaattttgactggctcttcctatttgacgtaggaggaaaaattgctataaaaaaaatttttggaagacaattggggaaatgtaaatatagaccagattttagaggaaattatgaaattcttgttaattttcataatgtgataatggcaatgggattaaataggagactatccttattcttaggagatgtatgctgaaatatttaggtaaattgccttgatgtctgcaccttactttcaagaagttcattttttaaaaagttgtgtttttatctgtatggtctgtatgtgcatgtatatacataaaaataaagcaaatataagcaaaatgataaatatgaatgacaactacagaatttgggttaaaggcatacaactattcactgaacttttagcatttctgtatatttgaaaatttcaaagtaataagtggagagaaatcattcacaaaactaatcttggcaaatcagtgtgttgtgaaatcctctctggaagatttttggtccaaa

SEQ ID NO: 3800 - DNA, 1197 bp, Homo sapiens
tctgtcatcatccttgtttttatttttcatcttgtttactcaaacgtgaactgtcttgtctgtggagatgactcagatctcattttctttctggagccctcttctgtactctggtaatgtttctaattgtcagatgtttgtgcctgattcctcaaatttaacatgtccagaccatgatcttatttttaccttcctgctcctaaactaaacgatataaaaagcttagttctggccgggcgccgtggttcacgcctgtaatcctagcactttggggtaacaccgtgaaaccccgtctgtattaaaaatacaaaaaaattagccgggcaaggtggcggcgcctgtagtcccagctactcgggaggctgaggcaggagaatggcgtgaacccaggaggcggagcttgcagtgagccgagatcgtgccactgcactccagcctgggcgacagagcaagactccgtctcaaaaaaaaaaaaaaaaaaaaagctcagttcttcctcttgaaacattatattggcttaatcattgccttgactaattgttagattattagtttaatctcatggttctgtaattcccactcctgattgtgagttactaaaaaaaatcatatggagaggtgattttattaaaactgattattcagttgagacctaggatttttagttttattctctttattatctagtgaatgaacttattttagaactgatgcaaagaaatgtcactgacttgttaagtagagtacacctgtggcttcttcaagtgtgtttgataatgaggtcatataagtgactctaaaatggtttgtttactgtgtgaaggaaggtaggaaacaatggggagatacgtgttaccagcacatggcttgtctaaaacacttatactaccaatctgagtctttaaaagttacaggttggggggggaggggcagttaaaacagtattaattaatgtgttaacatatattagagggcctggattgtcattgatctaatagtgataatttgaatcacttaagtatcatttatccaaaataaaatggcatgttagtcacttaaattgtagctgtatgagaccatattcttttttttttgtttgttttccagagacaggttcttgctctgtcacccaggctggagtgcagtggcacaatcatggctcactgcagcctcaacctcctgggctcaagcaatcct

SEQ ID NO: 3801 - DNA, 1177 bp, Homo sapiens
cttgaaggcttgctaaaagtaactgggcctggttctttgggtgaggggattgggagggatatatctttagcaactgttttagtcagtttgagctattataacaaaataccatagaggatggcttaaacaacagacatttatttctcacagttctgtagtcttcataattcaacatcaagatgccagaatggttgagtgctggtgagggctctcttcctggtttgcagatggccccctttttcctgtgtcctcaaatttcagagagcaagagcactggtgcctcttccaagtcttttaagggcgttagtgagagtgacagccccattctcatgacctactccaatcctagttattttccaaaggccccccacccccaaatataacatttggggttagggcttcaacataaatattcattctataacattccactcctagccactctattcatatccttacatacaaaataagttcattccatcctaacagcctccaaagttttaactcattctagtatcaactaacatttaaagtccaaagtctcatctaaatatctaaatatctaaataaaggccgggcatggtggctcacgcctgtaatcccagcactttgggaggccgaggcgggtggatcactacgtcaggagttcgagaccagcctgaccaacatggtgaaaccccatctctactaaaaatacaaaaattagctgggcgtgatggtgtgcacctgtaatcccagctacacggggaggctgaggcaggagaatcgcttgaacccgagagacagaggttgcagtgagccgagatcgcaccattgcactccagcctgggcgacagtgagactttgtctcaaaaatatctaaatcagatatgggtgagacccaaggtttagcttatcctgaggcaaaattcccctccagctgtgaacctatgaaaccagacaagttatgtgcttccaaaatacagtgatgggataggcaggattaggtattccaattccaaaagtgagaaattggaaggaagaaagggatgatgaggctgggtgtgatagctcatgcctttaatcctagcactttgggaggctgaggtgggaggattgcttgagtccaggagttcgagaccagcctgggcaacatagggagaccttatttctacaaaaataataaaaataattagtt

SEQ ID NO: 3802 - DNA, 1101 bp, Homo sapiens
tcatttgagagataaggaaactgaggcagatgtctagctggccgcaaaaccaagtgtcttggtgccaattttagtgttagttgtatttgagcacaaagggctaggtaaaggggtcaataagtagatggtaaataagtagaagagatgtgactgaagtccgatctaaaacttaagtctgaagctaaaatccatgctcttaattactgcttattacttcccattccctccttaacccacacccaggtctggcttctgttcccaccgttgtgtacagtctcctctgggagaggtcaccagtgccatgagtggggctcgagggcagctccattgttctcaatgcaaagctttactgctgttttgatgctccatacttgaggtgggtctctctgatctcacagttgtagattgtgggcagaaagaggtccacagtgcttaggtgagtccattttcttaagaaacaagaagagctagcttattttacttgtttccaggttccagtccttgtcaaggatcaggacactctccagaaggtggtgagtgccccaggaacaacacttcctcctgtacttcctggcagccacatagcagctgaaatttgcccgcatcctcctactgacctagtggcattcaacctccaggatcctcagcatggtatttactcagtgctctgggttttgggctgttcaaggacccttcctgtggctcatccccctacttccagggagttgcttcctctgctaccctgtctaggagtctcttacagtgccaatttctttctgctgttctgttgttctctccttctttcttgggcccctctgagcttgtatacatcccccctttttttttttgagacggagtctcgctctgtcgcccaggctggagtgcagtggcgcgatctcagctcactgcaacctccgcctcctgggtttacgccattctcctacgtcagcctcctgagtagctgggactacaggtgcccgccactgtgcccggctagttttttaattttttttttagtagaaacggggtttcactgtgttagccaagatggtcttgatctgaccttgtgatctgcccgccttggcctcccaaagtgctggg

SEQ ID NO: 3803 - DNA, 1195 bp, Homo sapiens
gtatgcaacctataggacttctaattttctgtgccagtttccacaaagctacttcctgaaactttgatggtctatgacaatgaatcacaatctggtgcaaactgcccaggccctcctcaactggctgatggaggctcatcttcacagctgtttactttccagtatataaaggactagagtcaattggtgagacaacaacaagtaaccaagagacctttgagtcctccccaggagagggagattggcttgagatcctgggggtgaggagagaatgcaattagacctcaaacctagagtacagttaaacctcaattgggatacctatatatgtttactgtaataatgttaatctctagacctgttcatctaaatattaactgattactttgtcttagaatggattagcacacaagcaaaagaaataggtttttacataaaacttccttagtctgttaaaagttgtacatagtaatgatttgggaatccttattggaataccataattaagaaactgtgatgattgtctcctaacagagggatatgctctgtgaggacctggctcatgccactgagcagctgaacatgctcacagaggcctcaaaaaaacactcggggctgctgcagtctgcccaggaagaactgaccaagaaggaagccctgattcaggaacttcagcacaaggtgagaaacacacaggtgtcactcaagatgggagacaagagaccaagtgtagtggctcactcctgtaatcccagcactttgagaggccaagggggtggaccacttgaagtcaggagttcaagagcagtctggccaacatggtgaactgaaaccctgtctctactaaaaatagaaaagttagccgggcgtggtggcgctcacctgtaatcccagctacttgggaggctgaggcacaagaattgcttgaacctgggaggtggaggttgcaatgagccaagattgcaccactgcactccagcctgggtgacagagtgagaccctgtctcaaaaaaaaaaaaaaaaaaaatgggggacaggaggaatccacagttgaggttgtcatgacattcctgcattggccaacttctccatgtacaaaggggaggctaatggagtatccttacctggactgagacttgctcagctgcctcccacccaccttaggtccttgacacatggcaaccagttctaacca

SEQ ID NO: 3804 - DNA, 1166 bp, Homo sapiens
acacagtgcctagggcccacaatacttttagaggcctctgcaaaagttttaatttcttttaaaatcagaagaaaaaaatgaacttttagggtcaaaagttatatttgtctttatattgatgcagttgtaaaatataatttttaatattatctgaaggagcaaggagcctacaaaggcagaagcacctagggctcatgaaagttatgacacagctctgcacagaactggtcccttgggagagccacacataaacatggcaggactggtggcagcatcagggtggtgactggtgctatgcggagaggagtgagctttcttttctttccctgtcagttcacaggtatgacccggcaggatgcttttctagccctgactcagaaagcccgggggaagagagtgggtggagacgtgacaagtgataaactgaaagactggctgatttcacggcagcggtactggggcacaccaatccccattgtccactgcccagtctgtggccccacacctgtgcccctggaggacttgcctgtgaccctgcccaacatcgcgtctttcactggcaagggaggccccccactggccatggcttcagagtgggtgaactgctcctgcccaaggtaaggagccacatccctgcagtggtgactgtgcctatggccccatacctgctagggcttcagacagcctcctccctcctggtgctaactctgctccctttttccctgacttccatgaggctggaaagaacactgtgggtctttggggccctttaagagaagggtctggaatctgtggccctgcctctgcaatgggcatcctcccttctctgagctgttggaagcagcagtgtcagttcagatctatcccagaaacatctgatccaactgatggaaaagctctaaattttccttacagctttgtaaaaaaccactttcctccattttgatattccaaagagccacgtggagaggggagaaaatgttctcttctccaccttgcagttttccaatatagtgactgtaacaacagtggagattttatcatgagtagcagagtagttgctaagagagcaagtgtgctcagggctgcattctttaatatgctgaagcaccatggttcctttctcctcattttggaagtgggattatgtttttctgtctattcac

SEQ ID NO: 3805 - DNA, 1162 bp, Homo sapiens
aaagtgctgggattataggcatgagacaccacactcggcctatcagtcaatattttataaacggctgatgtaaataaagaaaataaagaggattttgactactgtcttctaaactgtaaaaatggtctattgagtatatatttagtgtgacgatcatcagctatttcctagtggagggaattcctttactggaagcaggacgattctgaaactagaattataaagatgtaacactgacactcccacccccagtttatgtttgatgctgattattcagggatggtttaggtcttagcatttttgaccaagatgaacagcatcaaatggaagtgccagttcagagacaagcctgaggcatagtctgacttggtggttctcaaagtgtggtccctggactagcaccatcagcatcactagggaacttaactagaaatgcagagtctcgggccccttcccacacttactaagtcagcagtctgtgtttcaacaaactcacctggtggttctgaagcatgctaaggtttgagaaccacctaagtttttggtgtttatccctcggctattccattttgtcctctgtccttattagctctgccaaagccgcagcagctccctagtgttacgtctctacgtatgagccgccataacaagtcagtgaggacagtgaaatttgcctcttcaagggagcagaaggaagtttaattgggaatgccaggaaatccatctacttccctggaaggactgaacgtttataccgccccctcacaaatccttatgttgaatctctaatcccaacatgatggtatttggaggtggagtctttgggaggtgattaagttatgagagtggatacttcctgaatgggattagtgtccttataagaagagctcagagatgtagttagttccctttccaccatgtgagaaaacagcaggaagacagccatctgtaaatcaggaactggatcctcaccaagaacctgaccctactagcaccctgatgttggacttccaacctccagagctgtgagaaataaatgtctattgtttaagctactcactttatggtattttgttctaacagcctaaaatgactaagacattccccttagtctgagagatattccttttggaacagaaaacaagagagacagtatagtgtg

SEQ ID NO: 3806 - DNA, 1189 bp, Homo sapiens
aaatgcgaggagctcccacaccctatctgcaatccgggactcagaagccctccccgaggccagggcccgcacctgccgccccgcccgccgcgcctcaggcctctggcccgtgggactcacagcttcagctgctcgtaggccgccgtcgccatcctgcacaaccacctccttccttctctctccgcccgccccgccccgcgccgccacctcggctacaactctaccggtcaccctggcacagcggccgcagctcccagcctcttcccacccctttccccgccccgcaggagagccggcctgaacgggaggcggtggaggacaaattagtgcgcaagcaagagcacgcgagagatgccgccgacgcggcgggttggagtgcgacgaagagcgccgtgacgaagccgctgcggattggtggggcgcgttttggggaaaggcagagcagcgggagcgcggcgcaagggcaaaatggatcgttggtacccggaagcccgttcaaactgtataagggtgatcagctatcacggagaaggctttagcaagtcggggccagtggcgcaatggataacgcgtctgactacggatcagaagattctaggttcgactcctggctggctcgcgatgtctgttttgccacacttgacccatgtactactgggtcttgtaaagatgtatattcacaatgtgaaagtattacaagaccttggaaaggtgtatggttagaatgtgaaagttaaatatctgaaattttgatgccgctttgctcacaatgtcatcctttatcctttaaacctggagttgtctgaggtggtttgcaaactgcaaagcgccctgttcccaatgatgcacctgagaagtctgtaaatggggtaaatttaggcaaacacacctggaaaagtggcattttggagtggggaatgctgtggccggaggttagcaaccggatgatgcaaaagcgtatttaaggcagcagttctggcctttccccgccacggagcagaagcccccatagtgatgtgagaagcggcgctgtcccagtttactaggatgggatgggctttggatctaaccagcagcgaagaaaacctgcggtgcggctgcgctcggtagtaggggtccacaaagcgtcagaatctgcagcagccccggcctttgcgagctccagctccgaagtcaacccggcccccaa

SEQ ID NO: 3807 - DNA, 1090 bp, Homo sapiens
cccagcccacaggaagggaacccagaggagggtggggagaggatggccgcgctgggcccaaggaggggtgacggccaggagtggtgagagccgggctgatgtacttggcctcactgcccccagggaagtcatcagctccaaggagaagagcaaatacaagttccctcctgctgctttgccccaggaattcagcgccttcttccaaggtcaggccccgcccctgcccccacttggctccacccccaaacctaggccccttcctgtcgttccttgatcctgccatacacaggaaccacttggtggtggctgcatgcaggactgggagaaccaaagaccaagcaagagtttagggacagagacaagagaagacatcttgggctggagcgagggcctcccatcaggtggaggggtggggtcaacctgcctacccagatttctcatcctctttccccgccatctcctggatccttctagccacttgtaccctactgtgatcttaaaactctctggtccaatccctttgtccccatagcctccacgcatctccacccatcccggagacacaggaggtatctccacctcctgttccctggctgctggaggatctggtgcccaggacagctgtggctgcctgttcacaggtggtcctgtgaacctgttctccctggtgaccctccacccctgggtcccctctctcctctcattggagggagactggccaggactttagataggctcagggtgggatatggcctggacagaggtgggcagggctgtgaaaaggtggtgacctattgggatattaaatgtctcagtgatgcccccatggagctgtgggcctggatctagagttggggcagcaactccaggaggggaggcacccctagggagctcctcgactttattttcccatagcctgggtgctgttattaaaacaaactggatttcatttctcctcccatcatatcccttgatgtcaacctgacgtcctcaagatgaaatcctactcctcccacagcctttctctccacttgccctgctgctcagcctggcttctgtcctctcattcccagactgctaccactgaccc

SEQ ID NO: 3808 - DNA, 1177 bp, Homo sapiens
taagaatttcaatttaaccatccttaaaatgaggacagagagggtatatgggataagggatatctgctggtcgcaaagcccccttgcagtcgcaagttggtgtatatcccctctcccttccagactgctcccggccgcgcctcccttgcccatgaaggtggccatccgcagcgtggccgtgaccaaggagcgcagccacgtgctggtgggcctggaggatggcaagctcatcgtggtggtcgcggggcagccctctgaggtgaggatggggcgggggtggggaggcccctcgaacggggcggggcgtggcgcggcgatcccagctgatcctactcaacccttacgcccaccaggtgcgcagcagccagttcgcgcggaagctgtggcggtcctcgcggcgcatctcccaggtgtcctcgggagagacggaatacaaccctactgaggcgcgctgaacctggccagtccggctgctcgggccccgcccccggcaggcctggcccgggaggccccgcccagaagtcggcgggaacaccccggggtgggcagcccaggggggtgagcggggcccaccctgcccagctcagggattggcgggcgatgttaccccctcagggattggcgggcggaagtcccgcccctcgccggctgaggggccgccctgagggccagcactggcgtctgcggccgcagcagcactttttgcacagtctggggcggggttccccggcttccaagtcgctgtttcgtcaaagcacgagggccgcctgtggccttaattcctaacggcggccccggttctcccttctcggcaataaaccaggcctagttttgtagctgctccgtctccgagtgtgcgttcgcgcgcagcgtctcggcctgccatggccaccgtcccagggtcgccgtctgagtctggcctggctcgcgttcccctggcccgtgaccccctctgggcccactcgccccccctccgcgtggccgtcgctgaactggggcctcagtttacccggcagtgtagcccctgccccacatctcgccccggcttgtggtttccccacgatctcttcatggggtcgccttcgcacgccattcgtccacaaccgcaacccggccaggcgccccgcaggcgcgtttgcattccttcgccgggcaggggcgacaacacccgaggccg

SEQ ID NO: 3809 - DNA, 1102 bp, Homo sapiens
acagaggacaaggccgtgctgcaaaacctaaagcgcatcctggctaaggtgcaggagatgcgggaccagcgcgtgtccctggagcagcagctgcgtgagcttatccagaaagatgacatcactgcctcgctggtcaccacagaccactcagagatgaaggtgggctgggtgagcagggtagaggggctctggctccgggccccacccttaggagtcgaggccctgagtgtccgtccctggcccccaccccttcctcagaagttgttcgaggagcagctgaaaaagtatgaccagctgaaggtgtacctggagcagaacctggccgcccaggaccgtgtcctctgtgcactgacagaggccaacgtgcagtacgcagccgtgcggcgggtactcagcgacttggaccaaaagtcagtgcccagtcctctgctctttcccggagccacctggagcccagccccatggttcacctggagctggcccttctgcccaccaggtggaactccacgctgcagaccctggtggcctcgtatgaagcctatgaggacctgatgaagaagtcgcaggagggcagggacttctacgcagatctggagagcaaggtggctgctctgctggagcgcacgcagtccacctgccaggcccgcgaggctgcccgccagcagctcctggacaggtttgtgtggccctggggctgtggtgcggctcgggtccagacaggctggggtgatgggagcctggccccactttttccttgcctgtcgcacagggagctgaagaagaagccgccgccacggcccacagccccaaagccgctgctgccccgcagggaggagagtgaggcagtggaagcaggagacccccctgaggagctgcgcagcctcccccctgacatggtggctggcccacgactgcctgacaccttcctgggaagtgccaccccgctccactttcctcccagccccttccccagctccacaggcccaggaccccactatctctcaggccccttgccccctggtacctactcgggccccacccagctgatacagcccagggccccagggccccatgcaatgcccgtagcacctgggcctgccct

SEQ ID NO: 3810 - DNA, 1178 bp, Homo sapiens
tgatgcttctgcaccccagccccaactgcagccttcgggcggagagcctggtccacgtgcacttcaaggaggagattggtgtcgctgagctcatcccccttgtgaccacctacatcatcttgtttgcctacatctacttctccacgcgtaggttcatggcagggaggctgagggctttctccaagctaaacgggcatttccatgtcacctgcttccctggctctggaggtggcttggggtagagagatagaacacacctggtggtcatcagagctagggctttgtcccccagcagggtcttaggagcttgggtggggccggggctcttcccactttcagccccttcctgggttagggttcctaaaaggtgtactgtgtccatgacactgggaagtgcttgtgcctgtccctttcctttggtgaaaccaggagttttcccttcctcgactgtcagggcaacctactcccgggagccccagtgggccgggggctgggggaggggccgccctgatacgccctctctgccctccagggaagatcgacatggtcaagtccaagtgggggctggccctggctgccgtggtcacagtgctcagctcgctgctcatgtctgtgggactctgcacactcttcggcctgacgcccaccctcaatggcgggtaggtccctagcaggctccactgggccacagggtgggctcaggccagagagccttgcacttctgggttcttggccttccctggactttgctgtgacctcacgtcttcacattgttgtttttgacatttaagaggtacattttcttcctcttctttgtctggcttgtattcatacttgtgtttgtatatagcatatctagctatagtgagtgtccatatgtacaaaagtgcatatttgtgggctgggtgtgtatataaggggtgtgtgttggtatgtttgtgtatacatgagtatgtattgcatgtgtgtagtcggatttgtgtgtctgtgtttatgtattctatatacacacaccacacacacactgcagcttgatggcttaagccactggaggtgtgagatagagaagagaacattttttttttcatgattagaacatttaaatgcctaatgaaataggtcattttagaggaagctctttggaagatatgagcacactgtaatttgtcgcctttttc

SEQ ID NO: 3811 - DNA, 1199 bp, Homo sapiens
aggagaccggagtccagctcaaatctgtctccctgtgctggctttaaggcagtaattttattaggaaaggtttagagggtggatactaggattagcagatgattgatggaaggaagggtgatttctgggaagtctttgagcatgcccagttatctcttgatgccacctcacaggtcccatgtgcaaattccggggggagttagtatgaaacatggcagtggaaattcaggctgtgacatcggcaagctcattctgcacaactccagtcggccatcttggttccagcttatttcagccagttcttttatctcataagcggagggagtttctgggtttcagcaaattgtttcttttcttatctgccatcctgcaaactcaagaacttgtattagtcattggtttctttaactctgtggggcacggtttccaatgcccattaaatcccttgaattggaccgtctttcttcttcctgtgctcagctgccctttctgccctccctcatttcttctgcagtatgtgggtgccccggtggcttatgtccagcagatatttgtgaagtcctcagtgtttccctggcacaagaacctcctggcagtagatgtatttcgttcacctttgtcccgggcattccaactggtggaggagatccggaaccacgtgctgagagacaggtacccctctcagggaccctggcctccctgaatcccattctgtactgaagggagagttacagtcctcagtgtaactgcagtgagccagtcagctctgcagagatagaacaagcaagaaggatggagggtgagctagccttgaatttctcagcatccttgtgggtctacggtggctgcattccgcttggacctatgcagatggcacacacatagccttgagtctcatccttacatctcagatggagtcagtgtccactgtgctaactcatgacccacatggcttcctgcctgtgggttatggtgtgaatgtaatggtggtgtctctgccgacgagaagcaagctctacctgggggtaccttctgaagccccagcccaagtcgtgctcccctgcctatcagtgggtccctgggttatgctggcttggcatacaatgtgtgtaattggcaagctgcatcactgccaggttttagttagctagtggcgttgacagatattttggtgaactaaatgaagcccctaatttacc

SEQ ID NO: 3812 - DNA, 1158 bp, Homo sapiens
actcaggaggccgaggcaggagaatggcatgaacccaggaggcagagcttgcagtgagctgatattgcgccactacactccagcctgggcaacagagcaagactccgtctcaaaaaaaaaaaaaaaatacctgggtgtggtggtgcatggctatagtccaagctactcaggaggctaaagtgggaggattgcttgcacccaggaagttaaggcaacagtcagtgagcaattattgcactactgcactccagcctgggtgatgcagtgagatgctgtcctatttttttgagacagtcttgctttgtcacccatgctgaagtgcagcacaatctcagctcactgcaagctctgccccccaggttcaagcaggtctcctgcctcagcctgccacgtagctgggactacaggcatgcaccaccatgcccagctaattttcgtatttttagtagagatgggatttcaccatgttggccaggctggtctcgaactcccggcctcaaatgatccacctgccttggcctcccaaagtgttgggattacaggcatgagtcaccgtgcttggctgagaccctgtctctttaaaaaaaaaaaaaaaggcggaatattggaatagacatcaaagcagacatcggaatggctaacatgcgtatataagtgctcaacattattagggaagtacaaattaaaaccacagtgagggctgggcacagtggcgtgtgcctgtaatcccagcactttgggaggccgaggcgggcagatcacaagatcaggagttcgataccagcctggccaatatgatgaaactctatctctactaaaaatacaaaaattagacaggcttggtggtcccagcctgtagtcccagctattcgggaggctgaggcagaagaatcgcttgaacccaggaggcggaggttgcagtgagccaagatcgcgccactgcactccagcctgggtgacagagcgagacaccatctcaaaaaaaaaaaaccaccatgagatactactacatagccactaaaatggctatatcaaaaagactgacagtaacaagtgctgacaaggatgtgaggaaataggaaccctcatatcatacattgctagtgggaatgtaaaatggggcagtcactttggaaaatagtttggcagtttcttaaa

SEQ ID NO: 3813 - DNA, 1098 bp, Homo sapiens
taatgagttactttggttccttttagttcattcaagtcttggagctttttccttgtttcagtgatgcttccttcaaccagatagaaaacgctgatattattatttggttgctgtatgcattgtctccccccccccaactttttccctcttccaggatgatcctagtgctccccacaaaatccaggaggttctcaagtcctgcctgaaagaggaggagtcatttaacatccagaactccatgtcgcccaaacttgagggtggcaaaggtgaccaggctgacttggatgtgaactgtcttcagaataatttaacctaaagcagagcaagaagagaggaagcgggggtagtgggtggggggtaggggaagaaacattatctcctcttgtacagagtctatttcttgtaaccatttgttaaactcttttctttttctgatctcatggcatgcttttatgtattttgtacaggaggcaaaaaaatacttaaaataagcaaagaaactgaacagaattgcatacattgggttgttttttctgtgctgtctgtacattgcttctgctgctgtgatttctaaacctgtgctgttattcaactgacttttttttgtactttgacccacgtttttttgaaataccagtaaaaaacaaagttcttgaaataaaactttttaaaaagttattcattttcttagtctttgtgtccactcctttaagtttgagttgagtaaccttcattgaagatgtttgtttatttatttatttattttgaggtggaatctcgctctgtcacccaggctggagtgcaaggctcactgtagccttgacctccccagctcaagtgatcctcccacctcagccttctgagtagctgggactacaggtgcaagccaccacacctggctaatctataaattttttttggaaaggcagggtctcactatgttgcccaggctggtctcaaactcctgggctcaagcaatctgtctcctcagcctcccaaagtgctggaattacaagtgtgaaccactgcacctggccaaagatgtatatttatttatatttatttatttgtttatttattttttgagacagagtctca

SEQ ID NO: 3814 - DNA, 2020 bp, Homo sapiens
agtgaccttatttctgcttttctgagctaagaatggtgctgatggtaaagtttgagacttttgccacacacaaatttgtgaaaattaaacgagatgtggaaggagaacctcagtgattttattccctagtgaggcctctgagggcctccacactgcctggcagaacataccactgaactagtatgtgctagaggagggcacaaacatccgctccttccctaggcctgctggctctggttttctatgcagatgattcattggattgggggtgagtgttttgtttttctgggggcagtgtgagctttgagggttggaatattgggaggcattccttagtttcctcaactagcctggaaagttaggagtctagggtaattacccccaatgagtctagcctactattcactgctttgtgtgcatttttttctccctctttaaaaaaccctttaaaagaaaaaaaaaagtagatagtgctaaatattttagctcatgaaacttggttaggatggctgggggtacaagtccccaaactacctcttgttacagtagccagggagtggaatttcgtcaaccggtacttttaaggttaggatgggacgggaaaagtgaagcaggatattagctccttataccttctcccttccatttctgagatctcacattccatctatcacagggttttcaaagagatgctgagggtaacaaggaactcacttggcagtcagagcatcatgctttgaggtttggggtgctcaggctgggagggtagaatgccattccagaggacaagccacaaaaatgccttaatttgagctcgtatttacccctgctgataagtgacttgagagttcccggttttttcctcttgtccttccctcccttctgtccttccatgtgtggggaaagggtgtttttggtagagcttggtttccaaagcgcctggctttctcacttcacattctcaagtggcagtttcattatttagaatgcaaggtggacatcttttggatatctttttctatatattttctaaagctttacatatgagagggtatagggaggtgtttataaaacacttgagaacttttttccttaatatcagaaagcaaaaaaataaaaccacaattgagatttgcctttcaaaccctcaggtttgcctctaaccaggtgtccctggtcaccatcagagtactggaatacgggaaccgaggagaccttggtccttttgtttttgttctggactcttgggagtggaaatgagaatgagtttattcctactggagcttagttccaatgcatttggctccagaaagaccccagtgccttttgacaatggccagggttttacctacttcctgccagtctttcccaaaggaaactcattccaaatacttcttttttcccctggagtccgagaaggaaaatggaattctggttcatactgtggtcccttgtaacctcaggtctttaatgtgatcactttcaaatttaaaagatccaggtggaaatatttttactatagtaataattctacaaaatacctgaattcttaacactgttatatttcagtataagtggtggctttttcttttcatgtctttgatctggttttattcctgtaattcagccacctgattttgtgaggggggggaataatatgtggtttttgtacaaacatgtttctcagtgtgttgttattttggaaaaaatgaggggagggagtttggcaagaatggagaaaatgaatgaagaaggcctaatctctctctttttcagtgaataaatggaacaccatttctggattctagtcccattctctgcattcatacaccagtttcttcatatatcctatgaagaacctaaacatttggccccacctggtcttggtttgatcagcagttaaaattctgtgactcgggcttccttcccgactgcccaccttcatgatgtgtaaggaacatacattttgagggtacctcacccactgttcatttgcatggtcaaagtgaaaatgagtgga

SEQ ID NO: 3815 - DNA, 1177 bp, Homo sapiens
cccttccctcctttccttcctccctccctccctcccttccttccctccctccctccctccctcttttcttttgtttcttcttttctttctttctatcactcttgccgcctaggctggaatgcagtggcacaatctcggctcactgcaacttctgcctcccaggttcaagcgattctggtgcctcagtctcctgagtagctgggattacaggcacgcaccaccatgcccagctaatttttgtatttttagtagagatggggtttcaccatgttattggccaggctgctctcgaactcctgacctcaggtgatctgcccacctctgcctcccaaagtgctgagattatacgcgtgagccaccgtgcctggactactttctttacagtatgcatgtcttttatttattttacttgcctgattgaaaataatctaaggaaaccatcaaatctttctatttatgcataaatatttgcattaattttttttaaaaaagctatctaaagaacttctaatattacacattactttcttgttacctgacatgaaagcatctgttttttctgtcttaggccctggagatgtacaaggatgattggaacaaagtgtcggaacatgttggaagtcgtactcaggatgaatgcatcctccactttttgagacttcccattgaggacccataccttgagaattcagatgcttcccttgggcctttggcctaccagcctgtccccttcagtcagtcaggaaatccagttatgagtactgttgcttttttggcatctgtggtggaccctcgcgtggcatctgctgcagcaaaagcggctttgggtatggacttccctaaaccatctcctcaacagaaaaactcagtttatcccaatttaaatattaccagccgttacattcatttcttttaatgtaaataacaaaaatcagatattacctgtgaaagataccatattctttataaaagtattacaatatttggctggacaccaaattagctgggtgtggtggcacatgcctatagtcccagctacttgggaggctgaggcaggagaatcgcttgaacccaggaggcagaggttgcagtgagccgagatcgtgccactgcactccatcccctgggcaatagagcaagactccgtctcaaaaaaaaaaaaaaagtattacaaaat

SEQ ID NO: 3816 - DNA, 1201 bp, Homo sapiens
ttgaattctggctccatcagttaccaaccctgtggctaggacatattctctaacaactcagtgtttgtttcctcacccataaatgggatgatagcagaccctacctgcaatatagagcgattatgaggattcaattgtcagacatacattgcttataacagtgccctgtacacagtaaagtatagatatgtggtagtgaggcagatagcctatgtaaccacgtgttagtttccaattctgcagttaactaccaccatgaccaagtttgaatttatgttacttcacattaatgtcattagattacttgttgttatacattaataaacagttgttttgcatattcgtggttctaaattcactcataactttaaatgtgcaatataatatcaatgttttttatgctcttgtcttaatttgttgttgtatttttaaggaatctgaagatttttgagtttctaagtaacattgtttctgagaggatacatgtccaccttatgaattttgccattgctttttagatacttggcatatcgaaattttatgattgacacgtatcgtctaaacccccaagagtatttaactagcactgcttgtcggaggaacttgactggagatgtgtgtgctgtgatgaggtaaactgtttgactttttctgagacatttaactgtaggaatttacttatgcatgctgtctaatgtttgcttgattaaactggttgtttcaactgggtaaaacacctaattttagttatgccatttaggggttgattatattttgtttcctttcatttcattcaatttaattattttatttttattctattttattaatttaattttattgtcaagatggggtttcacagtgttgccaaggctggtctcgatctcctggcctcaagcgattctcctgcctccgcctcccgaagtattgtgattgcaggcatgagcactgtgttcagcattagaggttgaaaattttaaatatttaatttaggctgggtgcagtggcttacacctgtattcccagcacttcaagaagccaagatgggcggatcacctgaggtcaggagttcgagcctggccaacatggcgaaaccccatctttactaaaaatataaaaattagccaagcgtggtggcacatgactgtaatcttagctattggggaggctgaggcaggagaactcaggagacagagattgc

SEQ ID NO: 3817 - DNA, 2120 bp, Homo sapiens
gtgggtggggccggggcacctgcctgggattctccaagcgactgtgccttgagccagtgggtgccagggcagcaagggtgggggctgtgtgtgaaacccaccaccatcaccccatcccactccccccctcgactgaccctgcactgtctcccccactgtttcattgtagactgagggcggtggcagcgaggctcctctgtgtccgggtccccctgctggggaggagccggccatctctgaggcagcgcctgaagctggcgcccccacttcagccagtggcctcaatggccaccccaccctgtcagggggtggtgaccaaagggaggcccagaccttggacagccagatccaggagacaagtaagtggctgggctcggcctaagggccagccaggggccctgccactggccgcaaattgaaactcctttgtttttgactagagtgtggcctaaattttaatgaagtaaccttttattttccaggcatctaatgatgacattctggtctcgtcttccgtctcccccgtgttcccctcttgtctcccctgttcccctctcccttccctcctcccatgtcactgcagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctgggcccatctccctgctttggtcttgccccatcactgcgccactgctccgtggaggaggttgggagggggttggggtggttgaggctaagttgggatctaggagaggagaaccagattctatcctcatctttttttggttctttggtccaaacccaaaagaaactgacatgccctcccttctccctggatctacctggagggaagagtggaggtggattccgagtggtgacaggacgctgaccgtggagcttaagccactgcctctccctctggtcccacaaatgggcgcccccccctccccatgcaggtggtgtcgggcccttcttgctgccctgccccaagttgggggtcagtgctgcctgtccccatgcttaacatacccgcctagctgctgtcacatttttcttgttttgtccttttatttttttctaataacctaaaaactggcaaaatagttctgcaggttgaagccatgtctacatgaaagtcctcagtaagtgttagagggaacagggcggagatatccttatgccacccccgctggaggatgtgggcagcttagggccctggaggcggtgcggcagggaagaggggtgcagaggctgtggctggtgagccggtcaggcacacaaggggcccttggagcgtggactggttggttttgccattttgttgtgtgtatgctgcttttcttttctaaccaagaggctggttttggcatctctgtcccattccctgggatctggtggtcagccctaggataaaaagccagggctggagaacaagaaagggccaggagatggaattccttcaggccggcacccacaccctaggacatgtaagccctcatgtccaagggagcctcatgcagatagtaggaaatcaggtctggaaatttaaaaataaaaggcatgagactaaggctatctgcttcccttatgccctgactggagaggggagggaggagaggcaaggcccacagagggcatcccagctaggccttgggatggctgcagtgaggagaaatcccgggaactgtattgacacaaagattcttattgcacttgtattttttgtattaaagtttgcatggtttctaataaaggattcaaacataagtttgtagtgaaatggcctgggagattccaagggcttctctggagggggattggctgcagtgtagatttgcctctgaggaggctgccccagacttggcctcctcatgccccctcctgacctctgcccttctctggtcctggcatccctggagaagg

SEQ ID NO: 3818 - DNA, 1220 bp, Homo sapiens
ggtgtctctagcccacccagcccccattattgagcattcacccaccaccattccgccaatcactatggtgttcacccaggaacatttgaatgcaagctgtcacatcagagaccatgataaggagttggagaaattgagttctaccgaggaggctgtgctcaaccaagccccccagcagaaaaaggcagtgcgcagggccctgtctgaatgttctcacctctcagttcccccagctgtcaaccttgcagataagtaccctgaactccctgcccgagaagagccttcttctggcctgctgcctccccctagtagcccaatgcctagtcctacacctgggaaactgggagctcctgctatgaagcgctccatgactgtgggtgaggaacagacagctagctacaaattgagccctgggaaactgcccatcttgtctactaaagagatacctcctttcatctgtgaggaaccagtggccaagaagagagaagaattggctcacttcagcaacagcagcagcaactctgggaagaaggaactcggcactgctggattatatctccatagtaagctggagcagattcctgaaggaagcagcaaggaaaaagggcaggaagattttagtgaaactagaattgattcatgctcgcaggtttgccagcgaggagagaaacagccaggacagacggctctggcagggaagaaagaaattgaggtcactgcaacccagagcactccatcgttcctgtttgaaaagcccccacgtgatggtatgtttctaaattttgcctccattgggaacaagcagacagcaaggaaggaaccaaagtgacagattaccggcagagcactaagcagctttttacagctgggttctgtgactgcctggggaaagcttaattcccttgtgttggaagcttgctgggagtgaggcaaggaagagaacaaagtgaatcttgcagggtcaagctgaatgtcttgctagcatgacagataatgtgaattgagtgtgcaagtttggggtggaatggggtcagagaatggtgggtataaaaactagaccccctttcttgacctcatgtcaccctgtccaacccatcccccatccacccagccctcagctccctgttggtttgaaccagatgattcctgagctctaaatccttcaatcccaactgattgatttccttgcttgaaaatctgtcactttatatagattcaca

SEQ ID NO: 3819 - DNA, 1195 bp, Homo sapiens
ctcagcctcccaaagtgctaggattacaggtgtgagccaccgcgcctggccagcaatctgatttcatctgttcccaatcactccctccatttaaccctaggtgttttttggaagcaaaccccagatcatttgatctttatattagcatgtatctcaaaaaaaaaaaaaaaaaggttcctttttagagcataattgcaataccattaacaaacacacaccggttccctagtaccaaatatccagtcagtattcaattcaccagttatctcataattaaaaaaaaaaaactagctcgttagaattagaatctaaatttattttaatccatagattcttctataggggatatatatataaacagtttggattttacttgtgttttaaagatgccagagatttaactgtgctcatagccagagggggagaaatgaggagagaaggaatgaaaaattaagtctagaaggttggaggactgggtggcaagaaggtgataaagggcatatttgctgtccttggaaaggagaatcacgtgtattttgcatattctctggtttagcattttccccaaattaaaaagaaataaaaatgggggattatatttttctcataaataggaaggaaagaagtaatgatggactctgatgtagataaatttatggtagaggaaacagcagtcatataatatcattttctataaagtaaaatactatattttggatggagtgagctggaaaagaaagtatgtataacagactgtggagaatgagaaaggaagttgcatggggacacattttgtttttgtttttgtttttgagacagagttttgctctctcgcccaggctggagtgcagtgacgtgatcttggctcactgcaacctccgcctcccaggttcaagccattcttctgcctcagcctcctgattagctgggattacaggcgtgtgccaccacacccagctaatttttgtatttttagtagagacagggtttcaccatgttgatcaggctgttcttgatctcctgaccttgtgatccacctgcctcagcctcccaaagtgctgagattacaggcgtgagccaccacgccttgccagggacacatgtttttataggaagttgtgtagagaggtgtgtttataggaacaagtacattcagtatgataataaatcaagtgttgtaggaggtagaatactg

SEQ ID NO: 3820 - DNA, 1204 bp, Homo sapiens
cagcggctggctaaagggctcctcaagcgtggccagagcggacgctgaggccggggaggcgctgagagtgagcgagggctgctaacacgttgtcacctctcactattgctgcccctttcccatggcctgagctaaaagccatagaaagtgtgtgtatgtgtgtgtgtttaggggttgctgggcaggggaagggtgggacaccatcattccacaagacctcgaagttactcctcccatagaaaaatgaaagtggaaaaattagtgatcatacatctactttaaacatgagagggagaaaaaagtgttcattttctattaaaatccatgtaggcactgtcgagataccacacagatctggtccggcaagaggactgtcaggtccaggcagtcataggaagagattgtaagctgcagtaaatctgagtctctcttcaaagggtttagcctgctaacttccttatccttgttctcaaattcaactttcttgttcttccttacccctagttactgtaaacagcctaccccattctcgtcagctttaatcaataattcacatctgttcccttggttacctgtacccattgttcccccgaaactgcacgcctcacactccacctctgtaactcatgtccccctccccttctatagttaggaaaatatgtacaagtggccaattgggtcagctcagattgtgcagtctgaccccagcccatggggggagtgacacagagatagggactgtgttaaggataaaaatcccctggtctcctttgttctctgtgctcttgtgatcttgattgacacaagtggcaccgttccgcagaagtaaattaccttgctgagagaaattaaacttttgcctgagtgctggttttacttcatggcaccgagcatttcatcctagagcattttatatccaacaattctgggggctcgtctgggattcccattctccttcgggaaggggtcttcagtcaccctacccaggggagacacttcccactgccctgttgcggtggccctcagggatgggagatcgagacccacctgttgtgacgaataaacctggactctcagcaacgcggggaagagagacttgcaatactgcggcgaccaggtaaactgcacagaccaaggtagaaaacgtcgcaggggcaacaaattacttctttagtggttttgcgggggtcggggcattctggag

SEQ ID NO: 3821 - DNA, 1117 bp, Homo sapiens
actgggctgtgctttaggtccaggtaacataagccatcttacgttacgtaagctcacggtctgtttcagtggaggacgtgagatatgcgtccgtggccagaatctggacgtggtacagacgccaagaatccgggtgaccgtggtctcgagaatgctgcagcccagccaggggcttggacggaggcgtcgcgtggtcccggagacggcatgttcccttggaccctcctgcagtagccagcaagtaggacacccttgggtacccccacactctccccttgccccataccacaccctggggacagccagagcaggtgccagaggaggctcttcccatctttgcttggcccctcgtcaacctgcctgtcttccttccagtttgaggagccgtgccatgtcaactcctcccagctcatcacgtgccgcacacctgccctcccaggcctgcctgaggacccctgggtccgggtggaatttatccttgacaacctggtctttgactttgcaacactgaaccccacacctttctcctatgaggccgaccccaccctgcagccactcaaccctgaggaccccaccatgccattccggcacaagcctgggagtgtgttctccgtggaggtacagctcctacttggacctggcagggccccgagacccttcccttggctggacagcactgctgtgtgtggcggagaggccgagacagtagagcaagggccggtggatggacatggctcctcatccttgctgtggtgggggcagagggggctggtggggggtgcctagcctagcatctggcacgagctggactgcttggctggtggcccgggtcctgatgcactccatggcaggctctggaatgactgcatttgtatgttcggcctgtgcagtagctgggtggtgtggtccacataggccatcgggctgacccccgttggcagcctggctcacatggacatgcgctaggcatgtgtcttggacatacacagtgggcagcagatgggcatgcgggcagaccacaggttgatacagcatcatcacccccctggtgagtcatcagacacagattgggggctccagctttgttaggtagctgggcaggatttgggaggcagct

SEQ ID NO: 3822 - DNA, 1178 bp, Homo sapiens
acatctcacctggggctagtccttccctgctcagcccctgggggccatgggcaggttctggctccatatcttcccctggctccacagggtcgcctctccatgaggagccctcccctcccagcccccaaaatggacctggaaccgctgtccctgcccccactgacttcagaccctcagccacacctgaggacctcttggcctccccgctgtcaccgtcagaggtagcagcagtgccccctgcagaccctggccccgaggctcttcatcccacagtgcccctggacctgccccctgccactgttcctgccaccactttcccaggggccatgggctccgtgaagcccgccctggactggctcacgagagaaggcggcgagctgcccgaggcggacgagtggacggggggtgacgcacccgccttctccacttccaccctcctctcaggtgatggagactcagcagagcttgagggccctcccgcccccctcatcctcccgtccagcctcgactaccagtatgacacccccgggctctgggagctggtgaggcccagcccaggaaggaggcctcaggggaggggatgtggggaagatgctacccctagcttgccttgtgattctgcactgggaggaggtgaggggcagggtggagtctgcagccccacaccggccttgcctctggaatctggcaaggcagagggctgagctgggcagggtgggctccatagactgccttgcccttggtgcctgcaggaagaggcgaccttgggggcaagctcctgcccctgtgtggagagcgttcagggctccacgttgatgccggtccatgtggagcgggaaatccggctgctaggcaggaacctgcaccttttccaggtcagtgtgtcctgcctgccgctgtccttgcagcctccttagctgttgagaaactctgcacaagccctggggagcaggaggagggcagagtccgagggctcaactccaacccagaagctgtgctgggggatctgttgggtgacctgcaggactccctgggcccagctcctgaagctgcccaacagctgtgttctctgccctcaggatggcccaggagacaatgagtgtgtgatggagctggagggcctcgaggtggtggttgaggcccgggtcgagtgtgagccacctccagatacccagtgc

SEQ ID NO: 3823 - DNA, 1467 bp, Homo sapiens
tgattagcccaagccctttgctgttacagaatgtccccaaaattgctatatgaaagcaacccttcgattcacatatgataattttttatttctttttataatgtattttataggggacatcagcagccaccagcatggtggggtctttgttggggagtgggggagtcttttgtaaatcaagtaagaatccattaaagaaattaattttaaatgtgcattacctggttacataaaggactctagaacaacttaggttcttttgggactgttgaaacattgtctttaaggacagaatgtactgggtgcctttctctgtactctgaatatgcatgtgtattgcggtggggatgggggagttgggggccctcacttggtccttctctgttgtttttttccaggacaaagccaaaggccccttgttagctggccatccctgccccattttttcccctggtcctttcccctgtggccacagggaagtgtggcctgaataccccaccccggctcctctgcacccagagctgggggccacctcagaagtgtcatctctctctgagcacgcattcccctgcagcagtcgaggactgagcagattgagtgatgctggggcagagaggcctgggaggaaaggtgttcagccagtcgtttgtaaggcgctcgtcggcacctgctgaaacgcccccacctgacagccccatcctcaaagactgtcttaattactcatggcaggttctagagacttaaggggaaaagctgctttcaaggccaccacatgtctgtgctccccaaccagctctatctgccttgtgttcattttgttattttgtgacgtgagactgcaaagaccaataaaaacatattttataagaacaaaaggcctgggtgcctacccgtgtgggggcactgtgggaagcctttgctagggtgtcttgtgctgtgtggtttgttttgtttgcccctttattttgctttgcttacccagtcttcccttactcttggatgcttcttaaccctcaggcaaacctgtgttccccctgtattcaggctctgctttaaagcaagccatgaggctgttggagtttctgtttagggcattaaaaattcccgcaaactataaagagcaatgttttcagtcttttaggattagaagaattacataaaaattaataaacattttcaatgatggaaaaatgtgtcttgtaattctttggctcttgcctcgttgagtacatcagagaggaagactctcagccatgtttgctccctaattgcttgtcttgtatggtgtcatcttttctagctgttttgatatttgttaagtttgcagatgagtttggggcctctggcaacatagagactaaggaactgggtaagaaaaaaacaaatgttacaatcatgttacttacaacgcttcttcctgctaaattaaaagttctttctgctcctcacccccttccaggtgtggta

SEQ ID NO: 3824 - DNA, 1484 bp, Homo sapiens
catgaattctatgccagagtcactcctgcagtctgctagggatgggccttcttatcccactctcgcacacatcccagtctagtctttgccttcacagagtcctccttgacacccctgacttaatgatagttgctgttttggagtagaattgatcaggtttaagtcatcctgctcaggttgggcatagtggctcatgcctgtaatctcagcactttgggaagccaaagtgggaggattgcttgagcccaggagttccaaaccatcctgggcaacagagggagaccctgtctctaccaagaaaaaaaaaaaaaaaaaaagttaaaaaaacaattagctggacctggtggtgcacactcagtaggctgaggtgaaaggattcctttaacctgggagactgaagctgcagtgagccatgatcgtgccactgcactccagtctgggggacaaagtgggaccctatctcaaaaaaaaaaaaaaaaagtcatcctcctccaactactgattgacatatggatcatcagttcagaccctcactgcatacaggatccctagagggttctatttaatagcttgaggaagggagactttaaaaggacgtgtgtgagtgaaataggatatagccattaccacggtgccaggacctgacagcgttccaattctttttgcagcatggggaatcaaaggtggcatgccaagttcaactcagggctgaggtatccacattgtccacatcaggcaagccctgcactgacggttgagcctcatggagaggagcatgtgttggaaagagatccctttgttaactgttttgtggtgttctcttcaatgaattagagctcatgccccttttctggctttgctgttgattttggatggtagagaatattcctgagagccttccttttggcccccagcttatgccacccactctcttctcttggttgaattctctgaaggaaaggttcatgtgctattgtcctgttagtcaatagtcttcatatataattgtgttacatatattgctgtagactctcagaaatcagggtagagcttttcctttgagcagtttaatgagtgaattcagcagcaaagtcgcaagaaatggttctccagccaggagaggttatgtttatcctctgattgcccgttttctctgcacacagtgatatcgtattcagtgagaggtgctgttggcacccagcagcaccctgggcacacagcatttcatgtcatgtcacagtgtacaagctaccctctaattcagaaagaagagcattttgcacagagaaaaataaaaagatccatgaatgtcatcttttatcttttattttcagttggctgatgttggaatttttgttcttgtcatgaacttgtaaaccaatcttgccaagatacaagttgttttggtttttcactacaatgacctcttgttcctcctgtcttgactgctgacgttcctcaatgattctattgtctattttatg

SEQ ID NO: 3825 - DNA, 1177 bp, Homo sapiens
ctggccaacatggtgaaaccccatctctacatctctactaaaaatacaaaaattagtcaggcatggtggcgcgtgcctgtaatcctagatactcgggaggctgaggcaggagaattgcttgaacctgggaggcagaggttccagtgagctgagattgcaccactgcacttcagcctgggtgataaagggagactccgtctcaaaaaaaaaaaaaaatatatatatatatatatatagccacatacatggcaggagtatgagtcattggtggcaatcaaaaaatatatttgtgcaggctgggcgcggtggctcacacctgtaatcccagcactttgggaggcggaggcaggcggatcacgaggtcaggagatcaagactatcctggctaacatggtgaaaccccgtctctactgaaaatacaaaaaaaaattagccgggcgtggtagcaggtggctgtagtcccagctactcgggaggctgaagcaggagaatggcgtgaacccaggaggcagagcttgcagtgagcagagatcgtgccactgcactccagcctgggtgacagagcaagactccgtctcaaaaaaaaaaaaaaaaaatttgtgcctgatgtatgaacattctcctttgaatggcccaaagggttattgacattggaaccacagtgaagaaaatgcaattctggtcctacaaatagcatcctaaagctacaaaagtaactgatggaggaactaaaaatagtgctttatatatcaaaaagttgggacttgaaagtgggagatagggagcaatttaagtaagttacatgtcatagagagttagggttatactcagtgatgttggtgacaaccagaagaaccttagacaaatgactggaaaagatttctcctggataggaagacctggtggtggtagtggtaaaaaggaatgaggtcgcagtgttgttcctttccatcaaagagccttttatgttttatgaactattgatttttcttttcttttcttttttttttttttttggagatggagtctcactctgtcgcccaggctggagtgcagtggcgcaatctcggctcactgcaagctccacctcccgggttcacgccattctcctgcctcagcttcccgagtagctgggactacaggtgcctgccaccacgcccggctaattttttgtatt

SEQ ID NO: 3826 - DNA, 1182 bp, Homo sapiens
ccgtagtaggccaggtacactcaaggctgtgactctggctggctcttggcgactgctggcagtgactgatacaggggccctgtatctctatgacgtcgaggtcaagtgctgggagcagctgctagaggataaacatttccagtcctactgcctgctggaggcagctcctggtcccgagggcttcggattgtgtgctatggccaatggggaaggtcgtgtcaaggttgtccccatcaacactccaactgctgctgtggaccagaccctgtttcctgggaaggtgcacagcttgagctgggccctgcgtggttatgaggagctcctgttgctggcatcgggccctggcggggtagtagcttgcctagagatctcagccgcaccctctggcaaggccatctttgtcaaggaacgttgtcggtacctgctgcccccaagcaagcagagatggcacacatgcagtgccttcctacccccaggtgacttcctggtgtgtggtgaccgccggggctctgtgctgctattcccctccagaccaggtctgctcaaggaccctggggtgggaggcaaggctcgggctggtgctggggcacctgtagtgggtagtggtagtagtgggggtgggaatgctttcactgggttgggcccagtgtctaccctgccctctctgcacgggaagcagggtgtgacctcagtcacatgccatggtggctatgtgtataccacagggcgtgatggagcctactaccagctgtttgtacgagacggccagctccagccagtcctaaggcagaagtcctgtcgaggcatgaactggctagctgggctccgtatagtgcccgatgggagcatggttatcctgggtttccatgccaatgagtttgtggtgtggaaccctcggtcacacgagaagctgcacatcgtcaactgtggtggagggcaccgttcgtgggcattctctgatactgaggcggccatggcctttgcttacctcaaggatggggatgtcatgctgtacagggctctgggtggctgcacccggccacacgtgattctccgggagggtctgcatggccgtgagatcacttgtgtaaagcgtgtgggcaccattaccctggggcctgaatatggagtgcccagcttcatgcagcctgatgacctggagcctggcagtgaggggcccga

SEQ ID NO: 3827 - DNA, 1174 bp, Homo sapiens
cctgaccctttccctccgcagggccccgcggcgagggcatcggctctcgccggcggatgacgagctgtatcagcggacgcgcatctctctgctgcaacgcgaggccgctcaggcaatgtacatcgacagctacaacagccgcggcttcatgataaacggaaaccgcgtgctcggcccctgcgctctgctcccgcactcggtggtgcagtggaacgtgagtcctggcccgcagtgtggaaactgaggcccagagtcacaggccctcaccctgcttggtccctgcaaacttggctttcctctgtctcctcctgcagtggatggagatggggagaggctgcgtggatttgtcgtattaaatgtgcctcctccctgcacaggtgggatcccaccaggacatcaccgaagacagcttttccctcttctggttgctggagccccggataggtactggggaaggggagggagaacagaggtgttctgggccccagaaggcgacccccactgcagcctctcaacagaactgtagactagccacacccacccttccctagagatcgtggtggtggggactggagaccggaccgagaggctgcagtcccaggtgcttcaagccatgaggcagcggggcattgctgtggaagtgcaggacacggtgagtcccgggactggggcatgctgcggggagcacaggcctggcgctagacaggctgatgctggccttttctttgcagcccaatgcctgtgccaccttcaacttcctgtgtcatgaaggccgagtaactggagctgctctcatccctccaccaggagggacttcacttacatctttgggccaagctgctcaatgaaccgccaggaactgacctgctgactgcactctgccaggcttcccaatgctttcactcttatctaccctttggcacttatcttgcttatcaacataataatttatacacttctcccattttgtatcaggtgtgttgctggccaggagctgatggctcactgggctcttggaggggaatgtgaagaaaccaaggagtcactttttcatctagattacttaggattccttgacttttcagaagtcgggaagcagtatgtttgcctgttgtagacctacttgctcacatgcagatttgagaggacctcaacggcttttctcacaaaatcg

SEQ ID NO: 3828 - DNA, 1167 bp, Homo sapiens
ccagcattttggaagccaaggtgggcagatcacctgaggtcaggagttcgagactagcctggccaacgtggtgaaaccccatctctactaaaaatacaaaaattagctggtgtggtggcgggcgccgtaatcccaccttctctggaggctgaggcaggagaattgcttgaacccgggaggcggaaattgcagtgagctaagattgcaccattgcactccagcctgggccacaagagcaaaacaccatctcaaataataataaataaataaatagatagatagatacctgtgaatgtcaagaaaattaggtactgcaatcagcttcatttccatccttgggctgtagccagagttgtatcagagggagaagcccttgggtggcttgtttgtttgttttgtttttttgagacagtcctgcactattgcccaggctggagcgccgtggcgcgatcccagctcactgcaacctctgcctcccaggttcaagtgattctcctgtcccagtctcccaagtagctgggattataggcacctgccaccatgcccagctaatttgttgtatttttagtagagacggggtttcaccatgttggccaggctggtctcgaactcctgacctcgttgattcgcccggctcagcctcccaaagtgctgggattacaggcgtgagccaccacgcctggccctgtgtggctttttgggcctcaggcccataggcctcccaccacatctgcccctgggtagccacatacagttccaggaacatctgaggagccaaagatgttgattgttccagggacatgcttggatgcttgggctgtgtcaccctcaccaaacctggcaggaacacagtagttaatttttttttttttttttgagatggagtcttgctttgtcgtccacgctggagtgcagcggcgtgatctcgggtcactccgcctcttgggttcacgccattctcctgcctcagcctcccgagtagctgggattacaggctcctgtcaccatgcccggctagttttttgtatttttagtagagatggggtttcaccctgttagccaggatgatcctgatctcctgatctcatgatccacctgcctcagcctcccaaagtgctgggattacaggcatgagtcactgcacccggcctaacttttttttttaag

SEQ ID NO: 3829 - DNA, 1164 bp, Homo sapiens
gagcaggggcagttgagcatactgtgagcacttttcatttgcttccattcttcttgctcagggagaagaaattggcctctgactccacaggctgtgaatgctttgtgctacctcctgcagggtctgagtggtaggtggcctggaaggagcctgtagttagccttaacctcaactcctgccccaggcagggcagtggcagtggccacaactggttgggaaccagggcacgcccactggggaggcacatgcaatcaagtggccagggtctaaccatgccatagttcttggggcaccagcaggtgccaggccaacctctgctaaggagtgggtgtgtagcctccacatttgagcccagaggaatcactagacctgtggtaagggatgttgctggctatgcagcctgccctatgccagagtcactggcctaaaagacagtctgttagacaatcactcagctgttagttaggcctttctccccaactctttggtttgttcgggctttagcacttataaacagccctggctggtccaaaggtagtgagttatctcaatcgactactcacagtttcagatctaactccttgttctactccttcccctcttcttatactaccctcagtctttaaaaacaatcaggtccaaaggtattgagttatctcaattgactactcacagttacagatctaactccttgttccactccttccccacttcttatactatacttcacttggtctttaaaaacaatcaaaacaaaaaacagccttttgccagctctgcctcacccccatattccttcctcttattagctcaggaggtgggcacttccctgagattcagtttcctttcttccctttttttttctttttttttttgagacagggtctcactctgtcactcatgctggagtgcagtggcgtgatctcagctcactgcaatctctgcctcctggcctcaagtgatcctttcgcctcagtccctacccaagtagctggaactacaggcacgaaccaccatgaccagctaaattattatttttttgagacagagtcttgctctgtcactcaggatggaggggagcggtgccatctcggctcattgcaacctccgcctccaggttcaagcaattctcctacctcagcctccaaagtagctgggactaca

SEQ ID NO: 3830 - DNA, 1251 bp, Homo sapiens
actttttacttactatatgtatgccacactattagctaaaaggactatttttttttctttgctaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggttttttaaaaaagaaagtgtatttggaaataaagtcagatggaaaattcattttttaaattcccgttttgtcactttttctgataaaagatggccatattaccccttttcggccccatgtatctcagtaccccatggagctgggctaagtaaataggaattggtttcacgcctgaggcaattagacactttggaagatggcataacctgtctcacctggacttaagcatctggctctaattcacagtgctcttttctcctcactgtatccaggttccctcccagaggagccaccagttctcatgggtggcactcagtctctcttctctccagctgactaaacttttttt

SEQ ID NO: 3831 - DNA, 1139 bp, Homo sapiens
cccagatgaggacttaccagaggtggggggattggatcaatataccaagagggaagagggggccagtctggcctgaactgtgacttccagggaagtgccttggagggactactgttccttccttcccaaggcctgtggggtgggcagcattctggctcattgctggttgggaggcttctgggcagtgagctggatccttgctgggtccttgtgtgtgtgtgtcagatgctgtgtgacatggctagaatatcggagctacgcctgattctgcggcagccatcaccactgtggctgtctttcacagtggaggagctgcagatctatcagcagggaccaaaggtaagtgactagctcagctgctggctggccctttccccagaaagcttctatgactgggaaagctaggtggtggggtgggtaatgggtgaagattgtgaatggggccttcatggaggttagctgggtgtgaatgctggaagctcacaatgagaggtgaggccatgtccccatatcccctgacctttggggccacctgctactttcagagctggagcctttaggtgctgggagacacttttgagcttgtgtttctgaggactccgtctgcacagcaggagaacttaggtagtctgactgcctctttaggtctctgtgggctccctaaacagggttttcccagtgtctgaggcccagcggcccttctctctgctcctaggaccttggaatctggtcccagagctgtccactttgtctcactcagggcagtacatctttgctttgcagagcccctccgtgacctttcccaagtggctctcccacccagtgccctgtgagcaacctgcactcctccgtgaggtaagccctcaccctaggtaagaaccatgtgtgaatggctctagtgtccaacacaggccaggtagaccccttcctgtaaaattctggggctgggcccagggcccttgggtgttatcttcctcctgggtattctgtgggatttgaggcatctctgttgtggggctacatcaggccctaacctcatgtttcataagccatctgagaatgttgttggtctcagctggagggcccctagcccaggttggcctctctggagcctgaagggcactgctggggagagaccc

SEQ ID NO: 3832 - DNA, 1195 bp, Homo sapiens
acaagagtgaaactgcatctcaaaaaaaaagtggaaagaaaaggactgggcgtggtggctcacacctgtaatcccagcactttgggaggccgaggcgggtacatcattttaggtcaggagtccaagaccagcctggtcgacatggtaaaaccctgtctctagtaaaaatacaaaaattagccaggcgtggtggtgtgcgcctgtaatcccagctacctgggaggctgaggcaggagaattgtttgaatcttgaatctgggaggcagaggttgcagtgagccgagatcgtgctgttgcactccatcctgggcgatggagtgagactctgtctcaaaaaaaaaaaaaaaagaaaaaaaagtggaaagaaaagagaaaaggagcccgatctcatgcctgtaatcccagcattttgggaggctaaggtgggaggattacttgaagccaggagtttgagaccagcttgggcaacaaagagagaccctgtctctacaaaaaataaaaaaaaaaaaaaaaattagttgagtgtggtggcacgttccctaggtactcgggaagctgaggtgggggcatcttttgagcccaagagttttttttttttttttttttttttaaattttttgtagagagggttttgccatgttgcccacgctggccttgaactgctgagcttaagcgattcatctgcctgagcctcacaaactgctggattacagatgtgagccactgggccttagcctaggagttgaggctgcagtgagctttcatcacagcaaatcacaccactgcactccagactgggtgacaaagtgagaccctggctcaaaaaataaaaaaatgaaaagtctcttgtcgtcccctcccttttttttttttttttttttttttttttggatacagaatcttgcactgttgcctgggctggagtgcaatggcgtaatctcggctcattgcaacctctgcctcccgggttcaagcgattctcctgcctcagcctcttgagtagctgggattacaggtgcccaccatcacgccgagctaagtttttgtattttcagtagagacgaggttttactatgttagccaggctggtctcctgaccttgtgatcctcccacctcagcctcccaaagtgctgggattacaggcgtgaggcatcccattttattttttctgtaaatagggaatacaacacatgg

SEQ ID NO: 3833 - DNA, 1193 bp, Homo sapiens
tgcaggaggagaaggctcccctaccccctcctgagtaccccaaccagagtgtgcccgagaccactcctctgaaccaggacaccatgggagagtacacgcccctgcgggatgaggatcccaatgcgcctccctaccagcccccaccgcccttcacagcacccatggagggcaagggctcccgtcccaagaacatgaccccataccggtcacctcctccctatgtcccaccttaacccgcaagcgcctgggtggaggcagggtagggcaggggcctggagacgacatggtgttgtctgtggagaccggtggcctgcagaccattgcccaccgggagccgacacctgacctagcacacactgacacaggggcctggacaagcccgccctctctggtcctcccaaaccccaaagcagctggagagactttggggacttttttatttttattttttgcctaacagcttttggtttgttcatagagaattcttcgcttcatttttgatggctggctctgaaagcaccatgtggagtggaggtggagggagcgaggaaccatgaatgaactcgcaggcagtgccgggcggccccctggctctctgcgttttgcctttaacactaactgtactgttttttctattcacgtgtgtctagctgcaggatgtaacatggaaaacagtaactaaagattaaattcaaaggactttcagaagttaaggttaagtttttacgtttaatctgctgtttacctaaacttgtatgtataatttttgggtgggtatggggaattgctttgctaaaaataagctcccagggtgtttcaaacttagagaagaccaagggacagtattttttatcaaaggaatactattttttcacactacgtcaacttggttgctctgataccccagagcctgattgggggcctcccggccctggctcacgccaagtccctggtgctgggtttgctctcccgctgttgccaggggctggaagctggaggggtctcttgggccatggacatccccacttccagcccatgtacactagtggcccacgaccaaggggtcttcatttccatgaaaaagggactccaagaggcagtggtggctgtggcccccaactttggtgctccagggtgggccagctgcttgtgggggcacctgggaggtcaaaggtctccaccacatcaaccta

SEQ ID NO: 3834 - DNA, 1181 bp, Homo sapiens
aagatggctgtgggctgctcagaagctcttggggaggctgggatgaggggctccctaccccaggggtgccatgggctggtggcaggccctggctgctgcagagttagtggggggccatgtagagtgtcgaagaaaactttcctcgcagcagcctggttggttgggtgcccttgtctccactgaacagatgaggaatgtgaagcatcctccctagggagaataagtgggcaagttgtgatgcaaaccagccctgccctagagcccaggccccggggtggggggtgggcagtggagagggagtaggcatgtctgagccacagataaggcgttgctggcttaactctggcacctacccagtggcaggctaccggcccctgcaggacccaccgagtgctgacctggtgcgggcacagaggttgctgggctgcttccgggcagtgctgagtgtggagctggaccctgtggtgagctggggtctgggccaggcggggtggggggcttccacagcctcctgcccctcacacttctccctcctccccctccacacaggaggggcggctgttggacaaggagagctccaagtggcggttgcggggccagcccaccgtcctcctcacactggcccacatcttccatcactttgcaccgcttctggtgagcggcattgggaggggcatgggaggggaggagacaggccatgctagacacgcccgtggtagatgtgccctcactgagggctgcagtgctgaggtcccacagcatcacctggcgagggccccatgtgaccagggccctcagacctcagtcagtcccctagggaaacagggacattgccaaccaagggcatcaggggatgtcctggaaagaagactgaaggataataacatcccaggccaaggaaactgcgtgtgccaagccttagaggagccgtggggcaatggccttcttgtccctcagtcagaccccggaaggggtcatctatgtttggtgttgctcgagtggctcaaggctctgtgcctgaggcttgtgccttggccatgtgccagggcaggggtgccttgaccagagtggaaggccaccacctcaccagtgcctggccttggtgcagcgcaaggtgtatctggtggaggctgtgctcatgagcttcttgctgggcatcgtggagaagggcacacccacac

SEQ ID NO: 3835 - DNA, 1178 bp, Homo sapiens
caccagccggagtctggctgcgcggtgacccaccacacgttgcccagccgtgtggctgggatggtcggtacccatggccgtgcggtcgagccttgatgctccaggacagtcctggaaggcttcctggcagatccgtgggaagaaagccgacagaagggcgggaggcgggaggggaaaggtcccccgggatgggtagggcctcaacgctgggcatcggcgcaggtgtgtactgcagggagccagccagaccccccacggactgcctgaccttgggggaagcccggagtagaggaagaggccggacccccagacccgccattgactatgtccgccattgactatgtgttctgagagaaatttttttttttttttttgagactgagtctcactctttcgcccaggccggagtgcagtggcgcgatctcggctcactgcaagctccgcctcccgggttcacgccattctcctgcctcagcctcccgagtagctgggactacaggcgcccgctaccgcgcccggctaattttttgtatttttaatagagacggggtttcaccgtgttagccaggatggtctcgatctcctgacctcgtgatccgcccgccttggcctcccagagtgctgggatgacaggcgtgagcctctgagagcaaattttacccagttcctctctatcctcccgatgactctgaaatcaaactcagcaagtcatccgagcccccacggcgcagcggccctaggctggcatgggcgatgcggagctactccgccctcaggaagcaggcgaggtgcccagcgggagaatcacccacatcaccgtctaatctctgctgtgaagtggaagcgcgagaaggagggagcgtctcatgacggagggtgtgaagacgctaggctggacgaagcagaaaggcgggtgtcactggggacgttctgagggtaagccgatggcggctatcgcggaggagaccctggcgaggtggggccccgcgcggggcaagggggatggggtgccacagagggctagttgcaagaggacgcgtgacggctgcagctctgcggagaccgggcctcgacggccaaggagtggcaggtcggcggaggcgggggccaggcccggaggcagagcgagacaggagagcaggcaaggcgggggccaccgtgagtgggggccgcgaggc

SEQ ID NO: 3836 - DNA, 1200 bp, Homo sapiens
cattgttcaattcccacctgtgagtgagaacatgcagtgtttgttttttttgtcttgcgatagtttgctgagaatgatggtttccagcttcatccatgtccctgcaaaggacatgaactcatccttttttatggcagcatagtattccatggtgtatatgtgccacattttcttaatccagtctatcattgatggacatttgggttggttccaagtctttgctgttgtgaatagtgccacaataaacatatgtgtgcatgtgtctttatagcagcatgatttataatcatttgggcatatacccagtaatgggatggctgggtcaaatggtgtttctagttctagatccttgaggaatcgccgcactgtcttccataatggttgaactagtttacagtcccaccaatagtgtaaaagtgttcctatttctccacatcctctccagcatctgttgtttcctgactttttaatgattgccattctaactggtgtgagatggtatctcattgtggttttgatttgcatttctctgatagccactgatgatgagcattttttcatgtgtctgttggctgcataaatgtcttttttttttttttttttgagacagagtctcattctgtcgcccaggctggagtgcagtggtgtgatctcggctcactgcaagctccgcctcccaggttcatgccattctcctgcctcagcctcccaagtagctgggactacaggtgcccaccaccatgcccggctaattttttgtatttttagtagagacggggtttcaccgtgttaggatggtctcgatctcctgacctcgtgatccacccgcctcggcctcccaaagtgctgggattacaggtgtgagccactgtgcctggccaataaatgtcttcttttgagtagtgtctgttcgtatccttcgcccactttttgatggggttgtttttttcttgtaaatttgtttgagttctttgtagattctggatattagccatttgtcagatgagtagattgcaaaaattttttcccattctgtaggttacctattcactctgatggtagtttctttgctgtgcagaagctctttagtttaattagatcccgtttgtcaattttggcttttgttgccattgcttttggtgttttagacatgaagcccttgcccatgcctatgagcaggagcaggcatcttaaatggca

SEQ ID NO: 3837 - DNA, 1184 bp, Homo sapiens
tggtcagactgtaaatgtagaacagtgatgatcacaatgacttactatatagttataacttacttaagtggaatatattttcccatagtattcttactctttatcgttcattcaggcctacacatctttaacgtttcatatttcatttgacaacagcatcctagatatatgaagttaatctaatttgaaaagtccttttattcatttaagattggtggagcaactaagtcttattatttcttgatttatatgttgtactgactgagcatgaaacattcttcattttaagagaaaatactgtttatgatgtcatatcatgctatgtttttagtcacattttaaagaaattattttgaagtaaagataaaaaaggaaatttaaaaatatttctaagtggaattcagtagtctattctcagagatgattactgccttcactttgagtttattttctccacctctagaacactgcgctaaggtgggttttttcttctgactcaccagtaacttttatcaatgatttttactggttcctcttcatctttctgtgtttctaacactggtgatgcccccaaacttaatttctgacctcttcttttctgtttatacccaatcctgccactgtcccctctcgccattatcaccattgacttccagacttgcatattgcttccttgaacttccttcaatgcatattgcttccttgaactccacacttttaactaaactttatctctgttttgatgtctaataagcacctcaaactcaatagctcccaaacaaaattccatattgtatcagcaaaatgattcctttcttggtatttatctcaatggtttaggcaaaagacatctggaatttctcatactataactccaatcaaatgtttagcaggttctgtcagctctactttcaaaataaatctaaatctgaccacttaccacctcaactgttctcaccctcatataagccatcatcatcatttatgtgatggctgcagtaatctcctaactggtttctctcctccctcccttgccccttccatttttcccccaactaacatccagagaaatgttccagaatgaaacaccagatgtcattcttttgcctaaaaccctccaatggctatcatctaacccagagtagaagcagaagtctagaaaatggtctctagggccccagtgg

SEQ ID NO: 3838 - DNA, 1245 bp, Homo sapiens
ttcaggagttcgagaccagcctgggcaacatggtgaaaccttatctctacaaaaaaaaaaaaaagacaaaaattagctcggcatggtggtgtgtgcctgtggtcccaggtgctctggagactgaggtagggggatcacctgagcctggggaggtgaaggctgcagtgaccagtgattgtaccgctacactccagcctgggcgacagtgagaccctgtatagatcagttaatagatagatagaaagaaagaattcattgttaacagcatatagtatttgaaagcaagtgctgtattaagagaataaaaggaagcattggtaattgaaggtaaattgatgcctttgtaacaataacttggcagttctgcaaagctaaatgttttttatagccagtcatgagtagactgcaaaatttcgagagttcagtcttggcaatctgcaaatgaatctgcatgacatttgatttcaaacaatctttcctttgaagctaccaggagtttctttcaagcatacttccagccattggtgctcccatcctccttgactcaaataggcacaaatatgaccattcatttttcctttactttccccagaaatgtgattgttttcactgctcttttactgttttcctcttaagataaatctagtaatgatttcataagatgaccataatgcagaatgttttcctcaatatctgccttagtgtaatgtaattctgatgcagaatgatggcaaagttttaattagcaacatttaagctataagaaataaccaattgaccttggcaattattccatttatttgttcaacaaatattatattaagcacttattatgtgctacaagttttgctacatggtggagatgattagcaagacacagtccttatcatctaaggacttgcagtcgagtgaagtgacaaataggtgccctaaaatataataggtattcttctagaaatcagaattcagtgaagacccaaaagaagtagtggtcaggtctaaggtagggatgttgagaatggagaataatagagcaagctggaaaggattcatagaaaaggcaatattgaactgaatcctttaaaaaaaaaagagagagacggggaaagaaaggcaagaaataccattaataaagtagagtctttgtaggctttttcaatgtaaaagagatctgaagaggtcagagaggaccctgatgagactgccttaaatgacttgctgaaaagttcgacctctaacctgtga

SEQ ID NO: 3839 - DNA, 1196 bp, Homo sapiens
catttttcttgagtaaacatttcttggattgtcacaagcctttggttaaccagtattagccaccccattgctttcatggacaagcagattttcagaggtctttactctgccattcctaaagtacctctcccatcatcgtgttcttaatatccaaaaaagcatgttcttacaatcaaacgctcaggggccatgccccagaaaatgaagcccatggactcagtcggacaccagtttggctagaccttagtctgtcccatgctttgggctttgtgggtataaagtgggtatagagctgctttgggcactgtgggtatagagctacctctgttctgcccagtttgggtctgcttccatctggcctgtgagagtacccagaactcactctcatgtagccctctaagagagaaacaactcacagagagaaccagatctaactcactggtcccacccattgtcatgatctagtggcggccaggagtggcctattgaggagatgcatattgtggtggtggtgtctcacatcagctttcctctgctgtcaggaatttctgctgaagattttttgcgtgttccggaacctgatgaagatgagtgtcttccctcgggactggatggtaatgagactgctcacaagcaagtaagtatggaagggctctgtatcagcatcactgagctgttctcagactaagaagagtatgtgtatttcagagagggagcacatgagcaagacaaataaaggccagggccatgggaacagagaggagagggcaaatgagaaaaacatttttgtgcttagtagatgatggcacagtaaggatagagaagaaaattttcaggatgtgaaatataatatccagagaagggttcttccttgaggaaggcctgctcagtggcccactggcctctgctgccctataggtttgggcattatcccaagccttcttctcagtttgaattgtgttgtctaccaggcagtgcttgcctcccatagacagtgccagttatccacctgagacctggctgcaaggctctgaccacttctgattactgacatagaatttactctaaagataatcctaacctgactgcctcatttatatttctagcttgtgcttcctcctggcaaaccagacaaatgatgcatgtggtaaggggctggctcatctggtctctctctattcagcagaaggctactt

SEQ ID NO: 3840 - DNA, 1161 bp, Homo sapiens
ccaatgagaaatgaggagaaactgaggctcaattgagatgctaaatggctggcgagtgcaaaaccattccgttggacccacccctagaaccattctcaggcagcttctggcttgggatttctgtgcggcattcattccagaaacggtcccatccaggcaggaatcgccgtacacccggcgcaggggaacggccttcagtcggctctcagcggaactttcctctccgcggcgcgtgttcccgtccgtgcggtcgggcgcgcgggccgggagggggacgctttctggcgcggaccgtgagcggaggctggcgagcgccgccgccggtggagaccgacgcttggccagagccagcccgcggcgcccgggcctggccggctgcttcccgcctcagccgccgcccccgcctccgccgccgcagactttgcctaggcgggcgaagctgaacgtgaggtccctcggccctgcgcggtccggcgcggcccggagccgcggcgcaggaggtgagacgccggtgccggttcctcgctcccggccggggccgccgggtcccgcaacaatggggaccgactggagacgcggcctgggcccctgccatgcagtggctcggggcagctagatggacccagcggcccgggccttcggggcacggggtcccccacccgggaaactccagtggccggaggcttggcgggggtcttgggcctcgacccggggcctcagtggcttgatatttgaggatttcgtagccggggaagggagtcgtagggacacggagacttaactgttgcccctctgcgcttttggctctggatgctggcgccccggaggatgaccagagcgcggtgtggggttgggaaagtatttggaattttaggggcttctgtgtgtctaatccctaaggcgcatctggatgcgtctccccgaccccctctcctgaggtctgggaatttggcagactggggtcgggctggggcagaagaggcattgagagtttagcttccctgaggtaactggtgattagttcctggaaaggcaggagctcagctgggcacaagagagttaagcagagagctggatcctccggggccctgatgcaccctgacgaggagtggttttcaggcaaggaacttatcacaggagtgagtagtggcacacggtgag

SEQ ID NO: 3841 - DNA, 1112 bp, Homo sapiens
ttgcttgctcgcccatctgagtgtagaagcgcacatcccatttctgtctttgggaacattctttcccaagagagctgccttactaggtgacttagcttggcctggggaggggagtgaaggaagggagaatgagtgagagaaggagggtgggtagggggagcagactgtgatcccatgtgaagtggggtctttttagggggtgggaaggaagctgaccaggtatgtgtgtttgtgagtgtgtgtgtgtatgtttattttgtatgtgtatgtatggaacagagcaggggtgaaggtgggaggggagggagggaagaactaagagggaaactgaaaaatgaatttatctttctttaaatggaagtcagtttggtggttcatggcacctagtgtgaacatcagggtgagcccagaagagccatggaaataacaagtttccttcgggatgggtgaagagaaggcccagctaactcaagtccctggtattcagagccacatttgtgtgagaatttggggaaattcatgagagaaaatgggcattaccaatctatgtctcttaaccccggtggctatctctgagcagctctccctttccagcttggaaggttgtctgtgtgcagaggctgggagggagaagcactgcagtacgtgaatgaaaggtcgcagagttgtggctggaaaatacatttttcaccagggtagaactgagcccccagctgcctatcctggtagtcttttctgttcctttccttcccctttagagagctccatgttaatttatttcttatgggcaattatttattacttggacttttcatgtgtcttgtttatttgggggtggggggaggttaggggtaaggagggtaggtgatagaaagggaagttttaagatatcccagaccctatagccactggtgaaaaacaatcctggatggatggtaaattgaccaggggaagagttaggtttgaccaaggtttggattaaacaactatatttttgagagatggcttttcaggaagatcagggaatcctgagactggatagttagtggagggtgggactcattccacagaaatcgaaagttgtgatcatggagtttgcaattgggaagtaa

SEQ ID NO: 3842 - DNA, 1202 bp, Homo sapiens
tgctcatttttaattacagacaccaacatgcacctgcctgcacacagcagtccctgcaagtggggactcaaaccctggaggcccctcaggcagctggtcttcatggcacgtgcatgctttggggaggtatagcaagaggctgcagctagaaggtagcacgttattattctgcccggaaactttcctctcacccccaccaggctgccccaaagcttctggcccagaagccagacctgtctgttggtgctctggggccttgccacagcagcagggagagcctgcagaagggctggtgagcaccttcccctctctctactctcccctcacaccagcagagcccaaagctctgaaaatggcaggcaaaggagacagggagtaagacaggatggccagggagggaaaagaggaagcaggaagtggcagagagcaccccaggcaggagcctagggcattggcttggctacacaaatcggtagcttccctctggccctcaatttgcccaagtatgaaataaagggtctacagtcataccaccctgaatgcacctgatcttgtctgatctcagaagctaagcaaggtcgggtctagttagtacttggatgggagactgcctggaataccgggtgctgtaggcttttggcctatcgttccctccctctttccctctttggccaggcgcggtggctcatgcctgcaatcctagcactttgggaggtcaaggcgggtggattacttgaggtcacaagtttcagaccagcctggccaacatagtgaaaccctgtctctactacaaatacaaaaattaaccaggtgtggtgacaggtgcatgtaatcccagctacccgggaggctgaggcaggagaattgcttgaatgcgggagatggaggtgcagtgagccgagatcgcgccactgcactccagcccgggcaacagagcaaaacaagaaagaaggaaagaaggaaggaaggaaggaaggaaggaaggaaggaaggaaggaaggaaggaaggaaggacggacggaaggaaggggaagggaagggaagggaagggaggaaggaaggaaggaaggaaggaaggaaggaaggaaggaaggaaggaaggaaggaaggaaagaaagggattagaatagatgatctcaaaagaagtgaggaactggaaaggatgaataaaaacaccattatgtgacggtaagaaaactata

SEQ ID NO: 3843 - DNA, 1148 bp, Homo sapiens
ctctctcttctctcccaggctctggctcatgcacatgcaacaggtgcgtctgtctatatgtctgggttcttgtcttttgtggtctgtttgtcttttctacctctttctcttgcagtgatagactgagggggtaaaatcaagagaaaaaactctcaggaatcaaggaacataatcctgtggagggtaatccattacatgagcttctcctgttcttccactttcctgcctggctttcactccttcccctgctctgcccagcctttccctcccacccactcctccttctgcaaatgccctgaaggccagcccttaccccaacacccacttccccacctccttaggccccagatacatacatgcccacatgcacgcttacatgtttagagccatccttgtttccaaatatgacccttcgcttgagggcaactgcataggtacatctaactctggactggcatgcacattgtcatgtgcagctttgcatatacacacatgcatacatgagcctccacacaagcacttgcacacatgtggactcctaaccatgctaacctcactggctgggaaggtggggaccccatgggccagcccttgcaggaggcccttttgcaaggcttagggtgtggccagccctgaaagctacttggacacaggtttcagctggccccagcccagaagtgacccccagaaagggagggccaccgctttgccccctgcttttacccttccttctgggtgctctacacctcaggttaccaggcctgaggcatctcagccaagcttgtttcctgctctgaggcttgtggggtgggagccagagtggaggtcggtgaaataaagtgatgcaattagaccccaccggctcctgcttctaaagagcgccgcccctcccccacccctgggaccaacactgtgggcccctcccccaccccggcgggaccagatggtccccctgccctttgtccaccaggccagatggagaggaagggagattggattcccctccccacccacacatacccaggtgccaagagactcagctgtggggggaggtggaggtcagtgggaccaggctgagccgattatggaggagtgggggggaaggaatagttgcttccccgagggcggggggtgcccagcggacttga

SEQ ID NO: 3844 - DNA, 1115 bp, Homo sapiens
catgtagtttttctctagctttggcttctgcctgagcacagcctaactggcccacccaaagcctgcaattcctttttctaccctaccagacccataataaagctttccttggtctccacagcctgaagtgtaaccctctggtcagggtgtaacctgcctcctgagggcagtttggctatctcccttgcttggcagtggcacttagggtaaggagtggccttgtctgagtgcgtgcagggcacattcccacactgaccagccttatgacctccatctgacccagtgctggagttggggtcagcttctcttcctgtgtcagggggttctaaggattagctgagaaggctggagggtctaggggagagctgagcatgtccccagtctgttccttccctttacttttgctctctgttccgtggagtgaatcacaaactctgagcctcagtttccccatatcccaccttggctataagtcttttggaccagacttggtatttaattgacaccttcttctaaagaggggagggggtgtccctgaggggatgtcaggaaaaaacttggtcgaacccctgctgtaggaagttgaagccccacaaccttggcagacagggcagcaaagcagcttgtaattttgttcttgaaggaggtctgcacagcattacccaggtggcgtattggctccctggggtggtggtacactttctctggaaatagtttcaagaggttgggtatttccacatttgaggttgacttgatgctgtctttagaatgctgggtacccctatggagaggggcagcagggagagacttggggacccacatgctgccacctgtacctttcctgcttttcaggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaa

SEQ ID NO: 3845 - DNA, 1176 bp, Homo sapiens
cccatccagctggggttctggcatgggctgaaagaggctggcttggggccacggtgaaactgcctcctcaccatccgtcctgcctccctggcgcccccagagccttctgatgaagattgacgccttccactacgtgcagctggggacagcctacaggtcagtcggctctgccccaaccccacccccgccccaccctacactgctgttctggctcaggactaccttggactgatggtatcttgggcctgctcaggggcctccagcctgtgccagacgaggaggtgattgagctgtatgggggtacccagcacatcccactataccagatgagtggcttctatggcaaggtactccataccccagcagccagcctgccccatggacatgtgcccatgtcccaaggcagatttggggccctcgtctccagcactgaaggggttggggtcccaaagggtgtctgagacaatggccccctccccagggtccctccattaagcagttcatggacatcttctcgctaccggagatggctctgctgtcctgtgtggtggactactttctgggccacagcctggagtttgaccaagcacatctctacaaggacgtgacggtgaggatgctgggcctgccctcggatggcaggaaagactaagtccagccacagtgggacagccccacctgggccctgctgtaccctcattgtcctccactgcccccaggacgccatccgagacgtgcatgtgaagggcctcatgtaccagtggatcgagcaggacatgggtaagtgtggacagaagccctgccgtggccggcctgagcaggtggcaggactgaccctcacagactcatctgccccattagagaagtacatcctgagaggggatgagacgtttgctgtcctgagccgcctggtggcccatgggaaacagctgttcctcatcaccaacagtcctttcagcttcgtgtgagtccagcccctgtggatggagggacagcagggccagggctctgggtggggagggcaggcacggagccgccctcagactacttgccacctgaaactcctccacacagagacaaggggatgcggcacatggtgggtcccgattggcgccagctcttcgatgtggtcattgtccaggcagacaagcccagcttcttcactgaccggcgcaa

SEQ ID NO: 3846 - DNA, 1193 bp, Homo sapiens
agaaacaaacaaaaaccatgtttgggaatacatgtgaagagcgagggctctgccaatcattatcatcataatgaatattctaactaatattaatcagttactatgctccagggttgtgttcagtgcatcattcctattaccgcactaaattatcacagcgtcagaacaaggcctccgttttacggcttagggaattgaggcacagatgggctaagggagcacctgtagagcagggatgtggtttggtaacagagtgcatgctctttatactgctcttctgcgattattgtgaataaagcgcctacaagtgcctgtggaactgtaagtgccccatacaagatagcttttattaattttagggttctcacggggcgcttacttagatttttgctgtgataattgataaagttcagctttcaacactccatatcaaattctgttactttagaagtctaggcaccaatcacgtctccgaaataaacgcaaggcattgcataattgcattttggaatgtggtgctgtacatagtccatcagagagggtcatcacttctatctgggtattaggaataaaaatggcggtggcagagtagggggcgcggctgccaactgcgagctcagacctgcactggggaggcagggggcggggccgggccggcgccacgtgggctgtccttcccttttgggccgtcccacctccagagctgaggcgcctgcgccagctccttcgaggccctgctcggcttcagggagcacgcgcgccctgccgtgctctgattggcggagctgcacgcccccgctgcagtctgattggcggatccgcctcgctttagaaggtcggcgcccagttccggcactcgtgcgcctaccagacagtggcggaggacggcgctcgctagtctcccaggtcgcggtacacggcgagaacgggcggggcggtctcggctgcgtccgggcgatccagtgcttagttccgtcatatccctctccacgacctcggtcgagcatgttcaccagggcccaggtgagacggattctgcagcgggtgcccgggaagcagcgatttggcatctaccggttcctgcccttcttttttgtcctgggaggaacgatggagtggatcatgattaaagtgcgcgtgggccaggagaccttctgtaagtgagggggtagcagtctctgtttcctttcagg

SEQ ID NO: 3847 - DNA, 1156 bp, Homo sapiens
gagtaaagctgcaactttgatggcccaaggtgacgatccaagttaaagaatattctgaaaattagacatctataaaaggactgagataagctctccacacattcccagccagctggaaaacctacacatgctgtgggggaagatgcaaaagaacctggtgaagagcagaatccaaaggatacttgaaaattggctgcaactttgagtgcatcccccaacctatacacagatctgtcagcacatggtacatccttacgggcttgaggtagttaagtacaaacttcacctaagtcattggctatagaaagagaggagcaacccctagtgtcaggtttccttgcagacctatagtgggagctccagaggagagaagagaaagggagagaaaaaagatttgaagacataatgctgaaaacctctcaaattgatgaaaaacagctccaagaatttcaagtaagataatcacaaagagagccccatttagatacatcatcatcaaaccgatgaaaatcttaaaagcagcaactgattgatcacgtacatgtaattatctgcacattccatccaggggcctggggattgtccagcccaattgacaattagtgatacctgagcacttttcccagcatgtggggtcagggccactcaatctgtcactaccacgacaactggcacccatcttcatgtgttacctgtcggtccgggtactagctcacctatcatagccattgccagcactggtgcagaacacttgggtcccagagagttggcccagcactgctactgctttcacccttgccacatccactgcccaagggctcgggaacccacccacctgctcgatccactgctgccattcctggcactccagcaagccagctggagtcccaggaattggcctgcctggacctgctaacaccagtgccagtatacaccactctggggcccaaagcatggcccccttgacagcccagtccccagcagtactttatgcacctcaagccaggcacccccacctcctccccaccccccacattacttaggaactgggctccacaggagccggtgagtggcaggcaagcaaacattaccccctgagctccgcttcctgttagatcagtggtggcattagattctcataggagcatgaacccta

SEQ ID NO: 3848 - DNA, 1129 bp, Homo sapiens
tccccttacctttttgcactactcatttgtcctgggctctgcttcttgctcttttccacatgatggcccacctagcaaatgatcataattgtaaggcacatagagaagcagatgaggtgctgactccagaggtggataccttggggcctctgtaccccaggcctgcctgactgcctcatgggctgaaggcttaataccttcagcacactaatgtactgctacatataggttgggaaactctaggccaaatttggagccagaagttgagtcattcaagattgctgatatacaaatgaatatgcttttgttgaatttgtcccatcaaaattggaagtatagcattctggtaagtgaaagactaaaacaaggaagtccagggcttaaaaaaaaaaaaaaacttatagctagttaaactacaacacgttaaaatatcctcctaagtgagccaggagtttggtagcaggtgtccagctgaagacttggtgacagagtctatttaaatgtaagaacatggctgattatttcttatagaagaagttggattccatgggttccaagagaagaagagctacctccccttccagcagtgtcagcggggactttgatgatgggcaccattctgtgtcaacaccaggcccaagcaggaaaaggaggagactttccaatcttccaactgtagatcctgtgagtaacttggattacatggtttctgcctgctcttcccacaattcccctatcttccctttaatggtaaaattgttacgatgcaaggcatctccacttttttaagattctcttgattaatagtcttttcttttatgaacattatgtattcagctaagtcttagagtaatagtgtgatcttatgaataatttcagtatgttacatcatatattaattcagcaaataactgtgtgactatcatgtgacaagcactgttctcatggttgggatatagccatgtggaaacaagcccatttttcacatggaacttagattccaggcgggggaagtagaatgtaaacaagtaaacgaataaagaataatgtatccttagctagtaataagtgctaagaagaaaattttgggtgatttgggctgttttggcctgaattcgctggaagagag

SEQ ID NO: 3849 - DNA, 1185 bp, Homo sapiens
taaccagtggcataagctagtaaagaattggtatctaaagaactatcctcagggatggggtatattctttgtttcccttaagtaagttttctgcacaatttcacatggcgcaacgatgtggctatttttgtctcaaatgtaaggttccagtgctggaaaacgatattcacctcagtttgtaaaggctgccaagttactccattggaatggacatttgaagccatggggaaggactgcttcatatactgatgtttgggaaaaatggtatattccagacccaacaggcaaattcaacctaatccgaagatataccgagatctcaaacataaagtgaaacagaatttgaactgtaagcaagcatttctcaggaagtcctggaagatagcatgcgtgggaagtaacagttgctaggcttcaatgcctatcggtagcaagccatggaaaaagatgtgtcagctaggtaaagatgacaaactgccctgtctggcagtcagcttcccagacagactatagactataaatatgtctccatctgccttaccaagtgttttcttactacaatgctgaatgactggaaagaagaactgatatggctagttcagctagctggtacagataattcaaaactgctgttggttttaattttgtaacctgtggcctgatctgtaaataaaacttacatttttcaataggtatcttctttttttattccagataactacttccactcacaatgagatgaattgtctttttacagaatttagggattccaagttgcctggttttaatataatacatattcacaaaatttacacagctcatgcataccataacttatacagagaacagtttagcagtctgcttaaaatgttaaaaaaaaaatcataaaaagccattgttctgttacacataatctgtactgaagtcataagcatcatcctcttcaatgattttatccaagataaaagaccttgtagactgttcacctatattgcaggaaaataaagagattttcaaaaagtaaaagtgattctataccatgctgcttcgttagaaccccttttgcctgcctcacctgctgtagtctcctcagacagtgcctcccctgtctcttctgcagcaaacatgcctgagctgttttcctgtgtgacaaagaaaaatagtgctggattagtagcccttgtc

SEQ ID NO: 3850 - DNA, 1214 bp, Homo sapiens
gagggtcaggcaggagcaagatggggctggaggagccagaggagtccatccccaggcagggggagacccaggggggtgagctttaagcagggcctggcaagcgtgggtttgtccttctgagaaggtgcctctgctgctggggccgcacgtgggcctctgatcactctgcgggctgcagctccccaacgtcaccacatcaagcctcaccttccatcaggccagacacctggggtgttttctctcgcattccctttgtcttcaaggttgtgggaggatgagggaaggcgctcagggcctgcacgctccgctctgggttcttggatactgcgggcaacacagctggaccagatgccccagtgcaaggggttggcaagcatgagctcagccatgggaacgaggtggcaagtggttctccctgggacagggacaggcccgcaggctgagctcttagctacacgcagccctcaggatgtcccaccaggcccccaccagggcagatagtggtgcccagccctcccctcagccacgccgtgtgctctccctcacagaaaagatcaacatccgcgtgctggaccccttcaccatcaagcccctggacagaaaactcattctcgacagcgctcgtgccaccaagggcaggatcctcaccgtggaggaccattattatgaaggtaaggaggcctggggcaggcaggctgggcaagggacagggccagagagccgagcgttggacgtgcctcttctatctgagccccaggagggcagctgtggcccagaacacccagagctgtccctcagagcagctgggacgtggtctcttaaaaggcctcaggcttggcctggggacctagctaactcacagctgctgatgagctctgtggagctcctgctgcccaggaagctggtgaggattccaacctcgctgctaaatggtggatggtggcgtccctgaggtagtgtagggtggaagctatggtgcagcttgggaagcaatgcagaatttctggtatttgtgagtccttcacacagcaggctccctaagtacacaccagcctctctaagtaggaggccccagtgggagagatgggctttgactctggggtcaaatgtagataattggactatggacagtggctggctggtcaccaacaatggtgtttgaaacaaacatttagaggccatatttgggcttataaaaatagttctgggccgtg

SEQ ID NO: 3851 - DNA, 1148 bp, Homo sapiens
tcccacagagacctccagacatgttcacaactaacttcagcttccccctctccctaaccctaggtgctcttcctgggctgggctggcctgcccaggcagtgataccaccacccaatacccagataccagggtgtcctctaggctccctgctcctacctgaccagccaccaactccttccattccaactccagttctcatcctcttctctgccagtatcttagtccagactctcctcaatctcacccctacaatttgtcctttatgtggccgaccaagtgcacgttctaaaatataaagcctgatggctcatcccctggacatgttgccattgccctgtggataaagtccagatcctctaacgtgtctcagatactctgcagtctgcccgcttcttctctctttccctgtcaccctcctacccagcctctgatccagctgtgctgaagcacgtgtggctctcagtggctgtgctccccagccagctcgcctcatccctccccagtttcactcctcttcctagtgccttccttcccactgagctctgcaactctgccttgtgtgtgtgtgtgcgggggtccggtgggggggcccttaccagttgtcctggcctcttttttcacatcacagtcacagcacaatgcctggcacctgataaattcaagaatttttatcaaatggatgaaacatttgcctggacaaaactgggtttgttttcctgtagaaatgtgatcataccatagtcttataatattgatattatactaatttgcagtgtactttggggccttacagactttctgaagccttgagaatcatgtgtttcagtgaactaattttttcagtataaacagatctaaacaactaattcactcattttaggaataaaaagttgaggctgtctgtgttttcaaagtgcttaggtgtgtctcccactaaaatgtaagctctgtgagaactgttgttactcccttgctgcatcgcgtgggcccaggttagagcaagacctggcaccctgtgagtactcaggaaataaaggttattgactatggaaatactgcttaaaagtacaggaaaacacgaatgtttttcctttgaacgattatggtatcaataagccaacttactaaaatatatataaattttaaat

SEQ ID NO: 3852 - DNA, 1188 bp, Homo sapiens
ctggaagtcctgaccctgctttcacctggcatgtgtaatccagtcatgctcgtatcagtctctgtaggagcacttgaaggtattacataaatgctatctaactctgggaaacgccaacatgtgattgcctccagaggaatcttctttaaaaaaaaattcaaaatgttatttccttactaggatgtctttaaagaattataacccttaccgtgcctccacattagatagatccctgccaccagcacccatgtggccaccagcagagacagcaggaggagaggcagccagcctcccggcttgcttttgtctggaaaaaacaaagcttattcacctttggaaaacaaatccacacttatctcttaatttaaaaactaagacttggtatactttatagaggtttatttattttttattattttttagttttgagacagagtctcgctttgttgcctaggctggagtgcagtggcgcaatctcggttcactgcagcctccgtctcccgggttcaagcaatgctgcctcagcctcctgagtagctgggattacaggcatgtgtcaccgcgcccagccactttgtagagatttagatccctttaaaaccatcagtcagaagctctttagagagtctgccaatcatatctttttccctagagtgtgcaggtcttgcattagattctcaaaagggatatgggacccaggaagttaagaacagtcctaaaatctctttggcttctttgtcctgatatgcaccggcattttcacagtaggaactagggtttctgtccagtttttttggttctttaaggaattaatgttattctgggtacaactgcttacatacatagcacatatagatgacatttttacaggccgtcttgttagactgacatacatggaggatagtgccacccgcctcacaagaacatcaggtaagctcaggcacagagtgcccaggaatctgtaaggcttcgcccacgcacaagtcagggctgccagtcacctgggttgtcttcactttatttggctgcgtctaatgacaccttccaacttttgaccccacccctggactgttgtgtaaacattgtatttctccatctgtaatgaaaaagctaacacatctctaactccagagacattttccagaacatgctgttctcaggcactagtgaggcggtaccattattcct

SEQ ID NO: 3853 - DNA, 1199 bp, Homo sapiens
actagagcccaaaggaagaaaaatggagctatgtgaagacagtgcctgtagatgctgaatgaatggatgaatgaatgggcaggcttccctgactctctttaattgttccattagagggtaactttcctagctttggttcctttgataataaaataccatttcatcaatgtcatctctaggagaaggacaatttcaaatcccttagaagaaaagcaatgtatacaaaggaggaggctactgaatttgttgcttcacaaaggagcttagttttaccatggaagccacaatctctatccaagagacatgaagcacacacaaagtgacttttgaatatcattcattggagcaaaatggacttctgaccaacagtatcgatcaattggttaaagtcaccaagatgttttttcctaaaccatctcaccaacattggggcaaataattccagccaagtgcagcagccatacactgttggtgattacttgccctgtggaatttaattagcactagaacccttggcatcaccttcgcaccatgatgaagacacactgtattggatgtgagggcaatctggctgcaacatctgtcaccccattgatggccagggttgattcggctgatctggctggtaggcgggtgtccccttcctccctcaccactccatgtgtgtccctcccaaagctacatgcttggtcaaagaggacgacatccccaatagaggaggaccgatcttcagtcaagggcatacgagtagctgtgctcccctgttagaacccccaagcaagctgtcaagacacactgtattaaaggatgcaagagcaaagatgcctattcttaggtccggtgacatactgctaccctaccaacacaaaatacatataaataactttctgtgtaatatattaagttagatttttgttatattttccaaaccaggaaagacactgttcaaaagaatttggcaaatcacaaacactaacctggattatactttttaattgcaaatttttaggcactgtattagttaaatctacattcaatctacattgaacagaaaattttaccctatcccaaatgactagatcaaatgtatgaaaagatatatttaatgtgaatatagaaataagattttcaacccaaaaggttgataaaataaagtgtttttattttcagtcaggaaaaaaagtcatattaaaggtcac

SEQ ID NO: 3854 - DNA, 1168 bp, Homo sapiens
atcttttgggaaatgcagaatggcatgacgtaacagaacctgaggatagtgtctaattataacacatagaaataatcatgattcagaagtccctgtgtgtgctgctggtcttatctgcataaagccctataatcacagtgtaagatattgtaggggataaacagaaggcaattactgacactgtgactggaggccagacccagtctttgtgccattcagaggcatctgcttttgtttgtcgtattaatctatttatgataatgataactattgtagacaaccaatttattatgcttttatcatatgcaatgcactttccgcaattttcattttaatctccctaacagccacgtgtgggcaatggtatctgtattttatgaatgccaaaatgggaggcccagcgagatgaaaaaaattgcccaaacttatcaggagtaaagttgtggtttgaacctggaaatcagtctttggccactaagccattgaagtaataatatctctggaagtagggagcagctcctctcttacttccttggtttccaaggcagcatgtctttctggtgggttctctgagcccaacactctttcccatttctttttttttttttttttcgcacttgagccttcttgtccttcaattctcagcctaaagtcgcacctgtaaagaggcagtttctgacctctcagtactctctttttctatcagagcagtcttcatgattttcaatagtatctttgcttgtgtggttatttgatttacgtttgtgtccctcttggggctagaagctttgggaaactcaggatacatattggttttgttcaccactatacacctagcccctgcacagtgtgtagcccacagacattccccagatgtctgtttaagaagtaaatgaatggctccatcacttgctggaggttagaccagagtttcttagtcttctttttcattattgtcccacctaagaagaaaaattttattaaatttattttattttcttaaatttcaataggtttcaggggagcaggtggtgtttggttacatgagtaagttctttagtggtgatttctgagattctggtgcatccatcacccaagcagtgtacacggtacccaatgtgtagtctttttttacaattttattttatttattatactttaagtttta

SEQ ID NO: 3855 - DNA, 1131 bp, Homo sapiens
tgtagacagtgcatactatggagtatgcattttgtctttgaggtttttgtaagcattattggttactattgtcagcaaaggggttatattaataaaaaggtaggaaaccagatatggcgatttagcattgagctactagatttccccacatgcataaagcaatttaattgcaagatagtagagctgtcatagctttaatcttttgtgagatggcctctgctttggttccaggttctgtgtaaaatgaaagatgtacttttgtttttgatgaaaaaaagcagaaatgatcattcatttagtgctaaccaactagtttagtaatccagtgaagctagatgtcaaaaaattttattttatatttgtcttgtcaaatactgaattaccgtataactttagatgctgttttgacattaacccctttggagctgggagttgggatttcccaacattaaacgtgaacacatttcgcagaagcttttagcatcggattatctggacattcacatctagtgtgagtgttgtgactaagtgaacttgtggcagaagaccaagctttaagggattgtggacttgcagaccctgacgcgttatattgtgtgagtagtgtataattttaaaacttaaacaaactgtgtatttcaatagaggaggactttttgttttttaaatgtagctcttttagaaaacgatgaaaaggatgaagaggatatgtctctggattcaggggatgaaatctcacatatagaagtatgcagcaattttcattcagaaatatgggagaaagagaccaaaggatcacgtggaacagatcaaaaaaagaatactcaaattgagttgcaatcgtctcctgatgtgcaaaacagtttattagaagataagacttaccttgattctgaagagagaacttctattgatatagtatgctctgaaggagagaacagcaattcaacagaacaagattcatatagtaactttcaggtttatcatagtcaattaaatatgtcccatcagtttagtcattttaatgttctcactcatcagacatttttggggacaccatatgccctttcatcaagtcagtctcaagaaaatgagaattacttcttatctgcttatactgaaagcttggat

SEQ ID NO: 3856 - DNA, 1155 bp, Homo sapiens
ttctgataaacccctcattgtccgaattctcaatactcactctctgaaacacaagaaccaaatagatttgtgtaactcagtatctctccatatccaaacctactatctcaactttcactttctgaacttgggaactgaatagattttgatgatgaggaatgcttgcattgtagtcaggctttcagaagaaaacaagccatgtaatacaaacataaaattatgttcatatgcagtgagaaagtaagaaggaagggccaggcgcggtggctcacccaacactttgggaggccgaggcgggtggatcacttgaggtcaggagtttgagaccagcctgggcaacatgataaaaccccgtctctactaaaaatacaaaaattagctgggtgtcgtggcacatgcctctaatcccagctactcgagaagctgaggcaggagaatcgcttgaacccggaaggttgaacccggaggttgcagtgagctgagactgtgccactgcgctccagcctgggcgagagagtctgtctcaaaaaaaaaagagagagagacagagagtgagagagagactgtgtgtgtgtgtgtgtgtgtgtgtgtgtgtgtgcacgcgtgtgtgttttaattctaggacatttaattgaaaggtttctagcctgtaagtcaaagactcgcaagggttttataactctgcctggaagttttatgtcaatctgactatcccatctataaacaacagactgattaagcacatatatatgaaaataattaaattctatgtagccattaaacatgaagttgcacgttctgaaactcaaagatatttgactgccattcgactacctggaaactgaggctcaacaaagtgagaagtaaaaagtcaactgttgtaaaacttgtattaaatggcgcacctatgcaaaaaagttgtatccctctttcttggaacttacgaccaccatttagcaagacaaaaagaaaccttggaacagccacttcccttctctccaaccacctcctcgccttcagctaaaccacatatactggcatcacattcattttccattcacttctcaacccaccacaatctgatgtttgacccaatccctctacccaaactagatatgcttcagtattaaattggaccttacctcagaaatatcc

SEQ ID NO: 3857 - DNA, 1203 bp, Homo sapiens
tttccatactggtttagtccagaagtaatggctaattctcctaacctccatcttcccccacaaaattttcacttgcctttttgaagtcattggagccaagtctcattcttaaggaaatttccatggtatttcattagttgtatatggatgagtgggttctgagaacaatagctctctccatacataatagcaaagtaatcaaggtaaaatttactttgagctatcctcagtccaaaaaactttgtttcgtatttgtactcttgattcctgccagcatattcatttctaattgtacactatgttcaaccttgttgatgtagagatgaagtacccactcctaaagtattgtctgtggtaattttttttagaatgaagaaaagtgattttaaaaaaagatcttactgtgaagaacaaatggatggagagtggttgtattataatcattaataggcgtcagctgtgaattcagaaaatttcagatcctcagcctcttcttgctaattatttcgtcatcttctatgtattagttactttaaatcagacaattgtttatttgtacttcgtatgacccatttgtatgtcttttttttttttttttttggagtcagagcctctgttgcccaggctgggatgcagtgttgcgatcccggctgactgcagcctctgcatcctaggttcaaaggattctccttccttagcctcccccagtagttcggattacaggcatgtgccaccacgcccagctaatttttgtattctccttagaggtgggattttgccatgttggccaggctggtctggaactcctgacctgaagtgatccgccctccttggcctcccaaagtgctgggattacaggcatgagccgccacgcccagccccatttgtatgttttgataggaatgatatgtcttttaagtttagcttttttaaatttatgtatatatgataatattttttgtgatacatgtatacataatacaaaaagatctgccttaacaccaaacaaattggtaaaactaattgatgaagatgttcttttgattaaggaacaaagctgtttgatgacctaaattatatatcaatgcccactgcctttataaatacaaccttcaaatcttgagtgtgggctgggcatggtggatcatgtctgtaatcccagcactttgagaggccgaggtgggcgaatcacgaggtcaggag

SEQ ID NO: 3858 - DNA, 1205 bp, Homo sapiens
tttttttaatggctcctaatatattgagatcacatatctaatatttacatgttatttcttttttatttaccttttttaattagtagagttaatacagatacagaccatgagtatacaagcaaaggaaaaagctggttaacctgtgcacttttttgtaacatgctctaatcccatgtgtgcttgtttcttcattttcctgccttgctatagcttatccttttatcatttttgaaattttgaccagaggagtaaatggacttttggggaatggggaggacaatgaacttttggaagttacatgcagaattttttggagaggggcccctagctttcaaaggggtctgcaatttctcaaaaatggttaaaaacactgatattggtgtgttggtttaaagtaatttcacttaattgagaagctgactcagtttcttaatatttgtagtgcttggtttaagaggcatttgcaaacacttcaatagttgcaaagtgatgtgttctgggtgttcatccaccatgtcattatcctaggtcatcactcctgaagaaatcattcacccggatgtggacgagcactcagttatgacttacctgtcccagttccccaaagccaagctcaagccgggggctcctctcaaacccaaactcaacccgaagaaagccagggcctatggcagaggtgagtgctggtcctctggtgttgtattggagacatgtcctctggtgttggagatgatttcatggcttcaagagtgatgttcttagaatcaaaaatagataggtgtaatcctcaaagagaccccaagcctcctttgtaacacattttatgactgttttattctgccttgtttttctaaggctttaagaaatgtttctgcttagatggaaagggcaagtttgctgcttggtgattttagtgcagtagcccattgctcccatttttcagaagaggaatcgcggggtagggagtcgggggagtttggtcttgccccagatcaccacagtcagtgatgggggtgggccatctggctgctgattcatttctccttctgttacactaagcctgcctcagatttccagccggagtgggagctattgttaacccctggcagatacttccttgctaagacatcctgtttatgactgcgaggcagctgcggaacaccgttttgctcagaacattatagtgggtagaagccatttcaagg

SEQ ID NO: 3859 - DNA, 1200 bp, Homo sapiens
aagaactacattttaaattcaattacattttcattcatttaaattaaaatttaaacaaccacatgtagccattagctgctatattggagaatgcggatttaggacaatcctcttaaccctgagaaagatacacaatgattcccaaaatgctaatctaactcaaagaggaggagctaccctgagcccgagtttggtaattttgtgagctacctgaccacttgaccatgcccatacaacctagaaattactattcttaaccttaataatacttctcctgggtagtatatgtaacatattggatatgttataaaaccagataatttaggccatatttccaatgcaataagttaacatttttctacatgattgttgcatacacacaacactcaaacatcttaaaaaagaataaaataagcaataacttaagctacatcccataaaataagcaataacttaaggtacatcccaagtgtacatttaagcaaaatatcaaaatgccaggatcagtgtcttctcaaggattcaacggctatgacctttgagggtacaggctgtgcctgccagctcgatatgttcatctccaggggcctggcacagccgtggagaaggcactcggcaaatatttcctgaacacgagtaaataccaagagccattctattcagtaactcaggtttatttatttttcttattttttccccatctattgtgccgatgttctccactgaaaaggtaaaagtgaacatgtggggaaaggcaggttgtagaaaaaaaggacttcacccccaccaccctcccccaatatactcaagttacccagatagaggagcccaagcgatgagtcagtatcaatagactgggagagccacaggcccagggaaggctcagatcctaacctgtccaagcaccaaagggggctagaatgagagtacaggagaaaaaaaaaaaaaggaagaaagaaagaaaagaaagaaagaaagaaagaaagaaagaaagaaagaaagaaagaaagaaagaaagaaagaaagaaagaaagaaagaaagaaacaacaacaacaaaaaaccaacgctggccaggattacttttacccagataccaacaggaacagccaactagttgaccccaaagtcttgttctcaaaacaataccatcatgaaaataccaagggaggaaaaaacagaacacgacgtaatcagcaaat

SEQ ID NO: 3860 - DNA, 1196 bp, Homo sapiens
agttgctaagatcaggaatttgtgggacctaatttggtccaaactaggcaagaacctcgagaaattggtatgtaatttaggtttgtgttacagaaaagaattggcaaagaccataagagcataatgctttccacagttaaatgtgagcaacctccccaaatccagaactgtaagaaaagaacggtttctttgctaacccagtaggccatattgttaacagaagttgtatccgataaaagatctatgtttaaactataagatgcaacaggaaaaaagaaacacagcatatggaactgtttctacaccacttcaagtcaacagagacaatattttaaaaataaccaggagaattctccaggatgtttctttttatctctcttctctgcattgcgatttttactgactctgacacagagtagtcattgcaaaaaataagaagccgagggctagtgtcatatccatgctgaagaggtgtttagtttctttcatcaaggggcagctgggaaggaaagcatttctgtgtgcctttgccttggggaagacctgtctcctaagaactctgtgcatgtgatctgcgctgttgaaggagaaatgggtgagcagaagtgaccgcaccctgtaacttcctgtgtccaggagagctggcagtcggcccggtcttctgagacatccagtaaaaatgaatcccagttacatctgcggtgctcacagaaatagatctgctgtatctaataaaagcaaatgttactttttgtaaagggctgccgggtcacattcggaatggtaaacaagtcccccaaaaaacttatttttgaggtagagactgtgtagatcacattttacctcctggactattatttacgtgtatcttactgtaaatgactcaggattaaggagaaaaaaacaccatcttcctttgaagagaaagaagggaagctggtgtttctagcagtctctgcgaaaggtagagattccttccacatccgtgaattaaccccacttaggagtgggcaccctgctatatttccattcccaaaccttgcacacgctgtgttctcggggaggctgaacaagctgtgggtctgaattgcgtgtctggcttgcacagccccacgtgggccgaggggaggtgggctgattcataatgaatgctccgggtacttagagtagggcagagtgcaggggactgttattct

SEQ ID NO: 3861 - DNA, 1146 bp, Homo sapiens
ttaacaggttccagtaatggttgtgtgatactcttcattttattagggttcaacagttcatcaaagggaagagaaatgtaggggctcctatttgaaaaatttatgtgtgtttatttacacataaatatgtacatttgggtcaggtgcagtggctcacatttgtaatcccaacactttgggagcccaaggtgggcagatcatttgaggtcaggaatttgaggccagcctggtcaacatggtgaaaccctgtctcgactaaaaatacaaaaaatttagccaggcctggtggcacacacttgtaatcccagctatttgggaggccgagataggaggatcgcttgaactgtggaggcgggggttgcagtgagctgagatcatgccactgcactccagcttgggcaacaataaataaaaataaataaaatttaaaaaatatagtatgtacatttgcatatcctattcccattgaatattatctaaacttgcctatatttcttaactcagaagttacatgcatcctccttaacaagtgggtgagctagataaatctcaggggattaaaaaagattcaattacttatcttttggggtgaattgatgaataagaaactgtaatagcaaccctctggacctactaggcatctgtaattggtaggcttttccgacattttttccttcacagacttagcaaccgaagcacaaggtggattaaataaatgactaaataaaagagaaacagaaatatcatatcctggctccagatccatgattgtcagtagtgtgttacagtgtttttaccagtaacagttagcattgccttgattataagcaaacaaaagtagattctatttagcttaagcaaaaaaaaaaaaaaaaaaaaaaaaaaattattggcaggctttgagtagttcactatatagactaaaggatataggagaatgagacttgagaattgacagaaagcagagtagattggggtttatgcatagcaagtgctactgaacagtcttataaggacaccacgatttaaagaaataattttcagttcttttcagtcttctgtttattttagtcaagattcagaatttagggagaaatatctaattggcctgaattgggaaatgtgcccaattttggctacgacaca

SEQ ID NO: 3862 - DNA, 1164 bp, Homo sapiens
ctttgaatgcattctctgtgccaggtattttctttattcttttagatgaacttggaacggtgaaggttacaaagtaaaaatatttaggagtaagtggcttttacaagatttgaccaaagaacagaatgctttgctgacactttggaaatgtaagggtggtgtatgtttaatcgggaaatactcagtttctaatgcatgcaatgtttgtctggaacctttttccttaaatgattcaaatcagttccattcaaacctgtgtacttagcactcttgataggtactgaataaaacaaagatacagtccctccttgctgggacttcagagtctggctcattgttccttaacttatttaaccaatgtctctaaatttctaaatataaatatctcaggccctctttacatgttatttgaaactttaaataagctaaattaaagataattaagttaaagccctgctttatttttgttacctataacttatacatttatttatggctctctgaaatactgatgtgactgatgatgtgaaatagcaaacacttgctgataaatggcacaagcttgtcatttatcagtcagcttcatgttttgtagaaaccagaggttgcaaattagtggttccatgggtccaatgcagatcacagagtcattgtcatcctaagtgagccaacatttgaagttgagatattatccatagaatgcagattttcgacttatcttaaaacattggaagatcgggtagctatgggcctgcattcccacctgacagcaatgggatgggactgactggctgctgcccccttcagggaggacgtgttctcttctgttgtcatgtcctcatcactcatccagtaaacacacatgcctgaaaattggcctgcagcatgcaactaactttcctgactgctggaaaacacttgagtttgagagtcctggtagattccagggagaggagattggagtattttcagaatacagagtagatggaccttgaggtattggtaggatttatatacttgaagaagtgctgagaggaggtcatgccagaaaggagaataactttgatgctgaatcccaccaggtttttctctaataatatttaaattgctgaaggatgcagatgatttccttttttctaataaatgaaagcatatttaaggtta

SEQ ID NO: 3863 - DNA, 1169 bp, Homo sapiens
ccttgttttacttaataatggccccagcacaagagtagtaatgctggcatagtgttataattgctctattttatcattagctatcattgtcaatatcttactctgcctaatttataaattaaactttttcataggtatgcatgtgtaggagaaacatagtactgtttggtttcaggcatccactggggatcttgaagcatctgtcctgcggataaccagggacttctatactatgtgttgagtactgtgctgaataccatatgggaattgtctaattttattgctctaagattcttcttaggtggatattatgagcattccacctttgcatgtgagatgcaaagaagttattgttctgtcagttatgcaaggttgcacagacagtaagtggcagaggcagaattcaaactcccagatctgagttcataactatttccaaatactgtctccttcacattacaatgatatcttcagaaactctactgcatcctggttattactttatattgaaaactgtatacctctaacccagtgatgcgtcaccatttttggacccctcttcagagaaaaatacacacacacacacacacacacttggttgcattcatacatgtatatatgtgcatatgtgtaattttttctttttaatttcagaggttttaaggatcccaagttgaggacacctaacctacagggaaaactcatttgaacttggagtctagttgctgtttacttccttatgagggcactaattcttgctgatattaacaaaccctttcaagtatttccagtgtagcagagtcaaacttcaaacctggctgttggtctaatatataacaagactagtaaccatttatttattacgtgtacctaactcttagggttgacagtgggtatacacactggtgaagtcctactggttatacgcagtgggcatctgtaatgatttggtcaggggtgaatatcatgcctgctaacaactttttgaggtaggtgatgttacatattatgcccgttgttcaaatgagaatcctcaggctcagagcacttcctcaatagcttacatgtggcagatgcctgtcaatctaatttcaaatctgctctgatctactttcctatcccggctttgaatgtacctttccttccaaatctgttacaggttctgcatt

SEQ ID NO: 3864 - DNA, 1180 bp, Homo sapiens
ctgctctgaagctagcttcttttgttcccttttactccaatgaattcagactatctcctggcttttgtttctccacagtagtaaaactctattgtgatgcagcagcagacaattcaagccaaggtgacaatcatttcagaaaataaagcaaacctgctttcataaacacctaccacatgactaaatatgccttctacagcagggggaaggaacagacactgaaatgttcacttttagctcagaaaaaaagatgacaaagaaactctcaataataggtaaaagcagctgccatttacaaggtaatacttaatttcccttaatgatgtctgtaggacatagattctcaaactgtggtccaaagacccctgtgggtccccaagatactttcaggaggtgcaagggagttttcaggagacaatatgacttataatatcacaacagattgaatgcaaaagcagttaggagaatccagctgtcttctgctgaggcagacattaaaaagatttgcaaaagtataaagcaatgccactcttccaactaaaatttgttttgaaaaataattttttttttcctacggccataccaccctgaacgcgcccgatctcatctgaaaaataattttttttaattttgttattattacactttaagttttagggtacatgtgcacaacatgcaggtttgttacatatgtatacatgtgccatgttgctgtgctgcacccattaactcgtgatttaacattaggtgtatctcctaatgctatccctccccgctccccccaccccacagcagtccctggtgtgtgatgttccccttcctgtgtccatgtgttctcattgttcaatttcccacctatgagtgagagcatgcagtgtttggttttttgtccttgcgatagtttgctgagaatgatggtttccagtttcatccatgtccctacaaaggacatgaactcatcattttttatggctgcatagtattccatggtgtatatgtgccacatatattcttttataaaaatgtgttatttatgttaacatgctatggttgtattagttatttaaaatgaattaagtttttttaatttgtcagttaaaatttttagaacagtaaatatccacagatatgatccacataaacaaaacctctttcaggtcctattcaataattcttaaga

SEQ ID NO: 3865 - DNA, 1223 bp, Homo sapiens
agtcatgttatagcacagcgagaaattggaatatcagttatgtaagacacagagaagcccagcagtatatgctgtacattgctgcattctcctcctcaaagaggtcatctctaatgacattttaaccaacacacacacacacacagacacccatggcctgacaaacctgagcatcaggaatatcacatttaagtagtctgaatagtgtaataatgaaatgggtttagaaaggaagaatacagtgactcccatcatacaggaaaatctgagtctctcgattttgacaaggtaagagtggagatttcaaaaccaatagtattaactagccaatgatgcttacgtctcactcagcaggaggaatcttaagtcaagttggttgctaggcagagagctgaatgagtgacaggtattttcatcagggagtttccataaactctgtctcttctcagaacttctactgagcctacctcatttccagcccgaagcaaaaaaagataaaaatattaccagacccgctcttttccggttagcgcggcgtgagaagccatgagcagcagtctctcgcaacaccctgtacgaggcggtgcgggaagtcctgcaccggaaccagcgcaagcgccgcaagttcctggagacggtggagttgcagatcagcttgaagaactatgacccccagaaggacaagtgcttctcgggcaccgtcagacttaagtccactccccgccctaagttgtgtgtgtgtgtcctgggggaccagcagcactgtgacgaggctaaggccgtggatatcccccacatggacatcgaggcgctgaaaaaactcaaaaagaataaaaaactggtcaagaagctggccaagaagtatgatgcgtttttggcctcagagtctctgatcaagcagattccacgaatcctcggcccaggtctaaataaggcaggaaagttcccttccctgctcacacacaacgaaaacatggtggccaaagtgggtgaggtgaagtccacaatcaagttccaaatgaagaaggtgttatgtctggctgtagctgttggtcacgtgaagatgacagccgatgagcttgtgtataacattcacctggctgtcaacttcttggtgtcattgctcaagaaaaactggcagaatgtccgggccttatatatcgagagcaccatgggcaagccccagcgcctatattaaggcacatttgaataaattctattac

SEQ ID NO: 3866 - DNA, 1267 bp, Homo sapiens
gtatctaccttcacagtgttgagagattaaatgagaaaatatagatgcctggttggcataagtgcttagtatataccggctatttttattatttttaaggctattgattactagtactttagaactttgtatatactgtgtctccccacccccattacaaagtggcctttgcatagtaaaagttcgtatggctttgagtgtaatcatatctttgggtggatagtgcatcactacctttgccttacatgatatattaaataattgaacagcagcagatacctctttaactttattcagattttgtccttggcctgttccccaccagccaaagcagggagaaatttgtagctcaggccctcaagttgaaagtgggcattaatattagcaaattccctttaataatcatcccattaaatttgatgaccagaggggacgtcctcatagcttataacagaaaatagtgtctctaggagtcaagggagcttttcccaaatgttatctattgagcaagattaaagagacagatcacccaggaggctgatggtaggtggtgttaatccattagtccacacgcagataactcgttaggtttcctgagcatcccccttaatcttggctgcagagatagaaaaggagattgtagaaacttgccctgcagcaaagattattgatatgttttcctcttacatgactcaaaaccaaaaaggaatgtaataaataacggctgtgactcctggagtgattaaagagcactcaggagccaggagagctgatagctgccagctccagagcctgagtgggcagaacttggttccttgagacagcagctgcctaggaaggacaaagtctgcatgacgctctgtggtgctttgtgtgcaagttgaccattgtggcaaggtcataggatagcatggtggggagggggttgcccctttgtgtttgttgcccgcacctttgcccttgtgtgcaggattctctctgcttccttttgtggatgaatccttctgactttttaggtcatagattttgtgttgattcttaagtgtggcctctacagaggtcgtttgccccttaatatgtttatattgttgctgttaactttattgtttttgtctgtcttaccagacacaaggcaagattttgtttctctcttcactctcttttctggcttaacccaagacctggtggtggcacatactaaccactccaaaatttttagaggctgaatgccagctgttggcttaatccatatgttttcatgaaacca

SEQ ID NO: 3867 - DNA, 1198 bp, Homo sapiens
catcagtggttcttaaaccaacctttttatcaggatcactttgggcatatgttaaaatatacacacgtgggccgggcacagtggctcacacctgtaatcccagcactttgggaggccgaggtgggtggatcacctgagaggtcaggagttcgagatcagcctgggcaacatggtgaaaccccatctctgttaaaaatgcaaaattagccaggcatggtggcacatgcctgtaattccagctacttgggaggctaaggcaggagaattgcttgaagctgggaggtggaggatgcggtgagctaagatcgcgccattgcactccagcctgggcaacaagagtaaatctccgtctcaccccccgcgcccccccccaccaaaaaaaaaaatatatatatatatacacacacacacacctgaaccccactgcagattaatggctctttggatatttgtaggcctgctctttgttcttacagctatgtgtaggaatcactggtaagtctttaccttccttgtctcttctctttccaaaccattgttctttgtttaggcctttgttatagaacatagcccttttctgttcatccactaccctctgacctctctgattcatgtacccctcaccttcctcattgttttctgagtgtgtagtacatagtaagtgcttgaaagtggttgaagtaatgcagtttaaagttgtaacattttgaggcctggtgttgatctacaaagatggtaggctcagttccaaacaagacactagcctttcctgtctcctggaggccagctttacttagggatagtgataataaaatatagcagctactatttactatgctcttactaccttccgggtactttgcataatgcctctcagacattattgacatcaaggcctgaactaggaatatcagataataatatctattgccatcactttgtagttgaggaaatagaggtgcagtaagttttaataacttgctgaagatgatgcagtttgtaaatgggtgaagttctgtttgaaaccagtttttttgttgttgttgttgttttttgtttttttatttgtttttttcagacggagtctctgtctgtcacccaggctggagtgcaatggcacaatctcggctcactgcaacctctgcctcccgggttcaagcagttctcctgcgtcagcctccctagtagctgggactac

SEQ ID NO: 3868 - DNA, 1147 bp, Homo sapiens
tgtcatgcatcacctacccccaacttttgttcattaactgaggttaagtggatcctaaaatctgaacattaacttcagattcctgtaatgagattactcttaacaaaagctctggtttcctcaattccttaggttctgttagggtagcagggaatccaagtgaattagcaatggaattgcctgaaaatattaatagatgttttggacttgacagatcagtcacccttttatatttgtattaatggggagggaacaggggcatagggcataatcaaagccctttgaacttggctttaaaatacagaacaagcaaatacctttgaacttggctttaaaatacagaggactacaatttgtaatagttttacatgagtttgcatcctgagagcaggagatgtaggagtggctctgtattttgggatgggtttgaatgctctatttagttgttctgccaaaagttttctcagactaccttgggagatgtcatgttacctgattgccttgtgttgtgctttagaatggtgctagtttctgaattatccattttatttctgtttttttttcttatcttctatagatgatcacagtagggtgaagttaagacctttaccaggaaaagactctaagcacagcgactacattaatgcaaactatgttgatgtaagtcagaactgttattataaacctgtttctagaaattgaagactgcagcagaaactgtttaatatattttaatactgtacagagctttcactaaaaacaaagcccattcaatatggaaggcatttgaattattgactggtcttctgtgataactgctttcatctcactttgtgctgtgtcattttgaagggttacaacaaagcaaaagcctacattgccacccaaggacctttgaagtctacatttgaagatttctggaggatgatttgggaacaaaacactggaatcattgtgatgattacgaaccttgtggaaaaaggaagagtaagagccttttgactcactatcttaataatgcaccttcattcaaaagatacttgtggagtacctgctttagggtaggaacttgacaaggtataaagagttacggaaatgaaaagtgttctctctgctttatcttgcttatgattcagaaggaaagaga

SEQ ID NO: 3869 - DNA, 1209 bp, Homo sapiens
acaatcctatgaatatggtgcttttatttcttccattttgcagatgagaaatctgaagctcagaaacacatgagactcgtccaaggtcaaatagctgaatattgacagagatgctttatattgcctttgatttaggggaaaaaaaaaaaacatgtgaaagggtagcgttccattggacacaaaatggagacaaatagaagtgaaagggtgctggaaataacatttcattgctgggactgatacttgaatattcgttactatgtcgccattgggtgtgagactagatgaggtaagtaatgggtagagggaggaattgtcaactggttttatcatgttggacaaaatgtaaaatagtctcaatgaaacttttagaacccagctcttatttccattttcagcactaggtcaccaaagtgatggggtttagtaaatcttaacattttgggaattaagaaacctaataagaatctaacaaaacttatgtaacatgacccagagtatataaattcaaaatgtccactagcgtgaggctatttagaaaattattatagtctacagccataccaccctgaacacgccctgatctcagaagctaaacagggtcgggcctggttagtacttggatgggggaaaattattatagaaccttcactacctaacatacagaacagcacaatatgataattcatagtcctgtacatatattatatgactgttaaaaaaaataaggcagatcctccttgaaaaagtaaggcatgtacaggtcatattattaggtagcaaacagtatattaaagattgtgtttaatttcagtgttttaagttgttaatattggagattaaattatgaagaaccttaccttttcctcctgtaaacattcctgtattggttgaatttttataaatagcacgttttgactgaattaatgattaaaatcaatttgacctaaattctaaacaaaaggtcagatttctgccaccttcctgtatgtttctaaatgttataaatatcttttaatcaaagactttaaattgtctattcctgatacatttctatactaaccgaataaaatagatgaataagccgttgtcaaccggacattcaaactttttaaaaaccaactctaggactgtttttgtttcacaattcacttgggtagagtaccacagctcagggaaagcaaacgagagaagaaaggattttccctg

SEQ ID NO: 3870 - DNA, 1463 bp, Homo sapiens
ctgctgcccgtcccctccctcgggcggccgcgggagtcgaaagcgaaagctagcccgcgccgcggactttgagcccggggcggggggtggccttgaggaggcgggctcggggggctgggcggccatgggggcgctgtcagcgtgccccacccggtccgcgggccgcgcacgccgccggaactccctggcgcctccttaaaaaacggcccccgcgcgactctttcccccttttttttgttacattgtaggagcggaaagaatgtcggagcgggccgcggatgacgtcaggggggagccgcgccgcgcggcggcggcggcgggcggagcagcggccgcggccgcccggcagcagcagcagcagcagcagcagcagcagccgccgcctccgcagccccagcggcagcagcacccgccaccgccgccacggcgcacacggccggaggacggcgggcccggcgccgcctccacctcggccgccgcaatggcgacggtcggggagcgcaggcctctgcccagtcctgaagtgatgctgggacagtcgtggaatctgtgggttgaggcttccaaacttcctgggaaggacggtgagtgtccacgccctcctccccccttcaccccctcgcgaccccctcctctctcctcccctcccccctgcccccctcctgtgacccgccccctcgaggggcagagatgctatcgtttgctgggttgcggaacgcggaggtgcccacacctaccccgtgcgtgcgtgagtgtgcgtcacactcctggccactgacctgcctctcccctcctcctgtgtgtgtatatctcctagggacagaattggacgaaagtttcaaggagtttgggaaaaaccgcgaagtcatggggctctgtcgggaaggtgagtccagcccccctgatggagtttgtacaaacccctgggaagtttcattgacagttcactgggaccgggaacatcagcccaccataccgactccccgactccccgtgcctgcgaagatgctgcctgaggagggagggagggggcagagcgcttggaaagtttggtttgggggcctcctgtaatgagagcgtccggaatccttctgtgaccaggcaggagcagcattattggtgatgagcgctgggaaccggcgggaagtttaacctagatctctgcatttctgacctccttacggagaaacaggagtagaggaaggaattctcagctttgaaacctttccacgaatgcttaggggacattttctgttggcaatcgaaacgaattttgaacttaaagaagatgctttacctatgcagtcttatttctgtaggatttaaggtacaagttggggatgttagaaaaaggtcatcataacccggagtgcattttggtcagattttttgcgagctgccaatatcacgggggaaagaaagccagaattttatttggtcaaataagcctttactgcccgtgg

SEQ ID NO: 3871 - DNA, 1178 bp, Homo sapiens
gaggcataagtctagatgcccagagagcatccaggcactgaactgctcagagcttgagatgaaatgacatacaagcttcagggtaaaactgtctactagcaagattacctccctcaattctaccattgcagatttcttctgaccccaaatgcaaccttacagagaatgctgaatgaggaaggccaattccttacaatgatggcagaacccccaagcgaatgccctattgaggagaaggacatcactgtatttggaattctgcctgctagtgatagctcacacatcacatcccagaatcccactcccaatgcattatttcctgaggcaagaacttaaggtcctcacctaattcctccatcacaaccattaactcttattggacaagctcctcctgtgagtagggcctgtactcacttcctcttagatcataattccatcttcaagagactgatttccagaatagtaatctttttccagcgttctctcttctccaatgccctggttgttatttttcccacctctcctaatattgatcttcttgtcttttggttagaactgcaacttcggagttgagttcatttcctattgctgctcaattcagtagcaacatagctggcttgttcccagacccaggaagtataagtcattgacagtttcctgagtggctctgccaatccataccacccttggtactgtgaaaaggcttcttggcagccaggtggcattgaggatggtattcagggcgctttccttctgtcatatagttgtgggatctctaccaagtgtgaaggtgaatgaggtaagggagatcagaaccatgcttcctggtttttcatacatccaaggaagaagtcctggtgtgggttgtttgacaccttctttccactttcaccttttattttttattccttcctttctacccccaaccagtcgagcaaatgagcaattttgtgtttctaatacaggatctggaagtagtgctttctaatcctcatttcctgtaggatgttcctgcactataacaagattatgttttcttccttctgcagcagctttctgcttcttgggtactactagctattgttcaattcaggtgaggcctgtgatgacatatatgtagcatgtgctctgcgctccctgcaagctgagcagatacaaccaatgcatcactgtatact

SEQ ID NO: 3872 - DNA, 1156 bp, Homo sapiens
ttgttccggcgcccaggctggggaaggcaggggagagggagagctgcttccccgggcagcgcggtgggcaaatgcctttgcactttggagggctttgtaagctctcggggaaaattagaaacggaagggctgcgattctcctctgtccgttttcctatttctaaaaggaagaatgtacatgcggaaggctttttaagtttgcttcctggaaattaacatttgtatgttagagcactgtgttatctaggtaagagatgtatgtctgtgggcatcagaaaacagaatccagagtctggcttgctgagtgcttgggagctaaaaggcttttctccctgtctggttctgtaagtgaatgggccaaacccggaaggctgggggatttttgaagattcaggaaggctatgcctcccttcctcttcctaagtcctaagtctaactgacctgggtaccagggggcaatggagtgtacaaggaagctgtcttgtccacagtgttggtatatagactttgtctcacacacaaagggagtggatttgtgcctgaactaaattatttgagggtatgtatggcttatttttaaggattaggtatgttgggcccttttctctttcccagagtttaccatgctcaacaccctgtcaactgagaatcaattaggagactacttatgagtgtgtgctagccaaataacccttgctggtttatagtgttgtttgttttactactcctcttgaatgagtattcagtgctttcaaaagattcggacacatttgttgggggtttcagtaaaacgggaagcttttgcatgagggcattgtgacttttatattgaaaacataaaaattccatatgcacatggtaacccacggaatgacatactgtctttggggttctgggaaaataaatgcatttcttagttgagaaaagcttgtcttttatcatctataaggctcatactttctgaaaaactgttgttttttgatcacttggaagcctgtattaattagatatgaagttggattcttttcgtgatttaacttgcactgaaactcgtcgacaaggcgcagctcatcacttgccaatgaattttagtgctgttgaaagctttagcagtttaatggtatcaacagagactcgattcctccatttctcaact

SEQ ID NO: 3873 - DNA, 1157 bp, Homo sapiens
cccctcccaggcgcgctggggacccggggcgccgcggtgcacggtggcgggcggccccgggagatcaccgaccccgaagcaatccctggcggcgcccggggtccggaaccccagcgcggcgtctcagccgcggcggggtgctcgccactgacccctcagcccttggccgggactgacgttcaagcggacagctgggctctgccgggactgacgttcaaggggcagccgagcacttcctgagccctgcctggcacccgccgagagactttttggcacaagtaggggccagccgttgaggtgtcattcggggtctcacgtgttgaactttccatttgcccactgccgtctttaaacttttccaagctctctctctctgcgacattgccccatttcgcccgctgtgtcaaccccaggttttgcctcctatccatcatctttcagatgtttcccttttttccttcctcattaggcctgtggaaatcgaatcaagggtttctggagtggagtgattccagctgctttgagctgaaggaaaagtagcctggccagtaaagcgtccgtgtgctggaggagtgcagccacccatcccggcgggccttgcaggacgaccgacaccaggaaggctttgtgccaggcccagcagccacccccagccgccttatgcaagtgggtacatgccctcgccagacgccagctttctgatctgcgtctttagattttttccatcgcctaagcgttacttctccactgatcggtgagtttagtgatggccagagctcactggaggacaatggacttggataaccaaaggtcagggcttggtcataacaatgactttattaccgggaaggacgagtcaaaaaataggaaggcctgggaaccctcaggctcgccactctaggtgggtagccctgtgattcagccagtgggattactgctgtgagaatgggaaagttgtttgcttctgggaatgtttgatccactaagtatcctgttggccagttccagtggatgcctgtagaaagtgggccacctcctcccgttccccattggaatctggtccgagttgctgtgttgggggtggtgcctgtgaactcgagtatagcagtgtggtattcattaaggaaaagaaagcgcaccaccggccaggccttctg

SEQ ID NO: 3874 - DNA, 1195 bp, Homo sapiens
gacagtgatcacatcctttgcaaatttttatcagtgccataaacctccctagttagttcctttaaccctgtattagttcattttgctttgctataaaggaatatctgaaactgggtaatttattcaggaaagaggtttatttggctcatggttctgcaggctgtgtgagcatggcaaaagcatctgcttggcttctggtgagacctcaggaagcttttactcgtgaaagctaagggggatggcaaggcatgtcatatgacgagagggagcaagagagagaggagggaataccaggcttcttttaataaccagctcttgcgtgaacttaatatcacagggagggcaccaagccatgcatgtgggatctgccctaacggtccaaacacctcccactaggcctcacctccaacactggggatcacatttcagtatgagatttggaggggacagatatccaaactatatccaaccctttgatatgttgtacagcttcaggttctcatgttgtttttctgtaaccatattccagctatccatattggttaactggaatatagttagagaaaacaacttttcctaattgttcaggccaacatgcagcattatgggactggtcttaactttagataatagacttctgataactgatgcagtcttaaaggagagcaggtatttatgttgttgtttttttgtttacattgatgctatactttggattctttgatgttactagccactgaaagctggatgttttgtccacatatgcaattgctaagccacatctgcctattataaacttggcagtttggggagtgtctttttttttttgtttttcttaatatccaagtataggtccttacaaatgtattcttaaaattcaacctgtttttctctctttatatgtattctgccaacttacctggtgtttctagcttcatttcacctgttttgataattatatcctttatttctttttcaaataattgatgaaaatttttaataagactgaactctctgagaacagacatctgaatcatacttctggccaggcccttttaggtttatctcattctgttcatcagaccttcttggtactttgtatttctttatcttgttcacaaggatgtcatgaaaaacctttccagatcctctactgaagcctaggtatgctatcttttgcattttcctgagttgc

SEQ ID NO: 3875 - DNA, 1197 bp, Homo sapiens
cccagctactcaggaggctgaggcaggagaatcacctgaacttaggaggtagagactgaagtgagctgagatcgcagtgtgggtgacagagtgagactctgtctcaaaagaaaaaaaaaaaaaaaactcagtcctgcccagcagataagatataaagtatatctgtgttattaacatttcatgggggaggagggtattgggggaaaaattgtctagagaggctccttaagagtgcaattatggggccggctgcagcggctcatgcccataatcccaacactttgggaagccgaggtgggcagatcacaaggatgcaaaaattagccaggcatggtggtgcgtgcctgtaatcccagctactcgggaggctgaagcaggagaattgcttgaaccgggaggtggaggttgcagtgagccaagatcgtgccactgcactccagcctgggcaacagatcaagactctgtctcggaaaaaaaaaaaaaaaatgcaataatgaaaaaaaaaagttatgcaacaatgtcttaacccaagcatgttctgcctcagggcctttgcacttgttggcctctgtctggaatatgcttttctcagatctgccaaggctgaatcctcatcattgctatttctggctaaatgttgcctcctcaaatagccgtttcctagctgctttatttatagcattttagagagtgtctcactctgtcacccaagctgaagtgcagtggcgtgaccatagctcatagctcagggcataactcatagctcactgcagcctcaaactcctgggctcaagcgatccttctgcatcagcctcccaaagtgctgggattacaggtatgaaccactggcccagcctgctctgtctaaagtaacaactctccccatcacattagtctgtattctcattttcatggtacttaacacgacctgaaatcaccctgtgtgttgcttgatttgcttgttttctggctttcttcttcgctggcaagtctttgagagaggagcacttgactctctggcttgtgtcactgttgagtccccagagcctattataaagtctggaacacaataagagcttgatgaatatttgtgaatatgtgaatggatgctagtcacacagtggataaagcagtggagctaagatttggattcaggtgctcagacttcaaatcacctatttagcaactactgaaacc

SEQ ID NO: 3876 - DNA, 1166 bp, Homo sapiens
aaaagcaatattgtgcagcgatggaaatgcgccctcttgtttttgtgtttttacaaattctgaagggccatctatggcccccctattaactttgttgcctttccttttgccccattcagcattttactgggctttcttttctgtcttggtgaagagaaaaggggaacaaatttaaaacaaaaaacgaaaaaatccaggctcttagagatttgggatgtgaggtgcttgtcaaagtgtattggctcggtgtgatttgatggaatttaatttgaatccttcgtctggtaagacaggctgtagtaatagcctttggttttttttttttttttttttttttttgcattgttaaatgtttggtgatatttatggcagccaggctaatcttaaaagaatgaatttatgagaagcacagaacctcatgacttcagcctcttacccttagtatccaagcactgtagtgcattatagtttgaatgccagattcccattaatgctaactgatggacctcattatgctttgagatgagaccttaatcagggtccctgttgaaaatctacgattaggctgtctttgattcataactctgtgaacttgggcacatttcctgttctctctgggtctcagtgtcctcatctataaaatggaggtaataatactcgccctggggagtttttgcgagagttaaatgagataattcacgaaagcagtgctgtctgatagaatatgaaccaagtacataaattcaaagtttctagtactctcactaaaaatagtaaaaaaaaaaaaaaaatagtgaaactaattttaatgtattttatttaacccaaaatatctaaaatatcacttcaacatgtaatcagtataaaaattattaacaagatattttcacattttttcctaagtctttgtgctgcctttaaaattgcatgtatattttatacctccagcacatccccaatttggacactaaattttcatcagaaaatttatttgacctgtgtttagattttataaaatgtataattgaaaaagttagattcatatacctaacttgtttcaaacgtattcaaaagatttccaataaataaattgaatatgtctttagatttaaattaaattatatgaaaagttcagtctgaatgagtctgaacaagccacatttcca

SEQ ID NO: 3877 - DNA, 1205 bp, Homo sapiens
tctgctgtatcactagtaagaaaggactgagtaatgtagagacatgaatttttattttcaagactttaggctttgattcagccctctgattaccagagctcctgcgtatgctaaaactgattgaaatttcaatttgttagccttttccctgttggaaagtctaataaatagtaaaaggaccacaagacaggcatactcagcatgtggcctgaatcatccgtaaactggatatctagaccatcaacaatcaagaacccaggcagagttttccttttaaataattgtctgcatttctctcccccaccccccaccattggtacataatttgcatgtgtaggctcatgtttcaggtttcatatgtttaaagttgcttttctaccctttgccatttctgacattcacgtgaatgcatttcagtatatggatgtatcatcagttatatgaagtcagttttcctgtggtcagacgatcctgttccaacccatacaaattagactcttccgaaatacctagcaggccctgtctctgattgctgcccattaaggtggtcttgaaatgccaccctggctgaatttcttacttatttatgtgtaaatggttatctccagacgccctgcagaacttctccctggaaggcttttctttgggtgataacagtgtgtgccacattatacataatgacagcattaaagggtggggatggaaaggacaggccaccccctggactactatctcctgggagctagacccgctgcctagtttatgcttaaacatcctggtaacttatattttcctttttgtttctccatttcacttaatgattttctatgtattgttgcagacatctcaacagtgagcatgcgctggacgatagaagtacagcccaatgtagagtacaaatgcaggttgtacagcagttagagctacaggtaaaaccacatttatttttaatattaacctcagtatgcctcaaattccagatttctgtagtgttctgtaatgagttcctgtgtactcattattgaatggaaggtccaaaacctgtcattgtcctttattttattttattttattttattttattttattttattttattttattttttacctctttgggcaggttcagccccagttcactctttggaactgctgctcagaggtttccaaattctgggcacctgtgtgtatgcagccaactctcag

SEQ ID NO: 3878 - DNA, 1099 bp, Homo sapiens
agctaatttttgtatttttagtggagacagggtttcaccatgttggccaggctggtcttgaactcctgacctcgtgatcccgccgcctcggcctcccaaaatgctaggattacaggcgtgagccaccgcactcggccgggatttgacaaatatttgttcagcaaacaaatggatgatgaattaataaatgatacttaataatcaggacttgtatggaggacagttccaaaagtatatttccaagtaacttgtgtaccctcttattggaaaatgtcgactattccataggctatgaagttggattttgttttgaatctgcagtgattcaaataaggtaattcacaatgaaagatctttctgcctccgtcccctcgagagtaacatcagtgtgtctttcctagctgggagatcaggccaccaagagagacagtcattttgaaatgtgcgaatgttttcacaattgttcgagattatttctcagtaacacagctttagtctacagagcttgctaacctgcctcagtattctgtgttcttttattgtgggtagatagatgttgataaatcaaaagaaaaaaaaatcttgttaatttcagcattacatcagatcttagcaaatgtagatttctattataatattttggtctaactatcggaaataaaagtctgtttttctctgtgttataccagtttgctcaattttatgttttttttttaaatttaaatatatgaaaataatacaagaattggctttagttccagattgcagaactggaaactaaagttaaaaaaaatctaatttttttattaatgtatttgatattatgttgaaaacttagtgataatttactaaaagtggcattatttatatcgatttattaaatagagaatatagcccaaaccttaatgtgctggaagataattacttagaatatccgacagctttgcgagaggcctgtattactttaaaaggtataaatgataggttgtgtaataccctacattcttatcttgaactatattatcgggggctctttctgttttaccttaatgtgcccaggggactcctgcttagcttaataggacacccaaaaggagga

SEQ ID NO: 3879 - DNA, 1495 bp, Homo sapiens
gcgccaccggccaggcggccgccaactggacggcgggcttcggccgcgggcccacgccgcccgcgcttgtgggcatccggcccgcagggccgggccgcggcgcgcgccgcctcctcgtgctggaagaattcaagacggagaagaggctgtgcaagatgttctacgccgtcacgctgctcttcctgctcctctgggggccctacgtcgtggccagctacctgcgggtcctggtgcggcccggcgccgtcccccaggcctacctgacggcctccgtgtggctgaccttcgcgcaggccggcatcaaccccgtcgtgtgcttcctcttcaacagggagctgagggactgcttcagggcccagttcccctgctgccagagcccccggaccacccaggcgacccatccctgcgacctgaaaggcattggtttatgagggaggccccgccacatagacccccaacccagcctttccctttggctcggacggtgacgttgtatcttttccttctggcccctgtttaattttctaagctgccttcaaaatgactcgaagtggacagacacttggattgtactgactcctttgggggtggggtgggtgaggagtaggatgctcagcccactccagctccgcacattcgtcctcctaactcgactttcttcctgacaataggccctgcagtctttttgtagcggtactgacgtcttttattccatgtgtggttcctttttttctttttctataaaggctgtactaattttcttcatgcaacgtttcctaaagaccatggccagttttctacagaagctatttttgacaacctcaagtggcattacattttgcagtgaagtagaggaacctagggggacttcttcacaagttagatttcttgaggatcttctgttggaagcaggagaaagtggggggtggggggaagttgtccgaaatgccctctgaattgccggctgcagggtccttgtgctgcgctggttctttgaaagtctcagtgttgatattgaacttaaagagcagagatggagatcagtagcaaggcagtcatttttttaaagcagtaagtaacaagtaagatttggttcccggtttactttctgctgctaaaaaccacgtcagtgacaactgctctctgtattatagcaatcttgaatggaaacatttctgtcaagttgtaagttttaaaagagtaaagtgttttggttagtaatgatgtggagaaaaatacagtattgcatgtgttcgtgtgtatagattgtggttcgaggattgggagggctctgagaagcagagtactacatcaaaattgttttaagtattttttgccaataaaaaattaattttatggaaatggcttgtgctttgagaagcccagttttattctgtcttatgaaactaatttccactttgaaaattgttcttctgttgtttatggtataaatgaatggaatataatgatatcctccttctaggaaacaaagcat

SEQ ID NO: 3880 - DNA, 1182 bp, Homo sapiens
tacaatcccaattttcaaaatacctgttttttaaagctacgattttaggtaagtctgtaattggagatcttgctagtagtgtgagaatctcacttgatgccacaatacttgggcttgtgataatgtagtttctctgaggttaaataagcaggcatattatgccatgctctggggactcagtttttactagctatagaccttttctgttttgatagagaaagagaaaaagacaaagagcattcctgaaggactagattcaacttcttgtgaagtttgttctagttccttgttctaagattttttaaaatcataggcattgtggagcagattgcaaaagtagcttttttcataccagtataggtgggacatgttttgatagttggactatttgaggtaggaggaaaggtggagggttaaggggcatgtatgtaatctggtgaaggaattggaaaagaaacgctttggaaggataccttcctgattgccaggttcagaggcttgtcctcaggccttatttgctatagcttttaagattatttttaatattattgaccattctttccttgaaaagcttctctcccttttaaaatggtatctcattctcttcgttttcccctcttttactggcttctgttcatctcctttctttctcactgtttagtggaaagagcagaaacttgggttaaactctgcttgtgctagtctcgtttttactgttgggtgtttggtttatttaataacttcaagaagtcatgaggatagtgagaagtaatgtatgtagaatgctcagcacagtgcttcctcataggaaacattcattacctgttaattttcttacttctttccctcttttaacggggagcagttctatctctgggtagatctttatattcattgaggtctctctctctctcatgtatcatatacattgagatctctctctcatatatataatatccctaaagagctcagttctgaggcccagagagagacagttaagtacatcattataatacaatgttatgcaacatgctgatgtagcatctgctgtctgcactgcattgtacagaggacatacactcttgtagccagcattagctgacctactggcaggaaattattattttgatgcaagtttggggagtatacataacattgaaaagatcggtactgtctcagaga

SEQ ID NO: 3881 - DNA, 1243 bp, Homo sapiens
aaagaagagtgaacctaaaagcacttcaaagccatttaacagcaaattttgttagcaaattttctttccaaagcacttatcttagttttcttaaaaatgaccatgtttgcgtggaccgctctccgccaacaggtgtcttccacagacccctctcgctttagccctcagtctctttcaattctgtcttttctctcggtccataaaaacaaggaagtcgaccccagtggagcctagtctccccacgaggaggcggccccgggggtggagtcaaccctggaggccacgctctgtgggaaagcacggggcatgcaaactcgaaatgaaagcccgggaacgccggaacaagcacaggtgtaagatttcccttttaaaacgtggagaataagaaatcagcccgagtgtgtaatggcgtcaatagtggtgtggacgagacaaaggcaatgaggcaaggagcgaggctggggctctcaccgcgactttaatatggatgagagtgggacggtgacggcgggggcgaaagcaacggtaacgcttcttgacctttgggctaagatcaagtctagtaactgttcttatcagtttaatatctgatatgttctctatccgaggacaatatattaaatgggtttttggagcagggagatggaataggagcttgctctctccactccacacatcgacctggtattgcagtagctccacgaactgtgcacccctttagaagggaagaacactgcagagtagcttgcacacctagtatctgtgatatgctggttttcctattccttgaactaccttgaagttcctggtctgcggacataaggtggacttttcggcactcccattttcgctgtgtctacagcactttgggaagactagaacccaaaacgagactacccgtttctgtatctgcatgcagagagagcgtgttcaatgtttcttggaggtccttagatctcagcttggcagtcgagtggtggtgaccttttaaaggaacggggtccaccagtgtggcccagcctggacttgaacttcttcctcttttttttttttttcaagttctagatacatgtgcagaacgtgcaggtttgttacataggtatgcatgtgtcttggtggtttgctgcatctaccaaccagtcatctaggttttaagcccatatgcattaggtatttgttctgatgctctctctccccttgccccccaaccccgccgtcaggccccggtgtgtgatgttcccct

SEQ ID NO: 3882 - DNA, 1179 bp, Homo sapiens
aggctggagtgcagtggcacaatctcagctcactgcaacctccacctcccaggttcacctcccgcctgtaatcccagcattttgggaggccaaggtgggtggatcacctgaggtcaggagttcaagaccagcctggccaacatagtgaaacaccatctctactaaaaaaaatacaaaattagcgaagcgtcatggcaggtacctgtaatcccagctactcaggaggctgaggcaggagaatcgcttgaacccggaaaggcagaggttgcagtgagccaagatcgcgccattgcactccagcctgggctacaagagcgaaactacatctcaaaataataataataataataataataataataataaaccacagcacacccaccacaaaccagctgtcagtgtgaaaataaagccaaatagcttaacatttctaaagactagctggggccagacatgatgggtcatgcctggaatcccagcacttagagaggccaaggcaagaggatcacttgaggtcaggagttcaagaccagcctggccaacatggtgaaaccctgtcactactaaaaatacaaaaataagccaggtgttgtggcgggctcctgtaatcctgtaatctacttgggaggctgaagtggaagaatcgcttgaactcaggaggcggagtttgcatgaactgagatcatgcactccagcctaggcaacggaacaagactatctaaaacaaagactagctggagaatcctgccaggaaaaggccctcagcctccaactgctctgctcactcgaagctggaagatgcggctctagagacccatcaggaccaagccacgactccccacttggagaaatcaacggggaaagagacggaggcaaaggagaaccatctcactgggagaggcgatgctgtttgacacatcgtccctgtacctcccaaagccactgccctcccacacctgggcaacagtggccccaaccccaggcacagccctcctgcaggaaggaagaggactgaatggagggcgtggccgactgaaaggacgtggcctcctcaaaccccttggtaaagggcctctggggccacctggcagggaggggctggcataccaggaagtaccctccacccgggagttcagccagagcccaggtcctgtccgcaagtggcctccagagccacct

SEQ ID NO: 3883 - DNA, 1679 bp, Homo sapiens
ttttgccatgtgggccaggttggtctgaaactcctgacttcatgtgatccacccacctcaagctcccgaagtgctggggttacaggtgtgagcctccatgcccagcctaatttttgtatttttagtagagacagggttttgccatgttgaccaggttggtcttgaacttctgacttcaggtgatctgcccacctcggtctcccaaagtgctgggattacaggcatgagccactgcacctggctacttctaagcttcttacatgcagaaatcagaacctggaatctgtttctaagacttatcttcttaatgcctatgtggacaattaaaggatttttctcctcaggactctgaatatgatgaattgtattagtagactttctaatattgagcttttcttaatttgtgaaataaactcagaaagttccttcttggttttaacagtctatttctgtttgtaaatattagtatttctgtggattctgtacttgttccttgttatcctttcattctcttaggttcatttggtctgatggattcaggtaccattgaaattctgatagtttcaaaatcttttatctccaggtttgatctctcttgtgaactctggaactgtattcccaattgtcaattggacatccctacgtatgggacctcagatatttcaaacatgatgtgtccaagtctgtatcacttctggccatcatattgttcttttatttttccaaatttcacatcaccagtaacaaactagctgtgatcatggcagatagcctggaaataaaactcccctttttaccctttgcacagcaaattgacatcaaatcctgtttctactttttttttttttaactattgcttccctattctgtattctcactgctccatctcctgatgtaggaggtcatctgttttcctcttttcctctcctctgactcttaagccctttcccattctctttctcaggaatggctgttaaaatgccaatatggtcttgtaactttcctgtacttagtgaacctccttatttacaccctgtttgtgaagtggctgtgttcaccctgggtggacacggaatgtttttgtcatgtacaaagagaattttatgctgcctgtgtacagttattaatttgtaagtacactcagctttttgtatctgtaggtttaatatctgtgtatgtaagcaaacttggatgcaaaatatttgaaataaaatcagatgcttgcatctgtagtgaacatattcagactttttcttgtcattatttcctaaacaacacaactatttacatccacattgtatttggtcttctaagtgtgaaaggaaaataaagcttgggactccaaactcattaaactaaagggaaaagtcaagctgggaactcggtcatgcaaacctgcctccttcttttggttcctaaataagatggctccaagataaaaagctttttgtcttgtagccccctccatcatatttttcccacaaggaaatttctggtgtgctttaagatctttaaagtgtttctgttaaaattcatcatagcaatgtaaattgatagcttatccttttttttttttttttttttttgatatggagtttcgctattgtcacccaggctggagtgcaatggcacaatctcggctcaccgcaacctccgcctcccgggttcaaatgattctc

SEQ ID NO: 3884 - DNA, 1117 bp, Homo sapiens
tctctttagggtaacgtataacagagatgcataggaaaattcaggggtatgctttgaaatactattaggagatagcaaatgggggatagatggataaaatttaatctatatattactgggcaatagttaaaaggaataaactatctctagatatacatagatctcaaaattggcctcaaaaatgatattgacttaaaaaacactaagtaaaacatggtgaatgtcacatttctctgtgtaaatagaaaaatagaaaaaatataacaatcattgttgatatgtatttaggaaagaaaggattaatagtttaatattgagagtagattagacacacacatattaagtatataagaattagcctttggatttgttaatctttttgttttaatctgctgtatctctatttactatttcattcattattattgtcagtttttataatcgcatttcttctgcttggtttcttattttttccctaatatcttaagttagctgttgaatttatctgttttcagactttattgcttttttgtatgttttaaatatgctttcctatttccaaatctacaaatttttcaaaaaaaattgtttttttctgacttcaaacttaattgtgttgtgcttagagaaatatatctgtctgataattccttggaattggctaatatttgcattatggcctccccacatggttagtttctctctgaagttccatgcgtatctgagaatactgtgtattccttggaattggctaatatttgcattgtggcctcccaacatggttagtttttctctgaagttccaagcgtatctgagaatactgtgtattccttggaattggctaatatttgcattatggcctccccacatggttcggttttctctgaagttctgtgcatatctgagaatacggtgtattccttcaaattggctaatatttgcattatggtctccccaaatggttaggttttctttgaagttccgtgtgtatctgagaatactgtgtattccttggaactggctaatatttgcattatggcctccccacatggtttggttttctctgaagttctgtgcgtatctgcgaatactgtgtattccttcaaattggctaata

SEQ ID NO: 3885 - DNA, 1180 bp, Homo sapiens
ccataaatatatcaggctccatacaattaagtagaaaaggaatctcttttttatattattcttatcctgtagcatttatctgtacttggtgtcatatcagaaacatttccgagagggcctggtttcttccaattacgaagtaggaaatgtattttttttgtaaactttcaccaatgctctagttaccaatatgagaaatctcattgaaaactacaataccctctagtgtatgtgattgcatattgtttaaacattaatgttgctttaggatttttatgcaaagcagtaaaaatttgaggttaagccctaaaatatcatttcttcatttatctggcaaacttactgagcatgtaatatgtgatagatagtaatttagctgctggatatatagcagtgaacaacgggcgaaaatttgtgttctcttaaaatctattatttagaggggtaagacaattatcaaagaaaatatttaaaactcttaatatgtcatgtattggtaagtgctaaggagaagaaatacacatggagggtggacggttacaaggtcaggaaagacttcattaagcaggtgaaatgtgagcaaagacgcaaaggaacagagaagacaagccatgcaggatagcctagttgttaagagtacagactttgcaggtagagaggcctgcaggtgtctggtgtgtttgagggagggtaaggagctctgtctgactgggctgtagtcagctgaaggacagtgagagcagaaggagacagtggggtaatggagccaaattacatagttccttgtaggcctctgtaacatctcaggcttttactttgaatgagatggaaagccactgaagactttttatccagccataccttatgatctggcttaatacgagaaaatatcactgtgggtgctatggagaaggtgccctaagaggccacagtgtgttcataggaaatgctaagccttctacctgtgtgccagaccctatcgcctctcaattaatgcaggaacattattccaccaacttttccctttcttctgtatcatcaattctcctcttgctaattaatcatattcttcatatgcaaacatgctacaattattcttattttaaaatacctttccatattctacaaatctctcaagatactgcctcctttctctgatcctgagagcaaaactccatgc

SEQ ID NO: 3886 - DNA, 1203 bp, Homo sapiens
ctttcttagttaaattagattggaggacaggtttgacttctggcttattcgaatgccacagtaggaactcttaaacactgagatgccagattcatttggttccgttcgaaccaagatctgattaactaaaaatttgtcatatctaatacgaagaagaatgatagaactttaacgctattatttccaatatgctacaaagatttgcaaaataataacattacgtttcttctgaatgattgtttttattattagggtagcataaaacccattacttttctctttctatactacctgtaagtataacctttcttaagcacacttccttcaagtcactctttattcataaacctatagtgcttttcatcgcatcacagtgaaacctacaatacttaccatagcaatgcttgcaaattattcttctccgtgtagcattctggcttccatcagctgatctaagattttccaatcctgacactcatttgtccccaaactagctccagcatttcagcagagcagtctactttcaatcactagtatttgcttggtcttgtggttaacccaccccgatatcaattatcctttggtcctctttgtcaacaatgattaacctgaacaatctctgaccttgtgcttgtcttgtgttctttccaatttaaggtacttgctcttgcttgcattgccttctctatttttccccagcctatatgtctgacttccttagttcagtttgaagattttactggtatggggtgctgtctacaatttagcatataaatggtatatttttttcacctagaaaagcccaaaacagtgaacactaaatgaatgcctcggaatagtacattttaaaaagaacagaattcttgatctaaagcaaatactcaatattttttccatctcattatacctaaggaataatatatctgcattattatacctattccattatacctatacacatacccaccagtgacagtgacttactattgcagtagtaaatatagtgtttgaaaacaatatatatgtgatttgaaaaaaaactaatcgattctgatatgtgttgtttcaagtatgttacctgaatacaaatctaaccgattctgatacgcccttttgtagagagtgctgctacacaacgttgaaaatgtatgacccaaagcctataaatgagtagccaacattccagagtaacaaaagcactac

SEQ ID NO: 3887 - DNA, 1174 bp, Homo sapiens
gtcataattttgtcaagattacagtgaattttttcaaaagtcaaatagttgacataccttttatgaattcagcctttcttgtttcctgtttttgatatctattaacaagttttaaaatatttatctttttctctaaaaacattgattatatcagtacctcttgattttctattagatattacccattgatttttttttaatatataaaagcttaggatttaacattttcaccattcccctcttaggcacaaaattctccccaaatagtgctgatttcatttttattaattattattcagtgtttgaaacagcttactccatttaagaatatttatagttggatgtgaaggcactctggctgccacgtctgtcaccccagtgatcaccagtgtagatttacactgacctggctggctaggctggtgtctcttttttccctcaccagtccccatgcttccctccagaagctctttcagaggacgccctccctcctgagccatgaggatctttcttctgcgctctgctgctagagcctccaaactctctaggtctgtctgtagaacacagagtagtccagcttccaagactccagacacagcaatgaggtgctgtatatggcagtctgcctttcttggagggaaatatatatttatagctgatccacgcaaaatgttatacttcttttgtcgaactttttgttttctcttaattggattgtcttattcatttgcattgttttcaatttaacctcaaatgctcaccaatttgaatacattcttttgcaatatcttcaaatctattacttgttctatcactttaatcctcttttaccaatgttctatcatttgtgatcctttttacaaatctctcaccactgctcccacaacctaaggtgtgactatggtcttgggatgtcccttcgccatcatgttgggattttctagactttccctgtgtagaatctcctttttcctggatcccatgtccctttttctaagtttactctttggtatcagagaaagaaatcttccactagctttctgaaaaagggcttatttaaatcatattcttggatagcctttatgcctgaaaatatcttttactgccctcattattagttgatttcttaactaggtattgaatttagtgttctcgcagaattttagagcaatgt

SEQ ID NO: 3888 - DNA, 1162 bp, Homo sapiens
cagtctgtgtcttttaattggagcatttagtccatttacatttaaagttaatattgttatgtgtgaatttgatcttgtcattatgatgttagatggttattttgctcattggttgatgcagtttcttcctagccttgatggtctttacaatttggcatgtttttgcagtggctggtactggttgttcctttccacgtttagtacttccttcaggagctcttttagggcaggcctggtggtgacaaaatctctcagcatttgcttgtctaaagtattttattactccttcacttatgaagcttagtttggctggatatgaaattgtgggttgaaaattcttttctttaagaatgttgaatattggcccccactctcttctggcttgtagggtttctgccgagagatccgctgttagtctgatggtcttccctttgtgggtaacctgacctttctctctggctgcccttaacattttttccttcatttcaactttggtgaatctgacaattatgtgtcttggagttgctcttctcgaggagtatatttgtggcgttctctgtatttcctgaatctgaatgttggcctgccatgccagattggggaagttctcctggataatatcctgcagagtgtttttcaacttggttccattctccccgtcactttcaggtacaccaatcagacgtagatttggtcttttcacatagtcccatatttcttggaggctttgttcatttctttttattcttttttctctaaacttcccttctcacttcatttcattcatttcatcttccatcactgataccctttcttccagttgatcgcatcggctcctgaggcttctgcattcttcacgtagttctcgagctttggctttcagctccatcagctcctttaggcacttctctgtattggttattctagttatacattcgtctaaatttttttaaagtttttaacttctttgccttgggtttgaatttccttgtgtagctcggagtagtttgatcgtctgaagccttcttctctcaactcgtcaaagtcattctccatccagctttgttccgttgctggtgaggaactgcgttcctttggaggaggagaggtgctctgctttttagagtttccagtttttctgctctgttttttccccatcttt

SEQ ID NO: 3889 - DNA, 1179 bp, Homo sapiens
attaaaataatgcatttctccttcctccttttccttctcctcctccttcccctttctctctcttttagggctctgtgaaccagaagaaaataggaatagagggaggtaagaaattttgggaaaatgaagcaagaatcaatagcttttataaaaaatagaaagatcaaaaaatctttaataaactttgctaaccaagaagaactgtgatttggctgaggtttattgtttatttaatctaaaataaaatatttgctttgatatttaaatataaaatcattttgtcataaatacatagaattttaaaattattttgtgagattagtacaaataaatatataaaatatacatgtttatagaatatataaaaatgaatttcttgaaatttgttcttacacttagaagtattggtcactagatcagtaaatataagtttctctctatcaatgatttttgatggtgatggttttgaatcgatttatgaacaatttacatttttatctgatagctaactacattaaaatgtaggtcttaaagacaaaattattaatgtgtatgttcagaaatataattaaaccatagttaacaaaaacatgaaattatttaataagagatgtagtttttttctgagacggagtctcgctctgtcgcccaggctggagtacagtggttcgatctcggctcactgcaagctccgcctcctgggttcacgccattctcctgcctcagcctcccgagtagctgggactacaggtgccgccaccacgcccggataattttttgtatttttagtggagacagggtttcaccgtgttagccaggatggtctcaatctcctgaccttgtgatccgcccgcctcggcctcccagagtgctgggattacaggcatgagccaccgcgcccggccgagatgtagttttttaaagtattctttttgcactacctacctgggactatgacaaggaaatattataaaataagaaatactgtattttcttttatattatataatatctgaattatatgaattattttacttgattatatatttttatgttactatgatacttttgggattgattatccaattctttgtctgtcatttgtacaaaataattatggtactagcaatgtttttgcttaattagaaggcaataaagcatgattatttttgaaaaata

SEQ ID NO: 3890 - DNA, 1150 bp, Homo sapiens
taaaggttccggatgtttaaggacttcttgacactgcagttttagttctttcttaagtatgccttctttttctttattatagctgattattcatgatggaatttcagattttacaaaattaattatttctagatgcaaaactagtgagtttaccatgttcaacaaattacatttatatttaagatggcctcacagtcaaaatagcctaaatttgtataatttagcttaatttttcataattatttcaaaaacgtttgttatttttctaaaagatgatgtccctgttaataaaatactttatatttttaaaataagtaaatagtcatttaaaaacaaactctgactagtggatcacaaggtcaggaggtcgagaccatcctggacaacatggtgaaaccccatctctactacaagtgccaaaattaactgggtgtggtggcgggcacctataatcttggctacttaggaggctgaggcaggagaatcgcttgaacccgggaggcagaggttgcaatgagccgagattgtgcctctgcactccagcctggtgacagaacaagactccatctcaaaaaaaaaaaaaaaacgaaaaacaaaaaaacaactctgactatactgacattaaccattattaagtgggaataagaatttaataatttagcttgagagctcataatgaaatattttaatttcagacttatctgatttgctaatgcttaagtcatttctttactcaacctacacttacatagtaaagttgtgggtgaaagttttcctggtctcactcgttcaaagaagatggttatgacagtttttagccaccatatgggcttcttttgttttcttcaaaaatagaatacctgaattcacacagtaatgtctatccagacccttacccacgtgaactaagctagatagtaatttccagaaactacattatttaaccagactaaagaatgtaaatcgaatgattataataccatacttaaagtcaaaatcacaactataattttgcagaaagcttccagttttgattagatataaggtaagaaatattgataaaagattacataaataaaaaaacagtattgcttactaattccatttttttcttttttttttttttttctttttgagacagatacttgct

SEQ ID NO: 3891 - DNA, 1195 bp, Homo sapiens
acataaaaagaaaaaaatgaccaaaatatattgtggcaagtgttttcaaattctttgtcacaataagacatatgatgaggtgatatattaataataataatttttaaagttccatggattggaaaatgtagttcataacaaggaattataaccaagaagcagaaaatgtaatcagaaatgaaaaaatactacttagtaataagcataataagttagcattttgttgattaatttataaacctgggaaataattctgcccaattttgttcagtgaggtctcatagcaagtatggccaccattgtgaaaaaagtataaaacaagagttaaacatacatacattccatttaaatgaaaaatcactatcttaaaaaatctaatatttttaaaacataaattaaaaaatgttagattttaaagattttttattgaaaaataaaaatgttctaaaaatgttttgatactttattgcagcattaagcattaaaaattaggagccacttgaatttccatacattaggagataatctaatagtaaaactttttctcagtgatatactaggcagcaaattaaatatgaggactttgaagactgatgtggcacaaaatattcattgacatgaacttactagaaatttgtttgccaaagcatacagtacaactataactattagtagcaataaataatggaaaatgtaaaacttgtcagagcagctgtcattaatgaaatcataactattaattttatatatttttctcatgtgctcattctacctttattattggttaaaaaacaatcacagatagataagataggtaagatagatatatcagtaaggtaaatggatagatgaagtagacagattcacctcttttaattttgcttttccacatatagataaatatatatgatagataataatttgattacttagaagtaaattctagactatttttcatatggtctattcttccagaatatgcttctattgaagaaatcctaaaggttcaattgtgaaatttgcctttatttccctcctgaattattttccatttagttaacaaagaggcagatttgtagctaaactaccattaagaagttacttaattcaatcttaaagtattcctaaagggaaccaccattaatagagagaaagtattgctggcacaataaaattttttgagaaattgaagtgt

SEQ ID NO: 3892 - DNA, 1203 bp, Homo sapiens
ctttgacggttctgatgacgaagaagaaagccaggatattgtgaatcaagttcttgatgaaattggaattgaaatttctggaaaggtatgaacatcatcttttcttagttggaaatagtttctgcctaccacgtttgtcacttaattgttttgtttttactaggaggtgcatggtttttatttctgtttcaaaagtaaattaaacagacctctttacagcacatcctgtatgtcctagtccaaatgtttcctaatgcacgtttgtctttttcattgtttaatatagatggccaaagctccatcagctgctcgaagcttaccatctgcctctacttcaaaggctacaatctcagatgaagagattgaacggcaactcaaggctttaggagtagattagtcaaaagaagtcatactattttgcttacttataattatgtagtataaaccaagcacagtgcagatttcttttacaaaacacatgtattttgcaaaaaaaaaaaaaatgaagaccatgagtgaacagttgtttcctaacccatggctatttagaatcttttgccaaagaatgacaatgatgcaaaaatgggaacagtttggattttaattagaactgtttaggagtgatgatgtgtaaaaagttgacttctcttttgcatggcacagagaaattatattccttacttcatgtcagtttatgttctaaatctttttcactgaatataaaaatcttgttaaatgccattaggcaccaacttaaagagggttgtaaaaatattaaaagtatatcgttaattctgtatctgttgcttgtcttttgtaagtgattatgtgttatgaccataggtggttacagctgccaaattatttttaaatggtcaaaaagaagagtgctatttaaacatctgtcttaaacaaaaactgtcataacttttcttttttctttttccattaggagaacattctagttggtaaatttcaaaatgtgcttgacacctgccttaaatagcacagacctattgtgcacatctttaaattatttcagctggcagaaaagaattacatttaaaactgaaatcaaggcctcaatacaaagattatcctggctcttttctatctctgtgggcctaattgaaatatgtactcttattttagacacgcctctgttaaaacagaccaggttttcctggtctcagacctatgatg

SEQ ID NO: 3893 - DNA, 1201 bp, Homo sapiens
agaagcgtatcgtactgttgaagagctttacaaacgtccagatgaagaatataatgaaggcacaagtagtgttcaaaatcgtgttcgttttgaattgcttccaattttgaaaaagggattgttttttgaccctgaattttggaacttcgtaatgattaagaaaaactgtgtagcattattgagtgataaatcagcagttagatttctaaatgaaagcacactggaaaataatgcaggtaatctaaaaaggacggaggaacagcaaggtttggatgaagggtttgactctcttacagatcagagcactggagagactgatcctgatgatgtatctggagtgcagcctaaaggtcatattaatacgaagaaaaatcttacagctctcagtacttccaaagtagatcacaatgtcccaaggcatcgttgtatgttatgtaacaaggaatttttaggtggtcacattgtaaggcatgcccaggctcatcagaaaaaaggcagttttgcatgtgtaatatgtggtaggaaatttagaaacagaggacttatgcagaagcatttgaagaatcatgttaagaagatacagaggcagcaaattgctgcagctcaacaggatgatcaggaagtcactgctttggaagaaataaattgttctagttcttccatttcatttgaaaatgggaattctgatagtaaggatttggaagtggagacacttactgcttctagtgaaggaaacaaagaagtcatccctgagcatgtggctgaattcattgaaattcccataagtgtaccagaagatgttattgaaaatgttattgaaaatggcagtcctaataattctttaaataatgttttcaagcctttaactgaatgtggggatgattatgaggaggaagaggatgaagaaggtgattatgaagaagatgattatgacctgaatcaagaaacttcagtaattcataaaatcaatggaactgtgtgccatccaaaagacatatatgccacagatcaagaaggaaactttaagtgtcctgctcttggttgtgtccggatatttaaaagaattgggtttctaaataaacatgcaatgaccgtacatccaaccgatttaaatgtgcgacaaacagtaatgaagtggagcaaaggaaaatgcaaattttgtcaaaggcaatttgaagattctcaacattttatagaccac

SEQ ID NO: 3894 - DNA, 1185 bp, Homo sapiens
tcaggtgtatttttttcctagaaatatatctgtaacaatgatttaaggtggtgcagatggtgtttgttctatattataaatctgctgtctttgcttggcattttatagttaaattaattagaatatgtggttttatgcataacgtgtttagttctgtattctttctatgatagtgctttgaaccttcaaaaattcacattttccagcgctccgaccattttcccgcttatcaaatgtacaaatttgttcaaggtttttttttccccccaacttttgtaactgattgtctcagaactgattggtattctgagactaactttttaagcagcactatttctagttctggcaaaatagtttttttatttgcaatgttgttttctgttaaagactatattatgtttactgcaaaggtcagtgactctactgacaccagctttatttcccccactttttttgcattcacaaatacaaattgaaagggtaaattatattgaaaggcctttagaacagcagattcacatgcacatgtttgactttcgacattcagcttatagaattatggagtctatccagcaggctataaagcaagtacttgagacaaaaccggaatgattaataactgcaatcactgaactatatttggagagttttgttacataattgcagtcataatgagcactacagaatctgattatcttacattcacaatctggaggggctttttatttcactttgttataaaatgttctctgagaatatgatgccacatattaatgcacaagagggagatgcctaatgagagtggactgtgtgattaccagaacccagtgccatttactaagtggctctccatgtttacataaatcctgggaatactgtatacatttcttcttatgtacttagggttttagcttcagtcagcatcacactttttctccagaaattacttcacttagagtacaaacatatttttccaactattaagaaaaattatgcagcacatctcaaaaaatagcatctctttggaaaatagcctttaaaaaaaaacaactttatctgattatagaaatacaaaattctgctaaagctgaatacttttgaattgttcattatgttctgtgcctttaaactagagactatttgcttattaatattttttgttttgcaagcatatgtaacccggtt

SEQ ID NO: 3895 - DNA, 1169 bp, Homo sapiens
aagacagtcattttaaaatggtggctgaattttccaacccacccccaaactaaacactaagtttaattttcagctcctctgttggacatgtaagtgtgtctcttgttggacataggcaaaataacttggcaaacttagttctggtgatttcttgatagtttggaagtctattgctgggaagaaattccatcatacatattcatgcttataataagctggggattttttgtttgtttttgcaaatgcttgcccctacttttcaataattttctatgttagtagctgtgaagaactaaggtggggagcagtactacaagttgagtaatggtatgagtatataccagaattctgattggcagcaagttttattagtcagaataacacttggttatggaagtgactaatgctgaaaaaattgattatttttattagataatttctcacctatagacttaaactgtgaacttgctctagtgtcttattagttaaactttgtaaaatatacatatatttgtttttccattgtatgcaaattgaaagaaaaagatgtaccatttctctgttgtatgttggattatgtaggaaatgtttgtgtacaattaaaaaaaaaagatgaaaaaagttcctgtagatgttttgtgtagtatcttggcatctgtattgatagttaaaattcacttccaaataaaacacccatgatgctagatttgatgtgtgcccaatttgaacaagggttgattgacacctgtaaaatttgttgaaacgttcctcttaagggaatacagtaatcttatatagatatatatatatacaaatcttatacatatatataaatcttatatatatatatatatatatatatataaaaagaatctttcactctttaaactataatcaagatttgaagacttgaaagtgagatgaagggaaaataaatgtttttcaacattattttgttttgttgtaaatacaatgcacagattaaaatatgctatcataagaggctgaaatgaaatctgccttttcagttcaaacttgagtttcagaaacagactattttttgaatgttagaagttgatataaaacaaatgtcaaaaagtctctctaaatgtcatgcctattcttttcaaggtaaaattgaattaatttatctcatcaataaactgatg

SEQ ID NO: 3896 - DNA, 1199 bp, Homo sapiens
ggcgtcttatttatataatctcatttaagtttaccaataattaccttagtgacattattatgaaatacttaaaaaaatttagctccccatgagggagcttatgaaatttaagggtcgaaggtggatttagcagtaaactaagtgtagagtgcttagttgaacagggccctgaagcgcatacacaccgcccgtcaccctcctcaagtatacttcaaaggatatttaactaaaacccctacgcatttatatagaggaaacaagtcgtaacatggtaagtgtagtggaaagtgcacttggacgaaccagagtgtagcttaacataaagcacccaacttacacttaggagatttcaactcaacttgaccactctgagccaaacctagccctaaacccgttccaccttactatcaaataaccttaaccaaaccatttacccaaataaagtataggcgatagaaattgtaaaccggcgcaatagatatagtaccgcaagggaaagatgaaaaattataaccaagcataatacagcaaggactaacccctgtaccttttgcataatgaattaactagaaataactttgcaaagagaaccaaagctaaggcccccgaaaccagacgagctacctaagaacagctaaaagagcacacccgtctatgtagcaaaatagtgggaagatttataggtagaggcgacaaacctatcgagcctggtgatagctggttgtccaagatagaatcttagttcaactttaaatttacctacagaaccttctaaatccccttgtaaatttaactgttagtccaaagaggaacagctctttggacactaggaaaaaaccttgtaaagagagtaaaaaatttaatacccatagtaggcctaaaagcagccaccaattaagaaagcgttcaagctcaacacccatcgtctaaaaaatcccaaacatacaactgagctccttacactcaattggaccaatctattaccttatagaagaactaatgttagtataagtaacatgaaaacattctcctccgcataagcctacatcagaccaaaatattaaactgacaattaacagcccaatatctacaatcaaccaacaagccattattaccctcactgttaacccaacacaggcatgcccacaaggaaaggttaaaaaaagtaaaaggaactcggcaaatcttaccccgcctgt

SEQ ID NO: 3897 - DNA, 1168 bp, Homo sapiens
tgtaatggaaccaaaccaaaacaactggcttcgtacaaactggatctcccgtgatgcagctcagaaaatttatgtggaaatgaaattcacactaagggattgtaacagcatcccatgggtcttggggacttgcaaagaaacatttaatctgttttatatggaatcagatgagtcccacggaattaaattcaagccaaaccagtatacaaagatcgacacaattgctgctgatgagagttttacccagatggatttgggtgatcgcatcctcaaactcaacactgaaattcgtgaggtggggcctatagaaaggaaaggattttatctggcttttcaagacattggggcgtgcattgccctggtttcagtccgtgttttctacaagaaatgccccttcactgttcgtaacttggccatgtttcctgataccattccaagggttgattcctcctctttggttgaagtacggggttcttgtgtgaagagtgctgaagagcgtgacactcctaaactgtattgtggagctgatggagattggctggttcctcttggaaggtgcatctgcagtacaggatatgaagaaattgagggttcttgccatggtaagaaacaaacatttaaataatttatcttgcatttaaatgattttaaaaaagttttattttttaaattaacaaatagtaattgtgcatattcatgggtgtgtagtaatgttttgatacatataatgtatactgatcagatcaaagtagttaatatatccatcatctcaaacactgatcttttcaaaatgacgatttattaaaagtaaatattatacatttatttcaaataatacatttttgagtggtatacttgataattaattgtgaaagcaattgattcatattaaccataagaaaatttctgtcatttttctcctgggaaaggtgtatgaaattgtgccaaagtgctttcagtaaagtcgttaaacaatatgaattgctgtatccgcctaatttttataaaggaaagcagcatcaacaacagcaacaaaaagcaatgagattcaaaatagtgatttccctggtgttcacatttttacagtttatagaaatatgacatttaaagacagcaataattatttctatcatattgaattataatacttgaattgtacttaaataga

SEQ ID NO: 3898 - DNA, 1174 bp, Homo sapiens
gacatggtgaatcccacagctctatgagggcaaggagagactagagggagagagaacacaggctgagtcatggtggctaggaggtgagatggaccttctctgcctatttgtttttctgagaagaggtatgcataagtattaagctaaagaaggtttgcccatggatcacctgagtttctacactatatgaaaccctggtttatattaaaggtgtattttggctctgggatattaatactagccaaagcatacccaagagttgttaagaaactatttgtttggcaaatagtttttttaaaggtcaagttggtacaaggcacatcaggcacagtagagacaaagaagtataaggctttttttttttttattcttaggattttatttttcatttattttaagtaaagaggtatgtgtgtcattttttatgacgttttttgcttttgttttggacatgcatagatgggagtacatgcattcaccctcagagaattccaaagaagctgaaattctggaagttctacgccatccaagggactgggtgcgttgatgcaggcagaatggctgtgcaggggtttggagggcacacgatgtgtgctccccatgccactggtcggcactttgccactgtgtggcagttacccgtgccttagtcttctccactctgcaccctacctcgtgggcagatgataacatgttttggatgctgtcagtgatgaatggtgagatggcagattgtcagagtcaattgattaaacctcatttatacttctagtgtcattttatatgactagtttacaaaataggacattgagtttccaagtattgagataagggaatataaatagtattatatgtatcaggaaatctctcatcttgtttttgtttcatgtattttttaaagttttcatttgtgccacaaaaatctgtcgtggaatatattttattttcattaattcagtgaagttgagacttcatagtaattttagaatgcaacttgaaggtaaaaattttactttgtcaatactgaagtctctgctgtaatccttatatatctttctccagagaacataatattgtcaaatagatacacatttttctaataggtatttagaagcacttgaaataatctctgcatgtgttacaattcagttatttctgtagtttgtaaactcta

SEQ ID NO: 3899 - DNA, 1177 bp, Homo sapiens
taaaattacactgacttggctgttacttgatcttaggaaacagcacagtttaagatattgtgaattctgacttatactttattaaatgctgtaaatctaaatagatcctgttggatgtgatgggtctagtccagtttatttaagttcatgtttcactgtttgcactttgcattgaacaatgggtttattcgctgatgtaaacggttcgagtgaagaattaatgcagtaagtatgacaacacatacacacttgcctctccccatctccagaagaggggagcagagtccgagcttatctaaatatgaatgtggccacaaagctgtggaaggtgacaaagcttaaacacctttgccctggctctgcattgtcacctagagagcaagaggtctatagaaacatcatgtcacatgaaacgattctctgctttttggttctgaacttgaagtccctaaactgcaaaatctaagagttgggtggttattaaaatgcttttaaagtcaactgtggcaccaattctaatgtaatccaacttgtgactgtttttttttgttttgttttgtttttgtgtgtgtgtgtgtggcactgggaaaagtggaaacaaacatgtattgaaatacatattggaaataaaaatggtttgagcgtcagtgatattctcccagaatgtacttatcttacctcggcatgtactgtagtcactcagtatttgtatatgttgctagaatttagattgtaaaatagtgaaattttaatgtgttcatttgtttttaatgtatatatgtcttgctcagattatttggtttaaataaaacaaccttgaggtttgtagcttttccttatactataaaatgccagattcttctattttaacctcactaatttatggccaatattgtgcttccagcaacatttgaaaatgacactgttagtttactttgactttttctatgaccagcgccatcctttttttaaaaaaataatttcaacttttattttagattctaagggtacatgtgcagagtgcaggttgttacatgggtatattgtgtgatactgaggtttgtggtatgaatgatcccatcatccaggttgtgagcatagtacccaatacatagtctttcagcccttgccctccccgctcccctcgctccccccgccgcagtcctcagtgtctatc

SEQ ID NO: 3900 - DNA, 1437 bp, Homo sapiens
tgtgcttggctctgggggataatagaagtaattattaaaccggaatttagtggcccaagttgaatcaggaagccagttcctcagaacagttcccagcaatgcttgagaactctaacaagatatacagccaaagccagacacttttttacttgtgaaagactgtgaaaaaaattaatcatattttcctggagctccgttagtcttgcctatcaaactctttgatgataatgaaataacttcctggagcattgatgatgaagatccttcagtgccaatgtatttaattgcttgattttacatagagtatggtcatgtaccttccttccacattagtgtatcctggaaggaaataagatggaatttcgaatggcctgttctccattttcacagattacagatattccccctccaggaaactacatcccatcccacccttgaattaaacgcatcttctctgttctcccatataacctatgtagacttcttacatagcgcttaccacattgttatgacgtatttacttgcctaactcccggacttgaccttggagtccttggctaggttgtaaggtgcctgccacttcagagttattcagtaagtgttcattgactgacacgtttttaagtttccagcttcaaatgggtcctgtcaataatagatttattcattccttattgcctctgtctcattgctaagccatgattccaaagctttaacactcttttcatgccctttcttccacttattccttaaccactctcacccttcacaaacaccttcaccttcctcacctttcttctttgttgctttccttcctctgcccccaacacctcttcacatctttacacatgttctccttttcctgtctttggaagtattgctcttggtttccgattctgtcccctccatctaagctttgtttgtttttgtgagatggacttttgctctgtcacctaggctggagtgccctggcatgatcttggctcactgcaaactacgcctcctaggttcaagtgattcttgtgtctcagcctccctagtagctgggattacaggcacccactaccacactcggctaatgatgagattatagatggggtttcaccacgttggccaggctagtctcgaattcctgacctcagatgatccacctgcctcggccttccaaagtgctgggattaaaggcgtgagcccccgcgcccagccacctccatgtaagctttggatcataagcatcgcctcttaaatcttgcccatcaaatacccccttcccttctgtagctgtagtttctttctcactattggttctttttccacaactttataacacgcccagtggtcccactttctaataaaatctccctttccctgctccccactctgccagtttctcttccatcttcacattgcctgaattcattgtactcatctcctaat

SEQ ID NO: 3901 - DNA, 1097 bp, Homo sapiens
gggatttttaaataaagttgcaaagagtacaaatgataattggccatgcaaataaaaactgatttgttgattttttttttaaggggggttggcagttgattatgttctggatgattccgtctatatatgtgtgaataatgtaagtattttacagcatgttgatttttaaattaacgtagtaaatgctgtaaaatagatttatattcagttaaccgctttcagttgattttttgaaagaaacaaaggttaaatgggggattaaagtaaaattgagagaccctttaaaccattgtcagcatgcacaatgcctctgattctgcagttttagaaacttggtggcacttattaatcctcttggcccctttccactctaatggatagtgtacattcttcttaaagtccacaacagcagattttcttgcagtaaattatgcagatgcaaaatattctaattgatatatgtgttggaagactgagtattgatgggggagtggaccagacaaagaggtaagatgaaacagtagtgtgtttataattgtctgtgactattttctataataattagtactatttaatggtgagcttttaaaaatgtaggatagagggtacagtggcactgtatatactatttatagtctcagctactagggaggctgaggcaagaggcttgagaccaggagctcgaggctgtaatgtgccatgatgattgcacctgcgaatagccactgcactccagcctgggcaatatagcaagaccccatcctttaaaaaattttagaacttttttaaaatcaaagtgcagattgcttgtatgtaaaacccaaataaaggtagagtaagtgtgatatatgggagtattaaaatagcttaaaatttctcgtgaaggacatgtggctaaagggtcaaaaaggatgtaagacttggagccagagcatagtatttcctgaaataacaagtttagtgctttaactatggctacatgtgcttaaggaattttgagccacttatttttgaagatgctgaggacatgtagagtgctttttgtagtgagctaaccttgatctctaaggactaactacccaggtccaggtcttcac

SEQ ID NO: 3902 - DNA, 1279 bp, Homo sapiens
cctactagtgtctgacataataaatgtcaacttcattgacgcagttcttggtataaccaaaaaagcttgagatggccatgattatgtatgactagctcttctttaacatttttcttaacattatttctcctaacattatttcaaacagctacaaagatttaaccaaagggaggagaaaaaaaaactaccaattttaccctattatttaaagcaggtagttcaaataagtagcttctctcatagacagaaattaatgttggccgggcgcggtggctgacgcctgtaatcccagcacttcgggaggccgaggcgggcggatcacgaggtcaagagattgagaccattctagccaacatggtgaaatctcgtctctactaaaaatacaaaaattgctcctccacaggaggcctacacgccgccgcttgtgctgccgccatgtcgctagtgatccctgaaaagttccagcatattttgcgagtactcaacaccaacatcgatgggcagcggaaaatagcctttgccatcactgccattaagggtgtgggccgaagatatgctcatgtggtgttgaggaaagcagacactgacctcaccaagagggcgggagaactcactgatgatgaggtggaacgtgtgatcaccgttatgcagaatccacgccagtacaagatcccagactggttcttgaacagacagaaggatgtaaaggatggaaaatatagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacctatgaaaaaaataaaaaataaaaaaaataaaaaataaaaatacaaaaattagctgggcgtggtggcccgcgcctgtagtcccagctacttgggaggctgaggcaggaaaatcacttgaatcggggagacggagtttgcagtgcgcccaggtcacgccactgcattccagcctggcgacagagctccatctcaaaaaaaaaaaaaaggaaaccattcataaaaaaaaaaaacttatacttccaacttagtagactgctcgacaggaattaaaattcagaatattctctagttaagcccctaagacaaacttgacagtgttttcaaaaaagtgactatctgccacaaa

SEQ ID NO: 3903 - DNA, 1220 bp, Homo sapiens
taactctcttaactcccttattacctaaacttgtctggctcccaggaacagccttatagagagagggagtattgtattgggaagaaaatgttactgaactattgactgaaagtaaatttagataaaatacagcttttttccttatgggcatttgttttgtttcaagtcatcataaactaggtattgcattgctatccgtggatacagacgcttagctcttaaaagattttttttttatgtaaactgttgaatatttgaaatagtccacttcaccttaatgggtcttgtctatcttcattagtcttcaaagaaaaaccatttgctaccaaagtaaatcagtattttgaatgtgcttctcttgttttttgtttattagctagttcctgtaagcatttccaccagaacttgaggcaaatcgtaaggaagctgtttcttttaaaacacaaaccaccaccaaaaatttaaatgtacatattgcttaagtatttggctgtttttattttttaaaaggtataaacaccaaaaaaaaaattaacattgtatgaagatggaaaataagaagatgcactttctgtaactttgtctaaggatttaaattactaacttatgaactccaatttgaattgaacttaactatcggctttcttactggtaaaattatatggtttattttaaatgcgtacatattgaccaatggcctctgaaaaagcacattttagatactgaaattgaaggaaagaaaatgcatcttcaaacattttttggaatctcaccacatatactttgttagatttgtgtattgtagggtgtttgttttgtatttttgtattgtatatgaactttttttaaatgtgacagttaaacacatctttaaaagcatagtcacagacaaaagcatacagtataaaaatttccttgaaaactcctacaatattatatttggaggcagcttcagactgttttattggtggtagctgcttgctgaggtcttttagttggtaataactccagagaagcagcctgtgtatattcctaacactttgttcactagcatttaagtttagaataagcccaagtaagacaatggaaatgtatatagaactcttagttcttacatgatttaattatatcgatacatgaatttaacttactttaatgtaggcaaactatcaattttttgtccattttcctgtttgttaaaataacatacctctcctacg

SEQ ID NO: 3904 - DNA, 1221 bp, Homo sapiens
atggaaatttcctttgtgtttgcagagatccgtaaaacaccactaaaactgtagtttgagcttgaaaaatataaccactgcaaacttgtgtgaggatagagagcttgctttttgttttaacttgtgactcaaataatgttagttgtcaaaatgacttcatcacagtaagttttgcatgtcagtactgttttgctttgtaatttatgttgactttattaggatgcatcatcaaatgatcaaaattagcaaactagcaaaaatgaatttcaaagtcattcagtcagtgatgtaaaataaataaaatcctgagccctctgccaactgcatgaacgtaccctcatggccaaggtgaccccagaaaaacctttaaaacagagttcctgatcataacaggacaggagggcagacatgcctcattaaactccctcccttttgaagtttagacacaacaaccgaccagcattgatgttaaagaagagatatcaagactgacagaaaggactttttgtggcaaaaaggtatcaaaagataaacaagacccaaggccatgccaggtaagggttaagtcatatacccctacacttaaagaataaactgtgttctaactgccccagggttttcctttttctctaacagctaaaccatcactggcctacagataagcaatattaaaacaactgtagctcaccatcagacactgaataactgatccccgttccaccagctttgattggataagagactgatttcagtaactttctcctgataagaagaccgccaaccatggactgattctggcaggctttcagaggctgcacacttgcatgacttcgtgtcttgaaaagagcttttgacatataggacctaattataatacatttaagtattaaatatccactccaaagtgaacatcggtaatatgttacatgcatgtttgttcaatacctatgtgtcaggatcacctttatgaatattcagagtttctccagtaacctgttgaatgtgtacgtttaaccaaactgttcagcataaagctcctaccccaaccactcctcctttgaagtgcccgtctctagtctttctggaggctatccttctcagcctatgggatggacaccttgcaggctgtaaaccttttttttttttgagacggagttttgttcttgtcgcccgggctgcagtgcaatggcacaatctcagctcactgcaacctcctcttcc

SEQ ID NO: 3905 - DNA, 1215 bp, Homo sapiens
ttccttaaagatcctattaatataagggaaggccttttgaaagaatgggcttatcacctacaacatttcccttttattttagcatgattgctacttttttctttctaactttgtgtttaaaaaattgaatctttagaaacattgcaggaataataacaatgaactcatatacctttaacttagattcactattattgttttgacacattttgctttatctttctttgtgtttatatgtatctgtgtataattttttcccctgaaccacctgagagtatgttgcagacatcatggcactgcactccataaatatgcctctcctaagaaaatggactttctctaacatataaccataatgatcacatttgggacatttatcattgttatagtactgttatttaatatgcagttcatattagatattcaagtttcttcagttgtcccaataatgacttctgtagctatctttttaattttaactaatctaatctatgcttactcagtgtgtttggttatctctttaatccaaaagaattctttagcctattttgttttgtacaacattggcaattttgatgttgctgttttgtagaatgtccttttttttttttttgagatagggtgtcgctttgtcatccaggctggggtgcggtgcagtgatctcagctcactgtaaccttcagctcacttgacttcctggggtcaagtgattcttgtgcctcaccctcccaagtagctgggagtactaggcacgcaccaccatagctggctaatttttgtatttttagtagagatggagttttgccatgttggccaggctggtctcagactcctggcctcaaggatatctgcccgtcttggcctcccaaagtgctgggattacaggcgtaagccaccacgcccagtctgctttggatttgctttattgttttcactttccatgtgattagattgaggctaaatattttggcaggaaaattatagaagaagttttcctgcaaatatttttacaggaaattatgtttttgtaagaaaattattattgtacaataataattatataattattataactatagacaagtaaattgtatatttttttcttaccataaaagtctaaactcatgaaagtagtttatatgtgctctcttaaaaatcactttatttaagctatgaaatttgattatgctgtaatgtggccaggcctgtacactt

SEQ ID NO: 3906 - DNA, 1197 bp, Homo sapiens
ataattttcctgagaggttcgtccttaccttgtttgcttcctcctcctcttcctcctttctgccatcaaatatttgttgcacatctactatatgcaaagttccatattaggtgatagagagagaccaatgagaaagactgttcttcactttcaaggaagttccattctcatttggaagaaagagagtgaacagaatacacaattgatattttaattacaactagtcagttctttaatggtgcttcttaatgtcaatcttctgaagacatcttcgtggaaaaccataaaggtcttggtaattttctgtaaattcagctgtgctggactcatgatcaattttatatgccaactttgttttgcccaattaataatctattaaaaaagtgtatttttatacttttttacactgtacatttttatacttagtaaaatacatttttataatttttatatttagtaattatttgctgcattaaaatggaaagaacccaaagaactcttcggtacctgttattataaagagagagatatatatatactttaggtcactgtaataagaaacctcttctaacatttataggaggaggacagggctttcttttttttttttttttttttgacacggagtctcactctgtggcccaggttggagtgctggagtgcagtggcacgatctcggctcactgcaagctccgtctcctgggttcacgccattctcctgcctcagcctcccaagttcctgggactacaggcgcctgccaccacaccctgctaattttgtttttgtatttttagtagaaacagggtttcaccgtgttagccaagatgttctcgatctcctgacctcgtgatccgctcgcctcggcctcccaaagtgctgggattacaggcgtgagccaccgcgcctagcccagggctttctatattgtttttaagaatgaggcagttcacttgagagtatatgacttgattcagtgtaactgaatgctccatgaagtgaggcgtgttttataatgaaagtcttatagtataggcacaattccttactgttgaaattttcattttatttggtaagagttctttcctatgtttcacaggctggtttgaaccttgtttgcaaggaatgtactatctgatctaatacatttttattaccttttggctggaagttttaattaaggcgcagtcagaaaactc

SEQ ID NO: 3907 - DNA, 1151 bp, Homo sapiens
taaatgagcagtcaccaagagccagtgaagaaaccttgcttggaatttcaaaaaaagctaaacaaatgaagatcaatgtacagaataatgtggatcttggacagccagtaaagaataagagagtcttcaaaggtaatttgctttgatacagcacatactctagtaaaacaaaaaacaaataaaaagaaaccttttgaaagtaatagtcatgcattgcatagaaagaaattcaacatctcacatcttaattttgactcatattgattagagaggtatggtaatacctgtgctttctaagcttgagtactttaagttgtttatttgtttctgtagttgcttcctagttatttgcttgctttattcctttattttgtggtaatttggcaagaaatgtcatgcacttaagaatttgttgtagatttgaaaatagtatgcctaaggttttgtatctgcaatttttccacctccacagaagagtcatcagaatttgatgtgagggctttctgcaaccagctgaaacacaaagctactcaggtttgtctggcttcattaaatttagcttatgatttctgctaatttgtagaggatgcttcttaccaagggcagagattgaatcttttcattttatccccagctctaagcttagtgccttcttagttgtcagtgtgtgcttctgaatgaatagaggcaagggatttttaatacatctagttaattcagttaatagagtaccttcagaaatattttagtaggagtttctctagaattttaaagtaaccgtaagatctgttgttaagtatggattgtactgcagcttaagagtataggctttgcagtcagacagttggtttgaatcctggctttggtactagctgtgtgaccttctgtgagtttcctgatctctccgtacctctattttgtaatagtaatatgtgcctcatagggttgtgctagttttaatgcatgtaaagcgttcggtagtctggagtatggtaagcatttaattggagttagatgttattagctacggtcattttggtcatcatcctcatcattttgtcatgaagctattcctttactcctgttgaggttcaagttttaacatgattgattaatgtctgtaaattctgtttgttctggacctaacagca

SEQ ID NO: 3908 - DNA, 1163 bp, Homo sapiens
gttgatgaaggttttgggagcctgcaagttgttgctccgcttgttggactgctgctgcaaaacttttctgtatccttgaatatcttgaaatataccttcttttgatttggaattgtttggatatttttaacagtatttttgtttgaaagctaacactccataggagttacaacctacaggaattcttaaacttttgcttcttggcctccttttctcaggaattgcctgatgcagccattgccagagactgcctgtcactgttcagcacgtattatcctaagagcattgatagctagaaattcttaatcttagaaactaaactttaagaactaaatttaataatgggaactctagcagagtgtttataaccatattttaaagttttaaattcttaaatagaatgtgttttaaggctttaatacctttaagaaaattctctttacttccaatatatttcttcattcatgattgtaacttacaaaacccacattactttgattttgttttctaccttaaattgattttccagtttgactgtgaaacatctaggtttgcaagagttcattattttaaaccttgtgatggttgggctggtgagcaggttatggtatgtacatacctctgacatccttcatttctttctcatctcctttcagcctaggtttcttattagtagttttcaaacttattttcttatggggttatggaaggtgcaggtattctctttcttggtttgatcagagttttttgagggtagattgggaagccgagtgctgatggctgtatcaaaggagtaggctttgtatctcaatccacaagatcagcccaatcactgaacaactaaaaaaatcgggagtgactggtgtcacactgaaatctgggtcatggtaggttgtagtgaaacatcagtgggcttttactgaacattaaaaaaattaatgcctgtgactgggaattgcagtaataaaaaattgttggtagtagtcatattgcaacaggccgtttaaaatgatgctaatcctgggctggctgtatcacttgattctttctgtcactcggtttctaatttttaatggcaatgataaatgcaatttttgaccttcttatgtgctagactattttcttccatctcaaacaccactgcttttttgagcatatttagt

SEQ ID NO: 3909 - DNA, 1231 bp, Homo sapiens
gaaagattttcaaatcagggcaagagaaaactgatatacaatctcaacatggctcactcttgagcccctgttttatatttaaatcttgacttttttgtgtgagttatgactctaggtccttgaagcagaatattctccaaaataattcaaacgctctctcttttagggtgctacaacattaccatcccagaaagaagtgggtttgcattttatgatttgcattaaattgcttatctgaacctttcacaaggcaccctggtactaggcaggcctctttgaggaaacaggacatatttaggcatgaggtttactctgcgtttatctcaacatgggataccttgtgaagtaataagctttttgagggggtgcatttcccctttatcctctcatcacatctctgttcacttacatagaatcagaaatacacctttagtaaacagtcatgaaatatttgggctaggcactgtgagaaaatgggcacagcagtgaacaaaatgcacgtcagtgaacaaaatgccgggcgcggtggcacgtgcctgtagtcccagctacttgggaggctgaggctggaggatcgctggagtccaggagttctgggctgtagtgcgctatgccgatcgggtgtccacactaagttcggcatcaatatggtgacctcccgggagcaggggaccaccaggttgtctaaggaggggtgaactggcccaggtcatctacagtccgttggggaagatggacatgaaaaaaacacatgattataatctgttaatgataatcaggcaaaaagctacaagaagagaacatccttataagactcttatcattatgtgcagaacagaaaaaaaatccaagtaattgtcagcaatgtttatgcttagatgtaaagccctaattgctgatagcatctctctcacagctgaattcctcgagagcatatttggttctggaggcctccctaagagacctctttagggaggttcaggctttctctgtctatggttcccagttctaccacaaaaccaaacacagaaataaagtaattagggtgactctgcttgggctctggtatcagagaaggatgctggttctcagggaagggtgactttgaagaaataggcttcttgctgagattcctccaaatgtgtctgagaatttcaagttgactttcaaaggctagaaccttataataattatgtggatggaacattcaggaaaaggaaaactgagatgc

SEQ ID NO: 3910 - DNA, 1182 bp, Homo sapiens
cctgtcagatcagcggcagcattagattatcataggagtgcgagccctattctgaaccacacatgcaagggatctaggttgcatgttccttatgatcatctaatgcctgagatagatggaacagtttcatcctgaaaccatctgctccactccctgtccatggaaaaattgtcttccacgaaaccagtccctggtgccaaaaaggttgggaccactgctctaggggtcagagaaatctttaaagaggataatgaagagttctcaggaattccttaaacagcagaaaccaaagagaaggagataaggagaagaaattgtagtgtcaccgctgtctacctctgtgtcatttgagggaccagtttctctttggttataaacaatagagattgaatttggctaagcagcaaatggatactggataaactcacagaaagaaagggagatagaataatgaaggcttgggaaggccaggaaaacagaagctcccaggatcataaggatccatggggctaactcagcctcagcaagatattctccttgtgcagggagtcttattagttagccccatgcccaccccagaggtgagcctgtgtttgatggtcctatcagatttcaggaatgggacagagaagatctccgaaggaaaggcaggatattattgtcagaaggccaaaacaacagatttattacaaagttcatcggatttggcagtgtggaagtcttttgttgagcttggtttaagcagttttaggaataaaagtcaggtaacagctggttgaagagtgaataagaagtgaggaagagggggtagtaagtgtaaacaacttgttcaagaagactggtggttgggaggaagaatggggacacctgtggggagttgcaaggtcaggagaaaaatcagtttaggtttttacatggaaaaagttgaataaggatttatttttatttttgttgagatgggatctcactctgtctcccaggctggagtgcagtggtgcgatcttggctcactggaaccttcgcctcctgggctcaagccatcctcctacctcaggctcctgattagctgggattacaggtttgcagcaccacacctggctaattttttgtatttttggtagagatggggttttgccttgtttcccaggctggtctcaaactcctgagctcaagtgagccacc

SEQ ID NO: 3911 - DNA, 1150 bp, Homo sapiens
caaatctaagcttagaagaaaagtttagcgttaagcacctttatcttcatgaataagcttcagcttgctcttggcaagagaagagtgcttgagttacagaaggcataagtagtttgaagaatgcagcagcctttttgtaaacttcccagatatcaaaatagactttgatatataaatggttttctgagatgacactgcctctatttctataaccatttcacctggactatctaatcagtcctatgaatgtatccctaaatgtggttattgaaaacctaatagctgcctcatgacaagtacatgttatttaaggaggaaaaaatattaaattttgaattgagtgtgtaggctccctatcattatatatagagtttctttttccacggtagtcagtgacttaacctgaattgtaaatgtttgtaaagggttaattgtcctacatcaaacttagttaaataattccatccacttatggaggaggaggagaatgtggaagaggtaaaaagctgggcacaagttcatatgcctatgagtcagtaaagactgaagtaatgtcctatgttgagctggttattttgatatatgataataattatctttgaagtagaacaattctgttaactggaaaatcacaggatatatccatcatatttttcaggacagatagtttttactgtggggcaaataggttaaaattacactatgttagttgcatttaggttttaaagcaaagaatctgtagagaaatctatgcaatatatagtttgtccagattagctttcatttggggaatgaagttctgaaatatctaaagcagtttactcatcaattgaaaagtcctccaaaaagagaactattgggaaaccatggtgtggtggtggaaaagaaaagctccctcagttttttggagggaataacttaaaaaaatacttaaatggctaagtttacttggtgcagttaagaattaaacttgtcaattttaacattgctgttacatctgaaataaacttatgtgatgttctggtagtgatctgtgatatctgtaaatgtcaaaactgtattgttgaattctgcagccagcaaccgtacatactcattgtgtagtgtttcccttactgcttttatttactttcacatttaagatctaatt

SEQ ID NO: 3912 - DNA, 1177 bp, Homo sapiens
aatgtaaaaattagattaaaagtgtaaaattgtcatcaaaaggttttaggtaagcatgcctaacccttgttgattactggtagttgtaaagagaatgtaacagatgtttggagctatctgtggagaatgcttaaaacttgatgaaaccttaattttaattttttttctgatactctcttatatctcaggcatgtccagatcagcaatgagtcggcaattgacttctacaggaagtttggctttgagattattgagacaaagaagaactactataagaggatagagcccgcagatgctcatgtgctgcagaaaaacctcaaagttccttctggtcagaatgcagatgtgcaaaagacagacaactgaacaaattacaaatgaactttcttgcacttgcttgtcgccaaataaaagagaggcccattgattcctcccccaccccaacacttttcttttaaagcttttctccctccttgttcttgtttttctttcttcctttccttttctctgagagttttaatactttcaaggactttaaaaaaataatcatgtttgaattgttttctcttatttttgtgaggtggtttgaaggaaggacaaggtagatctgtttagttttgcagttgaagttagatggtcctaaacatttaattgtcaaataatttcaaatttaatgtcctgctttcacattgaagggcagagcctacaaaacattgtatatttcaaaagacaaaaagaagcagcagcagtatcttgttctctaattcatagacaagttgagtgtgtttgtggtactttgggtttttaaacactttgggatactaatccctagacattgccttcactccacctttagtccttctgagcactctctcgggagttggaacattgttatccttgtaagaaatactaagcttatgttgatttttaagtaattatatcttctcttcttgctggtgggtggggcagtttggtttagtgttatactttggtctaagtatttgagttaaactgcttttttgctaatgagtgggctggttgttagcaggtttgtttttcctgctgttgattgttactagtggcattaacttttagaatttgggctggtgagattaattttttttaatatcccagctagagatatggcctttaactgacctaaagaggtgtgttgtga

SEQ ID NO: 3913 - DNA, 1988 bp, Homo sapiens
ccgggttcaagtgattctcctgcctcagcctcccgagtagctgggattacaggcatgctccaccatgcccagctaattttgtatttttagtagaaacggggtttcaccatattggtcaggctggtctcgaactccagacctcaggtgatccgcccacctcggcctcccaaactgctgggattacaggcgtgagccaccgcgcctggccagggactatactctttttaaaatagacatttgtggggctcacacaatatatgaaatagtaccctctaaaaaagagaaaaaaaaaatcaggcggtcaaacttagagcaacattgtcttattaaagcatagtttatttcactagaaaaaatttaatatcaaggactattacatacttcattactaggaagttctttttaaaatgacacttaaaacaatcactgaaaacttgatccacatcacaccctgtttattttccttaaacatcttggaagcctaagcttctgagaatcatgtggcaagtgtgatgggcagtaaaataccagagaagatgtttagtagcaattaaaggctgtttgcacctttaaggaccagctgggctgtagtgattcctggggccagagtggcattatgtttttacaaaataatgacatatgtcacatgtttgcatgtttgtttgcttgttgaatttttgaacagccagttgaccaatcatagaaagtattactttctttcatatggtttttggttcactggcttaagaggtttctcagaatatctatggccacagcagcataccagtttccatcctaataggaatgaaattaattttgtatctactgataacagaatctgggtcacatgaaaaaaaatcattttatccgtcttttaagtatatgtttaaaataataatttatgtgtctgcatattgcagaacagctctgagagcaacagtttcccattaactctttctgaccaatagtgctggcaccgttgcttcctctttgggaagaggaaagggtgtgtgaacatggctaacaatcttcaaatacccaaattgtgatagcataaataaagtatttattttatgcctcagtatattattatttaattttttaggtaatgcctatctcttggtctattaaggaaagaagcaatcagtagagaattcaggatagttttgtttaaattcttgcagattacatgtttttacagtggcctgctattgaggaaaggtattcttctatacaacttgttttaacctttgagaacattgacagaaattatgcaatggtttgttgagatacggacttgatggtgctgtttaatcagtttgcttccaaagtggcctactcaagaggccctaagactggtagaaattaaaaggatttcaaaaactttctattcctttcttaaacctaccagcaaactaggattgtgatagcaatgaatggtatgatgaagaaagtttgaccaaatttgtttttttgttgttgttgttgttttgaatttgaaatcattcttattccctttaagaatgtttatgtatgagtgtgaagatgctagcgaacctatgctcagatattcatcgtaagtctcccttcacctgttacagagtttcagatcggtcactgatagtatgtatttctttagtaagaatgtgttaaaattacaatgatcttttaaaaagatgatgcagttctgtatttattgtgctgtgtctggtcctaagtggagccaattaaacaagtttcatatgtatttttccagtgttgaatctcacacactgtactttgaaaatttccttccatcctgaataacgaatagaagaggccatatatattgcctccttatccttgagatttcactacctttatgttaaaagttgtgtataattgttaaaatctgtgaaagaataaaaagtggatttaaattaacatttttttctttttctcttttttatggcacaatctgctagaaaatatgtaccttgtatcttgac

SEQ ID NO: 3914 - DNA, 1099 bp, Homo sapiens
cagagtatggtatgctataatgcttaagaaaatgggatctggccgggcacagtggctcatgcttgttacctcagcactttgggaggctgaggtgggcggatcacctgaggtcaggagttcgagaccagcctggccaacatggtgaaaccccatttctactacaaatacaaaagtcatctgggcatggcggcacacacctgtaatctcaactacttgggaggctgaggcaggagaatctcttgaacccgagaagcagaggttacagtgagctgagatcgcttcactgcactccagcctgggtgacagagcgagattctgtgtccaaaaaaaaatgaaagagagaaaagaaaagaaaattggatcctctctgatagctcatttgtcaactaataaaactgggcctggcccagtttttaagaattccagaagatatggtacttgctgtagagatgtaatgaagtatttgtaaaatgttggtatgtctggtgacatttagccgatgatgtgtgtgcttatcaagttctgtagtgcattttaaaagtggaacccagtattttgcttcactgaatactaaatcatttaggagcacccaacaagtaattgataatgttttctgattttttttccctgtatatctatagaagttagaaagtgtatctttatttttttctttaaacacatattagtctttcccagttataaaagtaatgacactttgcttatggattgcgtgtatgctccacacagtttctcacttctgtttggataccatataagaacaaattgggaaataatccgacctcagagatctgtttatgttttgacatttatttttccatatattttcataaacaccaggatgctcttttcttcacttaacagcattattaggaaaaaattgctatattgcttagccttccctcaaattggagaaagaaaaaagtggattatatcaataatcagtatggcctaagcagtgttactgttctctgtatacattttcaaggctgagagagccttggcttcatggcattctttccatgattagtctttctaattctgttctttcatttgtttggttttcatcagctcagacaaa

SEQ ID NO: 3915 - DNA, 1176 bp, Homo sapiens
tcgggcgtcagctcctccataggcaccgagcctgactcggtggagcagcagtttgggcctggggcggcgcgggacagccaggctgaacccacccaacccgagcaggctgcagaagcccccgctgagggtggtccgcagacaaaccagctagaaacaggtgcttcctctccggagagaagcaatgaagtggagatggacagcactgttatcactgtcagcaacagctccgacaagagcgtcctacaacagccttcggtcaacacgtccatcgggcagccattgccaagtacccagctctacttacgccagacagaaaccctcaccagcaacctgaggatgcctctgaccttgaccagcaacacgcaggtcattggcacagctggcaacacctacctgccagccctcttcactacccagcccgcgggcagtggccccaagcctttcctcttcagcctgccacagcccctggcaggccagcagacccagtttgtgacagtgtcccagcccggtctgtcgacctttactgcacagctgccagcgccacagcccctggcctcatccgcaggccacagcacagccagtgggcaaggcgaaaaaaagccttatgagtgcactctctgcaacaagactttcaccgccaaacagaactacgtcaagcacatgttcgtacacacaggtgagtgtcaccccacctggaggcctggcagcaggggctgagggggctgtgggaaggcaaggtaagagagcaggtagaagggaaggtttgggatcatctttcagattttaaacagaccccaccacaagcctcttctagaaaccccaactgtgttcctcccatcataagaacaaagcaccctgccaccaagagacaccgtcacaggaaccctttatggagaagggatgtcctagggatgtccagactgcagaagagaagactcaggtcattatataagccatattcaagtatttgtgtttcagaggcagcatactgtagtcaggaagagcttgagctcttacacccagccagatggcctgggtgtaaattcaggcttagctactactaaaccttgtcgccttggaaaaattacttaacttgtctatacttcagtttccttgtgtataaaatgagaataatcgtgatacgccttccttatagtgctgttttgagaataaatt

SEQ ID NO: 3916 - DNA, 1206 bp, Homo sapiens
gaggctgaggccggataattgcttgaacctgggaggcggaggtgcagtgagctgagatcggggcatacactccagcctgggtggcagagtgagactccatctcaaaaaaaaaaaagaactaagaattggtttgtgttttgagatggagtctcactctgtcacccaggctggagtgcaatggcatgatcttggctcactgcagtctccgcctcctgggttcctgggttcaagcaattctcctgcttcagcctcctgagtagctaggactacaggtgcacgccaccatgcctggctaatttttgtatttttagtagagacagagtttcaccatgttggccaggccggtctcgaactcctgaccttaagtgatccacctgccttggcctcccaaagtgctgggattacaggcatgagccaccccacccagcccaagaactgagaattggtgagatcacctgtagccatgtagtttctcaactgtattagtgcatcttgccctcctccaagaaaatgattcttggcaccaaaatttgtcaatttgccttttctctaactccaaatcaaaattagaatatcagcaggatggtggccatggaagttggaattcactaaggagtgtgtaacaactcacctgccaaatcgactagcccttaaaaaaaaattagaatatcatttagcatcagaaacgttttcaaattagttagcaaaccccagtctccaaaaatatataaagtcagggaaaaaataaacagactaaactagaatgtgtcttgagggcagtgacttcttgtcattgtaattccagtgcctagtagagtgccacacacgtaggaggtgtccggaaaatgtccagtgaatgaacagaacttgttgagacaagtaaaggagatgctcatgtttccataggcttgctgtaaacatgagaagcgaataggctaaaacctcagagagatgccgaaccatggtaataaagtttgatcttccagaattgagatcaggatgatggtatgatagtacttacagtaggtcaggcagcatatcacaaaaattccatttactgagattaaggtaatggcccaggatgggagcaggttatcaggaaaatgctcttgcttggctatggagggaaaagaataatgtcagctgtaatgtatttcctactgcctgatactcattctgtgccttttctattgatgcaactgtgga

SEQ ID NO: 3917 - DNA, 1219 bp, Homo sapiens
tggaaggcatgtttaagtgttcacataataaaacagtacatttcttccttgcaaacagccctacaccacatatttttccatttctggctctgtctgccaacttcaatgggctgtcctcagggttgggttggctggagtggccctgtgtgacaggcatgtgagtgtccctgagcaccgtacagatactagtctgcattgtcaaggagtgttttaagtctccacctcagggtgatgactgctttggtaggaaaggaggcaatctaaaattcacctgatttctgattcattccaataatgttttggtgtctttgaatatggcagccccctgggcagcagtccagccagcagaccttataacttagctctgtctgtatgtctgacatccagactcactagaagaggatctaaatgggccagggaattacttgtccctgggacagagcaattacaccatccctcataggccccagaaggcctatggacctttgcttgggcaccaggagcttctctgagagcaggtttggggtgggcttggcctccagagtggcctcctcctgcaatgtcaggctagattaacatctatgagagtctcctgtacaaggagaggtgggaggctgtgaacactcctatgtaacaccatttgtccccttgtgtgattgcttcaccaatgttgacagctcatgtgacacacctgtcttcttctgatggaggaaggaagtaataccattttctatcaaaagcattctttgatcatccctgtcctaaaaaaaagttacttgatgggtctcttgtcaaaatcagtgatatggtttggatgttttatcccttccaaatctcatgttgaaatatgacctctaggccgggctcagtggctcacaactgtaatcccagcactttgggaggctgaggcgggcggatcacttgaggtcaggagtttgagaccagcctggccaacatggtgaaaccccatctctactaaaaatacaaaaattagatgtggagttcagagtggaaacaggtgtgagagggttcaacagaagaaaacatagctgccaagtgtttgagtccatcggcaagtttggactggccttagctgttgcagaaggcatggtgaactctgccttatataacatggatgctgggcacagaactgtcatctttgaccgattctgtggagtacaggacattgtggtagggtaagggactcactttctcatac

SEQ ID NO: 3918 - DNA, 1113 bp, Homo sapiens
ggtgggggaggaaggaggtggaggacgagtaggaggggggaggaggagtggggaagtgcaaggcggctgcgcagacagcgctcctcacacagagcagctcctgacccgggcgaatgcgggcttgtgccgccgccgccgccgccgccgcccgggccaagtgacaaaggaaggaaggaagcgaggaggagccggccccgcagccgctgacagggctctgggctggggcaaagcgcggacacttcctgagcgggcaccgagcagagccgaggggcgggagggcggccgagctgttgccgcggacgggggagggggccccgagggacggaagcggttgccgggttcccatgtccccggcgaatggggaacagtcgaggagccgctgcctggggtctgaagggagctgcctccgccaccgccatggccgctggatccagccgccgcctgcagctgctcctggcgcaatgaggagaggagccgccgccaccgccaccgcccgcctctgactgactcgcgactccgccgccctctagttcgccgggcccctgccgtcagcccgccggatcccgcggcttgccggagctgcagcgtttcccgtcgcatctccgagccaccccctccctccctctccctccctcctacccatccccctttctcttcaagcgtgagactcgtgatccttccgccgcttcccttcttcattgactcggaaaaaaaatccccgaggaaaatataatattcgaagtactcattttcaatcaagtatttgcccccgtttcacgtgatacatatttttttaggatttgccctctcttttctctcctcccaggaaagggaggggaaagaattgtattttttcccaagtcctaaatcatctatatgttaaatatccgtgccgatctgtcttgaaggagaaatatatcgcttgttttgttttttatagtatacaaaaggagtgaaaagccaagaggacgaagtctttttctttttcttctgtgggagaacttaatgctgcatttatcgttaacctaacaccccaacataaagacaaaaggaagaaaaggaggaaggaaggaaaaggtgattcgcgaagagagtgatcatgtcagggcggcc

SEQ ID NO: 3919 - DNA, 1194 bp, Homo sapiens
gttcataactgaattgaaaagaaaaggaagaaaagtttaattttgtggtattcttcattcattcctgtctttaactttgctgtcccaagtctaatgggagtaaatacaaatacatggctactcttaattatgaaaacaagacttaatgaatttagaatttagtcttttcacaaactataaataaggaaattgatttgtcatttctagttcactttaatggtaatttaactctctaatttacacattgcatacaattgatatttattgaattcctctttggacagcctaacaatgtacagacactgggaagaaattagaggaatagtctctatcttcactaagcatatgaggtgggacactttttattgcttactttggctaggcatccatttacatactaattcatttaattctcacaacaaccctatgaggcaggtactgttagtgcccctattcatttagcgtggaagcaattgaagcacagaggcactacatgacttgtcctggatcatatagttagtaagttatggaactgcgattcaaacccaggcagtctgcttcaagaacctgtgctcctgatcactactctgtactgcctcttgttccagaacagtattaagaaaaaaaaaaatctgatactgttcaatatagtagccaatagcctcatgtggcaatttaaatttaaatttaaattgattaaaattaaaaatctagctcctcagttaaacaagccacatttcaattgctaagtagtcacatgttgctaatggttaccgtattggacatttcgttctttctttttttatttattattattattattattttgaaaaagagtctcattctgttgcccaagctggagtgcagtggcaccatatcggctcactgcaacctctgcctcccaggatcaagaattcttgtgcctcagcctcctgagtagctgagattacaggtgcgtgccaccatgcctggctaattgttgtatttttagtagagacaggtttcgccatgttggccaggctggtctcaaactcctggcctcaagtgatctgcctgcctcagactccaaatgtgctgggattataggcatgagccaccacacctggcctgtattgggcatttctatggctgtagaaaattccatgggacagcactgatatagaaaacaagtgttatagtagttcaagaaagtaa

SEQ ID NO: 3920 - DNA, 1209 bp, Homo sapiens
agaaatgagtgatgggtagaggttggaagagtttggagagctcagaagataaaaagatgagggaaagtttggaacttcttagagattggttaagtagttgtgaccaaaatactgacagaaatatgggcagaaaaggctatgctaatgaggtctcagacagaaattaggaacttattggaactggagcaaatatccccattgttgcactgtagcaaagaacctggctgcattgttgcactgtagcagagaatttggctgcattatggaaggctaatcttaagagcgatgacctagagtatctggaagaaaaaaattctaagcagcaaagtgctcaagaagtggcattgttacttttaacagcttacactaaattatgtccacaatggaatcacctaaaggaagaatctataattaaaagggacacgagcattaacatttgaaaaatttgcagcctggccatgtggtagtaaagaaaagagtgttttcaggagaggaatctaagcaactacttcctaaagagattagcatgaccagtaagagagcaaggtattaatagtcaagacaatggacaaaaggcatttcagaaatctttgaggccacccatcccatcacaatcacaggagcctaggagaacagaatggttttgggggacaggcctagggcaccactgccctgtgcccctttgggtcactgttcctcacatccctacaactccagctcccactatggctcaaatggacccagctactgctggggttgctgctccagagggcacaagccatagctttggtggcatccacatggtgttaagtctgcaggcacccagaacacaagagccatggaggcttggcagctgccccctagatatcagaggatatatcaaaaagcctgggtgcccatgctgaaacctgccacataggcagagccgccagcagtgtgcaacctcagtctggaaaagcctcaggcattcaactccaacatatgaaagccacatgggctgtgcacagcaaaaacatggggacaggactgccaaggccttgggagcccaccccttgcaccaatgttcccaggatgcaggacatggagtcaaagaaaattattttggagctttaagatttaatgtctactctgctgtgttttaaagctacatgagacttgttacgccttcctactggaatggaaatgtttacccaatacctatacaaccat

SEQ ID NO: 3921 - DNA, 1202 bp, Homo sapiens
ctttgcaatcaatttattgtccactgaaacggttatttattttcctctctctctgtgtccttatgtattattcagtaaagttcagcttcctgggtttcttctctctgcttctgtaactactgctggctttttttacttacttttccctcgcttctatgccactctgctttgtggaacaacctttgtgtgtcgggccattctagctgtgttctctggtaagaacagattcaaagtcctggctgggcatgctggctcatgcctgtaattccagtgctttgggaggttgaagtgggaggatcgcttgagcccaggagttggaagccagcctgggcaacacagcaagacctcatctctaccaaaaagaaaaatatactagccggacatactgccacatgtctgtggtcccagctaatcaggaggctgacagcggaggattgcttgagcccaggagttagagggtgcagtgagctatgatcatgccactgcagagggagttttaggggattccttatatgagtcagtcttagtatttagctacatcgtcggttacccagctactaaaatactctttctgattcagggatagtggacatgtggacccctggagccagaatatgttcagaattctgagatgatgatccagccaggctgtgggtaatggtcaccaacaggaggaaacactggggagacacagcacggcctggaaggaggagagttaggcaggtgcctcgtttctcatgttgtgttatgagaaccacacggcctccctggccacatataagctgtgaggtttggaaacgtcacactcaagcctaggtgagcaaaccgtgaggtatccaggaaggtgtctaaggacgttgtacagagctgaattggtgtatgaaagccacttatttccatagcctaggaaagagtacaacccgagttgacatgaacagagaaataggcgtaacacatccttggcagtggcccctctctgagagtaatgtgaacttgatggcaaggcccggcttcttctgcaaccctcagaacgttggttttgctctggggtggttcttcctgcagggaggcagagggagcaggcgtgcggagtgcagcactcggcccagctgcctgacttctccagcgccaggtcatgattcccggctggcttcgctggccttgtttctcagcagccctgatgcacatcagtctgtggggct

SEQ ID NO: 3922 - DNA, 1177 bp, Homo sapiens
tgaagtctccctctgttgcctaggctggagtgcagtggcatgatcatagctcactgcagcctccacctcctgggctcaagcaatcctcctgccttagcttccttgagtttctgggactacaggtgtgcaccagcatgcctggctaaagttatttttcacagtagtttcttatttttcttatttgtccatagtatggtttggtttgcctttttaaaatattttcaaaaactgtagaaaatgtactctgaaacaagataagtttctctactctttgacttgttaacctgccttcctttaatgtagggccccctgaaaaattattttacattctacagaagatgaaacattcattcagttgggtctagatataatgctttgttttacaaattatttcacaccatattcttttggaaaaatactcaattacttctttaaactcaaactcctgaagacctcaggatttttgaatattggaagcacaccaccatgcctgggtaatcttttttaattttttgtatttttttttttttagagatggagtctccctatgtatcccaggctggtctggaactcctgggctcaagtgatcctccgattttggcctcccagagtgctgggattataggcctgagccactgtgcctagcttcagtgtgcatttttaattattccagaaaatatactcagtttactcttaattacctaggagtgaattgacgaggtcataggttaattattaaactttttttaattaaaatttttactttagattcagggggtacatatgcaagtttcttacaaggggatattgcatgattctgagatttgggcttctattaatcctgtcacccagacagtgaacatagtacccaataggaagtttttcaggcctttcccccattccttctcttcttccttttggagtccctagtgtctattgttcccattttttacgtctgtgtgtacccaagatttaacgcccacttataagtgggaacatgtgttatttggttttctgttttttatgttaattcacttagggtgattgactccagctgcatccatgtttctgcaaaagacatgattttgctctttttgtggctgtgtagtattccatggtgtatatgtaccacattttctttatctagtccactgctgatggttacctgtgttgattt

SEQ ID NO: 3923 - DNA, 1194 bp, Homo sapiens
aaaaaagactgaaaacttgtttgatttacaaatagaaattactcgagtatgtgatatgaaatgaattaactcagttttccaacaagttgtaggagttctttttccattttgaagataagttcgtattagagattctgtttctcttttcagaagcattagacatttgcttatattagccacttcccaaaatagtgtcatattttctcgacttcttaattattccaaaaagcaaaacttagtgtaccactaagccaagtacttgggttttcagattccttccaaactcacattttaaagtttttatttttatttttagggaattcaagtttggaccaatgctaaggaatgctttagcaagatgtaatcctgtgaattgaatttctcttcaatcaaagtgccccaaaacagaagcacaagtaaataaaagaaatttaagtcactacctagtatacataaacatatacaataagttaaataaattcagctttctttaacttaattgtggtcgtgttaatgtagcacaaaaaatatattttaatgaagattaaatattataatttgaggttttggggactggtgctgattccaaaaagttaatttaataatatataccaacagattgtttgtcacgcttctgaaccaatgactgaatgtcaagatgttcgttaatttctagatgtttgtttcaagaccagctgtttcagatctattaatgtagggaatttttccctaagattgaattcctatatttacttggtaagatccactaatctgttatagggagttgttttctcttgccttatagttgagctatttggtttgacaaagctcagcagaaacttgatgtgaaaaatctacgattttcttctacattcattgatgccccttgtaatgtttgcatacactagaaaatgccttcaatttgtgttttaccagaattttgatactggtcagaaattttatactgccaacaaagaagactcaacttctcagatctataatgggatacattgtcatcctctagcaactcctatatagaaagttttaactgaatatgttacatataagaattaaattcttctcaaataattcttaacctcagtaatgagcctaaatttactctgcttggctctctacacatggcatttcagggtataagatgtagcatttcaatgtgtaagatatatgtactaa

SEQ ID NO: 3924 - DNA, 1220 bp, Homo sapiens
accatgctgatttggttactacagctttgtagtatattttgaagtcactatgatgcttcaagctttattctttttgctcaggattgctttggctatttggggtctattgtagttacatataaattttagaattgttttttctatttctgtgaagaatgacattggtattttggtagtgattgcattgaatctgtaaattgcgttgggtaaaattgtcattttcattgaaattcttccattcctcaaacataatgtatctttccatcggctttcatttttatttccctaacctcttctcaggtggctgtctaggctgcctttgtgtttctccagctgagctcttgttcccatcctgtgtcagtttctccatggttttctctgtaggagttcttcattctttttgcacacttatcctttgtctcttgtattgggtccaactattttctcctaggcttttgcttgcttttaaattttatttagaagttttgtcctacagaatatttaaactttgatgtagctaaattaatcatttttcccctttggtttttgctttctattgtgtgtgtgtgtgtgtgtgtgtgtgtcccttacccttaaggaatttaaatccctgatcgtgtgtgggtgtgtgtgtgtgtgtgtgtgtgtgtgtttcccttaccttaaggagtttaaatccctgatttaggttcaaatttttttctggctgtccacttccctggttgctcaggacatccaagccctgcctttctggcagagggagctgggaaaagttaaccacctctctttgttcctgtccataagccttgggcgtctgggtgcctgtagcattgctcgggtgaccactggccttggcaagaacagtttgcatcaggagaagaggaggggaggtgagaacacactgtgggcatgattctttgtatagttttgccatgaagaggaggaggggaatgaagtgagagatagcttgacgtcaaggctgggtttatagaggcagatcctagagcaagtttctgttctcatcagatgatcccacagaggtagaggggagaaactgaggaggcaggagagaggggttccttgtaggtgcgaccccttgagaggaccctggtagggtcccaggcctaggggagacactggcctttctggtgctcttttaattctctgtttcctcttctgcgtaaagtgatcgttaatagtctagccttcccacagtcccg

SEQ ID NO: 3925 - DNA, 1287 bp, Homo sapiens
aagctgagatcacaccactgtactccagcctgggcaacagagtgtgactctatctcaaaggaaaaaaaaaaaggctgggtgctgtggctcatgcctgtaatcccagcattttgggaggccgaggtgggcagatcacctgaggtcaggagttcaagaccagcctgaccaacatggtgaaaccccgtccctactgaaaatacaaaaattagccgggcgtggtggcacgtgcctgtaatcccagctactcgggaggctgaggtagaagaatcgcttgaacccgggaggtggaggttgcatgagccaagatcatgccattgcaccccagccggggtgacaagagtgagactccatctaaaaacaaaacaaaacaaaacaaaacaaacaaacaaaactaaaaaacgaaatcatgctatgaacctcaaatatacacagtaaaatttattaaaaaaaaaaaaaaaagaagagcaaagcagagctctgagcagcttcctgccccagcatccctggttctgctgctttcttcttcccaggcagccgtgtcacacagacctgcagctgagatgggtgccatctccctgggttgcttctgcagaggaggcctctcctccccagtggagcctcctacctgccggctattgactgagtgtccagctgaggacagcatccctgcagtgcatttcttgcccactgatgtgatgtgttcatgactcccagcctctctgtttgctctgccactaatacaaggaggtgccccagcctctgggcccctgcagctgtgccagcggatggtgctgttttgtattccttaatttgtgcagcaccagctgcgtgcaggcactgtgcttggcaccggggctgtaataggacccagacagatgcgtgcctgccctggccaggctcatgctctgcaggtggggtcagaggtcaacatgcagtagaggaaaggacagcagatggggtgcacaggcaggctgtggttttatacggggcgatcagggaggcaccccagagaagggaacacaggcctgcaggaaatgaggtgtggagtgggcagcaggaagggcagtccagggggcagtggggcacaggcctggtgtgtacaggccagaaaggaaaggcaggtggccgtgtgaagccgcaaggggtgggggggagtggggaggcactggccgggtcttgcttcttgcagcaaagcatgctttgggcctacccaggtccctgccacctggggtcccaatgcccctacctgccctggagggaccggccccaccagccctctgttccttg

SEQ ID NO: 3926 - DNA, 1421 bp, Homo sapiens
gctttgaagccagaaagacatggatgcaagtcttactttgcttcttgctgttaccagttggcctgaccttaggaaatgttatttaatctctctccagttgtttcccctggagaaagccctgtcagcctgaggatccaagacgcgtacgtaaagtgtctgatttcagccagtgtcccttcctgtcccttcctggggtgtgtgtcggttgccctgagcgaccggccatgggactctgtcgtgataaccaagcttcagggtgtgggaagaggacagtcagtgcttccttggggcatcactcggtaacatcatgggcataaacaaaagtactcagtcttcaaggtcataaagtaaccagagtgtattcctttttttttcagatctcttacctcagctagaagctccgagttctcttactcccagcagtgaactcagcagcccaggccaaagtgagctcactaacatggatcttgctgcactcttctctgacacacctgccaatgctagtggttctgcaggtgggtcggatgaggctctgaactccggaatcctgactattgacgtcacttctgtgagctcctctctgggagggaacctccctgctaataatagctccctagggccgatggaacccctggtcctggtggcccacagtgatattcccccaagcctggacagccctctggttctcgggacagcagccacggttctgcagcagggcagcttcagtgtggatgacgtgcagactgtgagtgcaggagcattaggctgtctggtggctctgcccatgaagaacttgagtgacgacccactggctttgacctccaatagtaacttagcagcacatatcaccacaccgacctcttcgagcaccccccgagaaaatgccagtgtcccggaactgctggctccaatcaaggtggagccggactcgccttctcgcccaggagcagttgggcagcaggaaggaagccatgggctgccccagtccacgttgcccagtccagcagagcagcacggtgcccaggacacagagctcagtgcaggcactggcaacttctatttggtatgaagcactctattcagtcaccaccatataggtcacttctctcatactcggtcttgaggatattctggattaatcctttctatgcagacgtttctggtttacaaaaggacgcagccctggactacaagtctggaactgacaagttcttatgaccttgacaaatcaccttaacccatctgagccttaaattctcatttatttcctgcataaggagatttggctaaatgctttctgaggtcctttggagtcctgtggctccatggtaatgtgctcctttccttgaagattgggggttttgtaatgttgagatactttgcctctatgcttgtcagctcatgaccagtcctagaagagg

SEQ ID NO: 3927 - DNA, 1199 bp, Homo sapiens
ctcttttgcactctctgccactttcttgcctttgaccctctaatccctcccatgtcttttgttttttgagacagggtccctctctgtcaccctgactggagtgcagtggtgtgatcatggctcactgcaacctcaggctcctgctcaagtgatcctcccaccccagtctccagagtagctgagcccacaggcatccaccaccatgcccagctaatttttgcattttttatagagacagggtttcactatgttgctcaggctggttttgaactgctggccttaagcagtctgcccacctcagcctcccaaagtgctgggattacaggcatgagccaccatgccctgcccctcccatgtctttgaaatgctttcctggaagaatgtttcactttgttgactttccctagcatatgtcccctaagcctgtgtctctcactgggacttttgtcctgaattctgaacctgcccctcctgtgtttccgtctgcctcagctattctatctccaagtaacaaaggctagagcagagttgtgtttcaggagtggactgggagtaacgagggctggagagggcagggttagagaggaaagtgacggtggcctggtgacctgtgaggggaatgctgagtgtgtgagtgcctagtcattgggcagctttgcagcatgggactaggaaacctaccccactaggccttctccacagtccaggatacagaagtgcctggcagctgtggtggcggcccctctggggagcacacccatgtgccctattctctgggccctggtgcggttgtcgctcctcaccgggcctggctgatggcatcctagctggccctagagttacttctgctgctcagtccgtggaggctgtgtgtgtcaccaactgggtcctcacgtctcctgtgtgaccagcagcaccacagcagagcaccggctttggggcgcagctgtgtcacagctgccgcgttggcaagggacaggcctccatgcctcgcacagagtttggtgaggggttgggctcagggcagttctgtggcctttgctttcttgtgatcctatttagaagtggtcatgaagcccctccttgggatcttggacactgatctttcacagtttacagcagttgccgttcagctttatatttaaataaattgcccttctggctttagtagtgtcttgaggacacggaatgtgcgtgcc

SEQ ID NO: 3928 - DNA, 1205 bp, Homo sapiens
gattgcagcttaagttttggtcaccctcatgcactctctcaggtcacttgttttgcgagaaggcagctatcatgttttgatgacgctcaggaatcctatggagaggcccatatggtgaagaactgaagtctccaaccaacagtcagcaagaaactgaggtctgccaatgtctgtgtgaacgagcttggaaatgaatgctactccagtcaagccatccctgggccagcagcttgatagtaacctcttgagagactttgaaccagaaccattcagttggttactccaaattcctgatccttagaaactgtgagagaataaatatttgcaatttaaactgctaattttcagagtaatttgctacacagcaatagataactaatacattcaccaaggaaaattaaactagtacagacctgatgagttaataaaatgtcttggggactttattcctaggacagataaaataaacctcatatagattttaaaattcaacaaaaagggattagggcacagacttagcactgaacttacttcataattgcaaacaaggaaaccccaagcagagaagttcatggggtctagtggagtgccctctgagttggtgatcctgagctgtggctgtgacaggttcctgctaaacttcaattaaagcatccttgtcaaagcttgcaccaaagattactagggaaacctgttcatcaaacaaagctgtgtttattaagcttagcaaggaagagctcagccttgacagagtcgagtctcagtatcattgcaaatgggagttaggagagagtactttgtgagactagggttagtcatagggtagttataggagagagattagtaagtgtgtcttggcagcagtgggtcagagtttgaaaactatttgctggaatggtctgttagtggtcttatttttagaattgggggtatacgagaccatattgagtttctgttactgtagtcttttcttgaaacatggatctgaatgagctagtgtaaaagattttcaacttagataatttgttgtacaacatggcttagtatggttcatctatttttgagtaatagtacacttgttaagtagttggctttattttccaatggagaaccatccagtgcttctaagcagggaataacaatgagacctgttaggattttattgcaaaagattattaaatatttattgagacttatgtttcgag

SEQ ID NO: 3929 - DNA, 1211 bp, Homo sapiens
ccccttccgcaccttctcggccagcgactggggcctcacccacctagtggtgcatgagcagacaggcgaggtgtatgtgggcgcagtgaaccgcatctataagctgtcggggaacctgacactgctgcgggcccacgtcacgggccctgtggaggacaacgagaagtgctacccgccgcccagcgtgcagtcctgcccccacggcctgggcagtactgacaacgtcaacaagctgctgctgctggactatgccgctaaccgcctgctggcctgtggcagcgcctcccagggcatctgccagttcctgcgtctggacgatctcttcaaactgggtgagccacaccaccgtaaggagcactacctgtccagcgtgcaggaggcaggcagcatggcgggcgtgctcattgccgggccaccgggccagggccaggccaagctcttcgtgggcacacccatcgatggcaagtccgagtacttccccacactgtccagccgtcggctcatggccaacgaggaggatgccgacatgttcggcttcgtgtaccaggatgagtttgtgtcatcacagctcaagatcccttcggacacgctgtccaagttcccggcctttgacatctactatgtgtacagcttccgcagcgagcagtttgtctactacctcacgctgcagctagacacacagctgacctcgcctgatgccgccggcgagcacttcttcacgtccaagatcgtgcggctctgtgtggacgaccccaaattctactcgtacgttgagttccccattggctgcgagcaggcgggtgtggagtaccgcctggtgcaggatgcctacctgagccggcccggccgtgccctggcccaccagctgggcctggctgaggacgaggacgtgctgttcactgtgttcgcccagggccagaagaaccgcgtgaagccaccaaaggagtcagcactgtgcctgttcacgctcagggccatcaaggagaagattaaggagcgcatccagtcctgctaccgtggtgagggcaagctctccctgccgtggctgctcaacaaggagctgggctgcatcaactcggtgagttgggcaggggcgcccctcctcccgcggccccatcccctccagggacgacggcatcggtgtcagatgcacgcccagtggtgcctgctgtgtgcctggcctggcttttggcttggccatccccatggct

SEQ ID NO: 3930 - DNA, 1115 bp, Homo sapiens
ctgaagtgctgggattacaggcattagctaccgcacccagcccacacttagacttctgcactgattctaccagcagctagagctagtggctgacctgtgctttccccatcccatctcaccaccctcctcctccccaccgacacccatgtgcatagcaggcacaagtcagtgttcacacccactgacaccgcaaggaaaagaaaggagccccagaatattaacaataaacttgcccttgaaagccagcatgtggggcaagctctctgcagcctggcccctttgatatagtcccctacttcctgggaataatgcctggcctcctcctctcactcaatacattccctgcttggtccccaaagacattcgagtttgtactccttggcatggtgcctcacagaggctgtcagcagccccctcgctgtaatacgcctccactggcctccaccttccagcttcccaaaaggcctccgaccggggctctctcccctgtccctttcctatgccttcgtaactgtcgcccttctttctgtctcctcgcacaggtgatctgcaaggactggagcaatctggctgggaaaaactacatcattctgaacatgacagagaacatagactgtgtgagtgcccagccaggctccgaaccgcagggaaaggctgcaggcagtggacagggtggggcagagggcaggctggggggacaagcagtgcgtgggagaaggcttagtccttcagttggtggcccagggatataccagcagccatcaacattacacacagagagctttcgtattttaaaatgtccaaaggctctttggttcttgcttccctctctttttaatttaaatgaatactttgttcatgtgtgcaccatcttacctctcccgtgatattgaaacctttctgtcttttttagagttgttttcttcctgtataggttgcttttctccgttttgggtctcagccttttcatatatatacatgctctccacacatgtctggtggagtttgttcatagctctctctatcgaaaaagtggctggaagctttgagcatagtgctagggttgtcagctatggcttctcatgagagtggtctggctgggccgtatcacttag

SEQ ID NO: 3931 - DNA, 1500 bp, Homo sapiens
agctctcatcatggcgcgtgctgctgcggcatatggacttttaataatgtttttgaatttcgtattctttcattccactgtgtaaagtgctagacattttccaatttaaaattttgctttttatcctggcactggcaaaaagaactgtgaaagtgaaattttattcagccgactgccagagaagtgggaatggtataggattgtccccaagtgtccatgtaacttttgttttaacctttgcaccttctcagtgctgtatgcggctgcagccgtctcacctgtttccccacaaagggaatttctcactctggttggaagcacaaacactgaaatgtctacgtttcattttggcagtagggtgtgaagctgggagcagatcatgtatttcccggagacgtgggaccttgctggcatgtctccttcacaatcaggcgtgggaatatctggcttaggactgtttctctctaagacaccattgttttcccttattttaaaagtgatttttttaaggacagaacttcttccaaaagagagggatggctttcccagaagacactcctggccatctgtggatttgtctgtgcacctattggctcttctagctgactcttctggttgggcttagagtctgcctgtttctgctagctccgtgtttagtccacttgggtcatcagctctgccaagctgagcctggccaagctaggtggacagacccttgcagtgatgtccgtttgtccagattctgccagtcatcactggacacgtctcctcgcagctgccctagcaaggggagacattgtggtagctatcagacatggacagaaactgacttagtgctcacaagcccctacaccttctgggctgaagatcacccagctgtgttcagaattttcttactgtgcttaggactgcacgcaagtgagcagacaccaccgacttcctttctgcgtcaccagtgtcgtcagcagagagaggacagcacaggctcaaggttggtagtgaagtcaggttcggggtgcatgggctgtggtggtgttgatcagttgctccagtgtttgaaataagaagactcatgtttatgtctggaataagttctgtttgtgctgacaggtggcctaggtcctggagatgagcaccctctctctggcctttagggagtcccctcttaggacaggcactgcccagcagcaagggcagcagagttgggtgctaagatcctgaggagctcgaggtttcgagctggctttagacattggtgggaccaaggatgttttgcaggatgccctgatcctaagaagggggcctgggggtgcgtgcagcctgtcggggagaccccactctgacagtgggcacacggcagcctgcaaagcacagggccaccgccacagcccggcagaggggcacactctggagaccttgctggcagtgctagccaggaaacagagtgaccaagggacaagaagggacttgcctaaagccacccagcaactcagcagcaga

SEQ ID NO: 3932 - DNA, 1175 bp, Homo sapiens
cagagtcgcgcccgtggcgtttcgggcccaggctccgcccccgccgcgctgcccctccccccatgggggcgtggccaggcctagcccagggatccgagattccaagtcacacccagcacgacttgggaagtcgcgacgaaagtgcgcgacttcccagcaagcgaggttgaagtcccggcaggcagggaggaaggcgtgtgtccccccgtgcatgcggggaaggagcagtgggggaaggctgagttgggctttcaattaaaaaaaatgtgcatacacttagttttttgatgcaaaattgccaaaggcgtgtaccgtgaaaacctacctcgacacctgccccctgcctcctgttccctttccggaagcgcctgccttacaccggtgtgttcctctagagatggccaggacctgggtgaggcagcacacactcacaggaccttcccaacactcattatgaaacatatcacatggaaaactgcaagaattacaggcaatcgcctctcagcctttggctaagatcaagtgtagtgttcttatcactttaatatctgctatctgaggacagtatgttaaatggatttttggagcagggagatggaataggaccttgctctttccactccatgcatccacctggtattgcagtacctccaggaatagtgcaccccctttgggggaataaaaaaaaaggattgcaggtgagcccccatatccctgtcatctaggcactgcactgcccatccccctgtctgcctgccagtcagtcttgtcagtcttctgtgcatttcaaagtgagttgcagatacaacaacctctgtaaatagttaagcatgtgtataattatctagagttcagtacttgattatggttttttaagtttttttttttttttttttttttgagacggagtttcgctcctgttgcccaggctggaatgcaatggcgccatctcagcttactgcaaccaccgcctcccgggttcaagtgattctcctgcctcagcctcccaagtagctgggattataagcgcatgccaccacacccagctaattttgtgtttttagtagagatggggtttctccatgttggtcaggctggtcttgaactcctgacctcaggtgatccacctgctttggcctcccacagtgccagaattacaggcatgagccactgtg

SEQ ID NO: 3933 - DNA, 1175 bp, Homo sapiens
gaagtcatcccccttcagtgcagctgccctggctggacacatggcacctgtgggccacctcccgcccttcagccactccggacacatcctgcccactccgacgcccatccacccctcctccagcctctccttcggccacccccacccgtccagcatggtgaccgccatgggctagggaacagatggacgtcgaggaccgggcactcccgggatgggtggaccaaacccttagcagcccagcatttcccgaaggccgacaccactcctgccagcccggctcggcccagcaccccctctcctggagggcgcccagcagcctgccagcagttactgtgaatgttccccaccgctgagaggctgcctccgcacctgaccgctgcccaggtggggtttcctgcatggacagttgtttggagaacaacaaggacaactttatgtagagaaaaggaggggacgggacagacgaaggcaaccatttttagaaggaaaaaggattaggcaaaaataatttattttgctcttgtttctaacaaggacttggagacttggtggtctgagctgtcccaagtcctccggttcttcctcgggattggcgggtccacttgccagggctctgggggcagatttgtggggacctcagcctgcaccctcttctcctctggcttccctctctgaaatagccgaactccaggctgggctgagccaaagccagagtggccacggcccagggagggtgagctggtgcctgctttgacgggccaggccctggagggcagagacaatcacgggcggtcctgcacagattcccaggccagggctgggtcacaggaaggaaacaacattttcttgaaaggggaaacgtctcccagatcgctcccttggctttgaggccgaagctgctgtgactgtgtccccttactgagcgcaagccacagcctgtcttgtcaggtggaccctgtaaatacatcctttttctgctaacccttcaaccccctcgcctcctactctgagacaaaagaaaaaatattaaaaaaatgcataggcttaactcgctgatgagttaattgttttatttttaaactctttttgggtccagttgattgtacgtagccacaggagccctgctatgaaaggaataaaacctacacacaaggttggagctttgcaattctttt

SEQ ID NO: 3934 - DNA, 1200 bp, Homo sapiens
ggtaattgggtaactggaggcggcttctccggccgggcggccccgccaccgcgacgccgagcccctgacgtcacccgattcgccaggaaatgaactttttaataatccgaggagggaggaaagccctcggtcccctcggctccgggggcgcccggctgggcccagctccgcgggcgcgcccccgtcaccccctcccaggccagttcagggcagcgccaaggggccgcgggctcaggctgaggcctcctcctgcctaggcgtctggcgtccgtttgtctgtccgaggcctcagcgcaggtaaagcgcggggctggggggcgcagagctccattgggctgggaaccagcgcgtctcgtgcccttgggggacccgcctgcccgagccgcctgctaagcctcccgctcccctccacgctggagcgcgcggagcccggtctgctcggaactccactctgcgggagcggaggccggcgccagcccgggaagccgcgcagggggcgggaggccgagcgcgaggcccttggcgccgggcctccgcggccaggccgggcaggtgagcagtctccgtgcctcccggttggcgttcccctcaacgcgtgcggtcccgccggggcccactgtctctccgtccgtctgtctctcaacttttcccatcctttagcttacgattcttcatcaactcgtaaaatgagatcgccgcggagctcgagcctatttggcgtctccggagactagcaagaccctctgaaagacaccgcgtccccagggataatcccccgtgtccggcaaagctgccccgctcgagcgcgaaccctgggacccagcgcgggaggcagaccagcagctggccgctgggctgtgaacgccaggaccgagcggaagcttcccgcccggccgcgatcggtgccgcggctctcagggaagtggctacgcgcgtccctcgggaaagcaggtaattcgcctttttctcccaccggcgcggtaaaaattaccctccccctccccgttccgtgtgtattcccagtttcagcgcagcgagctcggcgtctaacccctccgcggcagggtcccggccactgcggtagtggaggtggccagcctggctgagtcccctgcccaaacgtcagccctgtgctgccgcctgcctgacgcagagcggagcgagggaggggatttaattaccccgctcggcagctcagaa

SEQ ID NO: 3935 - DNA, 1176 bp, Homo sapiens
gctggatgcacaggtcaaggagctggtgctgaagtcggcggtggaggctgagcgcctggtggctggcaagctcaagaaagacacgtacattgagaatgagaagctcatctcaggaaagcgccaggagctggtcaccaagatcgaccacatcctggatgccctgtagcccctgcccgcatcctccagggggcccagggtgcctgcactttgctgtggcaggcagattgggtggtagtgggaggttgtgcatggaggccagtgaaagctgacatctgtaaaaggccttcaaggaagagaaaccaggccctgcgtcaggcagtgtgagtttgccgtttgtccttaactttctttttttttttttttaaaaaaagaaaactttaaaaaaactcccattaaaaacaaaacatctttgtgttttgaacaaaggaattttcaatatttgattggtattctgttctgaagtctaagatatttttcagcctataaagccccctgttttatgcccttctaattctgatgtttgggtattgtgtgagtgcatgtgtttttttttttttttttaaagcgtgtgtgaacaaatggaaataaagcagggactgtgaacatttgtttttggtctgttgaagatctctcataatttaattcttaattttgggaatagtgcttttatcaagtgctttttattcattaaataatggatttgcttctcagcaggtttgcaaggcaagcatttacattttacatattagaacactgagttattctagtaccagagtgttgaaagtggtgccagagtgttgaaagagttgacgtggcttatgtcacagaatggagtagtggagtgaggcctccatttttgtagtttttgcatccttcctgtgagtcatgttttactcagcatcaaggaaacagtgatgagcaaagcagagatggttcctctcaagaggcaagggattgaaaggtcatgtggggaatcgacagtgccagtgagtgccaggctttctgcccctctttcctctctgcaggagttcgctccctgtctccacctaatgaattcctgctcagcctcaggatgtgttacttaaggttactgtgtcagggagccatccgtggcctgccacactcagtcaagtcctgtggtaccctctcgttttcctttgtacctcttctccacct

SEQ ID NO: 3936 - DNA, 1406 bp, Homo sapiens
tccaggagtttaaggctgcagtggtttgtgttcgtggcactgcactccagcctgggtggcagagcaagaccctgtctcaagaaaaaagaaattgaactctccccaaaaatgatgtgagaatttaactgtggaggagaccagatactcttgggtgatgtgacctgtgatacttctcctagtagacactgaatgatgagaagctggggatcataggaatagctgtatttttcaaatgtttgttggtaacgagtgaggaacctgatgcatccagctccagagtaaggtttatttgccatggtaacactggataagtacattgttgcctgtatttccaagtaatttatcatttctgtattttagtaaacatacatatatacagaaaagtgcacaaataagtggacggcttagagaatttttataaacccagaggccctcttagtctcctttaagtcattatcatcgatgccctgatgcttgcgtagtgagtcttctgatttctagaactgtagactaattttgcctgatttggattttgtgtaaatggaatcatacactgtgtattcttgcgtatctggtttctttgactcagtgttgtttgtgagactttgtgttgttgtgtacagttgtaactggagtttccattgctcagtagtattatgtgatatatcataatgtatttaagtaaaaagactgagttttagggtatgtgtctgtattcatttgctagggctgccgtaacaagtatcacagatagagtggcttaaacagaaatttattttctcaattctgaaggttagaaatctgaggtcaagctgtcgggaggattagtttcttctgaagcctctccttggtttgtaaatgactgtcttctcttccctgtatcttcacaggatctttcctctgtattggctgtgtcctattctccttttcttttaggacaccagtcgtattggattgaggcccacccttatgacctcacttaacctcagttacttctttaaaggccctgtctgcaaataagtcacattctgatatattggggattagaatttcaacttaaaaattttaggtggacacagttcacttcataagagtatctattctgctctagtagatatggccagttttcaaaagttgtaccagcgtattcttccaccagcagtatataagaagtccaaatattccacatccttgctagcacttgtaactttttctctctaattttagttccctctggtagaaagccatttctttatggcaccatggtacagcttgtttactcaccagtgtaggggaacctcaagggactggggaaggttatcctggagtaaaacgtgtcagtttgagactacctcttgtaaatgctacttaaatccattggggttaaaagcagaggttcggccagg

SEQ ID NO: 3937 - DNA, 1242 bp, Homo sapiens
agcatctgaactggatgtggtagagctcccagatcatgatctgattgagaatgtccatgaacttctgtcctgattgctcagtgcagactgctgcttcttctggcaagactcctctcttcacattgacctggagttgtcacaaaatctgtttttctcttgctactcccctgagcatggcaccttctgccagagcgctcccttaactgtgtgggcaggctctgcttcacagctccccgcccactctgcccaagcagaagtgagcccctcctgggcagaaagtgcccgcaatgagggctgaaatgtttctattccctgagtaaccaacctttctctgtttccttgtccaggaaacggaggtggagctgtacaacgaatttcctgaacctatcaaactggacaagaatgaccgggccaaggcctcggcagaaagctgcagttgctgagggggcagtgagagttgagcacagagtccttcacaaaccaagaacacacgtaggccttcaacacaattcccctctcctcttccaaacaaaacatacattgatctctcacatccagctgccaaaagaaaaccccatcaaacacagttacaccccacatatctctcacacacacacacacacgcacacacacacacacagatctgacgtaatcaaactccagcccttgcccgtgatggctccttggggtctgcctgcccacccacatgagcccgcgagtatggcagcaggacaagccagcggtggaagtcattctgatatggagttggcattggaagcttattctttttgttcactggagagagagagaactgtttacagttaatctgtgtctaattatctgattttttttattggtcttgtggtctttttaccccccctttcccctccctccttgaaggctaccccttgggaaggctggtgccccatgccccattacaggctcacacccagtctgatcaggctgagttttgtatgtatctatctgttaatgcttgttacttttaactaatcagatctttttacagtatccatttattatgtaatgcttcttagaaaagaatcttatagtacatgttaatatatgcaaccaattaaaatgtataaattagtgtaagaaattcttggattatgtgtttaagtcctgtaatgcaggcctgtaaggtggagggttgaaccctgtttggattgcagagtgttactcagaattgggaaatccagctagcggcagtattctgtacag

SEQ ID NO: 3938 - DNA, 1205 bp, Homo sapiens
aatggtacacccctatagtcccagctactacagaggaggatccttgagcctgggggttggaggctgctgtgccctatgatagtgcctgttaatagcactccagcctgggcaacatagcaagatcttgattcttacaaaagagacagaaaaaaaaaaataaagtgggaaaatgaaagatagacagagacagtaagtatctcttgaaaaataggaggaagcatatttctttttttgtcattgttgttgttgttgtttgagatagggtctttgtcacccaggctggagtgcagtggggtgatgacggctcactgtactcttgaccttccaggctcagatgatcgtcctacctcagcctcttaaaaagcgtatttcttaatgaatatgaataatacttctatattttactcacttgccttctctgcttaagatagttcttttttttttaaaagcttataaataacacaaatttatttctcacagttctagaggttggaagtccacagattcactgtctggtgagggcctgtttcctggtttgtagatggtatcttcttgctgggtccttacactgtggaaaggctgagagatttccagtgatctctgcctcctggggtttatggcctgtgtcaactcctccctttgaaagtgggctggacctagtgactttattctacccaatagactatgactaaaggtgatgggatgctcctttgtaataaggttaccaaaaattattacttccctctgccagcagactctctctcttgccttcttggttggcacactggggagaagcgagctgcagcgttggagaggcccatgtggcaagggactgagagcagcctctggccaacagccggtaagcaaccagtgagcaaccgaggccctcagtcccacagcatgtgaggaactgagtcctgccaatgatcatgtgatactgaaggagggtctttctttagctgatcctacagatgagaatctagcccttgtgctgcctcatgagagaccctggagcagaggccccagctgagctatgcctggattcctacccacagaaactggaagacaataaaagtgtcgtttatgtttttttattctggtaaaaatcatataacatgaaatttttccattctaaccattaaaaacatgtctttttgtgtgtgtgagacagggtttcgttctgtcacccaggctagagtgcagtg

SEQ ID NO: 3939 - DNA, 1173 bp, Homo sapiens
cttcaactaccaaaatgttatctccacttccccctcacccgtagaggatcctggccacagacagtttcaagtagtgtcagatttttgttgcttgggcggctgttggtagagtgggcagtgcccgcgccatggggtgctctgtgggcttctccaggagcagggagggtggaggggagggatggggggcacaggagctgggagccccgtctccaggaaaaggagaggggttaagatgcaccgaggctgtagctgggctacttgatcttgctgaaagtgtttctaaagatagcaccacttttttttttaaagcttttatatattaaaaaacgtatcatgcaccaactgtgaatagctgccgcttgcgcagaggacccggggaggggtcccgagaggctccccatgcaacactggaaatgactgttccagagagcgggcagacctggcagagcgcccctggcgcctgagactaccacccactccgttcctgccagaaacgaccctctgtggccgatgggccatgcgggcccctcgcagccaactcagccagtgttgggactggctcagagcccatgggggctggaggggggcagctgggactctggaatcttctttataataaaagccttacggacaaacctactgtgggctccagcctttgtcctgagatagccaagcgggagaatgggcagtttctttaccagtttgtgagagagaggagggagggagcctgccgtccctcctgtctcagctgcactcttgaggtttgggcagacacctgactagcttctgagaaggcagtcagaggccaggagatgaaacgagacggtgcaggctgcatgcatgctgtgggcccggcccagagctgccattccttaagctctgaggacaccccgggacctccaggaagatttcacagctgctgtgtgctgcctgcaactgggtgggccctgctcctaacctcatctctaacaagcccgtcaggaatgtgctagcatccctgtatgacagacgcagcaacttgaggctcagcacagctgaagcaattctcaaggtcacacaaccaggaagggacagaataaggaccaggtcccatggtccttccgggccagagtctccacagtggtccccaaaatgggcggggaggccaaaggtgaccaccctggaaagggaact

SEQ ID NO: 3940 - DNA, 1350 bp, Homo sapiens
ggtggtatctggccctctgaaatgtcctcctggtattcagagccctccctgtgcctttcctatgggctgtttggaagcccaaggtttctcttttctgaatcgcttaacacgggtcagtcaggaagctggagtttcagccctgggggcatctcagggagtgggtgcagcccccctgttctactattgggaaaggtgaggcccagagacagggaggagctgggcctggagttcagcctcccagcctcgtctgaggccagggagcactcatggaggaaattggccccaccactgggcgggttatgccatctgcctgtgcccaccttcctcatctttaaacagggccaatgcgacctgcccataggatggagggtggtggcgagtgggaggcacggggtggggctggtggccgttaggactgaatgactagtgttttctcctcaggaaggcaggactgaaccaggcaggctggggtgcagtgagtcctcctgcctcttctctgaaatgcccctgtgtcaccctctccttctgtttcctctgcagagccctcaggactgcccccggaccctgctctcacccctggcacccgtgcctacgggtggctcccagaacatcctggtgcctctggccaacactgcctttttccaggtaagtagaagccaggccagcgccgggtggggccaggaggaggccggggagcacgcaggccactaactgcccccatgtcctggtgtgacccctgctctgggcccactgcagtgctttcgcacctgtgtgggctttgcttttctttctctgagtttccaccttctgcatgaggaagccccactctgactgcacggggctgcaagaagaggaagtggtgagggccaggccaagggggacagctgggggccaacagctgccaagggaaagccagtgcccccaggctctcctgccccgtgccacagccggagggtggacgctgccctatcctgtcctcccttagcctgagctgtgaccctggacacacccacccaccgccgagcccactgccccgtgggtggcttccatgtcttccctgcagaatgaccagagaaccccttggccaccccattccccattgtccagatggggaagatgaggcccaggaaggaaaagtagatgacgccagatcacacaacacagggctggacttgtgcttagctctggactccccaaccagtgctcgtctttgcaactagccccgcccccaccatctgggctgggggttggggacgcagctcctttctggacccctcctggaggcgcgtcctgggtgggaagcgttgacgagtcctggaggcgtgccagccacccccctccccacctccc

SEQ ID NO: 3941 - DNA, 1239 bp, Homo sapiens
cagaggctcagagcaggactcagggaggtcaccggaaggcagcattggaaccatctttagggcaaagctttaaagatttttctttttaaatttcttgtctgtgctttttgcaagcttaagccactgatgatgtgcctgcctggtttttgcacaggctcagctagttttcaaaagaaagcaataaatagtgggtccttctgtgcttgggcaaataaacacagttacggccggatgggcttctaggctggggctgtttccagcatgtccctgggggccaagccctgagcccagaggtgtgatgggctggggatgccctggaccaacatacaggagggaatggtcttccggaggatgacggcgggtgacccaggcaaggcacttcgcctctgagcctcattttactcaactataaaatgggtatatccatagtgttttccgcatagaggctgggatgaatcatttgttttaaagtgttcccaaacgccgggcgtggtggcacgtgcctgtagttcccagctacttgggaggctgaggctggaggatcacttgagtccaggagttctaggctgtagtgtgctatgctgatcgggtgtccacactaagttcagcatcaatatggtgacctcccgggagcgggggaccaccaggttgcctaaggaggggtgaactggcccaggtcggaaacggagcaggttaaagtgttcatacagtacctggcccacagtaagtgtccaggaagtgttagccgatactattgtgtttcagacatgactgctgcttatgttattattatgaagtaaaagttacccatgttcaactgctgatcaaaaaagaaagaaagaaaattcagggcaaatcatgcctaccttaaagcttttgagcagccatcctctcacctggacagccctcccagccctcttcattttccaagaccactcttgccccctacactgacatttcctatctgctaacacagctgccaaatgagccctttaaaaatgtaaagcaggtctcccccgattcaagccctcccatggtttccaggacactcagaataaatcctgaatcctaaatcctcccgtgggtcccctcatcttctaactccatttcacacctcccttgcccttgctccttcaccccagccacactggcctcatttctgtgcctcaaatatcacaagctcgttcctgcctcaggacctctggcctggccgctccctctgcccaggaagccattccc

SEQ ID NO: 3942 - DNA, 1138 bp, Homo sapiens
ttcagatattcatgactttgaatatgataaaagcctggggagtactcggttttttaaagttgctcgagccaagcaccgagaaggcctggtcgttgtgaaggtttttgcaattcaggatcccacattgcctttaaccagctataaacaagagctggaggaactgaaaatcaggcttaattctgcacagaattgtctacctttccagaaagcatcagaaaaagcatctgagaaagcagctatgctctttaggcagtatgtgcgagacaatctctatgatcgcatcagtacccgtccattcttgaataacattgagaagcgctggattgctttccagatcctgacagctgtggaccaagcacacaaatctggagttcgtcatggggacatcaagactgagaatgtgatggtcaccagttggaattgggttcttctaactgattttgccagttttaagcccacttatcttccagaagacaacccggcagatttcaattatttctttgacacatcacggaggagaacttgctatattgctcctgaacgttttgttgatggtgggatgtttgccactgagttagaatatatgagagatccttcaactccgcttgtagacttaaatagcaatcagagaacaagaggagagttgaagagagcaatggacatcttttcagcaggtatttgagtgggtcacatttgctaagggagcatgtgtttttcttttaactgttaaacagaaatgtggctttttttagtcaccagatattgaaaagttaatgtcttggtttgtcctcagacgctatttcagttagaggcagcattcctgcattggatatgtttaaatgcctaggaaatgcaaacagcagtttatttacacaaacatataaacatatttgcttgcctacttttattgtatgtgtcaggcactgtcctaagtgctagggatattggtggataatatattttcataatgcttccattttaaagtgaccgtggatattgcaaaaggacatttcaatgcggtgttgattgctgtggtggtgataagcatagggtgctgctataggaacacatagatatttaaattagtcctcatggtggtgttgagtcaagaggtgggatcaagaaaggcctctttaat

SEQ ID NO: 3943 - DNA, 1281 bp, Homo sapiens
gcgcgatctcggcttactgcaaactctgcctcctgggttcatgccattctcctgcctcagcctcccgagtagctgggactacaggtgcctgccaccacgcctggctatttttttgtatttttagtagagacggggtttcaccgtgttatccaggatggtctggatctcctgacctcgtgatccacccgcctcagcctcccaaagtactgggattacaggccgtgagccaccatgcccggcccgatttcatcttaattctaatctgttttataggttcatttcagctcagtgttgattttagctagaaacccaggtgaatctccattttcctgtgaatctccattttaccataacagagaagctgctttttaaaccagtaatttcttcaccttcccacccccacttctatttattaaattttaaaaatgtagcctgatttgggtgtattcttaaagaagtcaagtgtcctttctccatttggtacacagttactggttttttgagtgatatatgtacaagtcacttaaacttcttagagcataaagagagaaagtgaaaacttaatttggagggcatactcgtagaccttgcctgactgtgctcatgtccaggcaggggggacagtgtatgcaagaataatttggagttcctgccagctctaaccagcttcatcagtggctggataaattgcaggactctaaacatttccctgaagaaaaaaagaaaacttaatttggaaatggttctaattgaaaaacctctacttagagtatggattttgatttttaaaaattaaaaatcaaatattttgggctgggcatagtggctcacacctgtaatcccagcactttaggaggctagagtggacagatgacttgaggccaggagtttgagaccagcctgaccaacatagcgaaacttcatctctactaaaaagacaaaaaattagccgtggttgcaggtgctacttgggaggctgaggcctgagaattgcttgaacctgggaggtggggcttgcagtaagccaagatcacaccgctatactccagcctggtaaacagagcgagagtctgtctcaaaaaaaaaaaaaaaaaatcgaatatttcacaggtgatgcaacttgatattgaatacttggttgttttttcatgacaatagtgggaagatagacaatgtagtatgaagggtgtttgaggcagaaggaacaaaatgaacaaaggcatggaagagtggcttatttagggactcatggagtaatctgctatgactaagatttttcag

SEQ ID NO: 3944 - DNA, 1201 bp, Homo sapiens
ggttgagttcttagattggaactcaaaggaataggaatcagaggtgttcaaaattgagttttgggctttggaacattcagggtgctttgtttttctttttggtgtttttttttttttttttttacactgaagtgagatagttggtcctggatgaggtccctgttgaaaatctgataaaaatatgcacaatatacaatatgtgcaaatacataatatttgcctataatttcagaattgaacatgaacatctgaagtcaatttgtggattcccacttcagatctcctccatgtccaatacttgttggtagcccctaatgctcaaaacattcattgacgtgcccagagatctatgggcagctggtggtgtatttttttaaagctggaatattagactgaggatacagcattgagcttcaggtgctgggaagagaatgagtataaatgctctgggaaaaacaaaagatggtacggctaggaggaaactggggatgagtttaaattcgaaaggaatgttagacaccaaaggtatttatgaggtgttttgcaggtcataaaaatggaataaatggttttttgaaggttattggcatcaagggggtgtagctcagtggtagagcatttgactgcagatcaagaggtccctggttcaaatccaggtgccccctatgacatacttttgctcctcttggcagcttcattaaaaatcctggactagggtaaggcaagcaaggtgcgtaaggctcaaaatttaagcagatacttactctcaggttcatgcaagtgccttggctcactagttcccttatagcagagctaccatctcacataaactcaccctgcctctaatatgcacacacaaacccagtcataaaccatgacacatacacacacacgtgtgctttcttacatgtgtctttatctcttctttcctgtatattcaatcttattaaccaggcactttttcctctccctttcttcaagttttaaaatttattttagatttcatggaagagtttataaattctgtaaattttagatttacagaagaattgttaagatagcaatagagaggttttgtataccctttacctaccttgtaacatgttaacatgttacataatcatggtatatttatcaaaactatgaaatgaaatgtttgaggtgatggatatgctaattacccccaatatgatcattatac

SEQ ID NO: 3945 - DNA, 1174 bp, Homo sapiens
cacctctgcacacaagagtgtagacagttccttcaactttctcagattcttgttctttagagaacctggaacattagagctccctgtggacatgaaggagctgtcataaggaagaaggatttgccttgtccattggtttcctagaaggaattaggacacataagtgtaaagttacaggaaaacagcccaaaactcagggaaaggagaaacatgctaataaacctaaaagtggaatcagcttcttcaggaggacttgaattctgtcactggagaaacacaagtagaaatgggaccaacattttgtgagatattcatgactttttgaattatcatctgtaaattatatactactgagtctgttgttacaaatcactgtaaacatagttacatgtggcccatataataaaaattaggaaatatggccaggcgcagtggctcacacctgtaatcccagcactttgggagaccgaggcgggtgggttgcctgagctcaggagttcaagaccagcctgggcaacatggtgaaaccccgtctctactaaaatacaaaaaaaaacaaaaaaaattaaccaggcatggcgatgtgcacctgtagtcccagctactggggaggctgaggcaggagtattgcttgaacccgggagacagaggttgcgttcagccaagatcgtgccactgcactccagcctggcgacagagcgagactctgtctccagaaaaagaaaaaaaattaggaaatatgtattgagatgaaatagaaggtattatttcagacttccttaaaaagtcttctacagagaagtaggatatccacatcatctcccttctaagttttaagaaggcaagaaaaactattattaaatgttcactctttattattgctaacatgttagtgttaggtcaaatctgtggtgatggaattgtatttgtgtttgctgcacatgtatattttagtatgtcggtctccttatacatttttgaccatcttatgaaatttgcagtatgtattttttaccttaaattattataatctatgtttgctttttgtaaagtattattcagcattatatgatttatttgtatagttttttaactgaaaagctacagcccgctttatgacactacacctgggaataatttgtcaggagcccttttagtatacagcgaaggcaag

SEQ ID NO: 3946 - DNA, 1174 bp, Homo sapiens; identical to SEQ ID NO: 3945

SEQ ID NO: 3947 - DNA, 1136 bp, Homo sapiens
gaggtatgcagtgttaatatgcaaatatttatagcttaaacttttaaaacatagaataaaatggttttgttcactcattaatgaaccaagtatagtagattttgattaaatgaagatctcatttttgtttatcggtagttttagctacgatgtcgtttaaaaagctagagctgtcaagaatattgaaattactgccttgtaaatcaaaagactggtgaggaatgtaaaagactctgtctttcttctaaaaattagaagatagttgttaaagaaaatttactttataaccttgttgagcatggtcaaaacttgctgattatatattcctaagcatcaagaattctatatggttcttttttcactgtatttcccttatttgtcaatagcaagaagattctgtcactgagttaacagtggaagattctggtgaaagcttggaagacctcatggccaaaatgaagaatatgtagataatggactgggatatattgtatttctcatgttaaagcctcttcccttgaaattaaaaaaaaattttaactgataaaacttagggcaacattaattaatgtatattcttacctgaattgttatactttttgaaaatcctgtgacttgcctgtttctccccgctccaacgaaatcattaactctcctaaaatgtgtttcattctagtaagaaaacctcaaaggatattgtaggatataaatcttacttgaaaacatagctgttgaaatgttttggccttttggagtgggggaaggacaaatctgatcctgtaatctttttctttccagtaatcccttgtgtctgttgcatgaggacatggacaataaagtagtatatgatcctcagatacagggagaaggacaaggcatacagcttattgattagagctggcaagcatctgctcattatgtttggaattgctttctataagaaaattgcccactactactaacttgatcaacaatgaattcaaaatagttaacctatgaaataacatcctctcaaatgtttgctgatgaagtacaagttgaaatgtagttattggaaaagtctgtaacctgtggatcatatatattcaaagtgagacaaaggcaaataaaaagcagctattttcatgaatagacaa

SEQ ID NO: 3948 - DNA, 1198 bp, Homo sapiens
atctcccatgcagtcagcatccacagaaactcattggttagcagtttggagtttttccttccggtataatttacatgcatatagggatatatttttattttataaaattaagatcatactgaatttaaggacatatatcttacattttcacacatcttataatttactatgtcactaaatattcttagagaacttgaaagtattctattatatggagctcccagaatttattaacatactgcttttgttaaatgatagttatctgctgttttttacttttataaaagtgatgatcatccttgcacattagattaatatttgtgaatttttagggtaaatcactgtaagtaaaactattgggttaaatatatacatttttaataaacattgccagaatacttccaaaaagctgattccaatttgtaattcctgtagaagtacatgagagtatctatttcaatgtagtctactgacactgttactgttaaaaatatttcctagattcttagataaaacatggtatcttattttaatttgtatatctttgattacctgagaaattgaacttttccatatatttgttacttgtatttattattgtcctggctttttctgtactctagatcctctttacagggatcttctgttcaggtaggcttccccagtgagtgtgaattatggggcaataatagattgtaactaaccacaaaccaggccaagggacagctattcttatggacttgttgactagatcagtggcttttatgtctacttaatgcacatctgtcataactttctgtttcttatttattcttcccctgacatttattgattatgatgcataatatggtttagtaagctgctaaggaaaccatgtgatgggtgggataatttttcttatcaggaatttacaaattaattagtatcatacttgaaaactttgcatttgtcattaaagaagttaaataccactctacttattcaccagctacttattcaaatactttggcctagggaagactgtgagaggttatcaagttcatttttctgccattaggcaaaacctaatcaaacgaggctagaagaggcagtagagaaatgtaaagtattgcctctcccagcctcatttgattaggctttgactaaaggcagaaaatgaactgatgaagaaatatttctctgatttgagagacttctt

SEQ ID NO: 3949 - DNA, 1212 bp, Homo sapiens
gaagccactgtgggagaagttgttacaaatacatggctggtaagacaacactagtggttgaaataaagtatcgaaggatatctgaatgccaagaaggttaatgtttatttcttagacagttcagttacagtaaatcaatgcttggacttgaacactcttgattttgcttttagcaagggaaattcaaaattaaatgtgcaagcttcttggcctaatcccgatacagtagagattactgtttcccagggccacagcagcaacattccttcttaggaggtcactctagggtcatctcatactatttgtcttgttttctcataaccaaagcatcactggtaatttcactgttgatttttttttttttaacattccaagaattatgagaaaaatagtataaactaatacattagaaggaatgaaatttaaagcaacattcagtaactctaataatagatcttaccgattttaatagcctaatgtaattagtcgatgtatgtatatgtgtgtatgtatatatatactctaacattatgatatgaaatgtattgagaatgagcatacacaagtttgtattaaagtaaaatttcttcttatcaaaactaaattattgcttctgtacctgaaccagtgttaaccactggttgcttatttcaggttggctttactatttcttttgtttttaaaaggttacttgcatagactatcagactttgtttgatccaaagtcgaatcctctcttcacaccagttccagtaatgacaggaatgactcctttagaggattgtgttatttcatttagccagtgtgctggagcagaaaaagagtctttaacattcctagcaaacctccttggagcaaggtatgtaatatttttaatgcacctgttgtattggtgtatctttttatttattttgacttcttggagagcattcaaattagaatttggttgggtgtctttattatatttatgagtgttatgtggttccttctccactcccactgcttcacttgactagccttaaaaaaaaaaagtgcctctgttgtccaaagatgaaaacttaggtatcattagaggtaataactgcagtgggtccaaacacatgaaatagtgtttaagttgtgacttcataatgacaccaaataaagtaaggtaattggtcatctttgaaagatgctagagaaccagtccattactttgaaagctgacaaaag

SEQ ID NO: 3950 - DNA, 1196 bp, Homo sapiens
aactttttaagacagacttaataatgtggcatattttctagatatcacttttattaggttgaactgaaagggtttttgtaaattttttggccaaaattttttaaaacatacttactttggactaggggtacattcttacaaaataaataaacagtttttaaaattgtttagacacagatatttggaattagctatcttagtgccaactgctttttatttttttacttcatcaaggtgatgtaagtgactcacctttaaagtttttttagtgttattttttatcactactctgggaaatggtttgtcttcaagatgcaatacttttcttagtaaaggaaaaacagcataaaaagatacctggtctgccttgtacaagaaaaggcaatattagaggaagaaaatttaaagaaaagctagaggaaaaaaaaatttttttaaaaatacttattagaagcaaactgcccttgcatggaaaactgtttatttttttcagtgaaaaggaattctgctttcgtgtttttgggaaagcaggaactgagttcattacatctttaatttggcagaaattagcctttctgtgaaccagatgtggtttggggcagatctgtagtaaacaatggtgattttatttatttttactctctggaaaaggagataatacaattccagaaagtgaactcatatttctaaggttaagattcccttttattgcacctagaatagtgctatgcacagagcgggtgcttgagttgttgtcgttttttgtttgttttttaaatgtaaactggtaaattttgtgcttatcttcaaggctggcttaagtataaaattgttttttaaacacttgaaaaattaaaggatttgttttatattatgacagtattgaaattatttttcataatgaatgattggttattgtgtctggtaagtctttgaacattcaacagccagacatttgtgttttatttcatgatgttccagtcaagttccaaagccctaacacagttaagctggctcagactccaggttctagtaaaaagttggaattaatgttataaggaagtattaaaacactgaaacatttctccagaaccagcaagtaagggatatgtatgtatttatgctcagttttagttggcctaaagcagagttgaatgggctttctaaatagctaggcctgcaggtacctgccacta

SEQ ID NO: 3951 - DNA, 1214 bp, Homo sapiens
attttaaagtaagactgagggaatttaccactaagacactatctctaagagatttactaaaggaactatttcaggaatgaaggaaataattcagaaaagcaaagttagaggaaagtttacttgtttacccaatggtaaacatgtgggtaaatcattagtgtttctaaaaacaaggtaacactaaaatgttgaataacagcatttaagatgggagttggaaagctgaaagttttctaatgccctggtaccattccgaaagcaagcagaaatattgaataattttagatgttgtcaaatcaaccatgctttaaactgttaaagttgaccactgctagataagcagaagaaaaaaaggggattaatgaaaattaatcagtacaatagaaagtaggaataaaaaagcaaactgtatataaagcacaaactgagataatggaaataaatctaaaattactagcaatcagaataaataaaactgaaataaactcatcatttaaaagacaaatatcagattggttaagaataaatccagttatatactattggaagaaatacatccaaaagtctacggccataccaccctgaacgcgcccgatctcgtctgatctcggaagctaagcagggttgggcctggttagtacttggatgggagaaatacatccaaaaacacgatgactcacatgtattcgaagtaaacagataagaaaaaaaaacaggcaaatattattttttaaaactgggataactagactaatgccaaacaaaataaatattaagataaaagcattattaataataaaaaggatcattacataataataaatggaataattcttttaggaacacaataaattctgagtttctatgtacctaagacacagcctctaatcatataaagaataaaaaggcagaatctcaagaaaaaatggacaaatctctcattagaaagtgattttaacataattcattttgttatttataaatcaggcagatgaaaattggtaagtaaatggaagtaagcaacaacttaatttaatttagtggatgtatagagccctatccaatcacgagcaattatacattcttctccagtatatgtggaacaattgcaaaacctgatgacttaccaccaaacagcaaggctcaataaagactaaataatttgtcacacagatcatattctctgacctcaacacaatttaatcagaaatcaa

SEQ ID NO: 3952 - DNA, 1226 bp, Homo sapiens
agatacagtcatcacccactgatgccacatccccatcttctgtcatcccgtgcctgggaatgttcttcttcctcacagtacttccagactcctcaagtcatagcctcttccacgaaggaccctggaatttcttgtctggcaaaatacccattgtgcctgccccaccctcaaggtctctcagtattccttgcatagctctgtcttcatttattatttttttagaactgaggtcttactatgttgcccaggctggcattgaactcctaggctcaagtgatcctcctgcctcagcctcccatgcagctgggacttcaggcacatgccacagtgcccagcctatatagctatatctaagcactttctttgttacattttcattgcatattttaatgtttcattatggttttctaaaactttttattgagataattatgtattctcacgaagttttaagaaatattaagaaaaacccatttacccttcatccagtttatgctaatggtaacacctcatgtaactatagtaccaaatcataatcaggaaattaactttgatacaattgattgactttagtcagatatcaccagttttacatacacttgtgtgtgtgtgtgtgtgtgtgtgtgtgtatttagatctgttcagttttatcacatgtagagttgtatgactaccgccatagtcaagacacagaacagtttcatcacaagcttccctggtgatacccttttatagccatggccagcacctttcctccttcttctccctgatcactgacaatcaatgtgttcttgatctctataattttgtcattacaaggtgctgtataaatggaatcatatggtatgttaccttcagggatgggcttttttttcactcaacataatctcaacctggatggatctcatttccatacaagttgttgtgaatattaatggtccattccttttattgctgagtagcattctatggtatggatgtactacagattgcttcaccattcatccattgagagacatttgtgttgtttccagttttgggcaattaagaatgaagctgctataacattcatgtacatgtttttttatgtgaacatatattttgttttcatttttctagagatgactaatgagcatatgaaaggaagtttaacatcattagccattagaaaagtacaaattaagacaaatgcaaattaagaccacaatgatatatcactacacagc

SEQ ID NO: 3953 - DNA, 1220 bp, Homo sapiens
caaagttacattttctctggaactctcctaggccactccctgctgatgcaacatctgggtttgggcagaaaggagggtgcttcggagcccgccctttctgagcttcctgggccggctctagaacaattcaggcttcgctgcgactcagacctcagctccaacatatgcattctgaagaaagatggctgagatggacagaatgctttattttggaaagaaacaatgttctaggtcaaactgagtctaccaaatgcagactttcacaatggttctagaagaaatctggacaagtcttttcatgtggtttttctacgcattgattccatgtttgctcacaggtaagtatgaattagaatacatccaatagtttgggccttgaatataggttaagaaggcaaaaaatactttcccagggcctggggttgaaatatgtgtatagaatatcgtatatctgttttacaaaagatttatcacctcctaaacctctattcccacatcccaaagaaaaggcctgcattctgtttggaaatctctcttcttaatgtccacacaacaatctagaaagagaaatcatcaaaataaataaaagcagagctctgtgcactttgttacttatctcatcgtctggttttatatagtgcaatgtagttctttcagacttactgtgtgtgtcttggagatgttaactgtaagaacaaattaaaacaaagattctagcaaaatacacatgaataaaaagacaatttgtgagcttaacattggatacgagacttataaaaattggatttctctactggtcattgaagaaaaggtactccatagcattctaaaaaatatttggtttgggacatttcccctgccagtgagattacatagttttctctgctccactcctggttgcttgtacctatctgctttattgtcttaaaattggaactctgtagcctttgatgtttgttcatgtcaaatcacgtttaagagaaacttctaattttgatactccaagacactaggcactttgcagtgttgatgggagccttgagtactttctctctctctctctctctctgtctctctgtctcactctctgtgtgtgtgtgtgtgttttacacagaactaatttaattattctagttagtttacatcaggtaacaaatcagtactaagacaatttgcaaaggtgtagaactggcttaaacatcaaatttatggtgttcttt

SEQ ID NO: 3954 - DNA, 1188 bp, Homo sapiens
gtatgtgcattctttgtgtattcaacaaatctaaagatagaaactccttgaaaaattttaaaattctctgactataatgccccctgtaaattagtacccaaagacataggtctcttcccccccaatttcttaaactcctgatttcctcagatgttatcctcctttgttgcacatatgtctcttcttcagagtgatgagtttccttaactggtgattttttttttttttggtgttttactcatctttgtgttttgcagtccatttacctacttgagtgttgagtagcttactgccaatgattatgagggagggacaggacaagctgctgaggggcaggagtgctgttgcttgtcttctggtgtgggtattctctccttcccttctgagagttagcagctacctgtgacattgcactgctctgcagcccagtatgcatccttgctgctttagcctgtgaatatatgcctctgttgactgctgcttagcacaaacctgggaatggggagggcctgattgacccagctgttccacatgcaactcaccgattaatcatcctgatgtatgtctgagtgcccccaaccttcagctgtctgtgtccactggctctggcttgaaactcttccttaaccactcctacttttgcagatgtcttattgtacatctggcttagactatggcttccttcagttactgcctccctgccccaccattcaattccccacccccataaatataatctcgtctgattctaggagattgctgatagtctttccttattatctcatgcatttatgatttatatttgttaactgtaaatgtcatttcctcagaaagttttttcctagccacccaatttaaagtaatttctcactttctatcacatcacctcagtttattttcattgtagcattcatctctatttaatatttatggtcttttgtctttccagacctaaatgcatactcctttaggagccttatatgatctatttacagctatatcataagtggttagaacagtgcctgatatataatagacattcagtatatgatagttgaattaagtgactttatcttttttaaaaacattatatgtcacatttgcttgaattacataaattttagattttataccagaaaccaggcttatcaaatattccatcttaacatctctgtcaagacaaaaaaa

SEQ ID NO: 3955 - DNA, 1102 bp, Homo sapiens
gagtttgagattagcctgggcagggagaccctgtctctacaaaaaaatttaaaaattagtgggctgtggcggcatgtgcctatagtcccagctacttaggaaactgaggtgggaggattggttgaggcttcaatgagccataattgcaccactgcactgcagcctgggcaacagtctcaaaaagaaaatttacagaataagccaattcctggtagagagaagtattaagtttccatagagtttgaattaatatattttccttttattgccaggttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaatattatcttgggttctttgtaaaatttattttttacatgctgaattagcctcgatctttttgattaagagcacaaacttttttttgtaaaacatgtaaaaaaaaaaactgggattaatttttagtgttggaactgcctcttattttaggctgtagataaaat

SEQ ID NO: 3956 - DNA, 1112 bp, Homo sapiens
tcttaggatgccacaggtatagtatactactgttctatttatataaattatttaacattaagcttaaataaattggttgaaaatgtttagctagaaaaaataaaatggggcctatttttcttaactttatgagcagcatagatttatgcttcttaccctagctctaatatttatacataaccaaagccctaagagaagctgacagggaggaactgggcagcaggtatcctggcaagattcctcaaactaatagagccagggatcttggcctacagtagcaattttcaaactttttggtctcagaaacttcacactttttttggaggaccccaaagagattttgtttacttatatccatatttactgtgtttgaaattaaaacaaaaaaaattggccagttgtaatgggtcatgcctgtaactcagcactttgggaggccaaggcgggaggacagcttgaggctgggagtttaagaccagcctgggcaacatagcaagacctcatctctacaaaagaatataaaaataaaattagccatgtgtgttgtgagcctgtagtcccagctgctcacaaggctgaggcaggaggacggaagcccaggaggtcaggacttcagtgagccacgattatgccattgcactccagcctgggcaacagagcaagaccttgtctctgaaacatatatatatatatatatatatatatatatatatatatatatatatatatatatatatatatatataatattacaagtaaacctatatgtttattaatccattgtttattaaaaataactttcacctaatagacatctgtagaacatttcatccaacagctgtagaatatacattcttttcctcaacaaatggaacattctcaaggataaaccaaatgttaagccacaaaacaagtctcacaaaattcaaaagattaaaattcaatcaagtatattttctgaccataatgaaataaaaccagaaatcaataacaagaggaactttggaaactatacaaataaatggaaattaaacattatgtttctgaatggcccttgggtcaatgaagaaattaagagaaaattttaaattttcctgaagcaaatgaaaatg

SEQ ID NO: 3957 - DNA, 1321 bp, Homo sapiens
tagtggcctttcatttgacaggcttcttcactggtgtaatattttcaaggcttatccatgttgtcacatatatcatacttcattcctttttttctgactgcagcctcgacctccagagttcaagggatcctcccacctcagcctcccaagtgcataaccatgcctcccaaatgtgtaccaccatgcccagctaatttttctatcttttgtagagatggggttttgctatgtcacccaggttgatcttgaactcctgggttcgagcgatctgcctgccttgggattacaggtgtgagccatggtacctggccccttcattcctttttattgctgaatattccattctatgggcaataccacattttgtttatcctttcatcaggtgatggacatttgggttgtttctagtgtttggctattataaataatgctatatgaacactcatgaatgcatttgtgtgtggacatatactttgaattctcgtaggcatatacttaggagtagaattgcttgaatttttgttaactctatgtttatcatttttaaagaactgccaaattgttttccaaagtggctgcacttgtgagggcgatctggctgcgacatctgtcaccccattgattgccagggttgatttggctgatctggctggctaggcaggtgtccccttcctccctcagtgctccatgtgagtccttcccgaagctgcgtgctcggttgaagaggacaaccatcccaatagaagaggactggtctttggtcaagggtatacgagtagctgcactcccctgctagaacttccaaacaagctctcaaggtccaaagtggctgcaccatcttacattcccaccagcaatgtatgagggctccagtttcttcaattctcaccaacacttgtttttgtccatttaaaaaattacagccatcctagtggttgtgatgtggtatctcattcctggttcctatacctgaaacatcctttctttccttgcctatattcacctattgaaaaactatatttcaaatagtacctcctctatgaagccttttcttgatcaccctaactaaaagtgattgcttctttttttaaattctgcaaacattgcatatatatttctggtggtgtgtgtatttcccttatatcacatttctttgtatatttgttttacaattacactaaaaaattcctcaatggcagatacagtattttagtgatctctgaattcctagactccaaatccttctaaggaggtgtgtatgaggaggcgagaagataaggcagattatgatatgtacaaagaggaaatattagtacatatt

SEQ ID NO: 3958 - DNA, 1161 bp, Homo sapiens
ttagttccatcctccagagattttgattcagtagagcagtgataaggcacagaaatctgtctttataaacaagcgctctactgatgatcattgatgcagtgcatagtaagtacaaaataatctgtgtgtgtgtgtgtacaatagagtttaaattttagaagttcatagtcttattgcagtgatttttcactgtgccctgttaaagatcattttcgatcgtttaaggataaacagttttgatcacatgagtactttatcaattgggatttttttgtttgtttccttagatcaccatctggttcaaggacacctaaaaggtctaggcgatcacggtctagatctcctaaaaaatcaggaaagaagtccagatcccagtccagatctccacacaggtctcataaaaagtcaaagaaaaacaaacactgacgtaaatttttaagatgctgtcacttattggaaatgcgatttgttttgtgcctgaacggtctgttttttaaaaaaacaaaaaatcaaatgaaagagcattcctggggttttttgtttgtttgtgtatgcatgtgtaaactcatgagcaactgcatctgtagatctgtcattgttttatattgtgtaaattactttcattgtggctatttctcaagatgaaatttttattgttctaatggatttcatcagaaatgtgtataatggatctgctgacagtagtagtattttgttttaggatgttgtgacttagcaaaaataatacagatgtcttccccccttttgtagctttgacaatttgaattagatttcaaataaaatctgaacagaaaactataatgttgtttttttgccccaccggtgatattaagtcccttaaagtcctactgagtttcacactactgttgtgcttcttatacctgatgcactttataagccccagtgttcaagtagcttaagttttatatttactaagatgactatccaaattaagggacctgagactcctatttggtggtttgctaaccatttgcttttgataagtttctcttgggtaatactaatacccagatatcaaagactaggtagatatggcatggcgttttgttagtggaatgcctggctaaaacatttttttcacagaagcaatatgatttccatacatccaacccatgttct

SEQ ID NO: 3959 - DNA, 1156 bp, Homo sapiens
gagtgcatgggttttttaaccagatgtgttaggaggctgagatttttcacactggctcttaccatctagcaagatgttgtttcttctcaacccttggggtttggggaaaaggagggctgaagccttttggtgagtgtgttaatttgggtcctccaagaagcagatgctagaaagagattcattgcacaaaagattttcattcctttagagaatgtggggagtgagcatgaggatgccaggacagctgtcaggttttgatgcaggcctgatcctgtgaagagagagaaggaaggaaagctgggtaggaaatctttaggctgtggtgcaattctaggaaaagtttggcaagattaatgatgggtccctgagccatggttgcccttcagaggagtccccatctgcttgccttagtatccctgctgtgttcagtcatcggctgggagcctgacctcagtgtgaaagtggtgatggattccagagcagagaagctgagaccactggtcaattgcctcctcagagtgggaggtacattttcatctatctgagaggtacattttcatggatattacatctggtcacctctgccacaatggcagcaagcagcttcctctgttcacttcaatgtgcttcttctcgaacaatgaggccagagctagtgcagagggatagtcagggccatttaggtttggaggtcttgtatgaatttaaccacactaggcaccaggccatcactattatgacaaagacttgctttctctgcttgggaactaatagtggacacttcatgtttatttcttgttgtttcattgaaagcattttgtaaaaaaaaaaaaaaaaaaaaagagtgcctcgcccactaggaattacaaatgacattaatatggattctttccatttaggccccatgcagatagtatcttgtgcttcccgtctttgtagaagtagaaagaatagtaatggtgtcattcatggtacttgctgaataacttttaggaattaaatcctttctaagcaacgtgtgttgaaaaaatgatgttcttatgcaagcaccctaagccacgtagagtgtagatgatctatgttcccttcttgctcctgactagttttattgtcgtcattcaacactgagcatggaaggttgcctactgtgctgtgg

SEQ ID NO: 3960 - DNA, 1151 bp, Homo sapiens
ataaatgacttggagttttatgttcatgaaaaaattagggattatgttaagagtactattttttccattttagttaagtagtactacactcattgtttaaatgtaacttgctgtgtctgaggtataaatatagtctgtgggagtgagaggcaaaccagtcctacccaatttgatttgaatattttaaattatggaactgctaaatagatatttctataaatagataatttttatttatgtagctttttttggaagtaactttataaatttttataattcagaagactactatatgtgagaggcgtgatatctggatggaagttgggctggatgatctccaaagtcgtttcaactcttaaagacatcttaatcctgaatgtaaacaattgttatgtgtttagaatcagaatttgattttgaacttgagtaattcatccttacagctatctgtagaattagtcatcttttttcttttcttttttttttacttttttgttaataagcaaacttatttgctgcagaatttgggttgactcctgagcatatttaaaacaaagaagctagaaatttagcagtcagattaggtaggtggttttatttcaaagggaaactttaatccaaagaaagattaattactctaacaaacaagagaagcttcatgtttgatgatacagatttaagaatacctgagacttaagagtgttggaagtcatttgatagaaagatgagatcggagacaatgttgtgttatagggcacacattgaaggtatatgccaaatctctcaccagataagtccttttctccctgtgccgttttcttgctcaaagggaacagtgaattagccagctagaatcttcctggtccctttttgaggcagtagcaggtaaggaaagggctgattttcatcaaaaccaagacctttctgcagggatgatagtggaataataatgtgggattagcccgctagcattaggagcagttgggaagttacctggtagatcaagcattacacacaaaaaatcaagttgatcagagtatgggttctccatatagcaatacttcagtgagattaagtataaacagtttttggcaaaaaacaacacagtctactctttctgcttacaaagacaaagccttacaaactcacta

SEQ ID NO: 3961 - DNA, 1327 bp, Homo sapiens
agtacaggttcagtgtttgatagagtagtgtacctgtctttaatataataaaagatagtatatggagttttgcacttggatttaataatatacctttgatagttaattattccagtattttaataggtgatatatttcttctaatgcaacatttgcaacataaaaagatgttcacagtcaatatcttaattccgctgtttatatcattgctgttcaataaatggattgataatgtgagacacaaagataattttcagttttctagtagtcatactcttaagtaaaaagaaacattaagctaattttaatacatttgtatttaacccaatatatctaaaatataaaaagtattaatgtgctttttacaaaaaactaaatcttcagaatttggtggtggtgtatacttacagcacacctcaatttggcttagccacatttcaaggacgtaattgccccatgtgattattggctattgtgttggataaggtaggtctagattcttttgtgtggtagaatttttttgaagttgactagtctgttaagcagtcattcagctggggtagaatttttttaaacattttaaattgatatataacatatgtagaaaaaatgtataaattcataattaaatagctcagtcaattatgaggtaaacatattcctgtatctgctgcctaggtccccttgtggcccctcccaaccatttaccctctccctcttccccaaaagtaaccccactgtattgacttttaaataattttagcttcagaattatttaattgtaatggtgttttatatatagttatttaagatataatcttattttattaacaggttcaaacgggtacaacagatgttgctttggaatgaacttgataggatttaacagatcctagtagctttataagctattataagctttataagcttaatagctttataagccattaagatggatttttttttaaagaatagtactaaatagtgtagctgtattgtatttaggttcaataaattgttattcatagattttttttttaaacttgcttacaatgttataatttttggtttcttgctcttgcttctagctagtccagatcacatacttttgctccctcctttatccgttctacttaccacattatgtctggagttcagcatgttcagatgtctcttaaatggatgaaatccattaaaaggtttaataaaatgttagctatgagagatacagattttagcatacatttaaaaatttttaggcatatttatatttgttcttctgttaagtgttgctcatacttcgttctttcttatatagccacatgct

SEQ ID NO: 3962 - DNA, 1176 bp, Homo sapiens
taaaagagattgaagattcagggttaaatacatatagatttcactagtgatactgactttacatatgcattataaataatctgcctagggatgatgcatcattagagtcatgagttgccacttactcgctgcttctgccagtgaagaaaacaatagcagcttttttttcttagtactgaattctttttaattgccctgtagtccaaaagtgtgtttggtatgaatagcagctttttttctagcaaataagaaataaatgaatcttattttttattcttcttttccctgtaccagttcccaagaaatctcaacaaaatacaacaggataaaatattttaaaaagccagatttgcctgagaactctttctgattatttccaagccctgggcaaaggaactaatatttattattaaggttagattaaaagctgttaaaatgtagttataaaaaaagaagtctttaatagctagagtaaaattttataagtaaaaaattataaaatttaaaaaaattataaaaattaactattactccatttttatgaaatctactaaaatgctatgttgcttttttccagtctctgaaataaaaatctttcccctcctgtacatataatcttcaaaaatctcaatgattaagccataaaggaaaaatgcctggtaacttaaaatgtcagatatgaaatctacttttatcatttatatttcagggatctggctgctttaacatactaatggggcaagggagacagctcccagagagagctgcttaatagagggatgttaagtgaaaacataaggattttccatctgttaggaaacagtgtgtggtatctagttcttatggttagacttggagaaatacattaattgaatgacacaggaaatacaggaaaccacattttgcttgaagagcaatttttgaggacaataacgagtaatgaaaaaatgtgtaaggatgctggctgcttcagaagcaagaaaacaactaaaaggctactactatattatatatgctagaaatgggtaagttaatacttaaatcatttaactattaatcagcatgaacatttctgaaagaacttcaaaagtgaagatgaataagataggaagatttaagatcctgtccccaaagtgtggtaaataggaaagtttacagatactatattcaagttgt

SEQ ID NO: 3963 - DNA, 2084 bp, Homo sapiens
ttgattaacacttcttttgaaacacttttcttctttctctttcagtcttggtctttgtaatgggaaaagaaggggtccatggaggcggattgaataagaaggcatactcaatggcaaaatacttgagagactctgggttctagctgctaggcagactgttaagtattaggggaaaattgctcttaaactttcctagctataagcttaagtcttaattctggaaattttattagcaatgcagggtgatggggtatgaacctgtgtctcctttgtatccctctgttggtggggaaaggtgtctttctttctgccctccccccccaaaataattctgttcacttttgttttgtttccttgtgtactccagcattggttatagtcatgggaaaggaaggtgtccacggaggcacacttaacaagaaagcatatgaactcgctttatacctgaggaggtctgatgtgtaagcagcctctccccatctacctagcaactgtcttcatcaacaaccctaattatggtcacaatgctaccaaactgtagatggtagctaatttttctttacctattttctaatgtcatgattcctgtttgcccaatggatcatttgtatgttaaccactgtatgtaaccaacccttatctggcaacataattgcagcacaataatgatttgcatgataccttgaaattggggggagggggcatgccaagttgggcatcactttgtcttagcaattaatgggatattgattactaaaataagttaatattaagcaaggtgccggttgtacaatctctgatcagtgtcttttcagcactttgagcatttacttggctcatttagtcttccttttgtagcgcatggttgggaggaaaaagtgcatgcatcattccttcactcttctctttttcccgccccccctcccttcgcacataggcatttggtttgcttccatctttttttatgcagtgcctgtttttttttaaccaattaaaatcccttttgttgatgagctattgagagctgcagtagtttgcttttagtattgttgttgcacttgagcagagacaaacctttattcatagtgtctacaggacatatgaagagtgcaatggcaaaacaagagcaaaaagcacttcctcccatgaccttacagtaaccatactgattgaatccccagggacattccatcattgcaatagctcagatttttcttcctttttctttgcacaccagctctactctttagtaaaattgtaaaaggctgccattatggacattaggtatcccaacataaccatctggagtgtgtccagtttgttcttcataggaccaatttttatttgcagcttgagtttttatatgaagttgcattattgtggacttggctgtcttgtgatgaatttttttcatatgtattctgtgccatactattgttaaaatgaactgttgctattgtgagatggattttaactgacctattaagggtttctttcgaatggcactactttagggacattctagtatttgcttctattgtttgggccttgtggataatgtacagatttaaaaacaaatcttgttgctgatttgtccatttctttccctgcactttgttacatctgggatacagtctaactcatctgatttaatatgcatttaaaaaaatgccataactattaaacaccttgtttacagacagatgaaataaatttattccaaccaaatactctaggctcctgttgtttatatacattgtttatataaactgttaaaagttgatttttgacaaagtgggaatacacagaataggccaaagtctgctgcaagcataaaacttcagcaatattaggtgatggcctacttcaagtaatattacagataaaattagtgcctgggaatttctttttaatggactctgatctgttacacatagcttttagtcatttcaggctcatcttcaggagtatgtgagaagcaactgacttatctgctagaaaataagtattttcctcttcttgctggtttctagatgtgaaatctaatagtaaagggagtaccaagaagggtttctgcactattg

SEQ ID NO: 3964 - DNA, 1143 bp, Homo sapiens
aagcaactttaaatttgatgaaacatgatttactgtaatgggactgaatatgatagaccagctttgttcagagttgatagctgaatttttaccattacgtgaacactttcaggcaccagctgacttaatacagtttataaataactctttaagtttgcactttgtctagtgtcaactgtcaactctttacagtttctttgtatagactggtcttggttaagagacgacatcattaactgaagtcaaatcaactcatgtaaaatatgtgattatataggattaaataattatttagaaaagactgaatcttggttttacattagtgaaatgtggctatctggcagtggtagcataagcctagctacagcccttcctgttacatcaagccctaaaaggagttaactacaacttaatgtgtgtgtgttttttttttttctttttggtggggggcagccaatagaaatagatatgattgtaggaaaagaccgggaaggtttctttaccaacggtttgactcttggcgcgaagaaatgctcagtgatcagagatagtctatacgtcgatggtgactgcacaatggacatccggacaaagagtcaaggtggggagccaacatacaatgtggctgtcggcagagctggtagaggtgagtaaggcattcttttggttaaagttgcatgccacattacaacttattaagcagtttcttttaacattttgaataaaagttagtccataatggctattaaggtggtttttgtgaactgcccagcactatggagaagcactgctttagttttacctactctacagcatctatgacctggcctcttagatcctgattttgtttctacgatagaatattcgtatgaactcactttcagctttattaaacttaaaagtctcttaaactgcttgacatgtcaaatcataatcctgtggtgtttcagattgttaaattgttcgaatcacttggttattttagtcccttttggtgtgtgtttgacctttggatctcttttcttttttttcttgcttgtattctaaccatttcactactcagcataaagaaggaaaaattaacatccgttcatttttcagttaggaactttgctggggaaaagataattagatgaggatttt

SEQ ID NO: 3965 - DNA, 1193 bp, Homo sapiens
actgtctccagaaaaaagaaaagcaagagacacaaagaagaactggacggggctggaggagaagagtatcccatggatatttggctattgctggcctcctatatccgtcctgaggacattgtgaatttttccctgatttgtaagaatgcctggactgtcacttgcactgctgccttttggaccaggttgtaccgaaggcactacacgctggatgcttccctgcctttgcgtctgcgaccagagtcaatggagaagctgcactgtctccgggcttgtgtgatccgatctctgtaccatatgtatgagccatttgctgctcgaatctccaagaatccagccattccagaaagcacccccagcacattaaagaattccaaatgcttacttttctggtgcagaaagattgttgggaacagacaggaaccaatgtgggaattcaacttcaagttcaaaaaacagtcccctaggttaaagagcaagtgtacaggaggattgcagcctcccgttcagtacgaagatgttcataccaatccagaccaggactgctgcctactgcaggtcaccaccctcaatttcatctttattccgattgtcatgggaatgatatttactctgtttactatcaatgtgagcacggacatgcggcatcatcgagtgagactggtgttccaagattcccctgtccatggtggtcggaaactgcgcagtgaacagggtgtgcaagtcatcctggacccagtgcacagcgttcggctctttgactggtggcatcctcagtacccattctccctgagagcgtagttactgcttcccatcccttgggggcagcctcgagtgtagtccattagtaatcagattccagtttggacagggtggctggattgtatatctcgttagtaatgtacatgctcttcaggttctagggctcctgttaggggagggagaaatgttgaatcaagagggaaaacaactactatgatttataaacatattttaatgtaaaaatttgcattcaaaaggagtggccctgttttctgtgttaaaaccccatttggtgctattgagtttgttctttattcttttatcccagtgaaaattgttgatcttgctgtagggaaaaattaaactctttgaatctccaaacaaggaagtttcagcattcccttatggatcagaggaaccttagaggcctg

SEQ ID NO: 3966 - DNA, 1179 bp, Homo sapiens
atatgcaagctgttaatattgaagtagatgtttgttttccacattctaaaattactgagatttctgtttaacgtttcactttgcctttcttcttcacttaccaattggaagctttcctgataaatggatgagagccaagcagtttatataacctgaagatgattgaatttcagctttgtgagaatgaggaaacatgcatgtgttacaggccaggccttaaaaggatgcttataaaccaaaataattctatgctggaaaaacctgttggctttggtgctttaagttctttgtaaaatgattacttatctgcaagttctcttggatacttagacataaagttcagcgaagctaagataaaaaaataactcagggatatttcattgttttatttattcagacaggcctgtcttcacttcttattatactgaagttatgtaccatttgcaaatgtaagagtacctttggattcttcagctaccttaataaatatttgttagacaccagacctattttattcaaagcttattttaatatttgctctttctttttacagcaattttccagattattcaaagtatcaggatgggcatgtgaagtgactgaccttaagatgtttccattctcctgtgaattttaacttgaactcattcctgatgtttgataccctggttgaaaacaattcagtaaagcatcctgcctcagaatgactttcctatcatgcttcatgtgtcattccaaggtttcttcatgagtcattccaagttttctagtccataccacagtgccttgcaaaaaacaccacatgaataaagcaataaaatttgattgttaagatacagtagtggaccctacttattcagtcaattaagagtaagtttttttatgtggttattaaaacagtatgaacaattagtctaactctgcatagacagggtctagattttgttaacccaaatgtataactgcagttagcttaaattacaatttgaagtcttgtggtttttatatagctaggcactttattactcttttgaactgaaagcacactcccttataggttcatgtaactgtcctgtaataaggtgcttataaatggaacaactacacagcctagttttgccacaacctttagcatctaaaaagttttaaaagcttctaaatgtctaatataaagggaga

SEQ ID NO: 3967 - DNA, 1234 bp, Homo sapiens
agctctgggttcctccaatatttagaaaaaggggagatgaagagtaatcaggccagaaaaatgagaagaaacagcctgtgaggtacagggaaaatcaggggagaatagtcttggaagcaagggaagaaatgattccaggaagaagagatcatcagtgtttaatgccactgagaagtcattaaatttcatataaatttaatatttatattgaattcaatattcttcaaaatgtagacacaaataaatcttcaatacttactaagtgggaaacaaaaacaaataggaacccccatcaacaatataatctgtatattatctaatttttatgttttaaaaaagatgtataaaataggctgggcacggtggctcacgcctataatctcggcattttgggaggcccaggtaggcagatcacctgaggtcaggagttcgacaccagcctggccaacatggtgaaaccccgcctctactaaaaatacaaaattaactgagtgtggtggtgcacgcctgagccccagctactcaggaggctgaggcatgagaatcgcttgaacccgggaggtggaggttgcagtgagccaagatcactccactgcactccagtctgggcaacagagcgagactccatctgaaaaaaaaaaaagatgtataaaataatttataaatacatagtaagaaggaaggtacacactaaattttgtgtggtgcttactttggggaagggagttagaatagaagaagaaataaagggaatctcattttttaaaaaattatctttatttctgtattgtttgaatctttaaatctttaaatataaaaatatattcacaagttgcttgtaattaaaaaaaaaacctaaagggtgattatgagaacaatgagaaaagtaaaaaactttaataatgaactcttccttttgcatcaaaatgactcttttttgattaaaattaatttctaagtggggagaggaagggaggtgcaggggtgggggaaggaagtagagggagagagagaggggagaaagaagtatttttatattttgtgtaagaatgtatttactatggatgtaatgtaacaaaaggaggggatactgcagatttctaaccaagaaagaagtttgtctggagcctaaaaatttgactgcagtttccagacttactgaaaggaactggaaaagtgcttagcacattgtagaccctcgctctatgttgcctgaatttgaaatctccccttt

SEQ ID NO: 3968 - DNA, 1229 bp, Homo sapiens
cataattagtatcttgatattaaagagtaatgaaaatgggaatgatcaaaggaatataacaaagaatagaaaacaaggttctggtcctgtgtaagttctgtctttaagaaaatagaagttaaataacttccctagaggtacttcatgaactgtggacattcccagaggttctgagagatcttattggcggaatgtgatgagtaagtgaaagaatattgttaggggaattatgttagccttctcatttgataccatgtttctccaaaaacacaaataaacccttctgacaaaaacagttcaataatatatgccccaatattttccagggagaatacagttaaacatgaactatttaaaaatgaagacaacctcaaattatttttagcaattttgcatagggataatgaatagtttgttgtaccataatatatttagtgggcactcatgtaatactgtgcagagtttatagttcacatgaataaatgtttttcaggggtgtttttgaaatcctttgagttgttctggggtagttttttccaacttttagaaattatattcacctgtctacggccataccaccctgaacgcgcccgatctcgtctgatctcggaagctaagcagggtcgggcctggttagtacttggatggagaaattatattcacctgaggtgcatggtcccttaaataagtacagacatatcaattaattttacatgttttacctgagcacttaaatgccaataaaaaattaacaaattcatgatctgttatgactatacttctgtaattaactttgttatttatttttaatctgtagagatgtggtgaatcagaagtcttagatgagaaggagtctatttcttcatcctctcttgctggatccagtttgcctgttttccagaatgtgctgttaaggtttttagatacacaggccccctctttgtgtaagtagagaaaactctttgcctctagatcttaaataagggattgattttttttttctgattccttttttaaaaatttagatcttatttaatattcttggcactgaatataatgtatgttttactgagcaaaattttgtggcatgttttttcatggagacttttaggcaattttaaaatcagtcaagcttcaaagactttaaaataattgttaaaagtcacctcactccttcatgtaaggaagtaaggtcttgtgacatttgtctgtatattgaatgtgatttg

SEQ ID NO: 3969 - DNA, 1197 bp, Homo sapiens
tctcaaaatatttttttttagttgctgctcacttatggccacagaacagtccctttttgagtaaagcagcaaggttgcttaatgacatgctatgtggttaacaagattcaactgccacatcaaggactttaaataatttcaagattttaaatgtatttatgaaatgaactcattacagcagctaatcaatgcaaactttgtcctttttctttgtctttctaagagaaactgaatttaatttaaatttaaattacagtgtctaaaacttggtaaaatattttaaatttgaataagaggaaaaaaaaaacatgaatttatttatgatggagcttcatacccaggacagtagcttcttaaatgttagtaaaataattatgttaagcattaaaacaattttgaatatgtaattaagcatttatgttaaaaaacatgtttcttacgtgtgtgtgtatatatttataactgacacatgtgattctttgtacagtatttagaatccttcccttcagatagcagtcctcttgtattcagtcttgtggctaaaatagatcaaaaacatattttaaaactgttaaagtaactgtatgactcatgcttgaagttctgaaatttgggagcgttatgaggtttccatgccattaaccgctagatcatttgcattctctcacagagtaaacggaaaaaaatttagaaaacttgtaataatcctgacttctttaataaaatgtgtcctgtgtattgcttaaatccatagtccagccttttctgagttcttgagccatgagatggaggtggcctgtgtaatctactatttttagaaagttaggaaagcaaaccaaatactctctgagaggaccctatgaaatggctgtacccttcagctgtgctgcttcagactttggccaggctcccaggtgacttacgttaatagcagacttctagttagaagaggagaatttatttcattaaaaaaaaaaaaaataagtcaaacagttcaagaaagtattcatttatgtaaaagaagtcaattggtatgttactaaagataataggaagaaaattagctcactattttagttgcatactgatgattttaaggtttaaataattagatttaaatataccgtatgtaaatgtagaagtctgtatcgtaataaatctgttgctaagtaaaatgggaatacatgacaacgagga

SEQ ID NO: 3970 - DNA, 1158 bp, Homo sapiens
ccaaagttcttcctgaagatgtcaacactcttcctataaggccatctgtgattcaatatttttatcatgtaggtgaaaaaatagatgtcagaatcaactgagaaaggggtgagaggggtacgtattttccagtggaaatataggaccattcgaatagatcccttttatactgctgggtcaggtagtatgtcttaggctgtgtccattatgccacccaacacacagccactatcccaactaaacagatgcatgaactctgagggttaggaaatggatattccagtgtaagaaaacagatttaaataaaaataaaacacgttggtaagtgctttgaaaacacatgatctcatttggataaatctgtatgttttgcaccaaatattcttctctaattttggtctaatcactttacttttcctgcagtcatgcaacaatggttttgactacctttgttgggtcagggattattttacttgggtcaggcattattttatgtatacatcctgagtatactcctctgagtatacagaggaggtccttgtccactcaaagaaagataataaacatatgaacaaattaatgaactaattcaggttgtgatcatttctataaaggaaataattagagtacttaaatagagagtagtttgggaatactcttttagaagtgatggtctgaaaagttctccaaagctgtaggtctagcatctgagcgaaaactttaaaaaggttggatttatctgaaaaactggttaatcatcattcctggataagagagtaagaatgtcctgatatggaaacatcttggcaaagatgaagaattaaaaagaggttagtgtgtctggaaagttgtgagggtgagggaaaatggcattgagtattggagagttattcagaaatcgaaacctcaaaacctaaagggccttataatccaagttggaggtttgagctttattacagaagcatttattatggagtcattgtgattttatgacaatactctgtttaagcaaatggataatataaaatttgaaaacatgcttcagaagttaccatttcttaagtagttgcaaaacaaagttgcttgatctaaatttgttttgtttttaataactttaaaaataaagttactatgtaaacctcagtatttgttagtagt

SEQ ID NO: 3971 - DNA, 1183 bp, Homo sapiens
tcttatcattgttcaaaaaatgatatcattcatggctctagttacatacataaaacagaaacttttaatatccctctgaaaactcactaaatatatagtacttaaaatgtttttcagtaatatagacaggttagcataatgccaggattcattacataataagattgatcacaaggcatacttgacgttactattcttaaccttaacctaggtagactgctgttactgagcacagtaatttggaatctgtcagaaatagggaagcaaattattggcatggggaggaattactgtgtatctttcttaaaactgtgatgagggtagagggtataacgtttttctaaacagaagaaatacatgattcataaaaaggaaaaaataattacgtacattagctattatgtggcatgtaagaaattgatattggctacttccctgcctagtattttctctgcagttctaaaaagtcattgatgactgtccctctttgtttcattttgttttgttttttttttaagagttcaacctggtcattgctatcatctgtataatggtcttagagcaagtcttctagatgactatcaactgccagaaattttgagaactcctttggaagaactttgtttacaaataaaggtaaattaggtgggagaatgaagaaactaaatggaagtgatctcattttcaacatcttttgtagaacaaagtactgtattaatctccaagaaacaattattaactcacaatttatttcatgtgtgcattagtaaattgtgtgtttaaacttccttcaaatgtatattcaacacttttaaattatatactgctctagaggaggcaggctgcctgtgtttgaatcctgcttctaccccggaaaagctagttctgttatattgggcaggttgtttaaattaacctcctaaaatccttagaacagtgcctggcacgtggtaagtgtttagtaaacagtagctactgttattacatgttaacatgttatccttcattataaactacttatttcagtatcttgtgtcttttgatatagttagacttgttttgaagatagtgagtaatcagcttgttcactgagattttagccagctacttttgaagatagtgggtaatcaacttgttcattgagattttagccagctacttttcctattaatagagttgatgg

SEQ ID NO: 3972 - DNA, 1144 bp, Homo sapiens
tataaaatgtcacagattttagctaaaactagagtttcaaaaaagtgaagatattcaagaatgtttttattttaggtatgttccagaacaaaaagaacacagatcccagtttaagaggggtttcatgcaagggcatgtaaatagacaagaaaaagaagaaaaagaagcaatatataaagaacgttggccagattatgtaagggaactgcgaagaaggtaagtttattttgtctgaaggtgagaaatcagtggctaaataaaacaaaaagccagaggctgggggcatcttcttgaatctgtacgtacttaaaggagagcattgtgagtctcttattcgagctaaatattgtgctgatttgacttttaagcagtaattaccccagtaattctctccgatctgtagattatgttcctccatttgcagattgagttaattttaagcttttgtagcaagttaacagaaaacttgattaagtatttcatgactttgtgtttaactttgataggtattctgcaagtactgtagatgttatagaaatgatggaggatgataaagttgatctgaatttgattgttgccctcatccgatacattgttttggaagaagaggttagttttatttttctttcttcagttaacataattttaattttattaacgtatcaaggccatgaaaaatacagttttcttaaatgcttatgaaatagactggaagaaattacttttgatactagaaatcatctcatagtagcaaaagatttaggcatttgacctgtttgaagaaaagactaaacaaatatatggattataaatctcattttttaaaagtgagcttagctggatgcagtggctcatgcctgtaatcccagcactctgggaggccaaggcaggtggatcacttgaggccaggagttcgagaccagcctggccaatgtggcaaaaccctgtctctactaaaaatacaaaaatttgctgggcgtggtgacacaggcctgtaatcccagctacttgggaggccgagcatgagaatcacttgaacccaggaggcagatgctgcagtgatccgagatcatgccattgtactccatcctgggtgacagagcaagactctctcaaaaacaataattaaaaaaaaaaagcttat

SEQ ID NO: 3973 - DNA, 1100 bp, Homo sapiens
gtcaaacttctagtttccccatcagtatatatccctcataaaaatgttgtgcctattgatagggtgaccgaataacttattgtccaaactgggacactttgagattgaaaggatgcactgttaataataatgcccatgtaataaacataaaccaggactatattttggcgcagctggattgtgtgctcatcctaccattagatcatgcatgtaagatatatatacacatgatcactatattacatagtcaataagtggtaagatttattaagtttaagtgtttaatatatgcccatgcatggatatatattaaaatcttccctttaaaaggggtattttgaattggtaactcagaaagtcctaagttttcattcctatgtgtttttggagctgacagtgatcattaatttttttttaagtactgtagctttaattttcataattaagactttgtatttgtattgatatttgcagctggagaatgctggaggagaccttaaggatggccaccaccactatgaaggagctgttgtcattctggatgctggtgctcagtacgggaaagtcatagaccgaagagtgagggaactgttcgtgcagtctgaaattttccccttggaaacaccagcatttgctataaaggaacaaggattccggtagacttttcactaatcttttcatgaggagattgaacttagattgtggaatattttattattaattttcttgagcactgaatttttctacgaaaataagatatggaatggttttatgagaaatttcccatggctctgatttggggagaaaaaggaaaaatttaagctttcagtttaaaaagattaattttaattgtacagttaaaagaacttatcatttgagtattttatgttttataggatttgtgggtcagagttagatgtagctgttgtggccattcattcatttacttaaaagcatttcatcaaaggaaagtaggaagttggctagaatactccaaagagaagaaatctgtgtacaataagtgtttttgcttcctatcccaatagactagtttctaaagtatggagatttcttaaatctaatatatgggctaattttga

SEQ ID NO: 3974 - DNA, 1176 bp, Homo sapiens
aacaaaaaaacccaaaaagttttctttactgttggttaaaaaaaaaagccagaccatagtttgactggtggcatggaatttgtgtatcaaataaatgcatttgcttatttgacaaaccatcagtgtccactatttgttaccagagttgggccactatcttttaaaattgctggtgaaaacttgccactagatggcagtgcctgtatagatggggaaaaaattgccaccattcttggtataatacagtgtagcttagatgaggtggtgaaataggggtatcagccgaatattcctaatatagtttctcttgaattaataaactgaagatttgtaggaaaatgagtgagcaaaatttgtttactgttgtgaatttttcctacagcactgtttttaatcttgatgttttccaactttctgtactaatagatacatttctgtgcataagattataaagcatatactcacagttcagtagttttcgttaaggatttactgtgtgagtactttactgtgaggaattgcagaaccttttcccctctactcttgtctaaaagttctgtgtggcacacagagatgcgacctactcaatctgacttagtaaaaccatgctgtagaatttttgtcttaaaaagaccacatacccagcacccatgaaataaaagattcatctgtaattgggattcaaagtgattaaattcctttgttcatactcataaatagcactaaagtgttataacattttcatttacctatttttagttccttcattttaacttaataaaaatcttggattgatattcttttttttttttttttttttttgagacagcgtctcgctctgtcacccaggctggagtacagtggctctatcttggctcactgcgagctccgcctcccaggttcacgccattctcctgcctcagcctgccgagtagctgggactacaggcgcccgccaccacacccggctaatttttttgtatttttagtagagacggggtttcaccctgttagccaggatggtctcgatctcctgacctcgtgatccacctgcctcggcctcccaaagtgctggaattacaggcgtgagccaccgcgcccggcctagattgatattcttaagcaataaaagtttactggttgtcctatttgccatattattgaaacttggaaagga

SEQ ID NO: 3975 - DNA, 1181 bp, Homo sapiens
ttgaaattaaatgaattgaaagggaaactcagagtactaggacgtttattaaaaggaaaaaaatgtcttgcaatgtgctgtaatcacaagaggagaaaataacttgtttccttgatctgtcagaggtcacagtaacctgggccgagctgttattatttattatataatagtagtaggaagttaataactggttctctgtgttccaagcacaatattacaacttcttttgaaccgtaaatatcagaatgaatcctcttcccaggggattgaacagaagcttaatgtttacaagtgtttgaatttgtgatctgaaataacacaaaattaaaaacatgatttctctaattttccaactagaggaagagaaacttgtggaaaagttctttttttttcttttttttttcttaaagaagggcagccaaggtagtaacctaaaaatagtgcccaggcatatgagagttgtcctacgaggttaaagaacacactgttccactgtatggctttggccctgagtggccagggaggtcaacttgaccctgccatgttggtttgacttactaagacacaggaatcactgttttccttgaccagggtctcacaccctggaggaatgttaagtaagagaaagaacctctttcctgaatattgacatgtaaaagaccaaagtaatttttctgaacttctgcaattctgagaactctccaaggaatttacagtgattttagtgcttgtcagcatttttccatgaggactttcatacatttgactctttagttcacaggttcccattgattgtgagcaagatatttatctctttagcccttggggatccagctgagagcaatctcttgcatttttttacccgtgtatgtacagatatcatttcttgtgtatgccatgacttgaaaaagtttgggaagctctttagcaatatcagctaaaaggatatgaaatcacaggtgatagcagttgtcattcagtaatttcctacaagcagcaccccaaaggaaatatagtcctaatctttactatccacttctaaatttaatgtgaatttcatacatgttattagttgttttctttataattttataaaaattattcatcgggagtttaacttccacttccatgctatcggatgtgttgggctccatgcaagaacttggaagaaaaacaggcag

SEQ ID NO: 3976 - DNA, 1186 bp, Homo sapiens
atataggatacgagcctctgcctagccttcagtcctttttgtttggtttaggtgttggttgtctttgtaaacactggaagctgctgagtcatctccctcggctttttccatcacactttaccccacatacattcatacacacttggctcaagcttttcggttctttctctggacactagatgactgtcagccttacctgggccctgccccagaggctgccccagcatctggtaggagcttagtgagcggaatggattcctagtgaaataatgaatgtctttccttgtattctgtgtttgaaacctccaggatagcaattccatctgctatatgaaataagaaaaagtaaatattctttggttaacctttgtcattcgcctacttaaacctcaatcacatttctttgaaatcatgccagatttgtggagagcaaattgccaggtaaatggagggcaaattcaccaaactaattcttagttttttccttctctaagggaaggaacactttgcagcttaacagcattttcaaagtttcaaacaggactggctactgagttgaagaagcattagttggcccttaagtcctcccctctggccactgttgtccacttcacacatttggaccaacttccctcatctgagcctgaatcctattagccagcactgaaaatctggcatggtttcaaagaaatgtgattgaggtttatgtaggggaatgatgaaggttaaccaaggaatgtttactttttctgatttcatatagcagatggaattgctatcctagaggtttcaaaataatcttatcgagatgacttttgacccgtcttcaatagcattacaacaatccccgcagcctggagactaagctctgctgctgttttgagtgagctggccccacagagggtgtgacgtgggagtagagatgagtgtcggcctcaaagtctgctcccatctctcaggaaagcaccttctttagattaaggtattggggctgacactaaaatagatgatatttgaggctaagttttcaatttcactctttccagaaaaacaaagtactgatagggatctactctaaaagctggttttaaatacaaggcgttacagaagtgccaaatgcagtcactgcacttaaaatcatggcctgtggatagaaacaaagctgaagagtggcctgccgagtgta

SEQ ID NO: 3977 - DNA, 1186 bp, Homo sapiens; identical to SEQ ID NO: 3976

SEQ ID NO: 3978 - DNA, 1127 bp, Homo sapiens
gtggctgtttacctaaattgttttaaagtatttaagatcatgtgttgtaagtaattctccaaagtgaaccgtttgctataaatcttattttaaaattcttactgacgtttttcttactctacttaagtactatacttaaatacttaaaaagcagtttttgtttactttagtaggatcttaaaaagaagctttttttttttttttttgagacagagtctcactctgtcacccaggctggagtacagtggtgtgatctcaactcactgcaaccctctacctcctgggttcaagtgattctcctgcctcagcctcctgagcagctcagattataggcacccgccaacatgcccggctaatttttgtatttttagtagagacggggtttcaccatgttggccaggctggtctcgaactctcgacctcaggtgatccacccgccccagcctcccaaagtgctgggattacaggcatgagccaccgcgcctggccaaaatgaagcattttttaaaccaaactgtttctttgctagtgtgatctagcatgtattcattccactgtgctctatttctttacattcatgataaagtgaaggacaagttggggaaatctgagcagtcagatcctcattatttcacatgggaaggtggcaattaataatattttctcaaacacatgaccctatattttgtcagcaagagtccccagttatgtgtcaaggagatatgacaggccccactatcatcattcttagacatttagactaattctgctcaaagtatcctttgtagactttattgcaggtctgtgaaagaataggtaaataaattgaaagtaagggctgagaaatttttgtagcaatttgacattgttataatgtccaatttttctaatattttatttttattgtatcttacgaaatatccatatgcaatggattcgaaataaagaaaaatctggtccttcatcagaactaggaaagcactgatttaaacatttggtcagacattttaaattggtaggtgttttcatttatattatcttgtttgcttatttaactattaagtgaagatgtaattatttttattcccccttaaatagtttttactgtcttttcaaaaaaaatgtgc

SEQ ID NO: 3979 - DNA, 1168 bp, Homo sapiens
acttaatagagtctgctttggaatatggacatgttctaatgtcagattataaaactttacaggttagaatacctgtgtgataaagtgtcaatggataatgcagtagctttcatgatgggatacttcatagttagtggattttcactgtttgcttatttaatatatattgagtactcatgtgccctgcaccccatgttaatgacaaagctaggcctcaaatgtctttattcctcagcgtaatgatcgatctcacaaagctcttgtgaaatcagttgggaaaagactatgtacagtgaatattgacaactaggcaaaaactgaatctagtccacttgtgagaatttcttatttctatatactgtgcttatagaatctcctttcttaaatcgaatataaaatgtatggtttcatttcagtgtaggtttgaaagtaaatatctgtccagatttaatgaactcatattttaacagagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggaggtaaatctttgcttctctgttgcatcagaacatcattcgtccacttcagctttatacatttttgtttttaatctccgcgtcagaggtgactagtgataaattttcttcattttgtataatctcaaaagaatgaggtcagcatttcagtattccatatgtgaactgagactatcaagaaactatattatccccagaagcaccatatagtaagtaaatcaccaccaccaccccactgtagaaataatttaaacaaaagaaagtttgtgtttctttaaatcttaagtatagacaatttaaagataaataaaaaacaagtgtatatgtatttatataatgaatatacaaacaactatcttaatgtgttttgggttttgaatttatggatgtagtttctttgcttgcattccaaaatgttataaactaactaagatgtatagcttatcggtgcctgtcccccatccttg

SEQ ID NO: 3980 - DNA, 1197 bp, Homo sapiens
tatgccttccaaattatgcaagtacttttgattgaattgacctaaattatgtctaaaccctagccacagaggaatctgggaaatgttaacttttactcttcgttgtcacaggaaggaacgctaattcatcttatatcctccactttgttttaatgtggagaactgcgaagttatgttagcagaagaaaataaccacaatttcttcattgtgggcaagttaatattgagttaggcacatagtgtatctaaggctaaaaatcattatgaactcagtagtcaaggaagtgccctaagaaaaagttgtaaagatattttaaaagaagctgagaacatgaagccattaagaaatggtgtgtttacagccgagctagtgtgtttaactttgtgcattgttgtaacaccatttgttttgatacaggatatcgtttttttttttaaggtgctttttcccatatgcctaaaatttgttttaatgcatcacgtcaagtcatagcaactgaagaaatgtacatctaacaaatgatgttcattagcataaaaacacaaattaggttctttattttttaatttcagaatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacaggtagagtatgcatgttaccctaacttgttttccctttccctgccttcacattggaaagggggttactatgtaatgttccataaaatgtttctcttactgttaatttattgaacctgtctgacacattacctaatgggacttccatgacggaaaacctataatgaacatttatcctatggccaattaaaaaggctggtaaacaggtatgccataggaaagtacaggtagactgtaactccccagttgctgtgagggcatagaaatcagttttgtttctctggtctcggggagggagtagttggtccttaatttaaatagatacaggccttaaaagaataagtaaaagaggtaaaaatgggatcacttagcaaaattaattctcttggtaacttacattttagtttttatttttattttttgatacagagtcttgc

SEQ ID NO: 3981 - DNA, 1099 bp, Homo sapiens
acattacacatggaattctttatttcttacaattgagctttttctttattgtctaataactccatctccatctcctctggtatcagtggagaccaaattattttttatttgaaccaaatatttccattttggaggagtaaaatataaattaaaaatgcaaattagtagcagaatcacagctagaatcctaggtcatcttcctagatcttttccactagaagtcaaaataaccaaattcctttcacactcaaatactgttttatgaattattcctgccatcattcctttacatgttatcaatgtaatgtttattgtccaaaaaatatttgaggttacatgtttgtgtgatttacctgttattacttaatgtttgacttttctttgtttctctttaggaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctataattgcttctagattacaaaaatatgacaatcttgtaagtagcagactatggagaaaaatgagttacctggagggtcaggtaacttgccaaactaaaaagtatgttagttgaggcaaagtcctaagcaaggttgtgctatcaaggctcagcataccttcgtgggcctttgatttaccaacactggaaatgcctgccaactaatcttggatagattctttaaggcattccacttagcttgccagttgagacaatcaccacagttattacccaaatactatgaacatatttttgtaaaccagtcattctgaattatagtgatgagaatttaaatatatgcttttctagaatttgatgtttgaccatttatgacttaattaccagagag

SEQ ID NO: 3982 - DNA, 1334 bp, Homo sapiens
aaaatacaaaaattagccggacagggtcgtgcactgctatagtcccagatactctggaggctggggtgggaggatcacttgagcctgagaggcagaggttacagtgagctgagatcgcaccactgcactctaccctgggcgacagagcaagaccttgtctcaaaaaaaaaaaaaaggatttcacatagaatgtcatctcattgtgcatttcagactgctgcacttagagctgtgggcaacattgttactggaactgatgagcaaacacaagtagttttgaactgtgatgctctttcacacttcccagcactcctgacacatcccaaagagaaaattaataaagtaagtactattaaatactacttaatagatagcacttaaaatgttaacagtttctatttgtaaaattagagtcttagaaatgtctgtaatattgattcttaatacaaactgtcatttagacatcaagagaaaataaaaattttactctccataacaagcattaataattttttcatacataaaaccagttatgaaaagtgcaattttggctctcttggaaatgatgaaatagagataattgggtgttgaatgttgtatgactggaaatttttaatatgtatattatgtaattcttataagtttagtgttttataggtacttaatagagagtgtgtatgcatgtgtgtgtgcttgtggtggctatggaaagggggcactgactggtgatgctgatattggagtgcatctgaggctgttgtagaaataacatgggttgttgattacaacattgccaatgattataacccaagaacagctcacctaactagcctggcaccctaaaatctctaacaggttcattaaaatggtcctgtgatctgatccaaaagagcctagtatacattagctaatactaatattttttagagtaaaacttattagttatctatgattataacgcgtaaggccaccattattttgtcaaaagtagcaccaactgtgatgtaaagggtaacataaaaagattaagataggccaataaaacaatcaaatatctggttccacttttccttgagagaaattatgcagtgaatgactattacaaataagtatactaaaacaatgcactttgttttttatgtctccattgttgtggataattgatatttatctactttggctaagattcttcatcagaatagaatagagaataaagcacattatgtgagggaagggcactgaatcttatttacagctgttttaggatttgtatttgtattatactcattattcatatttgctcattcattatttcatatttgctcattcaaatt

SEQ ID NO: 3983 - DNA, 1334 bp, Homo sapiens; identical to SEQ ID NO: 3982

SEQ ID NO: 3984 - DNA, 1227 bp, Homo sapiens
tttgtcttactaacttcccatgaataaggggaaagagccaatatattacaaaatttaattggaatgcataagagaagataaaagcaaataagatttcatttgatatttaaaataacaaggttttgcatttaaataaaaatctaccttaaaacacagcatatggacccttttcacaacatggcgccgaaagcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctctatgacattgatgtggccaaggtcaacatcctgattcggcctgatggagagaagaaggcatatgttcgactggctcctgattacgatgctttggatgttgccaacaaaattgggatcatctaaactgagtccagctgcctaattctgaatatatatatatatatatcttttcaccataaaaaaaaaaacacagcatatgttcaagttagaagaaaaacaagttttctcttactttgtagagaggacagatgtgcccagaactatttattccaaaaactttcactaagtatcataacttacatatcattttcttatggccaaatgttatatattgagtggattaagttataaattttagcattatggaacaatctatgggaagctatagagtttaaaattgctatttaaaaaaaccacaaaacttagtagaaattccaaataactcgaagactctgttcaacaagtgaatgaaaaagaaaataatatttcctacccaggaaaatctacttgacttgataaattgacttcaggttacaaaatcaccagatgtcactaaggctatcctacagtaaaactttccttccattcttaaaatgataaaaaataggctaaaggatttttgccatgttcttcagagtctcatcgcaacacatcaatttcattaggagaactatcatttactacaagcacagactaccaatg

SEQ ID NO: 3985 - DNA, 1172 bp, Homo sapiens
tttgctcctcttttgctttctgttgtgattgtgaggcctcctcagccgtgttgaactgtgagtcaattaaacctcttttctttataaattacgcagtctgaggaatgtctttagtagcagcgtgagaacggactgatacatcatgccatataaaaatttaaacactgtaaaaatacatcaaaacttactataaaggatgcattttagaaagaaaatttaactaaatgtatagccattttgattgagggagaaaggaaagaaagttatccagggacctacatttttaccaaacaattccaaataaagaaaataaaagtagtaagaattttatatttatctttgtaaatcaatgagttttggagtggtatggcacatgattgacaactagaaccattactctcctttattccagtattttaaataatttgggattatatatcaaaatatgatcaggtaattgttcccaggtcagcagttgtatttagtcagctcaggctttcctaacaaaataccacacacaggatggcttaaacatagaaatttactatctcccagttgttgaggtgagatgtccaagatcaagacgttgataggttggacagtcttggtatcttctgaagcctctagctttgcattgcagatgagtccttctctctgtgtctcacatggtcttttctctgtgcatatgcatcctggcgtctcttcatgtgtctaaatgtcctcttcatataaagacaccagtcagattggttcatggtccaacctaatagcttcattttaacattatgtcctcgttaaagaatttatatacaaatataatctcaatctgaggtactgggggttagggcttcaacatacaaattttgggaagacacaattcagcccataacaactgtgaaatttgaaacctccctcagaagcaaggctgtgggttgtttgagatttaggacccaggcgtagagttgaggagagggtcaagtttgaaagagacaggagagagtgaaaaatttgtcaccacaaatctttcctgatttcccgttcctttttatctttttgtggcaaaattttatctatatatctttctatctgtctatctaccatactaagtgtaaatatttcttcccttctacttttttcttctatatctgttcttccttaccccttggttttgc

SEQ ID NO: 3986 - DNA, 1223 bp, Homo sapiens
cgggcccaatgagcaaggaggccgagtgggacttcctcccggaatcccgttggccagaatagccgggccgtgggtgacacgtaagttgggcaggaggtggcggggcggcagaggcaccagccgacccgtcagtgacaccgctgtgccgtccccaaaaccagccgagacagctggcccccacccttccacccattgggcaggccgcacgggggcgcggcccggagtcctggtccctttgttgggcgcgcaccccctcccttaggtggcaacaaagtcgtgcagtgggagccgccgcgatagggcggggagtggccagggcgggactccaagaactgcccgggggcagcggggccaaaaagtgggaagaaggaaaaaaggcaggaggcatctggggacaggcgcgagggcagccggctctgaagtatgcggagggcctcctcccggccccgggcattcgcggagaacgagcctcgcagaagtttggctgcagctgcccgggcggcgtcgatggctgcgcgccccgcgccgcgcgggggctgagcgggcgccacttcccctccgggccggcttttgtgtctggcatctcctcctcatgctgcgtctggccacctactgcggcggccgctgctgagacgctcgctcggaccaaggggaggagacggcgggggcggccgcggctttgggtccaggcgggactatgggaaacgggatgtgctcccgaaagcagaagcggattttccagacgctgctgctgctgaccgtcgtgttcggctttctctacggcgcgatgctctactacgagctgcagacgcagctgcggaaagccgaggcggtggcgctcaagtaccagcagcaccaggagtccctctccgcccagttacaaggtacggctaacgggacgcgcgcagccggtggccaactttgccccgcgcctccacccgggcaggaaaagtggctttggtgagctattggcactgtggttgccacctctgaccttcagggacgtcagaggtgagcgtttcaggactgccggcaccagagtgtcaggggagatgacattctcatcctcccgcttcttcctcccagcggttaggtttagaacttcgtagcaccagcccatcgtcccgctgggcgtttggtgggcgggtgcacagatagtcctttacccgagctcttgtcaaaggcccagctgcaatcggggcagggaaactggtagccctccg

SEQ ID NO: 3987 - DNA, 1149 bp, Homo sapiens
catttttccccacgatttttccttttctgccaatctccacttcactgtgaacaaagagggcctctatcatcaggaaatctactcagctctgctggggtgctgacggaagagaaagagcagaagtaacctcaaagcaggttctaaataaacagtctcctacttaatgtaggataagtctttattttgctcttcattgcttccaaaattaatttctacttcaaatatattctttggggtttaataagtatgctccacatgttctgaaatatcagttttaaattgacaaataaatggccagtagaggtgacattggggacacatgagtggctgtcaataaatgttcagtaaacaaatgaataactccatgtggactgttatatagaccacacttattccatcttcttcatctaaaaaactcttattctgtctcttgggtccctatttaatttttttttccacaggaaggattttcctgactgctcttcccaaattaaattatgtcccaattatttgttaccgtagcacactaaaatgctgcttgatcttttatcatattgtattgggattcactgtttaatgtctacctcctccactgcaccggcctgttatgtgtggtattctgtccccactgcctagtacagtaattggcaaatagatacttgaactaaaaattttatggggaagagtggtcaggaagtaaatttcaacttgaatcagcaaaaaagaaatgaacagtgggtaaggtatgcgaaggaaaaagaatctgtggcaagagaagaaattaaataaaagaagagatgcttggaatggaatgaggggaaggtaaataatgactttgccatcagaacttcatgcctaaaccatggaagaagtaatgggcaccaaagcaagggaaggaagtagttaaacaaaaagagagcacagaataatttacagtaataataatcagaaattaaaatagaaatgtactttaacaaggaagatttcctccacctgtttttattcctgactttttcttttccctagggaaggggagagcaatgtgaagtgaaagtttgatataaagatttgatttaagacatgagtttttcttcaaaaataaaaccttatttcatagtaagtaaatataagacattgaaccattttaat

SEQ ID NO: 3988 - DNA, 1319 bp, Homo sapiens
tttataaatgttttctatttgaatgatttataagagaggctatcatctaagattctaaggtttcttcttagtatgtaaattatgattatttactataaaatatcattcattttcttactgtgagagcagaaattcaatctttagtggcttgcattctctttattaacagagtcaaatctgtaattatgacagtgggctaggctgctcttaaacaaaggttatgacttcatggcaataggctgagggccaagagataataatcttaggctgacataaatctgaaacaatccatgaaattgttgaaaaacattatcagagtgcactcagttaggctcacctctgaagcacagcacaaacaatgagtcccttaagttttgcaaggtttctatgagggactcgtggctgtctcagacatgtgagggagtggaggggaaaggaaagtgaaatgatatggaaggaatcaagaatcaagagctttgtgacatcaatacttatccacattcatagtgaaggctctctccagcctatttgtaaaaaaaattatgcaatttgtttatttttatatttgatttctttgtggggcaaagagcaggagaccaaatagcatcagaacttgaggtacattaaccagaaaaaatgtttagctattctagtgaatacacagtttgaatgaaaatgtggtcattaaaattccatagtggctgagcagtgtgctgatatatatggaattatgcatatggaatggggctgtgattcatgaagttcagtagaaaagagctctgtagatcagattccgggttcaggggactttgagatggggtctgtctggtctgactggggtgaactttactttgaaaggtcttgagtgatttgctgaaggaaaagctgttagtaaatgatacaatggcgactcaaacccaaatcgggtgacctaatcttatactccaggcctaatctttacttaattttattccaagaacattttgatcctggtagaatcaggtgaggaaggaagagcaaccacagcctgggcgggaaggaaaatcttgaggagctctggcgtgggtgtgcactgggtggggaacccagcccctcctcttggcctcggtttgggcggcgggtttacagtcttcatgctgggagagctgctttttgaaccatctgtctgcaataaacgggcctcctgagtgtggtgtcttgggctctaatccttgagtaatgactataggtggaaattgtctctgaggcaattcctagtgagaactaggagttctaggaaggatctatttgttaaaaatcagccaacagcaattttccct

SEQ ID NO: 3989 - DNA, 1199 bp, Homo sapiens
ctttactgctatacaggctttattttcatgtgatttaagacttgtaaccatttgtgtggaagggtttggacccatgagtagtcattaactctcctgctgaaggtcaattttagcagaaaatgagaggtggcagatgtagaatattggagcgcacttgtaccaggagttaggaggcctgggttcaggtctttgtagtttgatggccatgtgactaagtcatttaatttcgctgaggttcaatatttttccatgtgtaaaatggggaaaaatgtcttgcctctctgatgaggttatggagagggtcatatgagagacagtggaaaaagatatcttgaaactccagagtatcctttaaatttagagttttgttactgttaatataatgaggagacaaggattcaggataaagttattcaccatcctcagtatcagggcttctcttcctctgcattggtttgtttatgctagagagatcaggagcctcatgaaacagttaagtgtgtctttggcagataaattaattgtattcaggaacagtgccaacccttataagtcataatggcactgagatagtttggtattgtgtatgatcaggaaatatagaactggtgaagagctgtcaggtttgcaggtgatgatggtgggaaggtatgtcagaccagggagctctaaactctagacaaaggctaatgatcagggatgggacccacactagaaaataggcaaagggtctgtctatctgaagtgctgacagctaggtgacatttaggtgtggtaacctgcaggagaggctcagtcatggcgaaattctacatctttgtcgtgcaggcaaaacatgactccctctatttgaaatcattttttttttttgctgcttatctgaattttcaataaatggtaggtaatatttttactattaaaactattactatgagtaaagtactgagataggtattacatggacattataccatttaacctttagactgaccttggcattttggagttattattctcatcacagaggaagaactgaggcccaagatggttaatcaattgccaagtctatagtcagtaagtagcagaactgggattgaaacattaggctgtctacgctcctcctctctctctctaccctgctgacaccccagtgcggcagacacccaagtggttgcagctatagagactagatccaagcc

SEQ ID NO: 3990 - DNA, 1176 bp, Homo sapiens
ggaggtattacatgaaagcctgaaagaacatgaaatgtgcagaaaatgatgagatttcaagttactggaggccaaatgtgtgggtatattgcagcacctggggatgggcttaataaatgtagcaatgttttctgctccatctacatagtaggtgatcagtgaatacttgtgaaaagaatgaatgaaaaagaaaaaaaaagaggagagataggcaggatctgattatgaagctaatgaatgtgggctttattttaaaggcactagaagcttttaagcagggccatgacatggccacattgaacatggtggcagcaaagcaaatgatcaaagttaggggagactggaggcaaaaaatccagggaagagactgcagccctaatgcaggggagagataacacatgtctgaacaaaagtagtggcatttgggcatggagaacatgccaagttacaagatgtttagaaggcagaatgccagaactcctgcttggttgtgggagtgagggaaagggagaaaaaaatctcaggggtgtttattttctagttcaggtgaatggtgagaggtaacagcagaagaggaattggagaaagacatttaatctggttgggaatgcacccttttaggtgcctacagaacatctgggagatatccaagaggcagctggaaaatgaggcctgaagattcagatgtgggagtccttggcacaggaagagagagcgtacatgagaagagcagtgtgataaggacggaagtctggcatgcagacatttatgggacaaacagaggaggattcagccatgaagcaaaaagagctccaccagaggaaaataggaaggcagtttcagagtccttctttttacactcttgtagctcttcatttttcttcatagcacttaatgtagctatagttgcatacttgtgattattgatttgactgtagagggtagggggttttgtcacacaggatcttgaaggccctgttaagtacatggatctttattatgaggaccctgaggagtcactgatgggttttatataggaaagtgctgtggtctgatatacgtttttaaaagattactctggctactgggcagagcatggatcttgagggatcagctgggagctgttatagtatccaaagagaatagtctttgcactggggatagtggaaatggaaa

SEQ ID NO: 3991 - DNA, 1170 bp, Homo sapiens
gcagatatattgttttcacccaccaaacaaataactgttaaagggcagaacatggtatatcactggagcttcaaaatggaaagtgtacaccccaggaggtgtgcaggtgtggagtttacagacgtatagtagaatgcctatgtatattatttctttcttatcctagtattattttttgtgagtttgcatcacagcagaatacctatataatttgtaaatacatacacacacacatacatgatgaatatgctcatgataatttttaatgtattgtttgaccaagacagtttggagcccactagttcatttatatcttcacccagtcaagaatatagagcccggctatgaaaagtgatataaattaaatagataaaccaagtttatatgatcttcatttataacattatttctatgcaaagtgtacctcatgtaactctagctttgacaatacaatgtcttttggcatccaaacttcgcccctgctagtgggttgttggcagtcctagcttaggagattctgggtatgcatacttgtgtgtgtgtgtgtgtgtgtgcgcgtgtgtgtgtatagtgtgtgtgtgtgtagatgctttgagaagacagaggattgtagaatatcagtaactttatacattagcatgaaaaatgatgagaagatagttctctctgactgggtctatcatcattcattattgtttttttctagatgtctggggttgagagggaatctagatgcttttttcccaaaggtttaagcattggtaagttgaatacttctgaccgatgattcctggaatcttaaggatgagagtaggaggataaagagaattgtagcagctgtttctttgtagttactgattttagactcctgaatcaggaaaagtatacaattgaaaaaattattaaagcagtgtattgaaaactgtcaaaaggcctcattgttatttcatgtaagtcagttttctgggctgaggcccagatggctaagtgggtgctgagatactcgctggataaacaatgatatacaattaatgcaacaaaggagatttgtgccaattatttccagaaccaaaggccagtgaaatactttaattttatcacacacatctattttggcagtgagcacttagagttttataggaaaaggtaagccatgccttggggtccgaa

SEQ ID NO: 3992 - DNA, 1150 bp, Homo sapiens
ctcccaaagtgctgggattacaggagtgagcccccgcgcccggcctttcttctgtctttattaaacttcattttgtttcttaaaaaaacaactctttaatttaaaaaaatttgttctaatgtctattactgtcttttaatgttagctttggttcctagaatgagaatatcttctatgtctttatttcagtaacaataacaaaacttgcttatggactgaggagcctcattaagacaaataactgaaataatattctctcagcaggaattcatagagtaaatgcatgcatatttagaataattggggcttgcagtggccaggatttggccagttgtgacaaactgaaagtaaccacaattgatcaatttttgagaattaagctacggtaaatatttctcaaataattgattttaaaatatttactggctggacacggtggcttatgcctataatctcagcactttgggaagccaaggcaggagaattgcttaaacccgggagttcaagaccagcctgagcaacatagtgagacttcgtttcttaaaaaaaaaaaaaaaaaaattagccagacgtggtggcatgcttggatccaggaggtagaggctgtagtgagttctgtttgcatccaatctgggtgacacagtgagactctgtctcaaaaaacaaacaaacaaacaaaaaattaccaatcttcaactattatcaagtcatgattatgaacattaatccttagtttgtgcttttttagaagtagtaaatataggagtttgggttggcatgcactaatccaagcatttaagtggagatttggaatgtgatgggcagttctacaggaagagaaagagagagggagggaaagcgagagatagagggggagagagaggacaacatgtttcactttgttagttgtttggatttcaggtttttgggagtagaatgtacaaccccaacagatgcaatgcggttagtttatggagtctatgcatgttttatcctggattttcagtgttatcgagggatataagtagaattattattgatttctttatgtatgaatggtaggtgagaaatacttccttgaaaggcaggcacaaaagagagtattactactctgcctgctcattcattcattttagctactcatggtgtg

SEQ ID NO: 3993 - DNA, 1167 bp, Homo sapiens
ggggccctttcagagggcagctcttctgggagactgcctcttggtagccctggggaagtaagtccttggtcccactcctggggtttggagaggacagctgggtccctgacacttcctgggctccctgtgtcttcagctgtctgaccccatgatctcccagctcttccctgcacaagtccagtcctccagtctagttttctgcctagctgcttccacagggctcaggggtacaaatgcaaagtagtcccagccagagtctttcttccagcccatcattaacaagggcatgggccagtcacttaatctctctacacctcaggtttctcgtctgtgaaatgagaagcatgaactaaattggtggttttcaaattgtactcctcggcatcccctcaggggagctagtgagtatgtgtatgtgaatgagagaaggagggagggagggagagagagagagaaagagagagagggagggagggagagagagagagagagagatttctctctcttttgtatatttaaatcaaagctcagttaatttaaactgccttgcaggtaaatctttctcatgcttacacacaaatactcattaatacttttctctttctagctgctcccctccactccgtatcatttttctttctctaagggaaattttcgcttagagaaaaaggcaattacacaaacttccttagaaactttaaaaactgtccctaaagaatccagggctcctaactgccaaagatcttagagtgccaaaaagcttcttcagactctctacagagtctctgtcagtctgataaatctagtaaaaatgacattttcttaagttttgagataagcaaacacagtcatgcatagttatgacaggggtatgtttgggaatgctttctgagaaacgtggcattagacaatgccattgttgtgggtacatcattgagtgtacttacccaaaccttaatttagcctattgcacattgaagccgtatggtgtaccctgttgctcctaggctacaaacctgtacagcatgttactgtactgaataccataggcaattgcataacatagaaaatgtatagtaaaaatacagtgtaaaagaaaaaatggtacacctgtatagaacacttgctacccatggagcttgcaggactggaagttgctctgggtga

SEQ ID NO: 3994 - DNA, 1552 bp, Homo sapiens
aagattaataatgtagtagttacacttgattaaagccatcctctgctcaaggagaggctggagaaggcattctaaggagaagggggcagggtaggaactcggacgcatcccactgagccgagacaagattctgctgtagtcagtgctgcctgggaatctattttcacaaagttctccaaaaaatgtgatgatcaaaactaggaattagtgttctgtgtcttaggccctaaaatcttcctgtgaattccatttttaaggtagtcgaggtgaaccgcgtctggtctgcagaggatagaaaaaaggccctctgatacctcaagttagtttcacctttaaagaaggtcggaagtaaagacgcaaagcctttcccggacgtgcggaagggcaacgtccttcctcatggccggaaatggaactttaatttcccgttccccccaaccagcccgcccgagagagtgactctcacgagagccgcgagagtcagcttggccaatccgtgcggtcggcggccgctccctttataagccgactcgcccggcagcgcaccgggttgcggagggtgggcctgggaggggtggtggccattttttgtctaaccctaactgagaagggcgtaggcgccgtgcttttgctccccgcgcgctgtttttctcgctgactttcagcgggcggaaaagcctcggcctgccgccttccaccgttcattctagagcaaacaaaaaatgtcagctgctggcccgttcgcccctcccggggacctgcggcgggtcgcctgcccagcccccgaaccccgcctggaggccgcggtcggcccggggcttctccggaggcacccactgccaccgcgaagagttgggctctgtcagccgcgggtctctcgggggcgagggcgaggttcaggcctttcaggccgcaggaagaggaacggagcgagtccccgcgcgcggcgcgattccctgagctgtgggacgtgcacccaggactcggctcacacatgcagttcgctttcctgttggtggggggaacgccgatcgtgcgcatccgtcacccctcgccggcaatgggggcttgtgaacccccaaacctgactgactgggccagtgtgctgcaaattggcaggagacgtgaaggcacctccaaagtcggccaaaatgaatgggcagtgagccggggttgcctggagccgttcctgcgtgggttctcccgtcttccgctttttgttgccttttatggttgtattacaacttagttcctgctctgcagattttgttgaggtttttgcttctcccaaggtagatctcgaccagtcccctcaacggggtgtgggagaacagtcatttttttttgagagatcatttaacatttaatgaatatttaattagaagatctaaatgaacattggaaattgtgttcctttaatggtcatcggtttatgccagaggttagaagtttcttttttgaaaaattagaccttggcgatgaccttgagcagtaggatataacccccacaagcttagcgttccaataacggaacactaggcataatgaaaga

SEQ ID NO: 3995 - DNA, 1200 bp, Homo sapiens
gtttatcaggtcatatgaaattcaagtttggaaaaatttgaaagtacattgcatgtcaataaacgcatcttggtgtctgattctgcatacatctgtagagaatttgaaaacaagcagtcaatttagaacttctgcttggtcttcggaagcaaaaagaggaaattcaaaagtaattttacacgtccttccaccagaagctgaaaggatggctttttcgcggctgaataacgaaagccccctgcttcgccccggactctgagcagctcaacctgcggaaaggatgtgtaataaaacgcctttccagggagacaaaaaaaaaaaaggccacccaaaggaagggcaactcgggagtgcctggtttctactgcggtacccgggcactttggaagaaagtgcgtgcagattcaagcttttgaaatggtttcagctctgttcaattgggcataggctatttttccttttctgtttttttctttaaatacattatattcattcctctcaatttgataataatcacttgagaattgcgaattgacacttacatatcaaggactttacaaaaccctctccaaagtggggtttccgtagtgtagtggttatcacgttcgcctaacacgcgaaaggtccccggttcgaaaccgggcggaaacacactaaaaaatccctttttttttttttttttttttccttcgcttggaagaaagcgtgagatcacgctttgttttcttttgttgtttgttttgtttttttttctgagggaagccttagcttaatgtatgccggtccttcaaaagacatgatagcaatttgagagtctgaactgtaagtttttgttactttattcgttcaccaaatgtttttatggaagccttgccacgtggaacatgtgtcccgggttttaaaaaatgaatttgactcaccagctaacactgaaaaaataatgtacagcctagaaggaaagatcaaagtgtaaaagtggttagtcctgtcgcctcctgagcatttttgtattatatcacttggtttttcgtctgaagtggctgtaaataatcgtattaaaaatcttctggtccagacgcaggaaaaccttttccggtataaagcccaccttcctctaatgttgcgcatgcccactgtgcccagctgctccgctttcgtgcatcccagacttctgtcaccaggtaagggcatcttggaagc

SEQ ID NO: 3996 - DNA, 1125 bp, Homo sapiens
agtcacagtgagagcatcttgctttgtggttgaaataggtagtgtatgtcagtctttgctttaggctgtttctcatctaagtgtttgaattaaagatgttaaatttttctaattgtgaaaaatatgttttctgtatcgacacattttattaaacttggcttgattgcttctttatagtagtccctgtaagtggacataaatgtggctatttgatgttaatgcaactatgtcaaggctgcaatcactttaatagtttctttttagcaaataaatgttcattgatgaagtgcctgggtattttcccgtcccatttgcagagctctactacttcatttccacagtaagcatatatataatgatcacttctgagtttatcaccagtaacattgatacctattttggggtataaacatggtgtttttcagaaataaaaattatttcattaacctttactattactgtgataatacccaggcactcaatattcatcctgaaattttttataatatatgtaatttgtctagtcttaaagacatttggagcatggccaacaggaaggtcagcttcttactgatgtgtgtggattcttacagaatgttagtacaaatttttataaatatttggtgatccctggggggaaatatcattcttactatggttagaaagtgaattagaaatttcagctcagtttctattttactattcaagttgtgtactttaaacaaatataaaaatcaaaaggctgcctctattacaatcctcagtggaatagatggctatctttcttggctaacattaaatattcttgtaccagagcatggaaaatcgtttataattgttaatagaatggcgatttttttttaagaacttcagatttgctatgctgctgtaagtagaaagcatgaagctttttgatcatgtagggcttattgtagagggtatcaattggcctaactaagcaggattgaatttaccagaggctaagttcagatagtaagaataatgcatatgtgattgttcttaaagtcaatgtattaaataaggtatttttccttttccctcttactggatttttcaattttcaaaccatatggcctaggtaactttaattgaaataatatagat

SEQ ID NO: 3997 - DNA, 1218 bp, Homo sapiens
cttcctacttttgctacctaagtttgcattttctgacttccttgcagtgttgcactctttgtcccattgggataaaaagcataagtttgaaattttgctttaagccttgtgttcctggggaagttaaacaactaagagagctgatttgtaaaaattattttttatatgacattaatattcatcaagccttgtgtaggcatgtgtaagacacagctatgcagctttgagtagtcaatatagtatgagatagagtgttgtcccaaatcctcctgtcactttttaagtagcatattatttccctgatggtcctgttactttgctgttgaatgctctaaacagaactttttaaaaggtgtgttttaagagcagtcacctaggagtagacaaggtggaatgggaggagagaaatggtaatgcaaaagcttgagcatgggaagagtcagaggaggaggccatcatccttgttagcttagcctacttcaacactgagcacatttctgcacttttgaagtgaaattcatgttttacttagaagaaataattttctttcattagggatcccagttgatttttgtttcctggtgtatcaaaatacttagaactatgaaacaagtattattgtgatcatgcctttgaataatttttgacgtagcttatcttcatgtatcaagtataaaattataatgagacatctattcacaaatacaagtcttagattgaattgaaatgtgttatagtgccctgtctcccactgacttgttcagttaaatgtcttaaagtacattatgtacatcttcaggcttttggtaccacaatggcacaagtatggtagggaggcaatatagtcttaggctatatgcctatattaagtgtgtataaacaatttttgaaagaatacactattatagatgtatgtgagtgatgctgacctgacagccatatccagtggatgaaactgactggacacactgttaaaatgttttaaagatgtattttcagccagaacagcctggttatagtttgtggttttcaccttggtggattgcaggaacacatgcagcctactggcattgagcattagctaatggcatgaaagggcctcatctcactacctctctaaggcctctagctccaagaaaaccatgaaaacttctttcttggagagatctttgtctcagaatccttagagaggatttcgtatgggggctaactttagga

SEQ ID NO: 3998 - DNA, 1156 bp, Homo sapiens
gctgttattgaggaagctcttcaactaccctaaatttcacaaatgtaacttataacactatgaaaagatttgaccaacaatttacgtttgctgtgtgctttagtttttgtttaagcatattcttttgcttgaatttctgtgttcatgagagttagggtgttttatgcttcttgaactaattttataacatatttaatatattaccagttaagatataaaatcatttgtacatagcgaattgtaaagcagctattaaagtaggtgaaataaagtatatatttgccggttatccatatcttttagaagtcctgacagaacaaccagtttatttgcacataggtagcttctgtttgaaggaaggtaaagttataaggaaactcaaatactataagatgtgtcaaggtatttctccagaattaattgcaaagctagtgctgaaggattttaatcagcttctaaaattttcttctcaataaggcatatgttttgattacttagggaagattcctcatttttatttgccctttatgcatttaatccacatgataggacattaaaaattaatataaagaaaaatcgtgctcatactgtacatctgtttctgtgcttggaactacttgttaatagtttttatcgaagctgtcagcaataagggacataaaactgctgtattatacattgtggaattgaataaacagcctaattttttttttctagtatagggtacttaagcatttccacttttggaagaaaagtgtattagtattttatattgcatttcatttaaaaggacagttttttttttttttttgtaaatccattcattgaaatggtttctaaactgtataatgtaatttggagcctatttagtaatagaattaaatgtcctatgtagtgctacaatttttgaattagaaagtgatcaaatgtaagaaaaaaatttaaaaattcagcccagaaaacaaaatagtgtattaaattagtttaatgtaaaaggaatttataagatttttttcctcaatatagatacctcacttgaaaagaaagcacagcatacttaaagtagttctagtaaacatgtcctagaaaacagttgctaaatgtaggacatcttttgaggaattagtttatgagaaataaaattttacttgttttt

SEQ ID NO: 3999 - DNA, 1187 bp, Homo sapiens
aaccttctctggccctggaaaagttgactggatgaaatgttaccagtcagttatccctctcctaaacctaggatgtttgccaccaagggtatagtctgactggcaaggctaagaaggaatggaaatatgattcaagctagaaaaaaggatgattccaatcaagtctcttaataacttctcctatcatcaactcaggttcaactggaaagtgtgaaactcctctctaaggcttttactttttcccatcatgcctagctttttgagtacatctttgctcctttctggtctgataatttaatgctgggtatattaactatgtaatttgtagactgttagctccttgaaggaaatggtcatgccaaattcacatggggtgtacagagttggtattcagtaatcatgatttgtataaatggatgtgtaataaagagaagagttttaaccaaaaattgtatttgttctgtctggctaggattctttgggtaactttatatttgacaaactttgatggtgaagagaaaatgagatggaggtcacttactgaataatttggacctttaagccccctttacctggacttaaatggaaatttgattggattgctttcttccaatctgggcttcatttgacctgatttgaaagtcaataacatggtttgatagaaggactttaatctatgcctcatctgcttgatttcagaagtctttggaaaatctgaaaaaggtgggtgttttccgtcatgcctggtctccctttagagggggtggtgggaacaggaaccaaaaactctgctctctggtgatgttggttacatctgtgcagctatcagtgtttcctcctacacctctatcctaacaaatacattttttgatgtgggtgtaaacctaatttccctgtgcataatgctagtgcctctggagtgtgcagagctggctggaatgtgctctaagtggtttgggaataaaggcttttcttgtcattatttgcagtctgtagtattcagctgccaacccatgccatattatttgtgtgatgcttggtgacagtctgtgttgagttttagctatgatttttgacataatttaatgagctggaatgccattttcccctgtaagaaatatgtacatattttcaatgccagtgaaaagttgtttattttatacatgtattatttttctgaatccaga

SEQ ID NO: 4000 - DNA, 1216 bp, Homo sapiens
gacagcggaagggcgccggggctgcgtttcccgcgcaggtgaagcaccgtcagggcacagcgcgcctgcgcgctgtggactgcccccagcggctacaagagcaccgtgaagggcgctatccactacccgggctgcggcgcgcccctcgccaaggtggtcttccggaatgcaccggtttaagaagtggacgcagctgttcattgccgctgagggtattcacatgggtcagtttgtgtattgcggcaagaaggtccagctcaacattggcagtgttctctctgtggacaccatgcctgagagtacgaccgtgtgctgcttgaaggagaagcctgaagaccgtggcaagctggcccgggcatcagggaacggtgccaccgttatctcccacaaccctgagactcagaagacccatgaagctgccctcctgcgccaacaaggttatttcctcagccaacagagctgtgggtggtgtagtggccagaggtggccgaaatgacaaagccatcttgaaggctggccgggcccaccacaaatataaggcaaagaggaactgctggccacgagtacggggtgtggccatgaaccttgtggagcatcctttcggaggtggcaaccaccagcacatcggcaagccctccaccatccgcagagatgcccccgctgaccgcaaagtgggtctcattgctgtccgccagactggacgtctccggggagccaagactgtgcaggagaaagagaactagtgatgaggggctcagtaaagtttgtccttctgccaccaaaaaataaataaataaatacaaataaaagataatattcattcccaactctcttaaatgtttttccacagtcgaaacagatgtattatgagttttttgttacataaatataggattattgtaaaagagttgagtggtacataaaagtgtaaagaagagattatatatcacctaaaaccccaccagcctgagataaaaaacattagtcatttagtaaccatatgttcgtgcatttctctatcaatataaatctacacgcacatacgtagttgtgtgtgtatatatacatacatatacataattttatattaaaaatcaatcacattgtatatgttgttttactttgaatttttataagtgctgtcttttgtggggtttttgcttgtctctcttcttcctctagttccccactctatctctatacattcccaatatta

SEQ ID NO: 4001 - DNA, 1174 bp, Homo sapiens
agataaagccagtgtgtaaattaccaaactacaaaacagtgccataatggaggttaaaaacagtgctatatgccttctagcaaaggagcagtcacaaccagtttaaattaagtgggattttttttttttttttttgagacagagtttcactcttgttgcccaagctggagtgcaatggcacgatctcagctcaccacaacctccgcctcccaggttcaagcaactctcctccctcagcctcccgactagctgggattatgggcatgcatcaccacgcctggctaattttgtatttttttttagtagagacagggtttctccatgttgagtctggtctcgaactcctgacctcaggtgacccgcccacctcggcctcccaaagtgttgggataacaggtgtgagacactgccccaggcctaagtgggattatttattcaaccaaaaccctttgttatagattgaactaggtccccatcgaaatttacatgttgcagtcctaacactcagtactttaaaatagcattgtatttggggatacagcttttaaagaggtaattaaggataaataagatcataagggtgagccctaatacagttgactaatgtctctataataaaagaaagagatatcaaggatgcaggtgtagagaaaagactagagagcgcagagagaaggtggtcatctgtaagccgaggaagggactcaggagaaacaaaacctactgatacttagattttggacttttagccttcagaactgtgagaaaacaaatttatgttgcttaagccacccagtcaatggtttttgttatggcagcattagcaaactaatacattctttagcacaagaaaaaataatggtaggtttaacaaactgaaagacaataaatcttgaaccttagattctatttccctcataaaactgattaacttataatactgaactggtctctagattaggcatcacaaacttaaggcctatggggctagacagttcaatcaatgaaaagtttctgtgagtaagaaaatatggaggggcggtgactgtgaccaatgaggtagggtgttcatgggcaggataaagaggctgacaccactcaaatttagtatgttatgtaggtgaaagaaaacacggctggacgcggtggctcatgcctgtaatcccagcacttt

SEQ ID NO: 4002 - DNA, 1170 bp, Homo sapiens
aactcaatgtaaggtttagaagtgtctatttatggctctgaggttcaaagaggctagcaattgtatcttagtcatcactgcgtaacaaacacctaaaatagaatctgtacaaagtattgaataaatatttgtcggaaaaagtataactggctatctgagaacattcaattctgtggaattcttttgctgatgatattggataaaataaattttaaggtttaaaaaatacaataaaatataaagaagcaaaagtctttaaatttttattttttcagaaataagagtcgtcagcatgcaagttcagacagtcacaaaattgaaaacagttactaatgttgttggatttgtaatgggcttgacatctccaggtaagtagggttgaaaatttataatctacactttatatgaaactatacaaggaaatgctctgtaataatttaatattatacttaaatatcctacttgagatataactagaaatttgtcccactcttagagtagataaatttgaaactaagaagtgggtcttccttctctttcctaccgtatctcttctaaaataaatcttagtcgggggagagagagagagagagagagagagagagagagaggtggggatctctcaggaggagatgaaacaagaaacagagtttagatttggtaaactggcatgttctaaaaaagccaaagttttcttttttcttatactcaccataacaccactgaaaattttattttgatcaagaagacattttaaagaatgattttctttttcctcactgcagcctctgcctcccaagttcaagcaattcttgtacctcatcctcttgagtagctgagactacaggcacccaccaccaagcccggctaatttttcattttgtatttttagtagagacagggtttcaccatgttggccaggctggtcttgcactcctatcctcatgtgatccaccagccttggcctcccaaagtgctgggattaaaggggtgagccagcatgcctggctaagaaagattttagtttttaatgatttttttttttaaataaaagttttggtctccaaatttagttgtccagttttattctatgtcccactctgtatccttggtccattgccaaatttgtcaaatgtctgcatggctttaggttttcaatgtgcttatgaa

SEQ ID NO: 4003 - DNA, 1145 bp, Homo sapiens
ttaaaggaatcacaaatgatcatacttaagtgagcaaaaatgacaagttttactagctaagtagagaaataaatctcaaatgcagcgctacaattttcattatcttaagtacattgtacatttctacagaacctgtgattattctcgcatgataaggatggtacttgcatatggtgaattactactgttgacagtttccgcagaaatcctatttcagtggaccaacattgtggcatggcagcaaatgccaacattttgtggaatagcagcaaatctacaagagaccctggttggtttttcgttttgttttctttgttttttcccccttctcctgaatcagcagggatggaaggagggtagggaagttatgaattactccttccagtagtagctctgaagtgtcacatttaatatcagttttttttaaacatgattctagttaaatgtagaagagagaagaaagaggaagtgttcacttttttaatacactgatttagaaatttgatgtcttatatcagtagttctgaggtattgatagcttgctttatttctgcctttacgttgacagtgttgaagcagggtgaataactagggcatatattttttttttttttgtaagctgtttcatgatgttttctttggaatttccggataagttcaggaaaacattctgcatgttgtatctagtctgatgtacttatccatctcattacaaacaaaaacacacagactgcatttgtagctctgtaatccttgaatacggaagtaaattttcttctttcctgactttgacattgtagctatactgtttccatttttgtttttacaaatcctttgggtctaattctgtgagcctacctatagcactggattaaaatgtctgcatcatttctttagttatccagttaactttaaaactgttgtaaaagtgtaaaccagcccatgacaggtttttgtacatgttaaagaacttcattgttcagttttcatgattattgtgtaaggaagactgatgtagatgttctgtgctgtcctggaccatgttaattacacttacgacgtattttagttccacatcacaatgatttgtccccagtgacccttttatcctttctaggcacatttcttgttgttgttgttgttgc

SEQ ID NO: 4004 - DNA, 1224 bp, Homo sapiens
taggtaaaacgtggttttttttttttttttttttgtaggtgacagatcaatgggtctttcttttttttagttcattcaaccactctgtgtgttttgattggggagtttagtccatttaatttactgttattattgataagtaaggactcactcctgccagtttgttatttgttttctggtcttctcttcctattttcttttcttcttgtcttccttttattgaaggtgattttctctggtgatattatttagtttcttgctttttagtttctgtatctgttgtatgtttttttgtttgaggttaccgtgaggcttgcaaatattatcttataacccattattttaagctgataaaaatttaacactcttttcataaagaaacaaaccaatgagcaaaaagaaaactgataaaaattctgcactttaactttgtttccatacttcttaactctttgttttttatatttacattttattttactgtgtatgtcttgaaaagttgttgtagttactatttttgattggttcattgtttagtctttcttcctagaatgagagtagtttacattaccatacagtgttagaatattctgtgtttttctgtgtactgactgtttccaattagttttatgccttcaattgattacttattcctcagtaacatccttttctttctgattgaagtactccctttagcatttcttgcataacaggtctggtgttgatgaaatctctcagcttttgtttgtctgtctgtgagtctttatttctccttcatgtttgaagaatattttcactggatatactattccaggataaagtggtttttgtccttcagcactttaaatatgtcatgccacactcttgtggcctgtaagttttccactggaaagtctgctgccagatgtattggagcttcattgcatgttatttgtttcttttgctgcttttaggatctttttttttatccttgacctttgagaatttgattattaaatgccttgaagtagtcttctttggattaaatcttggtgtttgagaacctccttgtactgggatattgatgtctttctctaggtttgggaagttctatgtttttatccctttgaataaactttctaccccatttatttctctacctcttctttaaggccaacaactcttagatttgctgttttgaggctactttctgtatcctgtaggtattcttcattgtgttttatt

SEQ ID NO: 4005 - DNA, 1194 bp, Homo sapiens
tatttggataggaaaaacatcttgtaaagatgtcagttctccctgttctcaaaataacaagaagttttgccttgatttttgtttttgaatttagcaaaatattcaaaagttcatctggaattatcagccaagtttaataagactgtgaagggactttacagaagctacttgggctgaatttaaaggatgagtatgattaaaatggcaataaatgtgaatatgaggtaaaagattatggagcatatttacaaaggcaaaaaactgtaaagggaaaagattgatctagtaagattagagcttggagtgtgggaaaaataagagaagagcacagttgtaatgtttgaggcttgagtcaaggctgtattgcatagttactagagatccacaatattgtcttaattgagtaatggtgtaattagatatatgtttttagatagccaattctagtgacactgtagataatgaagtgggtggggagaaattggatactttgtgctttcagggcctcttgtcttagttcatactgtctacttaacctgttgcactcttctcattctgtacctgtcagaaatcaggcccactttctcctaaaattaccacgttctgccttgtagattgttagataataaggtcttttcaacctcatttatatacttcatttatatacttgtatgagtgtttttctcctcctttcctttccatcacccatccctttgcttcagctgctagtgtcttaatagaaggtaattgcttaatgaatgcttgttgaattagagacagatcagtcctgcatatgagaactcttttagggtctaatagtgatagagaagattgaaaaaaaaaggtgatgaatttgagggtaatttaaggggtggaagtgatgtcatgcaagagaggagttgaaagcaccaaatgttttaaccttggagattgagaaagtggtgatgtcatgaagaatgtattccacatttgaataatgagcagagtaagaggtaccaacaaatgaaacaattaaaggaggccataaaaacaacagagatcatttcaacattctattgaggaaatttggggggacacactttaattaaataataacatcagtatttctttacctttgtaacttttaattaatgaagatgttttaagatgaaatataaaatgtgaacctgagaactgtttaacatttaacattat

SEQ ID NO: 4006 - DNA, 1196 bp, Homo sapiens
ctgccttgcctaacctgggcaagaccactcgcgtcctttcccttgaggagcagcgtgggaaaggtgccgctgcgcgccacgtttctcccagttccccagggcttgaaggggcggtggaggcgggcgggataaattcgctggccgcctggcgtggagtaatcctagagggtgggatcgccctcggggctcgggaggggctcttccccgcccagaaggagactgcggcggcgcaaggcctccggcagggggcgcgggccgctgggcctcccccggggctgcgggccggtggtccctcccaggccgcgtgtgcggtgcgttcgcgcagcccgctccctgcccccacctcacctcgtcacctccccgccctctcggcgggcccctgaggtgcgcggcgcaggcgcggagcgtggcggccagggcagtgcggccgcggagcctaggccaggggcctggcgctcagggcgtggggcgcgcggggagggagaggggtcggcccagcacagcgtccgggagcgctagggccggagcagcgctgcccgccgccgtgcgtccgcgggaaggaccgcgcggcccctccgcctgcgctctcggccgccgccgcctctgcgtgggccggccgggagggcctcgggggactgactggtgagtgtgagggaggagcgggtgggtcgggcgctggactgctccaggggacgcgggcgtgcgggcgcatcttctaacgggagagggcgggagagaccggagctccctttatacggaaactctgccttcgttatatggcgggatggcgttcccctcccccatcccgaaggcagttccaccccctgcgcaggacgccttggccgggctcccctcggccccctgctgccgttgtctttacggaacctttggtgtcggggcttggaagtctccttggcgccggcttctgggcccgggcgaagctggtgcgtggcgccggggtggaggcggctaagtcccagggacttctgccctgcgcctccgacgggcatttgtctggctgcgtccgggctcgggacgatcctgggtcctcgctggcgctgcggccctgcccggcggcttcgtgacctccggcggcgaatccccgggctcgcgcaacgagttgtagccgcggagagcaggcgtcgatgctggcgcccaaagcctccagcctgagagtcgcctcactcgtgtgacgg

SEQ ID NO: 4007 - DNA, 1190 bp, Homo sapiens
taggagattgagatcaggttgggcaaaaacatgaaaagactaaatcacatctctagcaggaaaaaaaaaaatccagatatgatagctcatgactatagtcacagctaccccagaggctgaggtagaaggccaagaagtttgaggctgtggtgatggtgagctatggaggtaccactgtgctccaacctgtgtgacagagtgagactctcttttctttcaaaaaaaaggaagaaaggaaaatcaatgttagtctgtcaatacattttcttattgttttaaaactgtatttggaaagtttcaaaatgcatttggactgcattgttctaaaggcaagttagaaatccaaatatcttttgcacagttatttcaccattaattcttactagttttggttgtatgatgggagatagacgtataaaaataacttatttaaaatgtcagtggatttttttgtaatggacattcctggatgataggtgaaatttgaacatgaactgtttgttagataatagtattgtctcaatggtaaatattctgaatacaattgttttgtgattgtgcaaatgttttctttcttagaagacaagtattgatgtgttaggtaacaagcttgtgatgtagtaatgacctgtcaaaatgttcaggaaggaaaataatacataagtatatataaaaatatatgcctctctttatatatatgggggtcatacattttatatattcattgcaagacatgtattatatatattatatatatttattatatattatatattatataatacatatataaatattatatataatgttatatataaatattatatatatatgccctcacacaggagagagagtatcgagcgcgagtatggagggaggggagaagtaaacaaaaggggctgaatgttaatatttgatatatctagatgaaaggtctatttcttgcactttctattgaaagtatatcaaaataagttggcagtgatgagtagcatgttaggtgtttgtagggtctgttttcaagggaaattgacaagtttgttggttttatgttttaattacatatataaatttatattattaatgtatgattagagttcctgataaaataaatctgggaactgctgcatattatatatgttccccatagagattaattagcatattagtgtagtaaggatgctgagaaa

SEQ ID NO: 4008 - DNA, 1149 bp, Homo sapiens
cataataggtactcaatgaaatggtttatagtagaatatctaagctagcactttattttaaaaagtaacttattaattaatcacacattgatggtacaccttgtatttagcaaatgtttgcatgttgataaaatctcctatgtcttctttcttaaatccagttgctgattttgtaaaatacagttgtgataaagcagcattacgggggggaaaaagctatattccaactggtgttaaatgtattcaacaaaatcttacatcatacagtatttatttcttaattaatagaacttcagtgatatacttggtagatatctcaagccttttgtcttttacacaatggtgctctatcctattgttttcttttcaaagaagcatctgaacacttgcatttctattttcctatccaaaggcatccacatctaagtgtgtttttaaagttgattaaaattatttttctgttaaagcattctgaaagtgtttgtctttacctagaatgatttgtacacactcgtggtcaactgaacatgaatgtcagtagtagtctaattatgggaagggtaaacgtgttagattaaggctcttaaagctctaaaccatataaactatggacttgtatcatgatttaactgttcttagatctttcttacacagtgattcattcctctatttgtacagtggctttatgaaatgttgtgaattgatactgtaatcaataaagtgcttttaaccagatttcattgtatttttttatgccacaatttttttttttttttgagagtgttactctcttgcccaggctggagtacagtggtgtcgtcatggtttactgcaacctcagcctcccgtgctcaagtgatcatcccacttcagcctctggagtagatgggactatgggtacgtgcatgccactatgcccagttaatttttatattttttgtagagacagggtctatgttgcccaggctggtcttgaactcctgggctcaagagatctgcctgccccagcctcctaaagtgctgggattataggcgtgaactaccatgcccagccaattttttataaaaagtttttattgagacaggggtcttgctttgttgcccaggcatgtctcgaactcctggctttaagggaccatcccaccctga

SEQ ID NO: 4009 - DNA, 1149 bp, Homo sapiens
tttggtaaacattgggattgtccctgcatctgaacatctttcccagtgctatcagtatacatctagagaggaaatgcaatgtgacagtgttacatttggagagaagtgtgaaatctaaccaatcgctagcacatatttgttgtaatacggtggtttatttcatgtttgcatactataaaatctgaattgatgtgaaatatctgtgcctttaaatttcttaaacctttaagctttttgttctgttttgcaacattttgtagtatttcttcccttccttagcacaaaatactggtttctaagtggttttgcttcaaaggatgtctagatgtaagtgattccacttaaagccaaaataaaaattcctaaagcagttcttaaaggagttagagagctatattaaacagtttttctgtggtataataatgtgtctcttactagaagtcccccacgaccaagttaaagatacttttcctgttggattctcttttacaaataagtctaaatgactgataatagaagattgttagtcttgcttgatggtaaagtcttggattattctgatatatagacgtgcattgttttgtaacttagttacttttcagataggtctgtgttaacttttgaacatgtgtaacttaacctaaatactcccaaactttacctctaaatttttgtttttatgttgtgaatgtgctaatatgtgcatcaactgtaaagatgtatcagttttattaaaatcagttgacaattagaataataaagtggataaaggcaaattaagatataggaccaaaacagaatattgtagatggcagttatgaatgtatatttatattttgattaagatttctattaactttttggctgggcagagtggcttacacctataatcccagcaatttgggaggccaaggtgggcagatcacttgaggtcaggagttcgcgaccagcctacccaacatggtgaaaccccatctcttctaaaaatacaaacattagccgggcgtggtggcacattcctgtaatcccagctactcgggaggctgaggcaggagattcgcctgaacccgggaggcagaggttgcagtgagccgagattgtgccactgcactccagcctaggcgacagagtgagactccatctcaaatt

SEQ ID NO: 4010 - DNA, 1158 bp, Homo sapiens
aattaggcaaggtggcatgcccctggagtcccaggctgaggtgggagcatcccttgaaccaagaagttcgaggttgtaagctacaatcacgccattgcactccagcctggctgacagagcaagaccttctctcaaaaaaaaaaaattttttaagccatttctagtaagaagtaaggcataattatataaatttctttccattttacagggtacctttcaacagatgtggatttccaagcaagaatatgaagaaggagggaagcagtgtgtagaaagaaaatgcccttgagaaagagttcccaagcttctaccttccttttgtcaccttacgtttcatagctttagtatactcaggaaaagaatgaccatcttttgtagaatgtttatacatttttgcatatttcaatttccacttaaattttttaaagctttaactggctctataaattaagtttgtgctttccttgaaatgcacttattcttattacaagcattttataattttgtataaatgtctattttctctaaatattttgctttcagtaaaatgctttccaactctgtttagtgtattaattaccagtggattggtagaactgctttttattgactagtaaaagttactgcctatgctttttaccttaggcttacagaattaaataaaaattagccattccagaaatatattttggactgttgtgcactgtgattactactttaaggactaaatgtatttctcattattttgaatcaaagtcctccgtttattaacagcaatacccacatcctcttcatagcctattaacaacagaggtaaaactattattcaaattcaaaaactacggtattgcctttgctgtggcagttaccatcaccttcacactctaaggtagcaggtgacatttaaagcctgcttaaatgtcagaatttataaagtgggaatctcatctgaactttatacctgatttttagaagcaaattagcttctaccaaattagctaattagcatgccatattcacacttagaacaactgattagtaaagtcacttgactaaaaacagaatttctttataaaccacttaacatatttactcctgtacacagactattcaagaaaaacaaaatggtaaatttaatagttcagacatcttagacaa

SEQ ID NO: 4011 - DNA, 1223 bp, Homo sapiens
gaattctaccagatgtacaaagaaaagctggtaccaatcctactaacagtatttcaaaaaatcaaaaatggagggactcctccctaactcattgtacaaagccagcattaccctgataccaaaatatcacaaagacacaacaaaaaaagaaaacttcagaccaatatccccaatgaatatagatgcaaaaatcctcaaaaaataatagcaaaccaaacccaacagcacatcaaaaacttaattcaccatgatcaagtaggcttcatttctgagatgcaaggttggttcaacatatacaaatcaatagatgtgattcaccaaccacataaacaggattaaaaacaaaaaccatacaatcatttcaatagatgcagaaaaagcttttgatagcatccaatatctcatctcttcatagtaaaaacgtttaacaaactaggcattgaaggaacatacctaaaaaacaaaagagccatctattacaaacccactgccaacattataccaaacaggcaaaaattggaagcactctccttgagaaatggaattagacagtgattgctgtctacggccataccaccctgaacgcgcccgatctcgtctgatctcggaagctaagcagggtcgggcctggttagtacttggaagggagacagtgattactcgctctcacactcctattcaatgtagggctggaagtccttgatggagcagtcaggcaagccaaagaaataaaagcatccaaataggaaaaaaagccaaactctgtctcttcatggacaatatgattctatacctaggtaactataaagactctgccaaaaggctcctggaactgaaaaacaacttcagtaaggtttcaggatacaaaatccatgtgcaaaaatcggtagcattaatatataccaataatgtcctgagagccaaatcaataacacaatcacatttatgatatctgcaaacaagcaaactagaaatacctctaaccaagaaggtgaaagatctctacagggagaactacaaaacattactgaacaatatcatagatggcacaaagaaatgaaaaagcattccatgctcatggaataaaagaatcaatattgttaaaatggccatattgaccaaaaaaatttacagattcaaggctattcctttcaagctatcaatatcattattcaaaaaactagaaaaaaacttctaaaatttatatggaacccagaaaaagc

SEQ ID NO: 4012 - DNA, 1178 bp, Homo sapiens
agaaccatgaaataaagcaaaataatcactttattttttccaatatgcaagaaaaaatgcatacctcccttatacaagaactacagggccaaatagtgagaatttaaaacttttcgggaaaggggtggggggtgatgcaaaacgacttatctacaattgataggaaaaacatagataagtctattcttttcgccgtcttacccagcgaactgtatctgcagtagtccagggaaagcaaccaccaggtttcaataacaacaaaagtcaattaactatgtactcaaatttcacctaggtcattggtctgacatcaagtcttaaaccgagaacgtcaatgttaactactcacgcattaacataaagtctcatttccaacaggcactgttcctactttaagtttaccacctaaggagatttaaacttgcaaaaagcttagggggatcctttatacgctgtgattccccattatgctggtaccacgtgacagttaaaccaaatccacagagctaatcagtaaactaagaaaagaaaatcaaaatgctgaaaatagaaaatcgtggccaaataaaataaaaacccataggataaaaggtacgctgaaatgaaaacctgtgagaattcactttgcatacgcacaatactcatgtattagaagaaggcccttcataaaaatagccaagactctcaaacatttgagatgctggcttagtgagattgactgacagacaacagctggggagattctgtattgatcttctaacaacctggcgtatttcgggaaaataaggagaaaagaacgctatagtggcaaaaaataaactattaggatttcattttcagatatgtgaacgctgaatgccccaccaaattcctctactctattcctcttacgtttttcagccccgattccatagtaatggatgtccttcctcccaagcaaacaaacaaaaaacctcgtgggagaaaaaacaaaacaaaacaaaacctccctccaaaaacaggggcagtgatataaagaaattagtcacctctccacctatctccctgatccatttcgcattttaaatcttactttaaagctcacaactctccttttcttccgtaatagaggggctaaggcgccgcccaatttcccaggccgcaaaaatattccaacccgccacaattcaaggttttct

SEQ ID NO: 4013 - DNA, 1269 bp, Homo sapiens
taggagacagggttctcactctgttgctcagactagagtgtagtaatgtgatcatagctcaccatgacttccccagctttggggctcaagcaatcctcctgcctcagcctctgagtagctggcactacaggcacatgctaccacacctggctagaaagtttttttaaagatctggatggctggggatggtggctcatacctgtaatcccagcacttttggaggccaaagcaggagggtcactttagcccaggtttagaccaacttaggcaacatagtaagacccccccgttcccaacctatacagaaaaaattttaaatcagcagtgtgtggtggtacacacctatagtcccagctactctaaaggctgtggcaggaggattgcttgagcccaggaactagaggttacagtaacctatgattacaccattgcactccagtctgggcaacagagtgagaccttgtttcaaaatcatcatcatcaacatcatcatcatcatcatcatcatttattgtatatttcaaaatggctagaagagaaaatttgcaatgttcccaacacatagaaaaaatagtctacggccataccaccctgaacgcgcccgatctcgtctgatctcggaagctaagcagtgtcgggcctggttagcacttgcatgggagaccgcctgggaataccgggtgctgtagggttggccgggcgcggtggctcacgcctgtaatcccagcacttcgggaggccgaggtgggtggatcacaaggtcaggagatcgagaccatcctggctaacacggtgaaaccccatctctactaaaaacagaaaaattagccagtgtggtggtgggcgcctgtaatcccagccactcaggaggctgaggcaggagaatggcgtgaacccaggaggcggagcttccagtgagccgagattgcgccactgtactccagcctgggcgacagagcgagactccatctcaaaaaaaaaaaaaaagagaaaagaatgtttgagttggtggatatcccaagtgccctgatttgtatacaggtatcaaagtatcataggtacccccaaaatatgtacaactatatcaattaaaaaacacaaaaaaacttaaaaactctacagacatacccttctttaatttttctttttccctcattaaatatatctaataggacaaagtcctatggattctatccctgaaatttacctcatgtctcctcaccctgccttttgtcatattttctaactgaacttctcctaactgaaatt

SEQ ID NO: 4014 - DNA, 1182 bp, Homo sapiens
taacttcttgtgttgctgtcactatcactgtgtattcctattcctagctctgcactatttctcctcactcggataccctttcccattctacattattaagcatcctttccaccctgctttagagataattcttagagtcctactacttaaaataccttagccaagaaaaagaaaagaagcattaataccaaattctcgtcaattctacagataaacatgtacgtaaagatgccacaaacttcaaaatctatgtagctttaaactattttgtgttaccctgttttctttccttggcatctatatttatttaattgtgcttggattataagaatctcagcatccatatatcaatattaatagataaactggacttcaggagagcgaggacagagatttttttcttgtttaacataggaccatgaacacaaaggtttattttcttttgttttctatctctataggtagagtacgtgtttacagataaaactggtacactgacagaaaatgagatgcagtttcgggaatgttcaattaatggcatgaaataccaagaaattaatggtagacttgtacccgaaggaccaacaccagactcttcagaaggaaacttatcttatcttagtagtttatcccatcttaacaacttatcccatcttacaaccagttcctctttcagaaccagtcctgaaaatgaaactgaactagtaagtaatttttaaattaataaataagggtttcatatgaaataattctcttcagtagttgatgagttgcaggaaaaaaagtttgtgtcagtagagcaaggaatatacatttgaaattcatatatttgattcaacaatataaaatataatcctaagaatttgttgttacagcccagtttaacttgttatttaatacgtgtctgccttagctctttgagtatttaaatggaacgtagttaagaaaagcccttactgccttgaagtgaagaagactttctttgaaaaatagagcttaaatttatttaatactttttgagacctcacttcttctataaaaaagtgttcccctctacttgcaatgtggttgtacctcctaaaaagatgctcacgtgttgaagggtcctaagcaaatgtgacattttactttttgaaggcagaaacaaccaactgttattcaggcaatcaaggttgtagcact

SEQ ID NO: 4015 - DNA, 1175 bp, Homo sapiens
atctgatgtaagtttttatcttcacaacgtaaatgagggggagtcgctgttatacccacgtatggaagatgaaagcatggatggtaaggcacagaagtgaagtagtttagtcaaggctagtgagtggcagaactaggattcacacctactctttgtgacattgactcttaggctgtttccaccacttttccagtagaaaattgatttttgattgtaaactaatttgagttggctcgacttagtgactgattttctttaactgatgtcaaaagaggctgacgcttaagccagaaggcagtttataaacttttggctggagcagtgtagcagcaggaccagaattctatgatagctggtcactgtatcccttctgctgtgagacagtttgtgtgggaggcccaatgggcagagtcagagctcagaatcctggctaaccttgaatgtgacatgtcattgaactgtgacagttctggtataaaaatatgcctcccaggtagagcagaatactttcaccagctgatcacagaacgctcttccttggacagaggaaaatctcttttacttcacctctatgaagacactcacccagtaacaaatttttttttttttttttttgacacagactctggctctgttgcccaggctggagtgcagtggcacgatcttggctcactgcaagctccacctcctgggttcgtgccattctcatgcctcagcctcccgagtatctgagactacaggcacccaccaccacgcccggctaagtttttgtatttttagtagagacagggtttcaccattttagccaggatagtctcgatctcctgaccttatgatccactcacctcagcctcccaaagtgctgggattacaggcgtgagccaccatgccagccagtaacaaatattttgttcacacaagtttattgggttacagctcttcagttatttttcaatcctgagcctagatggtcattatcttaagtgcattgggcatattgttaagcctttataatgaaaatttgtaaacatctttatatagtagcattctgcaaatggttaacccatccatttatgctcatttcatcctaaaaaatacaaccccccaaatctggaagtatcttattctagactcctatatgctgaatgcaaatatcaaaagcggtaaagtttcac

SEQ ID NO: 4016 - DNA, 1206 bp, Homo sapiens
ctgcctcagcctcccgagtagctgggattacaggcatgcaccaccatgcctggctaattttgtgttttttgtatggggtttctccatgttggtcaggctggtctcgaactcccgacctcaggtgatccgcctgccttggcctcccaaagcactgggattacaggtgtgagccaccgcacccagcctaaaatgtgattctcatcacatcagattgagagttatgatggttgctgttgaccttaattacatggctgaggtagtatttgaaagggttctgtgctagaaagttactcttctaccctccttccactctgtactattaggaaggatatcacaatgtccaactcacacttaagtgaaacattttttcctaacttttcaaaaggagcaggttgttttggatgaagcagataaaaatgttgaaccaaggaattaaggatcaaatccatgagatttactagaaattaaatacaagtactcatgtgtgcacatgagttttctccagctggcaggttggattcattgttacaatatagctgtgaagtgctatgttgtccttgccccctgctcaaagcaattgtttcccacaatctctgtctcactcggttctatagtaagacatggacgcttggtctcaaacattatttctctaagtattgttatgaaactattacatctccttaattgatttgccaatataattagtcattgtctttttttttttttttcagagtctcacttcatcaccatgctggagtgcagtggcactatctgagatcactgcaatctccgcctctcggattcaagcgattctcgtgcctcagcctcccgagtagtagctgggagtacaggcatgtgccaccatgcccagctaatttttgtatttttggtacagacctggtttcgccttgttggccaggctggtctcgagcttctgacctcaagtgatccgcctgcctcggccttccaaagtgctgggattacaggcgtgaaccactgagactggtcagttattggctctttttaaagattgtgttgctttctgcctcaatattaatatgttggaagttaccaagaagttcatgacagatctatttcaaattctggtgaagaaggaagaattggcccttgaaagaatcagtgttttacaataattttgaaagagggtaatgtttttctaattgatatacataaaaaccatagcca

SEQ ID NO: 4017 - DNA, 1124 bp, Homo sapiens
gcgaggaaccggtcagagtctgagtcctcgggggcggaggggcgacggcggtcctgaccaccggggtgtctgcgggagggcagccagcggcggccggcctctcagagccagactggcggtctgcggagaggctgcagctgggctacagggcccctttctgaggcgaggggcctccagggttcacctggggggtcttcctcccccgcttggtagctacagccctgagggagggcgcgcgcgcctcctggcactacggcccggaaccgcggcgcggctggtgcggcctggctagggcggggtggttgccgggactgggggtagccgcaggtgcggtaggctagtcgccgcggggccgggcgccgccgggggaggcggctgggcagacgggtgctgcttgttgccgatgggctgcgaacggggcgctgctttttatttcaggaagcccgggggagtgcgaccgcctcaaatccagccttcttgtttggtgggacgaccgtcggttctgtccgggaggaatgacggggtcaaggtggggtccccagggccgcgggcccgtgaagccccattaaagcgattgcgaaatgcactcggcactgtcacctgaccgttacccccgcccccgtcccctgcgagcctttgtttaccacgatcgcgacacccggcccgctgcggccgtccccggggagccggggcgggcgggggagcgggcgttccgccggcgcagtccccgcctaacctccccaccttcttaccactccaggactcagtttcttaatttagttcctaatggacccgccctcaagttctggacaccccgggtgaagactgttaacgcggcggggattgggcgcctgcggcagcttgtgggcggtacccgagggagagttcgagtttttattggcgagtttttattgtcactaggtgggcctgccctgggccattcttcccgcccccttgaaggtgatctggaggacgcgcgggagcgcgcgctgtcgctgcttttgcagctgcggcccgagtggagccgggtggcgcgggtgcgggaggcgcgcgctcccgcccctgctgcgggcggctggtagcctcggtggccgccgccgccgctgctgctgcctgatcctgca

SEQ ID NO: 4018 - DNA, 1119 bp, Homo sapiens
ccaggagtctgaggctacagtgagctatgaacgcacacggcaccctagcctgggcaacaggttgcgacactgtctcaagagaaaagaaaaagaaaaatagggataggttttccttcctagcccagtagagtttgacctcattagtatggtgctttgggtgaggacctcttccttgattatcccactttctagtgaacagctaaaattcctgagagtctctactgttaaggtacctttaataggataaagcagggaccacctatctcagtgggtccatttttcttttaaaattagttatctgaaaaaacttagcagtagttcccatctttaaggtaagtctttcatttggtccccattgtgtaaaatactaatcaacattttcaagcttctgtacaacagactgcttttgtctagatttctcaactccactttataaagcttatcagttttcagagaggaatgtgaattttttttctaatgcaaataaatggatatggcaggaactacagcataagtgattattgtgattctgggtggacggatataatttacaacatttagggatgttctaggtagcctgctgtagtttgacttccagtcactgttgtctttcacattataatttgtatatttcttgtgatagaagggatgatgcaaatatgtaattaaagtgtcaccagatttctgttaaaaccaaggttgaaataaaaagcctaacattggtaagctacattgttttctcattttagaatgattcagagatttcagatagacattttttaaactttaatgcttagctagaatctacattctgaggaaaactctaaaaaacttaaaaatttttagggaatttttatttttcaaatcataattttaaaatgatagataccattttgtgataacaacaattcagaaaacaattttctatcctcttagttgaaagaatgtaggtacagtttggatacttgtactttaattttagagtaaacatctgcattatactcttatagataatagaattatttagttaagaaattctttacagtaaatgagataatgtgtgaaaaagtattttgtaaatgctgaggattctacaaatgatagttgttattttcatgt

SEQ ID NO: 4019 - DNA, 1138 bp, Homo sapiens
tgagaatggtgaaaaatgatacaaacagtatacataatcttcatttaaagattgatttgtttataatataattaaatgataagttgaatgtataaaacctatgcccattaaagaagtttgaaacaatgtgtaaatttaacatggaaacatgaaagtcctgggaacccctttcgtgccactatacacgaagttctgggagttcatacacagtgcaattataattatagaaatggaatcggccggggcggctcatatctgtaatcccagcaccttgggagactgaggtgggaggattgcttcagcccaggagttcaagaccagccttggcaacacagggggaccctgtctcttaaaaagaaaaaaaaagaaaataaatggaactatacatactaatctgtagtttcttttaccttggattttttcttttaataacaaaatctggttcaatttcttagttggaatatattttttattttaaaactttaatcatggaaaatttcaagcagatacaaatgtagagagaatagtatgatgaatcattatcgtccagcttcagtgttccccaagacagggccaatttttttttcatctatttccctttttttcccttccctttccacccttgtattattgtaaagcaaattctagacgtatttcatgcataaaattttcaacatgtatccctgaaaaattaggaccctcctctttttattaaactccagtaccattactatatctttaaaaaagtgcaatttagtagacaatattctcagaattttaaaacataagaccttggtatgaataatcacttccttggtacctgtctgtatctgtgagtgtgctaggggctttacattattgttattccttgtgataacactgctgggtacctattattgtcccatttcatgtgtcaagaaactgaagtttagaaataattgtctgaggttccagagctatccagtggttggttctgtgtggagaatgtgggctgcctgactataaaacatgtgccttttccactctaccacgtatttattatgtctgtgaccaccagtgatttttgcagaagaggaattcctcttatgtgcgaggcattttcttctggtttttcatttttgtagcctgaaatttctca

SEQ ID NO: 4020 - DNA, 1206 bp, Homo sapiens
aaaatgtctgggttcactgcagcaaccccagttcctgtaagcataaggcccttttctcttagcctcactcagctggatactgataggattcacccttctgctgtcctcagcatcactctttatcactggagaatctctgcccctttggaaagtttgttgttgttttttttttcttttttttaaaaagtgacagtactgtttttcgcaacaggtttgccgctagaacacaggtgtcatgaaaactcccaagccaaatgggaaaggaaaagacgcatatcaacattattgtcactggacatgtagattcaggcaagtccaccactactggccatctgatctacaaatgcggcgtcattgacaaaagaaccattgaaaaatttaagaatgaggctgctgagatgggaaaggcctccttcaagtatgcctcggtcttggataaactgaaagctgagcatgaacgtggtatcatcattggtatctcttttgtggaaatttgagactagcaagtactacgtgactatcattgatgccccaggacacagagacgtcatcaaaaacatgattacagggacatctcaggctgaccgtgctgtcctgattgttgctgctggtgttggcgaatttgaagctggtatctccaagaatgggcagacccgagagcatgcccttctggcttacacactgggtgtgaaacaaccaattgttggtgttaacaaaatggttacactgagccaccctatagccagaagagatacaaggaaatcgttaaggaagtcagcactacattaagaaaattggctacaaccccgacacagtagcatttgtgccaatttctggttggaatgatgacaacatgctggagccaagtgctaacacgccttggttcaagggatggaaagtcaccggtaacaatggcaatgccagtggaaccacactgcttgaggctctggactgcgtcctaccaccaactggtccaactgacaagcccttgtgcctgttcctccaggatgtctacaaaattggtggtattggtactgttcctattggctgagtggagactggcattctcaaacctggtatggtggtcacctttgctccagtcaacgttacaactgaagtaaagtctgtcaaaacgcaccatgaagctttgagtgaagctcttcctggggacaatgtgggcttcagtgtcaagaatgtgtttgtcaa

SEQ ID NO: 4021 - DNA, 1150 bp, Homo sapiens
attatcctttgccagcagtgaactgccattctgtcacagctctgtgtctgatacaaggcacatagattctgtacttaccatccccaaattgcaatgtctcagactcaggcttagagcatggcatgaacatcaaaggcaggaacctgtttatctttgaattggaaagatacagcaaaattacactgtttggaaatacgaatagaggagtgaaaattgttgcagtggggtacccaaagggattcgagacctcaagttttttttcatcttgtatccttcaggtcctcttgcccctggccaatgtggcattaattgactacactctggaattcctgactgccacaggtgtacaggaaacatttgtcttttgttgctggaaagctgctcaaatcaaagaacatttactgtaaggccctgcaacttttctttccatgtttcgccatctttttccagttttttcaggatgaatgtaactaaggggaaatgtgagaggggaaaaatgtgtctacttagatgtcattgtaagttctaagggtattttctacacttatcaggaggtgagcagctgaaactttgtatctgtctgtcttgggttttctgtgacaaagattaaagaataaacttgggttttttctgaatctcattataaagtttggtgccagtggactttgcttttatttaatggcttcagtatggaagttacaatgataacatctttgttttcccactgagtttctaaatcttgtttgttctcaccttcaaggatataaatgagctccttgtcatctttgtattcccactgcctagctcagtcccaagcatatagtgagcacttacatgtttgttgaaatcttgaaaactagggaatcgcattgcttatggaagtccaggatgtaaagactaggacattagcatggtctccatcagacagttcctaaatgttatatggattgcagaaggggaaagctgacgtgaagcgtgttcccaggctactttgtgtaccctaggcttcagcaggattttgagttcaaattgatgtttagggacaaggggtcaaggtatggagaggaaataaccatgtttcctaacccataaaacaagactggtgacacaggatgctgaaagcattcattatagttcataatactctttg

SEQ ID NO: 4022 - DNA, 1456 bp, Homo sapiens
ttaaattatcagccaagggtggtggtgtgtgcctgtagtcccagctactcgggagactgaggtgggaggatcacttgtgcccagttcgaggctgcagtgagctatgatcacaccactgcactccagccaggaagacagagcaagaccttgcctccaaaaaaaaaaaaaaaaggctgggtgtgatgtgactcacacctgtaatcccagcactttgggaggccaaggttggcagaggataacttaagcccaggagtttgataccagactggccaatgtggtgaaaccctgtgtctattaaaaatacaaaattaggcctttcctttcagtggagcgtggcggcaagatggctgtgcaaatttccaagaagaggatgtttgtcactgatgacatcttcaaagctgaactgaatgagtttcttactcaggagctggctgaagatggctactctggagttgagatgcaagttacaccaaccaggacagaaatcattatcttagccaccagaacacagaatattcctggtgagaagggctgacggattcgggaactgactgctatagttcagaagaggtttggctttccagagggcagtgtagagctttatgctgaaaaggttgccactagaggtctgtgtgccattgcccaggcagagtctctgcgttacaaactcctaggagggcttgctgtgtggagggcctgctatggtgtgctgcggttcatcatggagagtggggccaaaggctgcaaggtcatggcgtctgggaaactccgaggacagagggctaaatccatgaagtttgtggatggcctgacgatccacagtggagaccctattaactactacgttggcactgctgtgtgccacgtgttgctcagacagggtgtgctgggcatcaaggtgaagatcatgctgccctgggacccaactggtaagactggccctaagaagcccctgcctgaccacgtgagcatcgtggaacccaaagatgagatactgcccaccacccccatctcagaacagaagggtgggaagccagagccatctgccatgccccagccagtccctacagcataacagggtctccttagcagctgtattctggagtctggatgttgctctgtaaagacctttaataaaatctcatacaaagacaaaaaaatatatacaaaattagggctgggcatggtggctcacacctgtaatcccagcactttgggaggctgaggcgggcagatcacctgaggtcaggagtttgagacaatcctggccaacatggtggaaccctgtctctactaaaaatacaaaatattagctgggcatggtggtgcatgcctgtaatcccagctactcaggaggctgaggcaggagaatcgcctgagcccaggaggcagaggttgcagtgagccgagatagctccactgcactccagcctggatgatagggtgagactccttc

SEQ ID NO: 4023 - DNA, 1201 bp, Homo sapiens
tttatttttcaccttattctctactttaaacaaatcataactttctctttaagcctctgctataaattctcctggctctcctgggcttccatattttgggggctggggtgtcaaaagtgagatgaagttcttagctccaggttttggggtaaaccaaggtaggaacattttggcatttatttcaattaacaatacttccttggacgggtgcggtggctcacgtctgtaatcccagcactttgggaggctgagacaggtggatcacttgaggtcgggagttcgagaccagcctggccaacatagcaaaaccctgtctctactaaaaatacaaaaattagatgggtgttttggcacctgcctgtaatctcagctactcaggaggctgaggcacaagaatcgcttgaatccaggaagcaagcggaggttgcagtgagttgagatcgcactccagcctgggtgacagagtgagattctgtctcaaaagcaaactaacaaagaaaaacaatacttcctggggttttggtgtgcagagggctttgttggaagtgtgactcaatcttgcctgccttctgggagctctagaattgttcccaacccagtccatggcttctagccaccactacagggctgtttcatgtacttctctctctgactctgtcttgtccgactctcttgagaatttctcaacgattgctcatgcctgtcagtatcagtgcttccatcgttccatctttgattcacttctctttcctttctatttactcccaaaatggagtcattcatcctgatgtcctcaattgctgctgatatgctggtgattcccaaatacatagctccaacccccaacttcccccagactttagatctgtattggtattacctactggacatctctatggacagttccgtatagactcaactcatctgcccaaccaagtatgttcctcctgaattcctctcctggttacttcatcacaatctacataggctcaccagctagaaacatttatgagcttacattccttcttcccatatcttatcagcatatcatatccatttcactccaacactctgtcttgaatttggccctccctctcccctctctactttaattcattggagcatgggatttggagttaggtggttttgggtttgaattccagctctactatttttggttgtgtgatagagttatttaacc

SEQ ID NO: 4024 - DNA, 1475 bp, Homo sapiens
tagaggtgaggaaactgaggcctagaaagaagaactggctttaattcatagatccattcttcccctttcaagcctcttagtagaaattactatttgtgatgaggcaaatcttttacttctctcggcttgtcctaacacagttctttcaaaaaacttagattgtttaaatgccaggtaagacacaaagtttacttacagacaggataatgggctgactttgctttgcgcatgttagacataattttctccaccttatttttaagttcataatattgagcaggataagtatgttctaaagcagttctttggttgctgtctcctgctgattaaaggaactgattcaaggtgtcacaggtagggctttcttctttagtcacctcttagaaggtcccacgccgccccagcttctttcaggaccccagccatacaaacacctgtagtagcgatgaagtagggcagggcaacgggacttcccagaggagagcggctgtaagaggaaggccacatttctaactagctctccttgcccaggtgccattcgcgccctctggcctcaaggtgcgctacttgaaggtgtttgaaccgaagctgaactacagcgaccatgatgtcatcaaatgggtgcgctacattggccgcagtggcatttatgaaactcgctgctagctgccactaggcagctagcccacctccccagccaccctcctccacaggtccaggtgccgctccctcccccaccacacatcagtgtctcctccctcctgctttgctgccttccctttgcaccagcccgagtctaggtctgggccaagcacattacaagtgggaccggtggagcagcccctgggctccctgggcaggggagttctgaggctcctgctctcccatccacctgtctgtcctggcctaatgccaggctctgagttctgtgaccaaagccaggtgggttccctttccttcccacccctgtggccacagctctggagtgggagggttggttgcccctcacctcagagctcccccaaaggccagtaatggatccccggcctcagtccctactctgctttgggatagtgtgagcttcattttgtacacgtgtgacttcgtccagttacaaacccaataaactctgtagagtggagttgctggcttagtgttgatgtgggagctacatggggagggaactggtgttgctctccgtgcagttttctgtactgaatactctaaaggctctttccttgtcttgtcccagttaggcccctcctgggccatccaagcccttatccttgtgggttctgggcccaggtttcctggctcctcttagaaagcctcaagggcatgcagccgcagcgggccccagtaccctggggatagattctttccctagctcctttttattccccctggtcctcggactcctaggctcaagagatcttacctgccccagcctctggagtagctgggatcacaagcac

SEQ ID NO: 4025 - DNA, 1148 bp, Homo sapiens
agccagaggagcaggccaaggaggtgacagcatcaatggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaaggtaaggtgtggttggacggtagaggtagggcgggctaggggatatcgttccttgccctccttgatgaccgcccatttttgacatgtttctgggtccctgcaatggaatctaagaactagattaaggacttttaagcctaaaaagggtgatgcaaaggggaaatactgttctttggctgctttctatttcccagggattaagggtactccttaaattattggcaaagatccatgcttttatttatttatttttaattagtggcagtatctgtgccaaagaggagacggaaaattaaggagctaaataagaaggaggctgttggagaccttctggatgccttcaaggaggtaagggagcagaaaatgggaggggagagggccaagttgaggtatggagcagtggtcattctgcaaccaaaactggatgttctgttgttctaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcaggtatgctgaagaaagggttgagaatggcttgagttttcttattagggccagaggaggcagtatgattgcttcattctgttttccttgcagatcagtggaagcctctaaacctagaggagaaaaaacgttacgaccgtgagttcctgcttggttttcagttcatctttgccagtatgcagaagccagagggattgccacatatcagtgacgtggtgctggacaaggttagtggcttcagttggggaggggacgataagttt

SEQ ID NO: 4026 - DNA, 1214 bp, Homo sapiens
tggagggggatgggctgaagcatatgtggggctcactgagcccacaatgatggggcggaaggcctgaggaggggtggggcctgcagttataggtgggacatgagaagttcctggtctgatgcctttctccttcctagccccgaatggatcagtatttcaaccagatggaaaaaatcattaaagaaaagaagacgtcatcccgcatccgctttatgctgcaggacgtgctggatctgcgaggggtgtgtgtccccctcctccccactgccagcctgctgcctccagtttctgacactgccttgtcttgccttccctgacatcatcgtgactggccctctgtctccacagagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagtgagttccaagctgggattgagaagggagcagtgaagggaccgggaggttatactttcctctgatgacttcctgttagtgccacgtgtctgggccactgagacaccatgatggaactgaggatctgaggaagggaggctgggggtggcccaaggggaaggggctgctaggatttattcattattccagtatgcccctctttttgtgtcaggccgtggacttccccttgtggatgatggtggctggaacacagttcccatcagcaaaggtagccgccccattgacacctcacgactcaccaagatcaccaaggtaggggtgtgtgtgggagtgggtgattcagctcaggtttagatcttagtcccttcacttttctaaagttgagaaggtgacagctgaatgtttcctcttagactaactggttggattgctggagacaggactgccagctgtagagggagggtggtactcccattagtctggaccagtgtttggcaaacacacacacacacacacacacacacacacacgtgccagatccagcccattcatacatcccaggacccagtagtggtttttacattttaaagttgcgaaaaatcaaaaagtgaatggtaatttatgctgtggaaattaaataaaatgtaaatgtcagtgtccatgaagttttattggaacacagtcacagcatgcctttatcatctac

SEQ ID NO: 4027 - DNA, 1214 bp, Homo sapiens; identical to SEQ ID NO: 4026

SEQ ID NO: 4028 - DNA, 1538 bp, Homo sapiens
agtcctgaaggaacaagacacgaggaagtttccggcaaaggatatagcatccacaaaagtgtcaaggccagagaaggtgtgtatgtacaggaaatgtgtggggaaggaagggaaattgagatcaggagttgtcaggatctgtttggggggcagtgaatgttcaggttacatgtaggatatatataggactttatgtatgatatatataggacttttagcgatttcctgaattcaggagtaccaattctgaatatagttttctccattaaatacatcatgggcagagaggtttcaggctgccaaggtgaggccaagcaagtttgtaaggtttttctgatggccaagtgactcattgctgtgcagcagtctcagatcatgagattagcatcctgtcagaggcctagtcactctggaatggccacaaatgtcaggctggtgcatcagggccttgtttgaacagtggaacttgggagggttccctggggtgggctggggtggcggtggccagtcacctctaactgctgtcccgcctgcttgcagacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctcactgcctttctgctttatgccctgctccctctagagaaggtgtttataggtggggatccttcccagagctggtactgtagcgctgttccctgtaacctggcacccctcctgcctcttcccctgtccatgattgcagggatctgaggtttcctggaaggttgggccctcagatgggcttgataggtgccttcctggtccggagaaaagggagattagtgataggacatccttgctaggctctgctctcctaccagaatgattcaagcccctgtgtggggaaggcttttgggtttcgggttgtttatagctggagaatccctttatggcttgaaggtgtcatctgtaaaatgaaggggctggatgcatg

SEQ ID NO: 4029 - DNA, 1216 bp, Homo sapiens
tgtgttagccaggatggtctcgatctcctgacctcgtgatctgcccgccttggcctcccaaagtgctggggttacaggcttgagccaccacgcccggctgaccagtaaccatttttaaatgggatcttttatattgttaattactgttaagaataactttgctgctattgctccatagggctgaccagtttgagtatgtaatgtatggaaaagtgtacaggattgagggagatgaaacttctactgaagcagcaacacgcctgtaagttacgtaatcttgtgaggattcttttcctcttccatgttctgagactttgagctatgctcctgcttcctctgttgagtccctctcctcaggcacctcagaccgaggtgggaactagaaagaaatagttctgggagcagtttccagtctgaaatgtagactgccctttgtcaggccctcctggcccagtggtccacatgagaaactgattatctcactgtgtaaagtgcaaaggagacttgcttccccaggaataaatgcagcattaagtgattagactgttaggctttgtgtgtgtgtgtgtgtgtgtgtgtgtgtgtgttttgctactctgtaaaaggctgtgtgtgtgtgtgtgtgtgtgtgtggctactctgtaacccaatccctagttccttggttttcctgtccagctattttttcttttctttaaagtcttattaaaacaatatgtgctttttgtaagtaatttgaaatgcagaagagtaatgtgaagaaggaaaaaaaagtcacctgtaattccatatccagagagaaccttttacatagacttttttgcatatcctggtgttctgtttttttcttggagactgtggtgtttattatgttttcttctgctctttttgcttaacattatgtaaaacatgtttccccatgttagtgtaaagcttttcttttcttttcttttcttttttttttttgagatggagtcttgctgtgttgcccagcctggagtgcagtggcgcgatctcggctcactgcaagctccgcctcccgggttcacgccattctcctgcctcagcctcctgagtagctgggactacaggcacccaccaccatgcctggctaattttttttttgtatttttagtagagacagggtttcaccatgttagccaggatggtcttgatctcctgacctcgtgatccgcccgcctcagcctcccaaagt

SEQ ID NO: 4030 - DNA, 1252 bp, Homo sapiens
gccccagattgggtctgttaatgatgatcctgggccttatctatatgagaggtaatagcgccagggaggcccaggtctgggagatgctgcgtcggttgggggtgcaaccctcaaagtatcatttcctctttgggtatccgaagaggcttattatggaagattttgtgcagcagcgatatctcagttacaggcgggtgcctcacaccaatccaccagaatatgaattctcttggggtccccgaagcaacctggaaatcagcaagatggaagtcctggggttcgtggccaaactgcataagaaggaaccgcagcactggccagtgcagtaccgtgaggccctagcagacgaggccgacagggccagagccaaggccagagctgaagccagtatgagggccagggccagtgctagggccggcatccacctctggtgagggttggtgaaaagttggccagtgggtccccgtgaggacgaactactgtcctgagtcataagtaatatgggtggggcgagggtcttatttctgtagaaatcgtgtgactttaaggatttagattttgtatcttatgttttgtaacatttaataattactgttaaaatgctgtttgtaaatgagattggtctactttttcctgtaggattttattgtagagttttgctggttttgtaaaatggatggaagaactttgtatttatactgtgattttgaacagattatgcaacattggaaggaaggctgtactttgatggtttgaaggaactcagcagtatgatgatctggttccaggggaaaaaaatagctggttggtgtctagccccccaacacttttgtctgttgtgtataaaagaagaaagactggcatgtaccttcatttgcttagctatttgagtatctagagaaaaattaaaatgcaatgagttagcagtataccctggcacacttaataaattaaacatttgtggagcatcttgttttctgtgatgcactgtgtgggcacttggggatagaatactaaacaagataaaggtcctactttttttcagaattgaagagtaagtaaataaacaagaaattagcagtgcaatgagttgaagtctacaaagggatacttaacccagctgggatgattgagtgaggtttgctgtaatcccagcactttgggaggccgaggcggactgatcaccggagtcaggagttcaagaccagcctggccaacatggtgaaaccctgtttctactaaaattacaaaa

SEQ ID NO: 4031 - DNA, 1155 bp, Homo sapiens
ccgctgcagtattttctctttacgtccagaataaatttcagtctccctagcatcctttactaattggttcgcacagtcttacctcgcagccttcaccgtgcactctgcacaagagccccggtaaagcactgaaaatcccagatacacacactcacaaataggcacttgcagaaagaacgtggggggcactccatccctatttcatctcttgtacaccgaaacattccccagtctgcatgccttggatgggagagtcctggttacattcccccgcccccgacttttcaagcctaaaatccgtcacagggcgcacccccgtccccaccctccagggcatttccacttatagcagcctgggcacacccccaacccagaagggaccggaaaaggaggggctgcgcgcggcactagggtcgccgtcctggctgaggtggccggaagtggcccctcgcgcgggcgcggactgaggctgcgcgccgcaggttccggctgctggcggcgttgcggccgcaggtttgactcccgtgcggtgcggcccagcagccacaaagctcccgctgccattgctccttgtactcccgccgtcactgccgctgtccaacccctcccccggggcttgcgcggcggctcccacacccctcggcccgtgtacgcgctctgcacctgcctgcccgaaaacatgttgcagacaccagagagcagggggctcccggtcccgcaggccgagggggagaaggatggcggccatgatggtgagacccgggccccgaccgcctcgcaggagcgccccaaggaggagcttggcgccgggagggaggagggggctgcggagcccgccctcacccggaaaggcgcgagggccttggcggccaaagccttggcaaggcgcagggcctaccgccggctgaatcggacggtggcggagttggtgcagttcctcctggtgaaagacaagaagaagagtcccatcacacgctcggagatggtgaaatacgttattggagacttgaagattctgttcccggacatcatcgcaagggccgcagagcatctgcggtatgtctttggttttgagctgaaacagtttgaccgcaagcaccacacttacatcctgatcaacaaactaaaacctctggaggaggaggaggaggagga

SEQ ID NO: 4032 - DNA, 1222 bp, Homo sapiens
gttttatgtttattttggtcaaatatttcccagaattgtccagaattttctggactacagaatgtttagttactctagcaggagaaacctcttcaataagactgctttcttctttccacagaaattctaccttttctgaatttagtctaaattatataacagcaagtttgttaacatggtactataaggataggacatatgaagaggagtggccaggcacagtggctcaagcctgtaatcccagcactttgggaggctgaggcaggtggatcacttaaggtcgggagttcgagaccagtctaacatggagaaaccctgtctctactaaaaatacaaaattagctgggcatgttgatgcatgcctgtaatcccagcaacttgggaggctgaggcaggagaatagcttgaacccgggaagcagaggttgcggtgagcccagatcgtgccattgcactccagcctgggcaacaagagcgaaactccgtctcaaaaaaaaaaaaaaaaaaaatgtatgaaggtaccaataagagcttgataaatatctttatggagtcaaagtagattacatttgttacactgtccatcatgtctctcaccatcactgctgtttttttttaagtgtatatatgaatgtaatctataaattagtttgtgatgagcacttagtaatattcaagggacactgaattggttcctttgtgcattatcttactttactcatttattcctcttagcaacacagtgagataatgggcattttctacattttacagatgaagatagggaggctaagtgaatttaagaaacattcctaaaattaccaagacatactgtagttgtaaggcttgtaactatctgtggggtaggggtggaattaaaatccaggtatctggtttcatagtcatgataccttctaaaggaacattataaaaacaacaaatatattgtaaaaaatccagaaaaaagttgagaatgtttccattaacagatttgtgggctgtaaatttaatccatattgcaggaatggctaagattgataatttacttccctgtcttagctagttgatggtatgtgggaacaacagtcaggaaagcacagtcatgtttggtttttaatctacaagttatgtccttttccttccctcatttcatccattgccactcttctctatttcctcttcatggcacccttattctctttgttatcatattctcagttctc

SEQ ID NO: 4033 - DNA, 1283 bp, Homo sapiens
catttccatatacctcatgcattgtgggttaaaaagtccctgcatcacttctgttctcacaggtactgagctgtcaaaagtgcatgaaggcctctcactgtactctagtcctgacttggggtgcagagggctgcttgcaatcctgtttgtaaggctgtgcctgctcagagctttggactgttcaacccacacaagaacaaacgctaactaatattttttttaagagattcttttccctatgaatgtgggaaatgcaggatttattctgtgaattgtttgtttctgtgtgtttgttcagcgtattcattcactcactcgtttgcaaacataatgggcagtggtcatttactgctgctcttttacagttagctctaaattacttgtttgaactatttatttctgaaaggaatgttactcaagctgccactccctgctgaagagcaggagggaactctcactgggggcggaaggaagtggagctggagcagtaactgccaacatgaagctggagggtttgggattttttttgtttttgtttttttgaggctcaaaaaatgctgggagaaatgaaaatgctgtgggatagggctcctgttgcctttcagaggaagtctgacactacagcgttggcacagtgccgtgaacagtggaactgtgcccaagggactctgattatccaagcatcttccgaagagtgttgtggtcaccttaaagagacttccccttctggaaatgtggtgacttggcttagtcttcaaactggattcatggatttgaagtaactgtaaaccctaaatcttcattttcatcccagatctggttgagtataaacctcagaattgtaggggctggcctgagctgtttatttcaaaagatactattcaatttaaagctatttttcctcagagtttttgttttctatatattaagtctaaattaagttttctactcattaagactaacatctccccactccatccccactgaaatttgtggaagaaaatttagtacttggctctgaggttgccagttatacaataatctattttgcatatgaaagtttgtatttaacttttttgttcattaaaaaccttactgatatggttataacttcagacagtttagagttggtcagaacatattttgcaagatctagtgcctagtgttgcttttctgatgtaataaaaggtggtctggcagaacctaaaaaagtatatgctgaaatgatttctaaccctctccctacttaaacctcccagacttgttctggttcataaaagcaa

SEQ ID NO: 4034 - DNA, 1325 bp, Homo sapiens
ggaggcggccagggactctgccgaggccctgagaaccccaggggccgaggaggggcggggaaggtcagccaggtttgccagaaccaccgagccccgcctcccgccccccagggcttctgcaggcttcagccatccacttcaccatccactcggatctctcctgaactcccacgacgctatcccttttagttgaactaacataggtgaacgtgttcaaagccaagcaaaatgcacaccctttttctgtggcaaatcgtctctgtacatgtgtgtacatattagaaagggaagatgttaagatatgtggcctgtgggttacacagggtgcctgcagcggtaatatattttagaaataatatatcaaataactcaactaactccaatttttaatcaattattaatttttttttctttttaaagagaaagcaggcttttctagactttaaagaataaagtctttgggaggtctcacggtgtagagaggagctttgaggccacccgcacaaaattcacccagagggaaatctcgtcggaaggacactcacggcagttctggatcacctgtgtatgtcaacagaagggataccgtctccttgaagaggaaactctgtcactcctcatgcctgtctagctcatacacccatttctctttgcttcacaggttttaaactggttttttgcatactgctatataattctctgtctctctctgtttatctctcccctccctcccctccccttcttctccatctccattcttttgaatttcctcatccctccatctcaatcccgtatctacgcacccccccccccccaggcaaagcagtgctctgagtatcacatcacacaaaaggaacaaaagcgaaacacacaaaccagcctcaacttacacttggttactcaaaagaacaagagtcaatggtacttgtcctagcgttttggaagaggaaaacaggaacccaccaaaccaaccaatcaaccaaacaaagaaaaaattccacaatgaaagaatgtattttgtctttttgcattttggtgtataagccatcaatattcagcaaaatgattcctttctttaaaaaaaaaaaatgtggaggaaagtagaaatttaccaaggttgttggcccagggcgttaaattcacagatttttttaacgagaaaaacacacagaagaagctacctcaggtgtttttacctcagcaccttgctcttgtgtttcccttagagattttgtaaagctgatagttggagcatttttttatttttttaataaaaatgagttggaaaaaaaataagatatcaactgccagcctggagaaggtga

SEQ ID NO: 4035 - DNA, 1286 bp, Homo sapiens
tgactgtaggctgctgtggacccaagcagtgagttctaagtattggaaatatgatcatttccaagggatagaaatcaatatcatgatttccaagggatagaaacttagctgtttgcgtaattttgattgtgcccctaatgtggagctgtggccgactggatttgatggaatcataaacatgttcacaaacctttcccacttcccacataaacctcagcagatctcaattctgaagacgtaaaagtctctgttgatttgtattggttctctccagcttagccaacgagaaacgtttcaacagttttcaactcttatttagcaaaggcagaacaaaatgacatacccctttgggaacaaaacaaagcatgtttttatggccaagagttttctctatattaaaatgaaggctgattttgaaaacactctatcatagtgggttcttgtaactcaattataattacataattatgtatcatttgtgcatttatatgtttatagcacatatatatgtgtactgtgtatatgtatatgtgtgtttgtgtatttgtttatataattataaaactatataaaaacatagcatcaggccagagttctctacccgccagccctgacgtagaaagggctgttcctacagttttccagtgagctgtgagcagctgaggtgtcatttcccagagtctctgtgtaacctccaccagattgatttttcttagtttgattatcccaggtctggatcctacaagcctctcattttaccttccctgtttccaccttcccaccttcccaccatatcacttacttccaagctcactgtaccgcctccagaaagcacaaaatgacataaaattgaaaacttaaatccatcaatactgctcctcataaaagttcatctcccagttggctggtggaggaagtagaaggcaatgctgtagtaaagcgtgattcagttcttgttgcagtttcttccttactttttgaaaataacccatgaagctgaattactctcatcttatatctctctgcagtggcatatcctgatggtgatttcctctttttgtgcctcagtttcaccccctatggaatggggataaacacttgcggctgggcatggtggcatgtgcctgtagtcccagcactttgggaggctgaagtgggaagattgcttgaggccaggaatttgagaccagcctgggcaacatagtgagacactctctctacaaaaaaaaaaaagaaaaaaaaaatcagatgtggttggtgcatgctacttaggcgactaaggcagg

SEQ ID NO: 4036 - DNA, 1183 bp, Homo sapiens
ggcgggaggatcgaatattcgcagtggcctgtgaatagacacttcactccagcctaggcaacatagtgagaccctgtctcaaaaaaatagaatgaggctgggcacagtggctcacacctgtaatcccagcactttgggaagcaaaggcaggcagatcacctgaggtcaggagtttgagaccagcctgggcaacatggtgaacaccctgtctctactaaaaataccaaaattagctgggtgtggtggcagtgcctgtaatcccagctactcgggaggctgaggcagaattactttgaacccaggaggtggaggctgcagcgagctgagatcgcgccactgcgctccagcctgggcagagtgagactctatcaaaaaaaaaaaaaaaaaaaaaaaaaaagtcgtttgtcagttttggactttacaaccagtagacttgagattacatttctattttactctgtttgtttttccacaggaacccagactagcacttatgctgtagtgtgttctcaaaaactatggttgactgactgaactagtgaaataaacatatcaaggcattgaaacatacaactttattattattattacttttagagatggggtcttgctctgttgcccaggctgagagtgcagtggcgcaatcatagctctctgcagcttctagctcctaggctcaagtggtccttccacatcagcctcctgagtagctgggacaacaggtgtgtgcccagctaattttttattatttatagagacaaagtctccctatattgctcaggttggtcttgaactcctaggctcaagcgatcagcccacctcggcctcccaaagtgttgggattacaggtataagccactgtacctggctgaaacatacaactttagagatgacagggatcctagaatccacctgccttcagtagtttcagttataatgtggggtctcccaaatactaaggacccagcagtaaaagagggtaaacacttttttcacatttctaaatacagagccctgttgtaggaacagagggtactttgatgaaacagacagataaggaaagtccttgctttcatgcaacttagatttacatgaagaaaatcttgacgtgctaactagaatgcctaatttctttttgatttttgccacgaatgaatctgaagctctgattgtctatattacc

SEQ ID NO: 4037 - DNA, 1187 bp, Homo sapiens
agttcacttaatattaaagcatgttcattcttttcttcccaggtcgctattaaagcatgaagactttctgaaacctgccctagagctgggatattgtttgtgggcaatattttttattgtctcttgtttaaaaagtgaacagtgcctagtgaagttaggtgacttttacaccttttacgatgactacttttggtggagttgaaatgctgttttcattctgcatttgtgtagtttggtgctttgttccaagttaagtgttttcagaaaagtatgttttgcatgtatttttttacagtctaaattttgactgctgagaagtttctattgtacaaaacttcatttaaaaggtttttctactgaatccagggtattctgaagatcgaagcctgtgtaaaatgctaccaaatggcaaaaagcaacaataaacagtttgatttttacttttctttctaacatatcaatgcttagcagaactattcagattgtcagtagtaaatttaaagacaaatgcccgttttcctccagtccatgaaacataccatacttatatacctgcaactaagtgtttaaaattatgctctgtaactctgtactgctagtattagaactaaaaatcttaaaatacagccagtgcttaatgcttatatcaatgtggatttgtcggcttttatgtaatctgtaatatgtatagcaggaaatacgaagagttacacagtgtatgccttaaaaggctgtttcttaaaggtgttacaaggggataatggtatttcaactagttatcagcaagtgacaatacattccaccacaaatacactcttgttcttctagcttttagactatatgaaaaaaccgggtgcttcaaagtacatgataagggaacactatacctgtcatggatgaactgaagactttgcctgttcattttttaaatattattttcaggtcctttgcttaccaaaggaggcccaatttcactcaaatgttttgagaactgtgtttaaataaacgcaaatgaaaagaaaaatgttggtgcagctgttcacaaagaagtgttcttgttctattataattagagttcttctgtagtttaatcgttagggcagtgtgttccttgggctgaggtgtatctttgctattttgggctgggttgagggggggatgaatttctgtattcctggaaaattcag

SEQ ID NO: 4038 - DNA, 1129 bp, Homo sapiens
tttttttcaggaggaaaaaccaggagaggaagtaattgacaataaaatgaaagatcatcaaagtgaaatgtaggataacaagaaaaactagcatgttttatgtaggcagtattttattttgtttagtatgttcaacagacatttacagatcaactaaattcaatctttttaattatttgaggaggtgagctgtaatttaaatagtgccaccttttaaagtagtatttctcctttggacatccagaagacttaatattttctaaattgagggggaaaatgtacaacaaaactctttgaaaataccagtgttggattcaagtttgttctgctttccttcatagctactggcatattgtaggtggttgacttgattttgtctttttatgattcatactataaaatctcactagagcagcttttccagggggtgggttacacttaagctccaaattgtcaggttccctgacaccgtctttctgcagagctctttaaatacagtacaaaaatgtgtgacgctaaatacgtttctttatcctatctagacaagtcacaatactgtaaacctcttcaaccctgagcgtttgtcattgtacaaatgaattgtccgtgctttcctttcatgcacttatgtattaatgtgtcactttttgactagaggtgtgcttttgacacttaacctattttctattgaatataataagaagtgtgaaatgtaactaatagttcttaaaatgttaaatgaacagtaaatgttcagtggcgcacttcacattcaacttaagcatgataagtctatttggagtagagaaatgagattaccatatattctagaaccagcagaaaactatgtagttttcagttttttgagctgcatattctagtttctttttttttttttttaatccaaatcaacaaagggattttttttttctagtttcagttttggcactggattttatcctggagttttaaaatattcttcatcctgttctttttctattaaggttaatgttgaagaaggaaaatgcggaagtcgtcatttgacaagttttataaatgagtatttgaagctcaggaataagtgaagctgaaatttgaaaaaataaaagaaagaatgcatgctaattat

SEQ ID NO: 4039 - DNA, 1089 bp, Homo sapiens
ctgggtattggattcggaaagcattgaatgatgcgaacatacgaggcttgctagaattaagaggaatctgttagaagggtgatagaaaagcaccatagaaattgatttttgaggctgtgggaataatttgtgcttttttaaaaaaaaaaaacaatttgttacctaagtttccccttgttggtaaagctaccttaagatctgaatatgatttatcaggtaaataagactattaaatgtcttagcaaacttttgattaagattttatatgattcctcagagtattttaggaagaaattttcagtgatgaagcgtgagtttcctgcgtaattttggagcccaaactgcttaatttggtttgaactaatcaagccttgcgtttacatactcggatgagcatagagtttttagtttttgatgtttttcccgaagccgattgactccaatgtcacgagtgttttagatttttttttaagttcttgctttcttgggtaagaaagttgggattgagctcaaaagttgttaaaaagtcgtgacttctgatcattggcagttgaatctgttataacagtcattggtgtttggactgcaaagtaagcgattttaaagtcttttgttattaaacagaaaaattcaattattgggtacctttctactcttcaaaaatactaaatgactggcttctgactagagctctcgattgaatacacgtgaagaatgcttgagaatggaaaattgcccagagttcattagtatattttacgtgagaagggaaacaattgaaactaggttccagtttgagactcggctcaagagaaatttgaaattttctgatgggttatctttttactagtaaaagtacactgtgtttttcgcaatctttgaattgtagagggaggttaacttaatgtgttaaaaattgagttttttttcttacataagagtcttcgctttctggccgagatctctaaacttttacgttgtgaaatacttccatattgttgtgtttggtgtttgcgtgtttgtgttccaattggaacctttaagggttggaatacacctgaatcaaacacgtgtctaggcttccaaagc

SEQ ID NO: 4040 - DNA, 1261 bp, Homo sapiens
cagtatgactttgtttctaacagctccaaaatggatcaaaatgtttgttttggatgaagcagatgaaatgttgagccgtggttttaaggatcaaatctatgagattttccaaaaactaaacacaagtattcaggtaagcattacttcacccccctcttaaaggtagagatggggtttatttaatgcaggtactgttacaatacaactgatgtgttttgttgtcgttccccctgcttaaagcacttgatgcataactctgtctaccttcattccgtagtaagacagagacgcttggcttcagacattttcctttgggtattaatgtgtaagttgtgctacaacataattttctctttttaaggttgtgttgctttctgccacaatgccaactgatgtgttggaagtgaccaaaaaattcatgagagatccaattcgaattctggtgaaaaaggaagaattgacccttgaaggaatcaaacagttttatattaatgttgagagagaggtaactgtctgattgttagacattattttaccttcttgtataagcactgtgctaaaattgcagacactaggaccatgtcttggtttttgcaataatgctagcagagtacacacaagaagaaaagtaacagcactagattgtaaagactggggtggacctctttcttaatgtccaatgtcctttgtcttaagatttggtgcaatatctcattagacctaacagaatgaagttaatttttataatttctacgttttgagactgggttatgagactggctaagactggccaattttggtattttgggtagagacagtttcactttcttgaaaccctggtctggttggaactctgggctctaagtgctaggatcccaaagggctgggattacaggcattagcactgtggctggcccagaatgaatttttaactgaagagttggaaaaactaaatgactgttaactttaacttctaaacattacaggaatggaagttggatacactttgtgacttgtacgagacactgaccattacacaggctgttatttttctcaatacgaggcgcaaggtggactggctgactgagaagatgcatgccagagacttcacagtttctgctctggtaagaggtgttctaaaatgtctggatttccactaaagcaggattcagactacaatatagctgctaagtgctgtgttgtcgttccccctgcttaaaataaagttgtttcttaactatacctgtctgctattctcctg

SEQ ID NO: 4041 - DNA, 1261 bp, Homo sapiens; identical to SEQ ID NO: 4040

SEQ ID NO: 4042 - DNA, 1261 bp, Homo sapiens; identical to SEQ ID NO: 4040

SEQ ID NO: 4043 - DNA, 1261 bp, Homo sapiens; identical to SEQ ID NO: 4040

SEQ ID NO: 4044 - DNA, 1132 bp, Homo sapiens
gttctcccaaagccttcccaggaaagtatggaacttaggtgtggaacagaaatgactgggggcacgggggccagttggcagagtgtatgtctagtctcacctagaaacatctttaataccgaacattcaattacctaggtaataccagctgagaaaattgatggagtatttgctgcctgtcagagtggctcttttgacaaactagaagctgtggtcaaggtaaagtcagcttactaactttggggaaaggaatattaagtcatcataccaaaagttttttttattataggatttaatagatgagggtcatgcagcaactcagctcgtcaatcaactccatgatgtggttgtagaaaataacttatctgataaacagaagtctattatcacagaaaaacttgccgtaagtaggtactttgcacatgtcaatggaacatttaactacctgaaggatgctaatttcttaaatttttctcgtaggaagttgacaaatgcctagcagatggtgctgatgaacatttgcaactcatcagcctttgtgcaactgtgatgcagcagttatctcagaattgttaacgtgaatatatctggatggggggttttgtaaataatgaagttgtaataaaaataaaatgaccaaaagcacctttaaagtgaatatacaatttatttaacattcaaacttcattaagacatgtgcaatatggcaattttactggggattaaaccctacctaggattgcttgctggggcttagcaacagggtccagttcacacttagcactaattaaatactttattgaataaatacaataccaaacaaaatgcattcaaatgctttctaaaaaaattttaaaggcctttctactcaggctaatgacaaacacaataaaggcagatatgctagtttaacataattggctgattttatacagcacttatatcttttagtccacaagtatattattaaatgatagagaacatctaatacaaccatttctacagaactaggaaataaatttctaagaaagaaagattttacagaccccatcttttatacccaccccaacagtctaactctaaagaggataaagccaatgactttcctcacaagagctcacgactaacgtcg

SEQ ID NO: 4045 - DNA, 1400 bp, Homo sapiens
cccaatcaggagaataattcctaagactggaacaagccttctctctctcccaaccccaccgatcacttgccaaattcttttatttctacatttttttttctcagagatagggtcttggtctgtgtcacccaggctgtagtgcagtggtggtgtcacagttcactgcagccttgaactccaaaactcaagtgaccctcttgcctcagcctccagagtagctaggactacaggtgtgtgccaccaggcttggctaattaagaaaaaaaatctgtgtgtggtgatctggtgatcttgctatgttgcccaggctatctcaaactcctggcctcaagtgatcctcccacctcagcctctcaaaatgttggcattacaggtgtgagccaccacacccagccattatttctaccttttaaactagtgagtctcaaactttggtctctgaatccttttacactcttaaaaatcattggtatctcaaagagactctatgtaaatgagccatatttatagatatttaccatactagaagctaaaataaaaaatttaaaaatatttctttaagaggaagacgcggtcgtaggtgcgaggatttctggtccgcatgctcctgctcctgactcaccgctgttcgctctcgccgccgaggaacaagtcggtcatgaagccgcgcagcagccatggcttttaaggataccggaaaagcacccgtggagccggaggtggcaattcaccgaattcgaatcaccctaacaagccgcagcgtaaaatccttggaaaaggtgggtgctgacttgatcagaggcgcaaaagcaaagaatctcaaagtgaaaggaggagttcgaatgccttccaagactttgagaatcactacaagaaaaactccttgtggtgaaggttctaagacgtgggatcgtttccagatgagaattcacaagcgactctttgacttgcacagtccttctgagattgttaagcagattacttccatcagtactgagccaggagttgaggtggaagtcaccattgcagatgcttaagtcaactattttaataaattgattaccagttgttaaaaaatatatatatatatttatttaaaataataaacccatcacatattgacataactaataagcccaccacatatttacaagaatcacacattgacacattaacactaacatttctattagaaaactattttccaaaacaaaaaaaataagaagagttgcactgctttacatttttgtaaatctcttaatgtcgcttaacagaaggagctgaattacaatatctgcttctcttgcaatatattcagttgcaaccaaaatgcaatgattttgtttgaagtatacagagaaaaattcatcctcaaacaggtaagtagatggaaaaggtag

SEQ ID NO: 4046 - DNA, 1192 bp, Homo sapiens
atctataacgagaagtctttttctggccattttgaaggggtgttgggccacttactattttaggaagtttaggtctggtgatgtaaaacagtcagcctgcttttttttattctatttttttttcaagcatgcatggcttcatttaacaaatgttacaaggccctaggaactgagtgatttgcaagatgtggtttctgacttcaagaaactcagagtgcagtcagagaggtagaccaaggcaaccagaaactaatattcagcatagaaaaagtaatgatgggaggacatataaagtgttcatggctcaagaggaagaagggagtggaagagtggaagaggaagagggactgctgtccacgttcaaagcccaaattgagtctgacttttgtcgagaattgcttaacaggctgcagaggtggccaggaggtagaccagggctggaattcaagtcacctcatttcaaatctattgctcagtccatcgctccgcctcatgccacattgggtttttctttacatcatttgtttttccttgtctcactttttttaggcttgttttcctgctcagaacaaagtgacttccctgaacacatcttcattatgattcacaccaacctgaagaaaaagttcagctgctgcgtcctggtctttcttctgtttgcagtcatctgtgtgtggaaggaaaagaagaaagggagttactatgattcctttaaattgcaaaccaaggaattccaggtgttaaagagtctggggaaattggccatggggtctgattcccagtctgtatcctcaagcagcacccaggacccccacaggggccgccagaccctcggcagtctcagaggcctagccaaggccaaaccagaggcctccttccaggtgtggaacaaggacagctcttccaaaaaccttatccctaggctgcaaaagatctggaagaattacctaagcatgaacaagtacaaagtgtcctacaaggggccaggaccaggcatcaagttcagtgcagaggccctgcgctgccacctccgggaccatgtgaatgtatccatggtagaggtcacagattttcccttcaatacctctgaatgggagggttatctgcccaaggagagcattaggaccaaggctgggccttggggcaggtgtgctgttgtgtcgtcagcgggatctctgaagtcctcccaact

SEQ ID NO: 4047 - DNA, 1183 bp, Homo sapiens
gcagcgatggctccgaacctcgctcctaaagcggcttgtgtgctctcaaccgtctccctctgttttaaactctctctctgacgtcaggctaggaggcgcccccagatctcaccagcccttttacgcaccattagcctcgcaaaatcaatcacagaagacaggggaggtgacaagatctaaagtggcttacttaaaaaaaaaaaaatactgcacacgcacaggcacacacaattccacatgccccacgatttatacaatcttttattttcactcagtgctatgagcatacacattccacaatttcactcccacacatgcacactcaattacacacaaacagaggctcaaacactcagctcttaaagagcaaatacactatcacccttaaatgcacacaaatgtacccagacaactccatctgtcatcatactctaacattttaggaaggcccaacaagcaacagggcatgtgtatggtaggtggagatcagaatcattcctctaataacagatttgagaatgaaatatggacagtagaaggactgagccctctttatttcctccattatctcataaaaagccttgaagatgtaacggggctctaaaagaacttcacttttctctacaatgggggagaaggtacctctggctcaccctccctccctctttctcagcaactgagacttctgatctacctgcctttctattgtgaccatatatatgtatgagtgtgtgtatatgtacgggagggaaagagagagagagagattgaaatggacttcattttggtgctgagaaatttagagctggaaggcaatctaagaaattattcaataaacctcagaatttgaatcagtaaggcagagtaatggtcagtaaattgttctccttcacatactgcacactttgagcaaaaccagacctccacattccaaagccagtgttccttctactgagctctgagttttctaacagattcctggccggtaagcatagttttatgtcaggaagccccagtttagacatataaggtctaggaactcccagaacatatgtgaccactattgtatatctatatgtggaaaggatcaaaagattcttggttaaattcagctctgcctgatctcctagaaacaaagaaagtttaagaaaacctgtccttgaattctgattgaactctggtt

SEQ ID NO: 4048 - DNA, 1176 bp, Homo sapiens
agtgcatctccagcagcctcatgcaggcctatcaggcctgcaaagccatcatcattaaactgctgtcccggcccaaggctattagcccctatcacctgcggagcatgatgctctgggcctgcgacagacttcctgccaactacttggctcaagaagactatgcagcccactttttgctgggcctcatcgatgacctgcaacactgtctggtcaacaagatgtgccccaattatttcatccctcagtgcaacatgctggaacatctgtctgaggagacagtcatgcttcacgcccggaagctgtcctctgtgcgctcagacccggcagagcacttgcgcaccgccattgagcatgtcaaggcagccaaccggctgacactggagctccagaggcgaggtagcaccaccagcatcccctctccacagtctgacggaggggaccccaaccagcctgatgaccgtttggcaaaaaaactgcagcagctagtgactgagaacccgggaaagtcaatctctgtctttatcaatcctgacgatgtcacaaggccccatttcagaattgatgacaaatttttctgagtgttagctgacttttttttttcctgattcttaaactctgataatgtgtcgtgtggtttgtgatgctatctttctgttttttacatatccagcctagattggatttgttaagaacaaattttaagtttcctggttctgcaggatggtgcaggctctgaaacagtatattactatttcatattctgcctctgatttcgttgtttactttttgtagttattgtcatgctctttagtttgttggagttttttttctttttaaggagatcttaagccatagatgaaaatgcccatgaatcctcttgcttttttctgtttcatacttggtgcaaatttgttcatgggtatggggaaacaaatctctttctgatgcttaacgattctatcctattatttttattattttgtttttgtcttttttcttatgagctttcaccactactgatatttgagaatcatatgaacctgggaactacttggcatgttagctggatttatttattttggccagtgaccagagtagtttccccccttttccaccaaacaatgtaaactttgaaagtgataatactacaaattgtgttttggagcaacttcattg

SEQ ID NO: 4049 - DNA, 1196 bp, Homo sapiens
ctggccaactgcatgacccagatcaatgccatgacctaccccgggcagccgcaccccgccttgcaggcgccgccaccgcccccaccgggacccggcggcccccagcacgcgccgttcgcgccgccgccgccactcgtgcccatccccgggggcgcggcgccccctcccggcggcgccccctgcaagctgggcagccaggctggagaggcggctaaggtgtttggaggcttccaggtggtaccggctcccgatggccagtttgctttcctcattcccaacggggccttcgcgcacagcggccctgtcatccccgtctacaccagcaacagcggcacctccgtgggccccaacgcagtgtcaccttccagcggcccctcgcttacggcggactccatgtggaggccgtggcggaactgagggggctcaggccacccctcctcctaaactccccaacccacctctcttccctccggactctaaacaggaacttgaatactgggagagaagaggacttttttgattaagtggttactttgtgtttttttaatttctaagaagttactttttgtagagagagctgtattaagtgactgaccatgcactatatttgtatatattttatatgttcatattggattgcgcctttgtattataaaagctcagatgacatttcgttttttacacgagatttcttttttatgtgatgccaaagatgtttgaaaatgctcttaaaatatcttcctttggggaagtttatttgagaaaatataataaaagaaaaaagtaaaggcttttatgtcttcgaactgattcttccagaatatgtaaaaaggcttttggtggaatttgaattacatgtaattggtaattcaggaattgactcttttgttattaaaagaacatttgtaaaaatccatcaaacttttcaccaatcctccatgaactaaaaagactaaattccatttactttacaagcagccatctggtaaggcttccctgataaacttgtggtcagtctcttaaaggatttccaaaaaaaatgtttttaagttgcagtcgggtaagtctgcagcccttgttcttctagctcctcctgaggaagattgaacaggactaaattcacgaagctaatggatccaatcctattgcccattgcacgttaagggtggttcctgcagctctcctctcagggtagc

SEQ ID NO: 4050 - DNA, 1134 bp, Homo sapiens
cttgattgttactttcagtgatattctttatattgggtacaggagaagtttggtgtttggtaggtttttcaacattagtttttgagactagtttacctcttcacatttatgctcacaaccctcttgttagaaaagtctgtgtttatatacaggctgtaagtttgtgattgataaaaagaagatgagtgttaattagcctccagtgaaaatatactgaaagcctgttttcatttgattccaatgtttcttccaaagaattctgtataaacatatgccaattccctatgatggtctagagttaggaatgagtgtttatggtgttgcttatagaacaactcaggtaatctccatttctggttttatattttctgtacaaactgcctgggttttatttttctaatcagcaaggtgcttcactgccttcttgagacgcctctcaaagctcttaaatggctcctgtgctatgtgtggtgttggcagtctaatttgcttctgttaaatgttgtagaacctttttcactaggaaataagattcatttctttcggcagtagatgtagattcatcttttaacgtttcttcaaatttgtttctgtcaggctttgtgttattttaaatggttttttaaaattttcttctatgttttcaattacctaaagacataggataatagttttttttaagttagaattttacctcataaaattttttgaggtttgatgtatgtctctgtcttatcaataatgaggcttaaaaaatactggatttgaatggctgccgttttttcaaagcaatatgaatttgatgagtttgttttatgccattaggtggcgccagaggtcagaacatgtctattttgaattggatcgttacaaatgagcatatttgatgcggaaatttctgggagaaaaaaaattgaggaaataaagttaaaaaattgacattcattgagccaaaagagatgtggagaaacatttttcacctttctgtttggcctgattaacatttaaattcttgccaaaattaaggtaacttttaaaaaacaccttttataggtggatccagcagtctggcaacgcccacagttaccacaacacagaaaactgatcgtgctataaaatggacgctaaactatg

SEQ ID NO: 4051 - DNA, 1140 bp, Homo sapiens
gctaggaagatctgcctcccttagctgaagtctaagatgtgtagcttattgatgcctctcctcttcttgttctgctgttgctgaatataatggggatgccagggcagacataccattcaacttgaatcttccttacccactttgtatagtcttacatgtcattgataccttgttttctggtacgcctaaaaggagtagaacttcaagtggtatttaaaagctttaagaaaagtcaaatttttacttttttcttcccatctgaggaatggatttattttctttttaaagaaatccaaatttttaaaagaagggatcttatttttaaaacgaagatcgataatatctactatgtactaaatgtcattctttaaaagttgttccctcataatttagtaaattacttccttttttaaaaaaaggaaagaaagagtgtttgtcttacaggctaacatcacaaacaataagtttcttctcatccatctccatttataaactagtgtgactgtcttctgagcacagtattaaacctggacagggagagggagggtgttagagaatgagaggaaaagagagagaatacctacatataaggtgaccctaaagaaaagcctttcacccttcggaagatcttttcattttcatttttctttttttcaaacaccaacttgtaccagagggaagatctttttttaaaagtgtttcactaaaatttgtaaggaaataatgagctagataaaatattacagtgtttatttaatgaatttactcatatttaaaataatatctaaaaagagtaatttaggaatattgaggcaatgagacttgaaggttataaatagtggcagtgagaaaaggaatattatagataagctgttgaaaagaaaagatgctaagttttctagtgcttccttctgtttccaagggattatagaaatcggagtttgtttgacctgtttcacaggcatctcctttgtggactcattgtgtctcttccttaggctaatagtcaccatttatcatggacggttgtcatgagtgttgaagcacacttaacctgcttcgtcagagggtacttggcatcaccggtgcacagctggtgtcctagcaggagactaactagctgacacaccgtgctttgtt

SEQ ID NO: 4052 - DNA, 1293 bp, Homo sapiens
ctctttcatacagattcctggccctatcctctagactccagagcatctattcagtgagtgggggttagagctgcagcatttacatttttaacaagctaccagatgatgctgtattttaataatgaaaacttggaaactgaatgttcaatagcagggaaaatgtgatatagacacagtatgaaatactgtgtggcagtcaaaaagaatgtagtaactctggatagttatttggtataaaacttcatttgggaataataatttacccaaggctagaagaatctaaatcaagaaatcttaagttctcttaggctctcatttttagttttctcagtttatcagtatgaccaaacactctgtatctatactgcctcttaagtaatagtacttttctttatttgaacagagaaacttaatattaagtttgtgcctgctgaggctagaactggactactgtctttcgaggagagccagagaattaagaagctccatgaagaaaacaaacagttcttgtgtataccgaggaggtgagctgaagaagaatttagaatgccacaaaacatccgaggctgctgagtattcattttttaaattgcttctttttctcagctgccattattagatccaaattacctattttattttggttacttatatgaggaatttttttccttctatgattgtttcagaccaaactggaaccaaaatactaccccagaagaactcaaacaagcagagaaagataactttctagaatggagacgtcagcttgtccggtgagtattatagactctatgaagacttactttgaaatcctgagttcagatatttggcatgcttacacagccatttgtgttttgaagttttgattcttttaagaaggaaatggtagcattctgctaacaagtgcaaatagatgtatgcacaaacaagattgctaggtgcaaatgcatccttgcacagagatcgtgagttggttactctgctcagttccgggccttttcctttcattcccttctttggccattgggcatcctggagttgatcgctgctctcctgcacatttttccagtaagagtgtgggaaagaaatgactttgtgtgataggtaaacttccagggcataaatagcttcaggataaaatttgaatttggtggagtattgtctaaataaatagtatttttatggtgtctcagcaggaaatatataaaataatttgactctggatatttgtgcccagtacttatttttaatgtaataaatttgagcatttacactgctaaaaattgtctatta

SEQ ID NO: 4053 - DNA, 1139 bp, Homo sapiens
cattttgtggtcattaagcattgggtgggtaaattcaaccactgtaaaatgaaattactacaaaatttgaaatttagcttgggtttttgttacctttatggtttctccaggtcctctacttaatgagatagtagcatacatttataatgtttgctattgacaagtcattttaactttatcacattatttgcatgttacctcctataaacttagtgcggacaagttttaatccagaattgaccttttgacttaaagcagagggactttgtatagaaggtttgggggctgtggggaaggagagtcccctgaaggtctgacacgtctgcctacccattcgtggtgatcaattaaatgtaggtatgaataagttcgaagctccgtgagtgaaccatcattataaacgtgatgatcagctgtttgtcatagggcagttggaaacggcctcctagggaaaagttcatagggtctcttcaggttcttagtgtcacttacctagatttacagcctcacttgaatgtgtcactactcacagtctctttaatcttcagttttatctttaatctcctcttttatcttggactgacatttagcgtagctaagtgaaaaggtcatagctgagattcctggttcgggtgttacgcacacgtacttaaatgaaagcatgtggcatgttcatcgtataacacaatatgaatacagggcatgcattttgcagcagtgagtctcttcagaaaacccttttctacagttagggttgagttacttcctatcaagccagtacgtgctaacaggctcaatattcctgaatgaaatatcagactagtgacaagctcctggtcttgagatgtcttctcgttaaggagatgggccttttggaggtaaaggataaaatgaatgagttctgtcatgattcactattctagaacttgcatgacctttactgtgttagctctttgaatgttcttgaaattttagactttctttgtaaacaaatgatatgtccttatcattgtataaaagctgttatgtgcaacagtgtggagattccttgtctgatttaataaaatacttaaacactgagttgtcatttctttagataaattttttaaaaagagcagttttaggctcatagcaaaatt

SEQ ID NO: 4054 - DNA, 1120 bp, Homo sapiens
aactagaaaaaaaacaaaacttggatcacccagaaagagcgtcacagaggcgagggagaatgaagcctcttgttatcctgatcgcctatgacaacgacatttctaactcttctttgaagcgcagttcttactcttaaatctggtcatacaagctttggcttggaatcctgtctgtctttgaaacagctgaagttagtgttttcctgtgttacccagtgttacatagtctcatctttgaacttttctgcgtcagccttctctctttgggaatgctgcctgtttctgtctaacttattctccctggtgtggtgtggcagtgaagtctgtgctgaagcccatctgcttggttcctccaagtgcacattatgcaagtgtatttggatagacagggagatgcccggaacgtggttttcctcctccctccctattggagccatacctcctaaatatattgtctgggtcccaaatgtttgagccctcttcctctgctctcagtgggctgctcttggcatgccctgtgcttggaacgggacctgcaggctgacaggcctctgagactgctagggccagcaaacgtacatgttattgggaaactccctttccccttttggtgagcttctaccacctcagtctaatcgttttgactgaaagctatttgtctgactgaaagctaaaatcttttatagtgtggcctgttagatactttggggtaaatgtggtctgaggtgctggactagcacgggtagatggagaaagctgttgggaagttgcataatgtggtcatctgtgcctaattaaatgaggttagaggtgtgcacaccaccacaatgcctgggatctaaatcttcagatattaacgtttgaggctatggagctgtttccctgaatcacacacgagaaagcagtcaacatgggtgggccaaatgtggccaagatgagagagccagaagtgttggccttagagcagagcctctgtgtgtgagacattagaaggccagagccggggaggtgccggcgcagccactgccttccggtgggccggacggaaagcttggtcttatgctagattcagaagcactgaagaatggaggttgacactttagaggactaggaagggatc

SEQ ID NO: 4055 - DNA, 1149 bp, Homo sapiens
tctttgggattgttgagcaaggggcagctggaccatccactaaatttttttgttcaagacacattagagaccctcctgtatatctagtaagtcataataaaggtgcttgggaaagccttaaatttgaagacacatggaggcggtagaaaattaaacttgtaagaggagaaaaacatgccattaggtaacgcagagttgtaactactggctaagactcaatggaacttccacttgctctaaaaccagggaaatcttagataactgggtgtgatctacctatagatctacctagtctataggtaataatttccagaaggaggatcttgctgtcagttggggatcctctggtttggtctgtaccaaattgtgaatactcttgctgtgttgtacccagttgctttatattaatactgcaacttgaaacggggagggtggggggacaatggggtgggggagggaagggagtgggacgataagtcttttgaagacatcagctcactgtgctgagagagggaccaaactcaaggaaacctctgatctatacattcaactgctgcatttttttataaatacatgtaaatgtcctgttgtaatatttgatcttggaaataaaaacaaaaacttttcagtattagttttttttgtgttgttgtttttacaagataagactctggatattactttcagtaatacaattgagattccaaaagcttgccccctcacgttctcatttaggtcagttactattgattgacaaaggttactttgtagtcccgttgttatgtgtaacgtttgctagccttttttctgctctttgtggtatgtcaaacattcatggtaaacactctgtaaatattagtccagttgttacagaaacattgggtaagctaggcttgttaggtaagtatgattctgtgtttgacatacttgggcgaatattcagtgtctgttctttcagaccagcagtaattactaatggttaattaaggacttagcttaattgaaggaaagataattactaaattaatgggcaaaaaggagatacgattatatggtatgacagaaattgttattgctgctggatgcagtggctcatgcatgtaatcccagccctttgggaggctgagatgggcggatcacctgaggtca

SEQ ID NO: 4056 - DNA, 1117 bp, Homo sapiens
accatgttcttttggttagaaataatggttcattttttgcccctggttggaatagtctctaaaaggctctggtgactgaattgaacatgagtccgcatgctgttttctttcaaaaggtatcaaaacggaaagcctctctaaggggaagacctttcaactccattcagaagacaacatttagtaaggaggatggcggaggttactagtaattttcagatgtcttgggctttttctgccaacaaaacccaaaatcaaattagagttggtgaaagctttcttcagtgtttttagaagaggccatcttgaatctgtagaataccatttacacatcaacttcaccctatgctcatttcgtattttgagcttaaatggagtcctctgaagggggggtagtcgtgattctggtggcaaaactagaacttttaacttgtaaaatgaaaaatattaaatggacctttttgtcagttgaggatttagattgattcttttatctgaggagcgtatgttcctcagatgttgcgtagagacctttaggttttcatctactttaagattgctctcttggcaattaggggatttgggaaaagaagaaaaaaagatgccatgtgttgctagtacacagttataggatatggtttctaatggttgaattttgaggaactctccctaaagaatgagttttatatctcctcaaggaaatcatggaaaaatctgtttattcttcagtgagtccttttgaattaatgttcttaaatttttttctaagtctgtgtaagtgcttatgtataagtatataattgtataaatatttataaatatatttatataattacggtttcatttctaccttgagtcaaagttctgtctttagattggtgactgagtaatacttacactttggtgttttttcttaggttcttgaggcttacttaactagcagcttctgatttattgagtgaaagatggttttcatgttaattcctcagttgcatctctgaacttggataacatacttgccgtttgaaaaatagagctgtatactgtcaaaggtgcactggagggtaaaacatttgttggtagtagacaagctcagaaatccaaaaattcagggagggca

SEQ ID NO: 4057 - DNA, 1199 bp, Homo sapiens
acactctgttgcccaggctggagtgcagtggcgcgatctctgctcactgcaacctctgcctccagggttcaggctattctcctgcctcagcctcccgagtagctgggattacaggcatgctccaccatgcccggctttttttttttgtatttttagttgaaacggggtttcaccatcttggccaggctgatctcaaactcctgacctcaggtgatctgctgacctcggccatccaaagttctagaattatagacatgagccaccgcactcagcctctcccatgttacagttagtttctgaatatgtgaagaggttactttgattaagtgaatattttcagttaattttctttgtatccttgggatagggaataccaccaagtcttaagattcctcttatctccctttgcatttttttttttcagagtcaacattagatctttgtatttgaggtcaagcatattgacagcaattccttcaattgacagaagtttgtgtttttttttttttttttttcagtgtgattcatgattatggctaactgaaactttcatccttctgtattatagttcggcaagaacaagaattaagaaatggaggagctatcgataagaaattaactacccttgcagatctattccggccacccattgatttgatgcataaaggcagctttgaaacagtaagttgttggagagtcagtgccttaactatgaatccttttgcattttcaatgcctttttttaaaaaattacttgttttagagcaggtctcgctctgtcgtccaggctggactgcagtgacacaatcatagctcactgcagccttgaactcttgggctcaagggatcctcctacctcagcttcccgagtagctagggctataggcatgtgccaccacactcagctaattaaaaaaatttttttggtagagacagggtctcactgtgtcgcccaggctggtctcgaatgcctaggttcaagcaatcctcttgcctcagcctcccaaactgcttggattataggtgtgagccactgcacctggccttcagtggcattttttatttttataagaacaaaaaaccattgtcagtgtatagggaattggcattataataagtatatctacatgatatgcctaaaggttacattgatttatatttctaccagcaatatatgaaatatatttctaccagcagta

SEQ ID NO: 4058 - DNA, 1190 bp, Homo sapiens
aagtagctgggattacaggcatgcaccatcacgcctggctaattttttgtatttagtagagacaggggctcaccatgttggtcaggctggtctcaaactcctgacctcaggtgatccacccaccttggcctcccaaagtgctgggattacaggcatgagccaccatgcccagccgatagtaaactttttacacaagtttgattaagtctattgtaactgggcctgaattttctcatttgtaatacaagatgactggatggaagatgtttggattaattatacatgaatgatttgaaagtttttaaacttttttattttttgagggaaggcaccatatgaatcttgagtgttttaaaacaagaaatactgtgctcgctgcggcagcacatttactaaaattggaacgagacagagattagcacggcccctgtgcaagggtgacatgcagttcgtgaagggtttcatatgttttattaaaaaaatacttttagataaggacatttttagaattgtttcaaaattaatttaaaaaattttcaattctattttttctccccaaagctcctaaaagacgacggcctgcacgttcaatttttgatggtttccgggattttcagactgaaactagtaggtatctatggaccagtttatcatctccctcttctcttcctattaaaaagacaaagatgattactattaggcccaattacttttaagttttcaccttctttaaaaagtgaaattatggatccagaatgtgattaattctcccctgagctaaattgttccaaattctaacctatttggttatagaaaaatagtaaaggagatggagataatgtaggaaatatggtaattgataaacttaattcgcttgtgaataaacacttaaaatgcttactataataaaataaactgatttccctcaggatcctgacttctgtcaatgaaaggaatatataatgaaaatggttattataagagattgaaaaataggaggaaaagccatgccacccaaagcagccactattaatattttggctacagttatttgaaatatttttgtgtaataaattagaatgagaatcttggtcttatgcttttagaggatttagtattgatttagcaatggaatcctaaagaaaggacagttaggttaggatatatgagaaacccttggaccatgcttg

SEQ ID NO: 4059 - DNA, 1154 bp, Homo sapiens
atatttcacagaaagcacacaagaatggtcaattaacccgaaaagatgctcagttttttgagtaatcagggaaaggccaatttaaaacacaatgagctagtatttcacccctcccagagttgctgagggtgctcagcaatgggaacgctcatcttctgtgggtgagaatgtacactaaaaacttttagaaaacaatctgacaaacctagtcaagtcacacacgggaacagcctgtaacccagcaattctaatcctaaatatacatctctgaatgacctttaaatctttggtcaggacccacaccaagaaatacattttatatcctgactcagtatacacataactaaaacaaactgtttcataagacaacgttttcactgtgtgcacaacactctgattatattattctagcgcatttagtgtcgtccactatacagagttcataacccaccaatgcattggtttttaatatgagctgcacatcattatcatctggggtatttaaaaaattaaaaacagtgctcgcttcagcagcacatatactaaaatacgaacgatacagagaagattagcatggcccctgcgcaaggatgacacgcaaattcgtgaagcgttccatatttttcactggccatcagagaaatgcaaatcaaaaccacaatgagataccatctcacaccagttagaatggcaatcattaaaaagtcaggaaacaacaggtgctggagaggatgtggagaaataggaacacttttacattgttggtgggactgtaaactagttcaaccattgtggaagtcagtgtggcgattcctcagggatctagaactagcaataccatttgacccagccatcccattactgggtatatacccaaatgactataaatcatgctgctataaagacacatgcacacgtatgtttattgcggcattattcacaatagcaaagacttggaaccaacctaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacactgcatattctcactcataggtgg

SEQ ID NO: 4060 - DNA, 1176 bp, Homo sapiens
ctgggttccgaacgggggtgagctccgtctcctcacccggccccgcacccgctgggcctggggacccctcactccccgtgcccgcccctccgcgaggcagcagaaagcgcccggccggggcctctctctactccatcttgccacagttgtctgagaagccagaaaaagtttccagaactggcagcccttaaaaaaaatgaagaggaagagaagaaatgggagcaggcagccctcgtcagcagaccgggagccgcgtgggcgcggagccatttgcattccggtctgcgggggctcggggatgctggtgacaggcccggttcccggtggctcgcccccacctgcgggcgtcgggaaggatcccttccatctctcagccgcagaggaggccctggcagcgccccggctgtagccatgcaaccccgaggagtcccgggcaccttcaccccaccgggaggggccacaaggacctgggcctcggccaccaagctttgtcccctctcgctgtggggggctagtgattctcctccgacctgacgattgcttggttttttcaaaagggagttttgtgcggtgagaagtgtgtttctgtgtggctaactctgggctagcgtgccgtggccattgaaggtgtggcctgcgtgggtgcagtgtaagtgacgctggattgtcaggtggcagcaggggacccctgctgtgtcagtgctaatgaaacatgttggttggtttctaaaataaagccaaacaagccagcacatgcagaggcttggaccctgatagaaacttctgctgccgatttctttcgttttgttaggcactcaaaggcctacctgctccaccgagaagggcagattccattctccaagagccagtcagggaccactctcatcctctagtcagtgaggccccccgcgcccttcttcgacctggactggttctctggctcttgcagggcctccgctgccctggcacattccagctgcctccaccccatcaggctctggggtgtctgcccttctgtggatgggtgcagagaagggtgcaaacttctctgctgccccctgccccacacctccaaaataagcggcccacatcttttctctggcaagctcgctgctaactcactggaggggggcgtggggagcggatctcccagagaccctacagtgggtgctctgt

SEQ ID NO: 4061 - DNA, 1171 bp, Homo sapiens
ccttcatttaccagaggttagaatggggttatactctcacctcagcaaaggggcatgggattgcaataacttgtttaggttggttatggttcatccctttgagactggagaaagggcctgccttctctaagacaaaaggatacctgccttttaaacttctaagtaggggcagtgattgctttgaaggcaataaagtgtgcaacatcagcttttcatgagtatgtgtatttcctgataagctcttataatacttttaaatttccacgttttttttctgttttggtttcatttctgttttatataacacaggttttttgcttttatataaaattagattttttcctttgatttgtaggcttagaatctctttatctcgtagttttagaaaaaccatttatattttgtctagctttctttgtagtttgataacataaaaattatcagtaggtagttctcactgatagaatgtcaggttttatataaaatttccaagatactcaattttttttaatttttagggaacctagaaaagttgttcttcatcgtggctcaacgggccttggtttcaacattgtaggaggagaagatggagaaggaatatttatttcctttatcttagccggaggacctgctgatctaagtggagagctcagaaaaggagatcgtattatatcggtaagacacgttagtcaagatcacgtttttgttattttcactggacctatttttaaagcaaggtcttctgtttttttatatcctaaagtaatggggatatcttggttatcttcttaacattttacagcttaattgtagaattgtagtgtcagagaacatattatataataggtgttcttttatagaaaggggtcagtttttataaatgtgcttgaagaaattatgtgttctctatttattgactggaaagtttgctatgtgtctattaactcaagtttgttacttgtgtacttctttatactttaatctgttaccttcttgatctattgaggttttgaaagctatccaaatatgatttttttaaagctacccaaacatgggttcaacagttggtcctcatagcattaggtttttttagtatgtcttttgaaattgtattattgggtacacatagttttatagttgttattatgtaatgaacatcttgatttataat

SEQ ID NO: 4062 - DNA, 1158 bp, Homo sapiens
gcagggtgactctgcatcagctgactacaggcagatttccaggctgactggctggaaaagaaaaaaaaaaaacgcggagttcgacgccgcgcgcagcaccaaacacttccccagaagggcgcagcctggaggcggccgcgcgcaggacgcacgcccaaggcgcctgggccgctagggaccgaccggagcgctcaaacccacagggtatctatcaggcgcgcgtcagcacgtaagcagagcgcgagaacgcccgagacggcggcgcagccaatcccagagcagcgctccccaacggccggccggagggcggggagagaggggggctcggccagagccacgcttcccattggttgagacagcaccgcccagccaaagcccccttgtcctcgcgcgggtgcgccgcctggactcccaccctggccagtcccgggcccaccaccactctggcatccccagcctgtccccgcggctcctcctccttccccggccctgtggcctgcctgctgtccagcattcttccccagggcgctgtggcgcggagggaggactccccaaaccccgggaacagagccttgcggaggaccccggaggaggaggaggaggagggacgcggacgggactgggagattcggtcgggaaggggacagggcctagagcccggggctagaaggcaggacacctggcttcggtctgggctcggcctttgactacgacgtgaccttgaggacggttccttcccttcgtggggcctgggtccccttcagtaagatgcgccggcaggaaacgatgagtcgtttcacctgggagctgcagggccgcgtgtttaacccagggcctcctcctgcctggcacattattccgaataataaatgccagatcatgctgctggagacgccggcagaaaagccgagagggagactccctggggtctgggcgcgatcggccatcctacccttaccccgctgcggccgcagggctcggcctgtagggcgcgagccccccttccccacccgtatcccggcttcggagctaaaggaacacgtgaggccgaaccaaaccgagtagagggcgccagggaatcccgcccgagctgcagagacgcggacccctcctcttacccaaaaccaaatgggcagggggctccgctgcagagggctc

SEQ ID NO: 4063 - DNA, 1198 bp, Homo sapiens
agacaaagtgttgctctgttgcccaggctggagtgcagtggtgtgatctcagctcactgcaacctcagcttccccagtagctgggattacaggcgcgcaccaccacacccggctaacttttgtatttttagtagagacagggtttcaccatgttggccaggctggtctcgaactcctgacctcgtgatccacccgccccagcctcccaaagtgctgggattacaggcgtgagccatcgtgccattgcaccttagcctggacaacaagagcaaatcctattgtcttcacccactccaagccaattaaaatctctgggaaagtgttttaatcattgccccaccttttcttctacagccaatgtgttcctttaaaattttaagtcaggtgcagtggctcacacttgtagccccagcatttgagagccctaggtgggaggattgcttgatgccaggagatagaggctgcagtgagctatgattgggccactgtactgcagcctgggtgacaagacaaccccgtggtctttaaaggaaatatatataaagtcatatcctttgtacattgctcgaaccacagtagtttctctcattcagtaaaagcccgtcattaagagctccataattctctttatctcagctgggattaaccccttggtgtcttcagtctttcttccggccaggacacacactccttggccccagtgcctgcgctagtcatcccgtgatcacttcatggcatttcccctccctttccagtctttgttccatggtcacctcagtgagaccttccttggctatttaaaatggcaggtaattcctcctttctgtacacacaaatatcctcacacttgtccttttttgctattttttcaatattgcctctgttatcatctgacctatgtattttccttaaacttacttggttatcatgtgaaagatttttgttttatagctgctgtattttacagaagggcctggcatacaatagttactcgataagtatctgttgaatgaatggtgttctaggcatttaaagtttctcaggtgatgaagtgggtaaccagggttgagagccactcgtgtagaggtcaccttgaatttgtatccaactatatcagcttgtattcctcttctttccctttttaaaatcagcaacacagtcactcctggcggcaaaccaaacaaaaccagagtcatct

SEQ ID NO: 4064 - DNA, 1100 bp, Homo sapiens
gcctcagcctcctgcgtagctgggactataggcacgtaccaccatgcccagctgatttttgtattttttagtagagacagggttttaccatgttggccaggatggtctctatctcttgaccttaggatctgcccgcctaggcctcccaaagtgatgggattacaggtgtgagccacagcacctggccagtacatgttttttatgagtgccggttcttacggtatgttcacgtagagactgaaggctataaaaactttccttaccactagaacatgtaattggtagcctttcagagatttatccgtattacggttcttgatttgtagacgtatatataacattcacctaatgttttgtgttcttttttccctgcagatgctgtacccctcaaggatttaaactaacgaaaaatcaataaataaatgtggatttgtgctcttgtatttttaagtggattaaaaaacttactaccttaaattgatttgctacatgcttaaaatgatagaggttgctcagcatttttggagtacaagggggtcagagagacatgtgatgaaaattacagggcgagtacagagatttagaagggaacgggttttaatgcgagtatctttgacagagtcttgctctgttgcccatgctggagtgtagtggtgctcgctgcagcctcacattcaaaggctcaagcaatcctcccttggcctttgaagtagctgggaccacaggctcatgccaccatccctgggtcatttttaaattttttgtagagagggtctgactcttgcctatgctggcttcaaactcctgggctcaagcaatcctccttccttggcctctcctgaagtgctgggatacagttatgagccaccacacctgccaagtgctttgtgatactatgcatttgttcaatgcagattgggaaacttaaaatttgaatggagattatgttgatgggctttggcagttcatttggatagactgggatgagaagctcttgggacttgtgactggacaaagcattccagtatattaaaataaaattaagccatattactccactcataaaaagcaatcctatggtaggtacatggaggttggga

SEQ ID NO: 4065 - DNA, 1215 bp, Homo sapiens
tgcctgggatggctttctctgccgctccactcgaaggggtcaggacctgagcccagcggggcctccctggtctggaagtttccctcctgccccctttgccgtctccacgtagtggtggctggaattgagatgccggaaacattgatgggtggatcgaaaggccagcggaggggcctgggcacggaggacatgtgttgggtgggtggagacccactgaccagtccgtttgacactgagtggttcatgtcacgtcctgtggacaggctgcaggggagtggtgtggctggcagctggtgtgggccgaggggctagtgtaccctttccacccctgtgcatctcctccgccttggcagtgggcgcgttggagcggacgtggagcgctcgtgtggagcgtgcgtgggcaccttggcttgaccacagctggtgtcatccttggcagatggtcaaactgaggcacagaggccactccgaccctggctttcggggccggcctcccggccacgggtgagcaagggtctcacactgtgtcttgacgccaccaggtcgcgtggggcaggcagtggcgctgcgggccaaggccttcggcttcaacgtgctcttctacgacccttacttgtcggatggcgtggagcgggcgctggggctgcagcgtgtcagcaccctgcaggacctgctcttccacagcgactgcgtgaccctgcactgcggcctcaacgagcacaaccaccacctcatcaacgacttcaccgtcaagcaggtgcgtggagccggggacacaggactctacttctgcggggcaggtacaggtgggggtgtcaggcaggtccctcccagcagccatctgcacctgggcaagaccctgccttcagcgagccacatggcggcggctgccagccctgctgggggaagccctgtctgcccagacagcgttttctgtgttctgagttctactcaggacatctaaaatactctctggacaagacagaacctcatacctttgaacaccaaattcccctgaagcccttgctgttgtcacagtggggacagatgcagctacctgggggcgttgggtcggcccttgtgacttccgtgctgccaggttcaggtttcacatctgcagctggaacgggctgtgctcaggtcggcctctgacatctgcagctggaaagggctgtgctcaggtcggcctctgacatctgcagctggaacgggctg

SEQ ID NO: 4066 - DNA, 1189 bp, Homo sapiens
ctcgggagaaatgggatggacttgctttccaggaatggctccagcttcagtgttaccgactgcaggggtggggcatggagggcggaaggggcttcggggcccggctgggcctgggggaggcctgaggacatgtgcggatgtccacgtaggggtgtgcaggcggggccggcacccagattctgacctggccacagcctcccagcagggtacccccgagaggaatcggggtggcgaggtgacgcggggagacacgtgcttgtctcttcctgggctgccagcgctgagtcgggaggggtcagggcagcgtctcacaccccagccctaccacacaccgagcagttgccgtgtgtgtgctgccacgtgaacctaaagtggaggtggggctcctggagttgctctgttgcgcccgacctgtgagcaacgtgttcatctcgtggcctcccggggtggccttggggacacggcctttggcttcttccttgggaagcttcaaacccgctccagtcacggcggccccggtgtcctcccggaggctgggcccggcccgggggtgaccgccgtgtccttgtccccacaggcattgccgtctgcaacgtgcccgcggcgtctgtggaggagacggccgactcgacgctgtgccacatcctgaacctgtaccggcgggccacctggctgcaccaggcgctgcgggagggcacacgagtccagagcgtcgagcagatccgcgaggtggcgtccggcgctgccaggatccgcggggagaccttgggcatcatcggacttggtgcgtcggccgcagctccacgcctgtgtccctccctgtgtctggcgctgccgctcttcagctgtgcccaggaggagaggcccggggcggggtggggctgctgcaggtgtcggtcccaacccaggacaggactgagtgcgcacaggcaccagggcccgggagtcccaggcgtgtgccctacgtgcacggacgtcacagcacacgtgggtctcacacaggcacacacagataacgtacacggatgccacagcacacacagcctcacacagacatcacagcacgtgggtctcatgggcacatgcagataacacacacggacgtcacagcactcacatgggcttcatgggcacatagataacacacggatgtcacagtacacagcctcacacagaaatcagagcacac

SEQ ID NO: 4067 - DNA, 1099 bp, Homo sapiens
cctggggtctcggacggtctgggagggtctcggggggtctcagagggtcttggagggcctaggagggtcgggaggtgtctcggtgggtctggaaatgtcttggggagtctcagagggtctgggaggttctcagagggtctggagatttcttggggggtctcggagggtcttggagggtgtgagagggtctcagagggtctgggaggatctcggaggggccttggagggtctcggaggggacttggagggtctcggaggtcctgtgcccaagggagatggtagtgggtgtccacagtctgtgtccacttgagtcagcgagctgaggcacacacgagttgtctttcacgtggatttttaatttactttttacaaatatcacaacatatagaccagaaaacccccggcggtcggccctcgttggcccgtgcacagtgggtggcgtggagtgggttgtagccacggggccgcagtggtgcaaggctgagcacttgcctctgtcttgcaggcgtccgacctccgatcatgaacgggcccctgcacccgcggcccctggtggcattgctggatggccgggactgcacagtggagatgcccatcctgaaggacgtggccactgtggccttctgcgacgcgcagtccacgcaggagatccatgagaaggtaccaccacgtggtcgcctggggctggcagaaccgcacgttggggggagttggagggacgggagcacggcaggcccgggccacagcaggtctgggtgccactggggcaggagcagcctctgtcccagtcgtcccgcgccgtcaggaggtggacacggggttttccctggacaccatcaggaggtggacatcgggtttgccctgagccccatcaggaggtggacacggggttttccctgtgccccatcaggaggtggacaccacgtttgtcctgagccccatcaggaggtggacattcggtttgccctgtgccccatcaggaggtggacacggggttttccctgagccccatcaggaggtggacactcgttttgccctgtgccccatcaggaggtggacacggggtttgtcctgagccccatcaggaggtggacacggg

SEQ ID NO: 4068 - DNA, 1229 bp, Homo sapiens
gctcagtgcaggcagtgccaggctggatgctggaaagccagcagcacctctcccggtggctcctgggaagttccacgtccttgcctggtcacagaggcccgggaatcagtgacatgagatagaagcttccagaacaggaggcagagcctttccgcagtttccctgcccacagcacacaccctgtgccctccgtcccctggttcttggacactggggacatctggatgcggctagagcctgtgggggtggccgcagccctgggggactgttcccaggagtaggcctcggggccacaggggcgcggcctcgggcctggcactgcaacctcagggtgagcgcccttcgtgtgtgcggcaggagccggggcccctggctgtcagcaggcccccgagtccaggtaggtcccagacagcagtcccgggtgtggcagatgcagtgaggtccacttctgaggcgttccctggagtctgtgagttctggtcggaccttcgatggcattttaatgtgtctcttgtgtttgatttttagtaagactttgaccccgacgcaggcttcagtgattgccgcggatcagaagcctgagcactttggctcgagacaattaaggacgtgggatgaggctccgagacaggacgcggttctgcctggggatcctgaagataaaaagctttgaaaagtcgaattcatggtcgtggaagctgagcccatattaagagatgtcaggttggtaggggttcctggcgtcggcggcagagtgaagccggccggtctctttgcgaccgtgtggaggaggcactgcctcggatcaagtcgagggacctgggctgcatgggcgtcgggccggactgctgccacctgacccccggtgtgctctgggcgaggtcaggtgcccctcgagggagggcttcctgcacacctggtggcagagcacagctgtggtcaggcctgtccgtggcatctgctgtctgtttctgtcggaaagtgtctgagaggcacggagggcctccatgtggaggccgccagcacgagggtggagccccacacggaaccctggaaatctcaggtgtccacccggctggcccaggagcagggccgtggcccctgtggagctgttccttgtggttggtctgcgctctctggcccggaagtgcgtgcagtcggaaacagccttgggcttgggggatgctgcaaagcctgcttcagcacaggccgtgtgactgtgaagcctc

SEQ ID NO: 4069 - DNA, 1131 bp, Homo sapiens
gccgggcggttggcgtttgtgccgggcggtgggcgtttgtgccgggcggtgtgtgttgcgctaggtaacgtgtgtttaaagagccagatggtttgtgtttcaggctttgctgtaatgcctcagttgtgaacacagctgtagatgatgtaggtggatagatgggcgacgttccaatgacactttgtgaatgaacaccgacatttgaagtgtatatgattttcacatttcaccaagtattttttgtttgtattgacattcttggcttgtgggccacacagaaacaggcaggggctggggaggtagatgtggcccttgggcagtagtttgcagaccctgctctagaaaaggggagaatgaagatgggaaggcagtggtggtccctgccacacgtgcgtgcggcatccatgcacggagagtctccccccgcccatcctctgcgtgtggggcagttgggtcaggccagctcgcatccccaggtcttcagaggagcagctgagccgcgcctaccgcctgctgatagcacagctgacccaggagcacgccgagatccgtctctcagccttccagattgtggaggaactcttcgtcaggtctcaccagttccggatgctggttgtttccaacttccaggagttcctggagctcacgctgggcacagaccccgcacagcctctgccgccccccagggaggcggcacagaggctgaggcaggcgaccacccgggccgtggaagggtggaatgagaagtttggggaggcctacaagaagcttgccttgggctaccacttcttaagacacaacaaaaaggtaggtgggcctggcccattttttcagagactggttacctgacgtgaggagggcagacgataccagggtgaagatgcgcctcctgttgaacctagcacagcaggggcctgcttggccttgcctgaacacccaggctgccagaccatctgtggggtgtgggaaagagggcagcatctagggtcacggcctccctgagaggggcggcgcagctctgagaggaagagcataagctttatgtgtgggtggagctgaggctgcatgtgtcattttttatgtgcgtgtaggagacaaaggaaaagccaaatccaacttttcagatgcaac

SEQ ID NO: 4070 - DNA, 1192 bp, Homo sapiens
gggccgtggctgtggctgtgagctgggggctctgacgctgggacagaggtgagtcccggctgtggctgtggctgtgagctggtggctctgacgctgggacagaggtgagtccgggccgtggctgtgagctggtggctctgacgctgggacagaggtgagtccgggccgtggctgtgagctgggggctctgacgctgggacagaggtgagtccgggccgtggctgtggctgtgagctggtggctctgacgctgggacagaggtgagtccgggctgtggctgtggctgtgagctgggggctctgacggtgggacagaggtgagtccgggctgtggctgtgagctggtggctctgacgctgggacagaggtgagtccgggccatggctgtggctgtgagctggtggctctgacgctgggacagaggtgagtccgggccgtggctgtggctgtgagctggtggctctgacgctgggacagaggtgagtccgggccgtggctgtgagctgttggctctgacgctgggacagaggtgagtccgggccgtggctgtggctgtgagctgggggctctgacgctgggacagaggtgagtcccggctgtggctgtgagctgggggctctgacgctgggacagaggtgagtctgggctgtggctgtgagctggcaccccagttactggtggtttttccccagctgacatcgaccagcgtggggtgtgcagtgtggctggctctgatttgtgctccttagtttgagacaatttgaatggagccactgctgtggagaggcctccttctgaagcatcacaagtgggcccggctgaccctagcccagtgcacgacacccctcttggagtctggggttcttggctgtgggctggagatgacagtggtggctgccgagggtggtgggagtggtcagtgctgagcacgcgatttcagatccagtgagccaggcgggcacagcctttagctgatgtggtgtgtcccctggcctggaacagccccatgggtgggtggcacccgtcaggacctgtgcacagaccctgcctgggtttggtctgcccagtcccctggacctggcagcagcggggctgtgcctggtgacgggaaggctctgagccaggctgggtggcccactgtgcgcgtcgctgctgtgttggtggtggcgcctttgccctggccctcattcagg

SEQ ID NO: 4071 - DNA, 1519 bp, Homo sapiens
acatgatttaccacataaggagtggggtgtaggaaggggcccctgttttcagggtgagatgaatgtcaaccgagccatgcttctgttttccaggatgtgtactctggcacacccaccaaggtgagacacatggacagtcaagtggaggatgagtttgatttggaagcttgtttaactgaacccttgagagacttctcagccatgagctaactgccccctggcggccaggaagagaaacagctcctccccgactaggtggaaggctggccaggcaccaagcatgtgtgtgcacttgtacctggtggtttctctgttagcagtccattagctcatgctgaattatttttgccttactttcttaagaaacattaattttatgtatagtgagtatattttgcatgttttaaattgtaaatggagctaagtccaagaaagtacttgaagctctcttccagcgagcttaattgcgtaatccctgttgtcctccagggtaagctgacacgtctacataactggttttccacaggcatcttcagttattgcttgtcaggtggactgttttggatttaaccatgtaatccatgggaccaattgagagtcagctacttttataggcatcaaagtattctcagacacctttaatatctttatggaaacttaatttttggccttttatcaatatgtcataacagcattctgaagtcagacattgttaaattgagctattaaactaatgagttttatgtaagttatatggtcttaatttggtacttgtaaatagcactagttagactctttagaatactccaagagttagggcagcagagtggagcgatttagaaagaacattttaaaacaatcagttaatttaccatgtaaaattgctgtaaatgataatgtgtacagattttctgttcaaatattcaattgtaaacttcttgttaagactgttacgtttctattgcttttgtatgggatattgcaaaaataaaaaggaaagaaccctctttcactgactggggctgttgccaggtgggccagctgccgtgagagctgacatgtttggagggtcagaattgtgtctgcctttcttgtgtctgaagcaagtggcactcagtgagtggcgctgggtaaagggccttctttatttttttaattttattttttgagagtttcgctcttgttgcccaggctggagtgcaatggtgcaatcatggcccactacaacctctgtctcccgggttcaagcgattcttctgcctcagcctcccaagtagctgaaattacaggtatgtgccaccacacgcagctaattttgtatttttagtagagacaggatttctccatgctggtcaggctggtctcgatctcccgacctcaagtgatctgcctgcctcggcctcccaacgtgctgggattacaggtttgagccactgcgtgtggccgggggccttctttaataggtgtcacatgtcacatttggtctgatgcttattcatcagcactggcatgacagcct

SEQ ID NO: 4072 - DNA, 1194 bp, Homo sapiens
cgggttccgggttccgggttcccgccagggaggagacacgcccccacctgggcaggaaccaagcagagccgcgctccacccaggccggaaccaatgggagatgcgccacgacccaggccgagaaacgtgccgcttacccttcccccacgacctgcgccgcgtcgcgcgcggccgaatctcccgccaaagctgcccccgcccgccaaggcgcgacctatcagcgtcgcagaggcccgcggcggcccggccgcctcaatcccgcgggtgggggcaaccttttcctcaggcctctcctcagcccacggcgtccatctggctcccgagccgagggccgggcagtcgggcttcgcggctgcccgcggtcccgaggcctcgccctagccccagtcggctcgcgaggcgcgcacagctgagtggacccctgcggcgtggcccgatggtctcgcccgacccggcgcgcgcgggaggccgaggggcggggcccggcgcccacataaaggcggttgggggcggggcgcgcagagctcgtgagcgccggcgcggggacgcgggtttctgcctcaggccctgccctgctctactctgcgctctctgcccgcgccgccgccgcctcagcctcggccctgcgctgcgcgcccggcccgtgctgccatggcctgccgcccgcgaagcccgccgaggcatcagagccgctgcgacggtgacgccaggtgaggccgggctgcgcggcgggcgagggagcgcgtgccccgtggggcgggggttgtgcggggccggggtgtgggagggcggaggttgtaaggcggtcccgaacctcccgtgcccagccgaccgcgtccctccccgcagcccgccgtcccccgcgcgatggagcctgggacggaagcgcagagccgacggcaggcgctggaggcccgaagacgccgaggaggcagagcaccgcggcgccgagcgcagacccgagaggtgggcgcgggacccgggggtcggggcgcggtggggcccttgacgaggccgcgggctccagggacctcgtcgcgctctcgcggtgccgggatcggtcaggtcggcaccctgcgtccttttatcttggtctccgcgcggcccgtggactggggcggccgcagcaggcctgggaggcgctggaacactccggaagcctcttgccaggatgggagtcagctgaaccggcgt

SEQ ID NO: 4073 - DNA, 1132 bp, Homo sapiens
ttgttttgagacagagtttcgctctgtcacccaggctggagtgccgtggtgccatcacagctcactgcagcctcaacctcctgggctcaagcagtcctccaccttggcctccttagtagctgggactacaactgtgagccaccatgcccggccaattttttttttttttttttttttacacggagtttcattcttgttgctcaggctggagtgcaatggtgcgatcttaactcaccacaacctccgcctcccaggttcaaacgattctcctgcctcagcctccgagtagctgggattacaggcatgcgccaccacacctggctaattttgtgtatttttagtaaatatggggtttatccgtgttggtcaggctggtcttgaactcccgacctcaggtgatctgccggcctcggcctcccaaagtgctgggattacaggcatgagccaccacgcccggctggcccaaaacttttaagcagattttagatgtgcagagaaaagcataaggaacagaataccactgatgcttctcaccccctgagataaaatgtcaccagtaagtgcaggcagcatttcctacatccttctctgggccctgggtccgtctcccctctacccctccagcctgaatttgcagttcttcccatgtctgcttgctacttttcaactttgttttttgccccttttgaaatttggtcaaacgaagcgagaatgaatcaaacattggtttacaacgaccccaagaaggaagggagacccagcagcagagaagtcgcctcccagctgccatgggtgtgatccgtcccagagccacagatcccctgcctctcccctatgcctccaggatcacccagcagcctccatagggcagagggtgtagaggagctgggaggggcttgagaggttggccctgaggggctccagccagagtgactctgagcttgtggcttggactcgtggctgtcatctcctttctggaactctgctgaggcccaggtggtggtcactgtggtgctcccacgtcagtgggatgagaccaagagcagccgctgcgtgcagctgcccacgtgtcattcagaggacagccgagtggccgcctgggaaggcagtgccgccccaaggtggcagctgg

SEQ ID NO: 4074 - DNA, 1391 bp, Homo sapiens
ttgctgaagcaggagaatcgggtgagcctgggaggcaggggttgcagggagccgagatcatgccactgcactccaatctgggtgacagagtgagaccctgtctcggaaaaagaaaaaaaaaaaggctctgagctgtgaacagccccctgatgaggcagcactggctccgctcagcctgcagtgggtaatgaagcgtcaccgtgctctcccggaaggacaagcagccacgtgggatgggcaggtgagggaggggggcacggagcagcagagaggccgggcatgctggatgcgggtctgcgttttctaccactaccctgacttgagtggttttaaactaaaaagcaaagagcccggttagcttgtccacatggtcctctgtgtcctactcaacactgggagggcctagtgactgaggctgcctctgcttggtggcagcatgcacggtgcaaatgagactccctcaggacgtccgcgggaagccaagcttgtggagttcgatttcttgggagcactggacattcctgtaagtccttgagtccctcttgaactgtcttgtgtgtggtctgagggaacgagttgttttaagggcctatattttctattcctgggggtctgagcctttggttttgttgggggcatggggccgctgtgctgttccctcgccgcactgtctcgggtccctcatgcactgtctgaggctcttggcctgtgtgggcctttcctccctcacactaggtcagaggtaagaggcaagggcgaaatgggttcctgtttcatccccatctcccgcaggtgccaggcccacccccaggtgttcccgcgcctgggggcccacccctgtccaccggacctatagtggacctgctccagtacagccagaaggacctggatgcagtggtaaggacgcaggtagtagctattccacagaacctgcaggccgctctggggcttggccaacagtgggcaggggtccaacagcctgacccgccatccctgccatccctgcccctgctggttggggtggaattgcagagagctgccggcccctggcctgtcactactgcccaggtcgctgagggtccaggcttccacccagtgtccccgcagtcagctgcccaccagcagcctccccgggactctccggcctgggcatggcgttggcctctggtggccttgcagcagtgagtgtggttcttgctgccgtgagcccgagtgtcgcccctttcctcccgccctcccacgagtccagacgcatctcctggcagcttaggaagctccatcttcacccaccccacatctgagggtcccgtgccttgtctccctccatcctcactgtacatgccaggcttcagcctgttctaactccgggcctaaattgtccctaagagagc

SEQ ID NO: 4075 - DNA, 1133 bp, Homo sapiens
gagctactggctcacggctgatgccccagacagcctcgaggatctgcaggtccccagacaccaagcctgggtgctctccagcagacggcgtggtacccacagctaatgcctgccccttcctagaacgaagagtcactgaagaagtgcgtggaggattacctggcaaggatcacccaggagggccagaggtaccaagccctgaaggcccacgcggaggagaagctgcagctgtgagtgctgggcgaggccccaccctggagggagaatctgagcacctgggccccagctcagcctctgccccgcccctacccctccagggcaaacgaggagatcgcccaggtccggagcaaggcccaggcggaagcgttggccctccaggccagcctgaggaaggagcagatgcgcatccagtcgctggagaagacagtggagcagaaggtgggtgcgggaagcccagctcaaggggccgtctggcagcaccttctagaaggcccttgggcctgctgctccctccaagcagggagaagccccgcaactcatcttcctcctccagactaaagagaacgaggagctgaccaggatctgcgacgacctcatctccaagatggagaagatctgacctccacggagccgctgtccccgcccccctgctcccgtctgtctgtcctgtctgattctcttaggtgtcatgttcttttttctgtcttgtcttcaacttttttaaaaactagattgctttgaaaacatgactcaataaaagtttcctttcaatttaaacactgaagccgctctggtcttgatgaagcaaaggtttcccagctctagcctgaggctgagccgacccgcaggtgccctcccttcccctcagagctggccacttggtccctgcctaccccaggctcaggccaccctgccgaggggcagggacagccagtggatagaggaggctcaggcctgcccagtctgccccggccacctcgggttggctacatggtcctggcctcaggtacacacatcaaagtccaaatggactcgtttttttgtttgtttttttgttttttgttttttttgagacagtctctcacccacgctggagtgcagtggcgtgaactcggctcactgtaagctccgcc

SEQ ID NO: 4076 - DNA, 1177 bp, Homo sapiens
tctgtgcggtgcccgcagggcggtgctggcgctcgcctatcgctctgctctctctttgtagacggcgggcgctaacaccaccgacaaggagctagaggttctctccttgcacaacgtcacctttgaggacgccggggagtacacctgcctggcgggcaattctattgggttttctcatcactctgcgtggctggtggtgctgccaggtaccggcttctgctgctgctgctgctccgcactgtctgggggacgctggctcgggacacgccaaagctgccaggacggacgggaatcctgtgacttacggccgtcccgcttcttgagccctcactcctggccctgtgcccagtgtggggacaaagttggcctggcccggtcctggtcccagaggggccccctcagccccctcgagcccacttcccatctgggtccccaaaggcctctcctgtggctctggtgtctcccgggcgcctggtggcggtgtgggactggctggctctgctgggctccttctctccagggtctggccctctagactcactggcgttactgactgcgagaccctccagacaaggcgcgtgctgaggttctgagcccccttccgctcccagtggtgcctgcggctctgggccaggggcatccatgggagccccgtgggggggggggccaggccaggcctcaacgcccatgtctttgcagccgaggaggagctggtggaggctgacgaggcgggcagtgtgtatgcaggcatcctcagctacggggtgggcttcttcctgttcatcctggtggtggcggctgtgacgctctgccgcctgcgcagcccccccaagaaaggcctgggctcccccaccgtgcacaagatctcccgcttcccgctcaagcgacaggtaacagaaagtagataccaggttctgagctgcctgcccgccaggcctcctggagccccacctcggcccacgctggtcctgggctgtgtgagccctctctgcagccaggcgggctcccctctcctcgtctctgctcaccatgtagagcctagggtactttggggcacgaaacattctaaaaatcttcattcaatgctggtggaagtcagaacgcccccccttctggcccagcactgacccccggctgtacctccacgccctgtcgcccacgcggcgccaacctgccc

SEQ ID NO: 4077 - DNA, 1236 bp, Homo sapiens
atttggaagacaggaacggcacaggcgtccaggaaagcagctgcactcagacaatgccttctccattacttgaagcttctttctgttcagccattaaagaaacttgacaaaataggaacaggagatatttctcaattgtaaacctttgtgcagggacagttggcttccagaggctttcagctttcagttatttgagaagtttgttttagatccttaactaatatttatgaattctctcaccctgtgtaagtagcctggtgttcgtttgtccaagtgtacttacccttgagaacaagtcttgcagttgccaggtgtgtgcagacgcctctcctgtgagcggcatcgcgggcccagtcagctgccccggctctcatcctcgtcctcactgccttggctgagcactgttgacgtgaacagccactgcaacaggcagcccatcccactgtcccctctgccctggactccgcatggcctccaaaagccagcttgccctccgggtgctgcaggggctttgcaggtggggaaggctctggtgggtgcctttggtggcttccgtgacatcagccgtgctctgatgcaggcttgctccctcgtcattctccctcgtcattctccctcatcgttctgtgtgcatttttctctatgtcctgacctttcttcttgcacctaaaagtggtgtctgggtgcaaatgtaagcagtggtggatccagaaatatgagctttgtgtaataagcttcttaaaacagtcctttcttacacctgcccagggccagaccctcggtcttggcctttttcaggagctaggatatctgcgcctggtgaaaatgaaacgaattcctgatttaggaattcagtgtttcctcctcactccagctaagcactcacttttttttttttttttttttttttttgatacagagtctcgctctgtcacccaggctggagtgcagtggtgcgatctcggctcactgcaagctccacctcccgggttcaagcgattcttctgcctcagcctcctgagtaattgggattacaggcatgcgccaccatgcccagctaatttttttttttttttttgagacagagtcttgctctgtctcccaggctggagtgcaatggcgtgatctcggctcactgccagctccgcttcctgggttcacgccattctcctgcctcagcctcccgagtagccaggactacaagcacccgccaccacacctggctaatttttttgt

SEQ ID NO: 4078 - DNA, 1195 bp, Homo sapiens
cacaggctggagtgcagtggcgcgatttcggcttgaaacaacctccgcctccctggttcaagcaattcttgtgcctcagccacccaagtagctgggactacaggtgcacaccactatacctggctaatttttgtatttttagtagagatgggatcgccatgttggccaggctggtctcgaacttctgacctcaggtgatccgcccacctcggcctcccaaagtgctgggattacaggcgtgagccaccgcgcccggcccctggggtgtttttaagtgaagagttggtgccctgttctgaggcccttggggtcctcgctgtgggggttgctgacccccaagcctctctggtgttttgtttactaacgccgtcatcgggtcacgcagcacagcaacaaacagaccttgtagaacttgagacactgtcttctctgagagctattctggtgatgagatgggcggacctgctgtggggccagcagggttggggggctgcccatctgctgaacctggccttggttgcagtggctggacctgcacctgcatcaggagatccccacatcgctgctcatcctgtcccgggccatgtacctcccggacaccctctctccagccgaccagctcaagtccacactgcagaccctcccagagattgtggtacgtgctgtcggagaccccttttacctcatctcttcataggtggctccgctcttctggggtggggggaggtgtgcaagcgcactcattcctcaaccatgggcgaggagcctgcctcccaccccctcgcgagtgcccccacccagccacctgtccccttccttccatccctcctcaccagccccttgcctgccatcccccgtgtggcacagttgccagtggtcccgacctggccacgtgttggctgctgtggatctgggccgcggcccttggagctgtgtcagcagcgcctatgctccttcccacatgtcaggagtcatcgggcgagcgcagagggcggcccaggggcctcccagcaattgcgggcagcacctcggcagtgccttctgtcctgtgtgtgtgaagcccaggtggtgacggggcaggggacacaggacacaggacagaggtgaggggcagcaggggcctctggtggcttctgggctcacccacagatgtaccctcttctgaaggcaaaggaagcacaggtgaaagtggccg

SEQ ID NO: 4079 - DNA, 1195 bp, Homo sapiens
tcacccaggctggagagcagtggtatgatcttggctcactgcaacatgtgcctcccaggctcacgccatcctctcacctcagcctccagagtagctgggactacaggtgcacaccaccacacccggctaatttttgcatttttcgtagagatgggcttttgccatgttgcccaggctggtctcgaaatcctgagctcaatctccctgcctcggcctcccaaagtggtgggattacaggcgtgagggactgcgcctggcctggttggctttctttcccattcaattttgaaccttatctgagtctcttgtaagttaattagtttccctctttggcatgtggcatggaagggataagaagtatagaatttgttttgaggttaacaggctcagacaacaccaagggaaacaactgcaaaatagcagtagatttgactagtttcatcccagattctaactttcattctctaacattttattttaaaaactaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaaggtgatagatgacccttcagtctacttttagaccagaaatttaatttttattctttaagttaacttatttttgttttgaacttatacttgctcgaaatattgtaatggcttaacaatctctttcattgttgacttttgcccaaggatgccatgttacaatatgataaagttcttttagagacacaactgatttttttttgctcatttgatgactctcagagataacttgttttagaatttatatatacacatatatgtacgtatatatgtgtatacacacacacagacagagggattaatgtaatgtgataggaattgatttctggtttaaagaaacaataaaggtattatgttgggctgaattctaaaattggtttttaaaagtttttatttctattattttttaaaatttttttgagatggagtttcactcttgtcgcccaggctggagtgtaatggcatgatcttggctcattgcatcctctgcccctccgggttcaagcgattctcctgcctcagcctcccaagtagctggaattac

SEQ ID NO: 4080 - DNA, 1166 bp, Homo sapiens
aaaaattagctgggcgtggtggcacgtgcctgtaatcccagctactcaggaggctgaggcaggaggatggcttgaacccacgaggcggaggttgcagtgagctgagattgtgccactgccctccagcctgggtgacagagcgagactccatcttaaaaaaaaaaaaaaaaaaaaaaaaaaaaaaaatatatatatatatatatatatatatatataaaaaacagataaaacagatgctaatataatccctaaggttagatatagtcaccagtttttttgttgtaaagagatttgatctgtaagacataagccctggaaatcagcagggttacaggaaacccatcatgggctggatctgtatgttgaatgccctgggtaggttctcacagtgcttcaaatgcagcttttggagtggttttcatgtacattttccccattccccattccaaggtaatgtaaatgggaaaaaaagaaaccacacaaagaggatacaggaccctacagaagatgctgaagctgaggacacacccaggaaaagactcaggacggacaagcacagtcttcggaaggtaattgtgttccaggtttgcttgacctgtcagagtgtatgctctgtgactcttggtgccactgtttccctgcatgggagcacacatgagatgcaggtgtcagtgcacccagctccttccaggctggtattcagcagaaggcttgcatttcttacagaaccccattgagaaaggctgcttgcaggttcttaccctccaggggtgttatcacagaaaccgatggtgtgttgctctgcaagaaaacagacatccaaatgctttgagtaatacttgttttttagattggacaaaattgtcactaaaaataacctctttggccgggtgtggtggcttacgtctctaatcccagcactttgggaggccgaggcaggtggattgcttgaggtcaggagttcgagaccagcctggccaagatggtaataccccgtctctactaaaaatacaaaaaattagctgggcatggtggcgtgcacctgtaatcccagctactcaagaggctgaggcaggagaattgcttgaacctgacaggcagaggttgctgtgagctgagatcatgccactgcactccagcctgggcgacacagcaagattctgtct

SEQ ID NO: 4081 - DNA, 1208 bp, Homo sapiens
ctaaattaattgtaatcatttcgcaaacatacaggaaattatttgtggtgaaaatgacatttgctctcgtgctgatgtacagatcgctgttttaaaactgatgtttataagttaaggctgtaataagtgtagactgtgaagcactgaatctgggctgagccatagcagacaggctaagcctggccgcctcgccctcctcttgcaggggggagccttctgtgctgtgagtcctgcccagcggccttccaccctgactgcctgaacatcgagatgcctgacggcagctggttctgcaatgactgcagggctgggaagaagctgcacttccaggatatcatttgggtgaaacttgggaactacaggtgtgagacatagaatcgtatgcttttatgtcttttctgttcacatgtgttcgctttacagtacttaaagtattgaaattattatcgctgtctctgaggagtctgtgaatcctgtttttaatatttataatagatggtggccggcagaagtttgccatcccaaaaatgttcccccaaatattcagaaaatgaagcacgagattggagaattccctgtgtttttctttgggtctaaagattattactggacgcatcaggcgcgagtgttcccgtacatggagggggaccggggcagccgctaccagggggtcagagggatcggaagagtcttcaaaaacggtacggagatattcagatagagagtgagacagcactctcgtgcattttcttacccctaatttctattttttaaaatttgatctttatagaaaatactggactaagcattcaatctgtttttttaaattaggaaaatgtttgcagtctggtttatttgttgagcatagaataagatacactgataacttttgtaacattggtttgtgattaatttcattaaaattctgtaaacctattattcagaaattatttttaatactaatttacagaaatgttccatggcttgcctttatgtaaaatgcagatctgaaggaagggtcctgttgtctcgaccttgtgcagcaggctcttgggggctcgctttacctttcagtgcatgaggaatcaggggtggtcaagcagacaaggtgcttggcctctgattccccagctggggtgggaggcaggagcaacgatgtggcatggctggctgatgacccacgtttgagggaggcaggatggggatgt

SEQ ID NO: 4082 - DNA, 1220 bp, Homo sapiens
ccatgggtgcaaagtcagagctcactgtcactcggatctgcatttctccacctctgcctggatttgctctttgggaattgtttctttgcatcctttgctggttttcggttgggtgagtcttttttttttttgagacggagttttgcttttgttgcccaggctggagtgcagtggcgcgatctccactctctgtaacctccgcctcccgggttcaagtgattctcctgcctcagcctcccgagtagctgagattacaggcagccaccaccacgcccagctaattttttttgtatttttagtagagatgggggttcaccatgttggctagtctggtctcaaattcctgacctcaggtgatctgcctgcttcagcctcccaaagtgctgggattacaggcgtgagccactgcgcccagccagggtgagtcttgttcttgtccttgagtgccacttggctaggctgttgctgctgaccttagctcccttgtttgccatcatggaggatgctgggagctccagctccctgtcctgtcctccccggcgctcactaaggctcggtcctctccacgtggtcctgacctgtcctctgtgagcaagagaaacaggactggtttgggggtgtcctgtctcagtggacacaggacaccacggttttcagtacaacaaggaacacaacttgttcaatgtgctttatgatggtgaaaattccctttaaaaataacatgcgattgctaacacttgaccgaatatatcacttgaccttacaggaccgtataatagacgctggccccaaaggaaactactctcgatttatgaatcacagctgccagcccaactgtgagaccctcaagtggacagtgaatggggacactcgtgtgggcctgtttgccgtctgtgacattcctgcaggtacaagctctggggaccctgcatggggctcctggctatgggggcagagtggccatcgctgagggctgcgtggggctggactggaaaggctctgggggaggtgggtgctgatgtggagtctcttttggtttgaatatctcttttaccaagcaaaattgaaaggccatgggtcaagccagtacagatacaaaaataataagagtatttttgttgacctaatacacgccccttagcttttgaagagaaaggcaggtgtttccaatttggtgtctgtctcctcttctcccagggacggagctgacttttaactac

SEQ ID NO: 4083 - DNA, 1220 bp, Homo sapiens; identical to SEQ ID NO: 4082

SEQ ID NO: 4084 - DNA, 1197 bp, Homo sapiens
agggcacctactgagaggtgcggtcctgggggtggaggcctgcctggcaggtgtgcgtgcctcgtacgtgtgttatgggcactggtctaggccaggtatgacacccactctcctgtgagatttcactttagtttttaaaaggtccagttctacagagtgagacctatctatctgagtactacatatgttttaagacttggttctttttttgagggatccttgaccctgggaagtctggagcaccctgagaagggggcaccatgtgtgcctttgcccacgtgtcctgaggggctgcttgtctgggagggagggagagaacattcagcagcaggtgcttttttatggccttttcttaaaataacctaagggggacacatccatcttgcagagaagtttacagaactccccttgaaaactgctgctgaggctcctgttaaattttctgtggcatcttttatgccttggtaaaaactgcagtgtctttggacctgagagtggctactccgtggttttgtgacctgtaagcgtggggttcaggggtgtgtggccctgcagggtcccacgcctccctgagcactgactggaagtttcactggctggtggctgtcccttctcccatcagggtccccagcaaagttaactacacagaggacccaggggaaacgagctgtgtagccactgacttgctcgcgcggccgtggcctctgaggggcactcgccggttaagacagggtgggagtagtgctttccagttcagactctaacttctcccaaagtgtcctaagaaaatactggatcggctcatagatttatgctccttatgatgccctaacttggaaggttgttctagggacaggccgggcagtgtccccacacacaccttagagtcgaaggccccagggccccgctgtcacttgcccaaaagatcccttccggcaggtaagggactaccaatgcttacgtcaaaacagcagaatcggctttgcagtgcactttggggagcagatattaacttatttttgtgttggacagtagtgaaatcttgtgatttttaatcgctttgataatacttccaaattttatgatttttctgaaggaaataatgcaaacattttaaatatgtttctccccctttccaaaaactgttaaactaatgagcaagtaacactaactttgaatgtctctacaatacccgtt

SEQ ID NO: 4085 - DNA, 1244 bp, Homo sapiens
tagcagatccccctcctgggggttctgagagtcctgggcagtgtggccttctctcattctggtggcatctgcgcccgtgagtgacctcttccttggctgcactgccctgtgggtggtgagacgcttggccttttttgttgctgccaggacttggtagagatggcaggaagggtgtgcggggtggttgtgtgcagaaccctgccgcccctgaggtgagcagaggcactggtgtgcctgccaggctggggcggagctgcccggaacccttgccaggccaatgtgtagcttggtggcgcccttgaaggccactggggggtaggtgtgtcctcccccggggctggaggccgggtgcctggtgggtgggcctgacctggcccacctcatccctccagcctgggatctcactgctctgcacatgtgcactgacgtgaattttatacgtttgtagaaactctgatgtaacttcttctacctctgaagcgccctcctgggccctgctgtcacgtggctggtgcggcttccccgagtgctggccccctgcccgctccccatgggcacccaccactcaaactctgcgtggtgaggcccggggaaagccaggccgggccctagcactgctcaggggcctggggctcctgggatttctgtgtgtttggaagcctctgtttttggagtggggggcgtggaaggcgggaggggctgacagtgcctggggccagagctgggcgaaggaggacatcctcactggacgagcactgcaggcctgacgagaggctccgggcagctgagggctgaagcgcctcgggatgccccacactgcccagagccacgggtcttgctgtgctgggggtggggtggccccaggcagctgccactgcccaggtgtgagtcgctgcagacctggtccctgagggtgggaggcctgcttgtgctgaagctgccatgtggtctggcccccagaagggctcctgagcgtagggagttgagccccgcagccgtggcggcatctcctcctccttcctccgccccatgcccagccttgcttccggctggtggcatgccttggggccgggcagcaggtgagaagctgcccccggagggaggggccaagggctgggtcagtctggcctgaggggtggatggctggccctgggggaaggctgggcctgggaggccctgtggacagcaggcctgaggccacgaggtcctggggccacccctctcctgctctgggtgtccttctc

SEQ ID NO: 4086 - DNA, 1178 bp, Homo sapiens
cccctcccgggggcacaaggcgagctgcctgtgtccacctcacaggagaggctggcagtaggtctgggggcagcaggcctcagcagaggtctcacatcaccaagatttgaggcatcatctgcccaaggtgtgtgtcacccgtttccaaggagcatgtggagccgcagcgccctggcggaatccagccccagtgcggtctgtgtggccagcgtggcgccggcccttaagagctgattgcccggagccatgacccgtccgccttgtgcttgcacttgaatctgtgagccccaccccagggacctgcccctggcagtgcatttcccctgaatctcctccacttgggtcccacttgctctccctgctgacgccctgggaggggcacctgaggggctccatgaaggaggctggggaagggtggggcttggctggggcctggctggggctggctggatgctcaccagagcgaggtctcggagaagccctgagggcacaagaacccatgatgttgttcgaggctcggcccatgtcagggcccccacaacagttcacaaggggctgtttttccatccctgcccagacttcagacgggaccaacctgggtggggcggacacggggcacccagcccctcctgctggttgtgccacctgcttcctcgcagctaaccagtcacttccaaccagcctgtctccctattgccccttctcccagctccccagagctgtcctggtgacagtgggtgacctcaagcagtggtgcccatgcctcacggagccacatcctcttgggcctcagtgccagaaccacctttcagaaaccttggggatgggcccccacctctgcatgcacccctgagcccccgcctcacagtcctggcctcccaggttgactccctccctccctgccaggctggtggcccacgccccacagtcctggcctcccagggtgactccttccctccctgccaggctggtggcccagatccatgatgagctgctgtttgaagtggaagatccgcagatcccggagtgtgcaggtagcctggggcaacacagggttgcttggacatcacagacagctaagaggaggctccatgccccatgggcacagcccaggaaagcccctcagctgtcttcccttttatggcccctgccccacctcattgctgctgtgtcacctg

SEQ ID NO: 4087 - DNA, 1100 bp, Homo sapiens
accagtggtggcccctcagcccaccctcccggcagctcagcctgtggctcttgaggccgtggttcccacgtggactgggaggcagtctcagccacccggggtgctgttcagctgcccctccctgccatcagcaggtgggtgaggggttgcccactgggtgggggcccgtgctaggagtcaccacatgctccaacctcccactgctccctgtcaggggcccaggctgccatcactggaggctgcagggaccaagaggccatcaccgtgtctatagagagcagacagaagcagaacagagcccggggctcctgagcctctgcgtgtgccctcccagcccacaccagtgctctcggccactgagcacccagactcaggcttgggttccccagccttattggaaggcagctcccgcataccaggataacccccgcaaaccacatagcagacccccgccatcctcgcagagtgggagaggctgcagcaaggctttgcctctgcagaccccatcttagtggcacggtgcttgggcctgtgtccccgggtggtggaaccctgtaccggtctgtggccctagggtccctgctctgtctgccccggcccgtgctgtccgctgggtgaggcaggctcccccgtgccctgcctccctctgtcagggaacctgggaccccctccccactgcctgcacagaggaccctgaccctcggccagcagggtggccccaggtccatgttgggcactagggcaggttccgtgccagagtcgggggccacacgagggcctggtgccggtgaggggggcgtgcgctagagggggaaaggggcccccggccacctgtccaccgtgtgggccgtgctgtgtccttatgtcattgtaatataaatacagatttttatatctcaccctgctggctccggctctttctgtggttgtcactgtcagcgtgcttcgcgccctgccctcggcctccaagcagaaagcctggcccaatggcaccacgccatgtggccttcgggccgtggccctcgttgccctaccacagcctctttcctgggaggcctgacggagcacggcaccccgtgccgccaaccacaccgggcccg

SEQ ID NO: 4088 - DNA, 1224 bp, Homo sapiens
agcctaggtgacagagtgaggccctgtctcaaaaacaaaacaaaaaaaaacagtgaaaacattgatttttcagcagtgagaatggctgttattaaaaagttaaaaaataacagatggtggtgaggttgtagagaaaaaggaacgcttatacactgttggtgcgagtgtaaattagtttaaccattgtggaagatgatatggcaattccacaaagacctaaagtcagaaataccattcaacccagtaatcccattactgggtatatactcaaaggaatataaattgttgtgttacaaagacacatgcatgcgtgtgttcattgcagcactgttcacaatagcagagacatggaatcaacccaaatgcccatcaatgatagatagattgcataaagaaaacatggtacatatacaccatggaatactatgcagccataaaaaagaatgggatcctgttcagggacttggatggagctagaggccattatccttagcaaagtaacacagaaacagaaaaccagatactgctggttttctgcagattctcccttataagtgagaataagcagaacagaaaaccagataccgcatattctcgcttatagccgatgagaacacatggacacgtagaggggaacaacatacactgtggcctatcaaagggtggagggtgggaggagggagaggatcaggaaaaataacaagtgatggctactaagcttactacctgggtgaagaaataatcggtacaacaaacgcctgtgacacatgtttacctgtgtaacctgcacgtgctgcacatgtacccccaaatttaataaaaggaaatgtgacccccaccccccattttggagctagggtctgctgggaagtgttggatcatggaggtgggtcttcatgaatgacttcatgaatgtcctccccatggtaatgaatgagttcttgctctgttagttcacttgaaatctggttgttaaaaagagtctggggcctcccccctctatctctggctcctcactctcttgccatgtgatacatttgttccttctttgccttttgccatgagtaaaagcttcctgtggcctcactagaagtggagcagatgctggtgccatgcttgtatagcctacagaactgtaagccaaataaacctctgttctttataagttttttaaaacccactgatttggccgggctcacgcctgtaatcccagcactttgggag

SEQ ID NO: 4089 - DNA, 1538 bp, Homo sapiens
tgggacttcctggcccgagacgatgtggagggaacaaaccttcctgtcctttcacaggtggggacaggaggcccagggagggctgggcacagccaaggctgccctgcaggtccctgcctgactccgggctcccgtcccctggtccaagctgttcagcctcgggcccagcccagagtcgcccaagccctcttgaggcaggagcaggtggagacgtgggcacagtcagggcggccatccttgtgggccagaaggggcacctagtggaggcaccacagcctccagttcttctgtctgtccttgtaactgtgtgtgcatgtccgcgtgttgctccgtgtgtgtgcatgtccgcgtgttgctctgtgtgtgtgcatgtccgcgtgttgctctgtgtgtgtgtgtgcaatgtccacgtgttgctctgtgtttgtgtgtgcatgtctgcgtgttgctctgtgtttgtgtgtgcatgtccgcgtgttgctctgtgtgtgtgcatgtccacgtgttgctctgtgtttgtgtgtgcatgtccgcgtgttgctctgtgtgtgtgcatgtccgcgtgttgctgtttgtgtgtgcatgtctgcgtgttgctctgtgtgtgtgtgcatgtccgcgtgttgctctgtgtgtgtgtgtgtgcatgtctgcatgttgctctgtgtgtgtgtgcatgtctgtgtgttgctctgtgtttgtgtgtgcatgtctgcgtgttgctctgtgtgtgtgtgcatgtccacgtgttgctctgtgtgtgtgcatgtcctcatgttgctctgtgtgtgtgtgcatgtccgcatgttgctctgtgtgtgtgcatgtccgcgtgttgcttgtgtttgtgtgtgcgtgtccgtgtgtcgctcgtctgtgtgtgaacatgtgtgcttgtcctgtatctgtgtttatctgtatacttccatgtctgtgtgacagagtccttgtgtctgtgtgtctacatgtctgcgcgtgtccctgtgtctttgtgtatatatatccatgcctgtgtgcctgtgttcctgcgtgtgcttgtgtgtgcacgtgtgcatttgtgtgtttgtcagagtatgtgtgcatgtgtgtgtctgtcagcgtatccatgtgtgcatgtgtgtgtctgtcagcgtatccgtgtgtgcatgtgtgtgtctgtcagcttaaccatgtgtgcatgtgtttgtcagtgtatccgtgtgtgcatctgtgtatctgtccatgtatccgcgtgtgcctgtgtgtacctttgtgtgagcatcaagggacctcccaggcctggtgctcaccgtccgccccaacgcaccctgcattgcagcgactccagctcggacacagacagcttctacggcgcagttgagcggcctgtggatatcagcctttccccgtaccccacggacaatgaaggtgaggtctttctccgcatccactgcccgtttgcctctccccacctggcctcctcttggccgctgtggaggagagggaggtgtgttcggctgtgctccttgctctggccctttggcagtgcgcagtagcat

SEQ ID NO: 4090 - DNA, 1218 bp, Homo sapiens
gttttgcatcttctgcacttttaatgaatggtattacatggtgtatgttctttgcaggttggtctctttcactcagcgttgccttcaggagagtcatccacgtggttggtttagagcacattgtgtcactataagccttcttatgaagacactagactatccatctcctatatggatggacttttgggttgtttccaattgtggtttacgaggagtagggttgctgtccacattttagtacctggtttttggtgaacacatttgcttctgtggggtgtaaaattaggagtggaattactgagtcatagggtatgcatgtgttcaacttttgtggatgtttccacatgattttccaaagtgaaaccctgttttgagatctggaatattgactgtctttcactctccttggaccctagggctacagaactggctacccttatcgataccctgctctgagagagaagtctaaaaaatacagcgatgtggaggttcctgctagtgtcacaggttactcctttgctagtgacggtgattcgggcacttgctccccactcagacacagttttcagaagcagcagcgggagaagacaagatggctgaactctggccggggcgacgaagcttccgaggaagggcagaatggaagcagtcccaagtcgaagactaaggtgtggacgaacattacacacgatcacgtgaaacccttgctgcagtctctctcgtccggtgtctgcgtgccaagctgtattaccaactgcttggtctgtgcctaccttactgttcatagttagatgacgtagagcaagttgggtagctggggcttcggaggctttgggaatccagcctttctgacccaggtgtaaagcgaaccttccttattcactttcttgtagtctgaacctaagtccactgaatgcattactaaaattcggataatactatctgcttgaaactgcttaagatgtaatgtaactccgcagtagttccagtatatctccgtatatagcaaaaatatacaataatttacatgtattaacctacaaataggagctcttcttatttaattcaaattatattcagggactcttaatacttcatgcacaaaaagacacttcagtcctaaacctgtattttagtgttgtgaactccagtggtttcaagtcactaaagtttcttaagtcttcagtgttttcttaagcagttttcccttgtggctcc

SEQ ID NO: 4091 - DNA, 1103 bp, Homo sapiens
aaccctgccccgcctagcacccagcgtcagtttgcacactgggctctagcatgcacacggccccccgcggcagaaaggggttctcctgtgagccttctcacgaagcaagtggctcacggcctttcgtgccaagtttgtctgggaaagaggggttctgttgacgtttctggctgtgaggagcacaggctatggtgacctccaactccccaagtcccctcctttcagagagtgctctcaggggccagcccacggccctccctcttcaagaagacagtggctttacttcgttccggctgtgccaggacttgagcagccacagccttggcttacccccccgcccaccggtaggcgcacagcaagggcaccatcctgctgcagggagctcgcagcactgtcctcacgctgccttgacaccacagaacccgtgcgtggagctcagggcacgcagcaggtgagtcatcgcagagtcggggatttcgtgtttttcaggagctgtgtcagagcacactgaccgaaatggaaagccagaagcagctctgccggccgctgacctgtgagaagagcaagcctgtcccactgaagcttttcacaccccggctggtcaaagtgtgggtgctggcagcatctccctgggaggccagggctgtgggctcagtgggagctgacggggggcgtctgccagttctgcagttgagcagatgactacggagtgaagccacactcccaagcaggctctggctgagaggtggggacagactcttgcttccttaacagtggctttctggttgtagcctcgagtttggaagaaaacaaggcagtagtaaggaggaacaggaaaggaagaggctgatccacaaacacaagcgtgaatttaaaggggccgttcgagaaatccgcaaggacaatcagttcctggcgaggatgcaactctcagaaatcatggaacggtgagggggacgtgtgtgtgcgacacgattgtggtgtcactcagctttggtgctgtgtggccctgggcagagcaccgggcacctggcatcccacagccttggctctggctgggggttggagccaggcaggttcacttccccctgtttgaactgaac

SEQ ID NO: 4092 - DNA, 1174 bp, Homo sapiens
aaggctgactgtggcagctctgaggggctgcggtgtggaagtgcttcatcagccatgacgtgcagtgcaccggtgcagcccttggccagcccagactgcagggtctggagtggaggcccccactctgctgcaccctcatctctcagcctccaggaatggagacagaaaccctcccctgggactctgaagaggctttcagcataaataatgaataacctggccagacaccaaccagagccagccagggaggtggtgcccgtgaattcctgagtcagaggggagcctgctggaacagtcgtggccacctcccactgccctctgcgtcccttcctcaccaggtgcctgagcaggactaggaggccacgggaacagtggggccgcgggcagctgcctgtgtccaccgaacctctgaagatacccaggctcacacctcagccctcacgtcgcaagccagccgctcaaacccaacatccgtcatgctcagcaccctaggtcccggctttggggcctgcctaggggcctttgggcagggccaggccccggacccctccttcaaggctcagaaaaaatcaaatcaacgcaactgaaagcggagacctcacaggctggcggtctgtccggggccttgctgggcctcttccccactcccactagggctggggactgggggttcccttctgctgtgctggaggccggctcctcgcctgaggggggcagtgggggtggcctctcccacaagtggctcaggtgctctcagcctctctgccccaggctcacctgcctgacccggaggtggagcagctgagtgaggccactcccatcctggaagctgacaggctctccggcagccccaggcccagccctgtccaggccgcccacagggccgggtgctctctgctgccattctccccctgcagcttccagctcttgctgccaccctcgctccgtgcaagaccctccccacacccaaaaccatcaccccacacctgtgaccttcaccgcacacctatgaccttcacaccctgcaagaccctcaccgcacctgtgaccttgcctgtgcctgagaccttcaccccaccatgacccctgcccacccgggaccctgtcctaatgggctggggacccacgcactttaagatgctgggtgtgtgggaccacacctgtcccctcctag

SEQ ID NO: 4093 - DNA, 1191 bp, Homo sapiens
ctgtgtccagcctttccttcgatttctgttgattgtctctcttaatagtttcattggctaagttaactcaagagtgatttcactcagttggcttactcatagaatgggaatagcatatctaccccacgggcttcttgtgaagataaaataagacaatgtttgcccagggcaggatggggatagtagtctgctgggcctcccatgacaaagtactacagacttgggggcttaaaccatagaagtgtattttcttacaattctggaagctaaaagtctgagatcaaggtgtccacagggttggtttctaatgaagcctgtctccttgacttgcaaacagcccccttctccctgtgtcctcacatggtcttccctctgtgtgtctgtgtcccaaaatcctctccttataaggacaccaatcagattagattagggcccaccctaatgatataatttaactttagttacctctgtaaaggctctatttccaaatacacccacattctgaagccctgggggttaggacttcaacatatagattttttggggaacacaagtcatcccctcacagcaggtgatgtgaagtcatgagctccaccctggccccttagtagccacatccttgatcaagtcccttccactactgggtctcagtttcctcatctgggaggtgggattgatcctaggggccgtcagtggaggaggctcaaggaagtcctgtagcttccagcagaacaagggtgtccttcaggcagctcctcgtgagcagaggggcagctgtcctttttctgccatgtttcagttggggctgtctcttctgcattctctggctggaagggacctctgaggtcaggtcaggtggtctaggtgacaagtgagggtggtgatcagttgacctctgtgacagctgccactctccttcccagccagactctcccagctatgcctgtttcaggagcaggaatggagtgcaatggatgggaaggcaggagagctagaggccgaggacccagctgcagacttaactcccagccattcatttccagagacagggcaaagacctttatattttttatttccttcttttaacttaaatgtcattattattattattatttgttttgttttgctaagagatgagttttcactatgtttgcctaggctggtctcaaactcctggcctcaagcgatcct

SEQ ID NO: 4094 - DNA, 1182 bp, Homo sapiens
tttcctgccgtgctcagaaatccttccctgcgtgagcatggaggccacacttcctgcagggtgctcccagtgcctgcaagaggcagggatgtggaggcctccttagcccacatgacagggctcctccagaggacagcctgggccccaggacttcttgctctacctgctgagatgtagaactgtgcagcaccagagtcttgcctccctccctcctttctaccctctcttcactcccttcctcccctccctcccttctttccttaccccctctgtccttcttttctccctccctccttcccctctctcccttccctccctccttcccctctctcccttccctccctcccttcccttctcccctctctcccctccctctctccctccatcatggggctgtcagctgcatcgcaaatctgtgggctctgcctcctctggctctctcctcattttgcctcacagatatgtcccccagtacacatcttgcccacatctaatcctggctcagtgtctgcgtctcagaggacgtggaccaaggcacttgccgtctcaggcttagttgacccttcaacctcctgagaactctgggcccaggcaaccctagagaactgactcctgtccatgttctcctttctctggaaaccacttagctgcctccgtcatgctctgggcaaaggcagggcaggttgggagaaggaatcagtgaggctgaggccccagcctaaaggtcacagggccgcctggcccaggagaaatcccctgcaccaggcatttgcccacatggctacaagtgaacgttgggatacggagtgttcttttttgctatgaaactggagtcatggaggtcctggtcgacattcttccttccaaatacagtggcctggatgggggagggcagtggctatagaggcttcctgcaccgtgtcggggctcttgtccattgcaagctgggaccccaagctacccacgtggtgtttggctcccgtctgatagggaaagactttgaagtccacatccaggcataatggatagccaggctgcctaagtggtttgatagatctcccagaaaattcccagatggactctggacgcacagccatgccacagctttcctcctcttgggaacagactaccagtgagaggctttactctgaagccaggtgcaccagggcccctgtgtctttt

SEQ ID NO: 4095 - DNA, 1177 bp, Homo sapiens
tccgcagggtaggtcacagtcccccagatctccgcccaggtggcaaagaagatggagctgggggccgcgccccggcggcgcggggcccgaaggcgaggccgcccagcccgcaccccaccccacgcacggcacacgccgccgcggcccctgccacgcacaccctcgcgctgctccgcccacgtgggcgccggggaggaggctcgagagatgggaagaaaggctggcacccaccctcctgccgggccggcgcgccctgggcgcactggcctccggagatggcgcgcaaggattgactctcgtggtgccagacaccttgccgggcgccctgcgtcggggccagcggcctcgctggcctgcgtcagtgcgctgcggcctcgcctcccagcccctcggtccttcgctccatcccccctgctgtgggctcctgagcatccggcctgggcagcccagatagaggccgcttacgaggctggcgcttcttttcgccttagaagcatcccgctcccacacaccccagctcgccggtctcctgaaggctgggccagcctcggctctccgccagcctctgcccggctctctgagctccagcgatactgtatctaaccgccagccctcctccgccgcccgccccatctgcgcacactcgcaggcacactgtccttggcctttgccagtgctgtgctctctccgcgaacgccctaacttcagctggccagctccttgtagtcagggagatccccttgcccctcctgagctttcctggaacgtggcgctgtcccaggatgctgttaccatctgatggcctctgccttccagagcagaggaggaggtggggaggagggcaggggcagcctcagcccctctcccagggctccacccacagtgaatgttgggcatagcagggccatcccccctaagtcagagtaacccgctggtgtggagggcgaggccatgggaggagctggcccttcctgtagcaccctgggctggtgggtggtggctccactagctgggatgggcaaggaggagggacacattcggggatagagtgggggaattagaatcctttcctagcagggcatttccaccctcctggagacctgcagctctgcagagactgatgttgtagcgcacagtggaggcttgtggcttgttgcaagatttttgttgctgttga

SEQ ID NO: 4096 - DNA, 1570 bp, Homo sapiens
tcgggcacccgcgccaggccgaggagcggccccagcttggccgctcttcgagagcgatgatttcatcgagatgcaccggaatcgggggtggggcgggagaataaaggcgtgctcgggtcagggccgatctgggccccgtcttcgtgttttgttttttgacggtggcggcgtgggataatcagagtggccgggtttgggcgtgatgcgtgttcagtggaagggtcataaatctcagagtcgccaaggaaacagaaacggacaaggtcccgggccgtccagcaagcgggggtggaaatagaggattttcggggaagacgttggacaagtcaacgttgctagagactggagtgagtcaggtggtggccagaagaggtggcgtcctgcacagtggcgttcgtgagggtttgggggtcgttgtgcctgggattaacctctcgatgatgaatttcttcccattgtgctttaggtttccagccaatggattctggtcaactggtggagattggctgacaccctggagaagccgaaaccagagagccttttgttttctcttttttcctgtctatgctctgtctcacttaacactacgttttctgctatggtctgtggttgatgacctcaatatgagtttcgattgttaacgtgtttttgtttgggaagtaattttgtttgaaaatgctctcacatacaggaattagggcctagattgtaagctcttgcagcagtcacatttgttcccgggctttggtggttatttctaaatttttgaggtgctttgctatttcttgtgtgacctgatagctccctggaactttgggtctgtgtgtgacacatgagactcacagttggagttctccagctctggaggtgctgaaggagctgcattaattctggaagacgactccatgcagcaactactgaagaaaggaccagacttcaacggggagtgtggatgggccgacctggctgggactcgtgaatctggagaagagctggagaatggatagtattgtctgtatttggagactttaatttctgtgtgagaccaaaggaggagagatgtgttttgttcaaaatttaaatttgttgtggtacactatcttatgtaacctgtctggtgagtttgtttggacaacctaactcagctttatttgacatggaacctaaaatagaagataagatcttgatattctgtacaagttgatgtaataccctgatgcgttttagaggacttggcataaaatgaaagattggcaaaggcccttgaggggcttggggatgacagtatggaactgtctgcattggaccctaaactggactagaagaggcatcttcaaggttcatacgttgtccagctgtaagttcatttgagtagcagacctaacaaatatttgaggtcagaaccctaccatgttaaaacaaacaaaaacttaccatgttaataaaagtattcatttgcttgaaaagacgaaagacctaaaaggttattgagaaatgttagtcctttaagaatgaaatctgctgtctcccagatggttctcactgtcaaatggagggtgaacatcttaac

SEQ ID NO: 4097 - DNA, 1129 bp, Homo sapiens
agaagtggcattcttctgggtggttcacatttatttttaacatcaggatatggaactttgagagtcaatgtcttcatggtaaatttctcccaattgtgctttaggttcacagctgaggactgtagtcaactggtaaggatgaactgacaccttgaggaaactgaaacagcttgtcattttctctgttttgtttttgtatgttttttaccccgatgtaacagtctcccttatggtcagtgattgatgacctcgatatggatttagattatcaaatgtgtttggttttggaaatataacttttgtcaaagaaatactctcagaagagaaatggggcttaattaagttgtttttgtggtcacgtttattcttgttacttcgctgtgtttttgaaatgttgggcatggcctcgtattttgctgttacctttgtgacctgattgttttttggaacacgtcaagacgtgggatcagaatcttccaactttagaggtgcaatggaagacactacgctacttggttgagcctggtgaagaatgtattaatgagactgctttgcataaaactgggaagaaagagaagacagttggagatggaagatggttttgtatatattttggaactttagttcctctgtgagacgaaagaggagagctatgttttgtggcacattgtctgatatatattgtgtaacctgtcaggtgagttgatttagacaacatagctgaccttttatgacaaggcagtttgaatagggactattgtaataccctcacacattataggggcatcagagaatggcatggaagagacagtctacagagagctttaagaggccggagaaaggaaaagacattatcagggcctggaaagtctcttccagttcatcagggtagtagacctgtcagattggaggtcaaagtcaaaagtataataagtgttaatttgccttgaaaaacaaagacctaaaaagccttttttaagaaataaattttttgttcacatgaccaaagcccctcctgtgtgtgttaataaaagaatcataaacaaatttttttggaatggatgttcttcattgagtgtcatcaaatggggttgaactgcttgtagttaaaggctcttggtaagccttt

SEQ ID NO: 4098 - DNA, 1187 bp, Homo sapiens
tcttccatcccagaagcccccagggctgtcccgggcgggctgtaaagccccaggctttggagctgggtgcctgtgtctctcgcagaaggctactatccattccgggtagctttattcaagagaaaagcactttgaactgacgtgagaaaagtgactgtgtaagatagaaatactagactacagaaagtttcagccatcaacgacacgtatatttctttccctctctgggttgttttttaaagttccaagaagatattttgataaaattccttgcaacacttaaactctttttctaggagattttaaaaatatataacatggatgtgagggcgatttggctgtcatatctgtcactccattgatcaccagggttgattcggctcatctgctggctagcccggtgtccccttccccactagcactccatgtgcgtccctcccgaagctgtgtgtttggtcaaagagaatgaccatccctgatagaggaccggtcttcagtcagggtatgtgagtagctgcactcccctgctagagcctccagacaggctccattcgtaggagaatgtagagtcgtcaaccttccaagactccagacacatccaaatgaggcactgcatgtggcagtctgcctttctaaaaataaaaataaaaaaggccaggcatggtggctcacgcctgtaatcgcagcactttgggaggccgaggcgcgtggatcacctgagttggggagttcgagaccagcctgaccaacatggagaaaccgtgtctctactaaaaataaaaaattagccaggtgtggtggcacatgcctgtagtcccagctacttgggaggctgaggcaggagaatcgcttgaacccaggaggtggaggttgcagtgagccgagatcgtgccactgcactccagcctgggtgacagagcgagactccatctcaaaaaaaaataataaaaatatataacaatgtggtgtatatgtacagtggaatattatttggccttaaaaaggaaggaaattctggcacatgtggccacatgaaggaatcttgaagataccctaagtgaaaccaatcaatcaaaacaggacaaataatgtatggtccacttctatgaggtccctaagagcagtcaaactcagagacaaaaagtagaatgatgggtgctaggggttggggagacggggagtaggaa

SEQ ID NO: 4099 - DNA, 1270 bp, Homo sapiens
gcctttgagccctgcacagctggacccatcctaagtgccagtgagtccctcacacatttgactttagaacgtgtgcttcatgacccgttgtacagacggaggagcgagcaacacacgtctaacagcctagacaatctcgtcagatgctcatactggaccatcagcctccccattttagctgactttcccagggtcgttggcaaattttttgttctgtcttttccttgactaattgtagaactttgtgtgaggactttggttatccaaaatcacagaaatgaaccgttttgcagctgcgcagtctaaagggcaggccagtgtctggaagcagggcccacgtggcggtccgctggcaggctggtcctggggagcattctgcggacccggtcacgggcttggttagtcatgcgtacatgtgtgccttggggtgctctgcactccacggcccttctcagccacacttcccaccccagggggtgcccccaggctgatctcatttctgatgttgagggctgtttggctctgtctgtatagcttgtaacaggagccttgggctaggggctggggaaggaaagccgagctggcattcgttctctggactttttatgcctgccatacccgctaatgctcctcgaggtgcaggagcaggttgctgagccagtggctgccccgtgccctccttcccagcactatcatgtgtcacgtttcccggactctgcccctacatctcagctgaatctccagggaggctgcagagcatcgtggagaccactttctgcctcggcctttaaatgctgactcacctcctctcggaggaggcgtcctgtcttcacgggggggtcccggtggcctccagacgtagccatttcctgacatcaagatgttgaatgtaatctggtctgagctgggcctgtgggaggggccgcctgaggcctgtgcgctgttgtcctcgcagatgtacttatttttgttcatgttacgggcgttccgttccttaaagatgtatatattttcttactgtacataaagatgttccttaagtcgtacagaaggtggcgcggcaaagggcctcgtgcagtgtgttcagattgcccctggggatcttctgtgtcttcagcgcccagccctgcgtgttcctggtgaagcagtttcacatcagtctctccagatagcactacgatgtattccgcttctgaacaggatcccatgccagtgtggaacaccttcccaatcttagttcagaagtggcttgtatgacctgttcaggggt

SEQ ID NO: 4100 - DNA, 1282 bp, Homo sapiens
tttctatatatctttatttcatagtcgagacaattttatactctgaatttttatcatataagtatctacccacattatcaggaatgctttgtaagcatcattttaatggcttcaaaatagtctatgatttagataacgatgatttggccatttttgtggtcacctaccacttattggagacatattatattctgagaatattatgccatttataggcattaattccaatatgcaaaagaactttgaaatgaaggcgttattattcccaattttacagatgctgaaactgaagctcagagaggttaagttgcccgaggccatacaggacaataggggcaaagatggttttgaatcaatggatgtctgacgacaaaggccatgatctcaccactgcactgcactgtctcctgaagccctttgtgtgaaatgattaaatacatcatgattatgtcacacttcacttacccttctccaggtagttgaacatctggatgattttacatcgtcaaatacaaggttgttaacaattaaaggataaaacagggtgcggccggaaaggcggccgccccctcgcccatcatgcaatgcacattcgtggggaacctggcgctaagccattcgtagatgacctgcttctggctcggggtttcatatgtagcagagcagctccctcgctgcaatctattgaaagtcagccctcgacacaagggtttgtaaaaaaataaataaataaaacaaaaaacaaaaaaaagcaattaaaggatataaaaaatgaagacccctgagacataatcagtgtcttgcaacctctttctctatggccacaccacatccagcaagagcgtctgcccctatttgaatgcctccttccacctgggtcagccagttcccttagcagccgtagcagcaattttaacctgcaagcagcctgattggcccagctggtcatgcccaccctgtcactcatcactgccctctctactgattggcttctcttgggtcagatccccacccaccgtgggcttattccttgaacacagggctgtggcttcctaggacttggcacatagtagctgttcaattcacatttgttgaaatgaagaaaattgggtcagcattccttaggactttggcaaacgggctgaaacccaagtctagaaaattgcccagaaaaggccctgcccaggtcagcctgggacagcagccacctctgtgggaggaagtgagggttgcaaaaagttctagtactttgtctttctgaccccatttcaggtgccttcta

SEQ ID NO: 4101 - DNA, 1175 bp, Homo sapiens
ctggccacccagaacctcttgagttaacaccaatggtgttgatgtggtctgcttgaccccaaacacagcttctcttttcagcctctagatcagagagttacaaggacctttaagcctcattatgcacagtattcaatggaaaggattggatgctgtggaagagaactacaagagagaatatcatgaaaatcctgcaaggattttaccattgaagacaccgtcattgctacagaaaaggccatgaaagctaccgagcctgaaacaaattcccgccagagaaaatagtgtccagatgttggcctgacttcacaggatttatagcagagccagtcaaggaaatcatgaaagagttgtggatatggcaaaggtgggcgatgaagggtggaagtgtcatgcctgacttcacaggatttacaacagagccagtcaaggaaatcatgaaagagactgtggatatagcaaacaaaggcaggagatgaagggtgcaagatacggatcttgagaaattcaagagctaatagactccactccagaggaattaactacagacgacctgatggagatgagtgctgccaacccagcgccagatgatgaggaagaatatgtaaaagagacagtgccagaaagcaaattaacagacagtgtggcagaagggccctgattattccagactgcatttgacttcttttatgccatagactcttctgcgatatgcactgaaactaaaggaaatgatggaagaaggattggcactgatagaaacgtttttagagaaactaaaaagtaaagcagacagaaattatgatgtatttcatgaagttacactgaatgtgcctgcctctcctgcctcccttccacctcctccatgtcttccacacctgagacagcaagacccgtcccttctcttccttctcctcctcagcctgctcagtgtgaagaggatggggatgaagatctttgtgatggtcggtccacttccactcaatgaatagtaaattttctctttcttatgattttcttttcttttctttttttttttttttttgagacggagtcttgctctgtcgcccaggctggagtgcagtggtgtgatctaggttcactgcaacctctgccttccaggttcaagcagttcagcctctcgagtagctgggattacaggtgcccaccatcat

SEQ ID NO: 4102 - DNA, 1177 bp, Homo sapiens
cccaacagtgcttatcattgtagacaagattattctgtcatagaggcagaaggctcagttcagggaaatatgtctcattcaaaaaaaaaaaaatggaataatttgataaagtacctttcagtcgtggaaaggaacagagaccccagtttgtctgttgtaccacagatctcatggaaaggaggttccaaaaagaataaacctgaaatttacagataaaatcaatagagacacttgcaaagtgcaagacgtacccagagaacaccttcgttctgggaggatgcatctcatctctctgcagactcagcccagcccattgtgttacattcctcaagtgatggcatcaacaacattcatttttctctccctgcttcttttgagtcttgtgtcaacacacagtagctggtgaatctcctcattatgtttcctaatttcagtaagaatgtatccggtccaactcctgagagcatctacattcattgcattctgtgggggaaggagaagtcaatctttctatattgatttctatgaaaatgaagcatgaagctagaagcactttttttggcagaaaatgattttacaaatacaactctctgcctgaatgtactgaaagaataaggatctctaattagttttctaatgcaattgtgttcttataatagaggttccccctctcaaaagagtaattacaaaaataattgtattgagaaatgaagtagctctttgcaggtaaggaggtccctctttcactgaatgtcaatcacttgatttgctctttctttggaaagagaccaaaaatagaagagagaaaaagtaacaaaaaataaataaataaaaacaaaacaaaaagctgttctgtggtactatgcatggtttgtttaggaaaaggcctccaggaaggctctcaattgaagttcattgaaagtttaattgaagttattagattactgcttttggcaaaaaaaaaaaaaaaaaaaaaaaaaggagagattgagcagtaatctttgagtagtatatattagcagatttctctctctctttaagtgatcagatttaccatgttcactctcagcctctttataaaaaagtatagacatgacactttgaaaataggggtagatgttgttcgtttcaaggaggggttcacagaggatattaactgtccaaagatactaaattg

SEQ ID NO: 4103 - DNA, 1212 bp, Homo sapiens
tgcaggaagtagtacctcaaagtgctaatcctatgaggacaatcacatgtatattgtttagaattgatgcagttccaaactgtgattgctgtactgtcatatttttgttgccacagaactttgtatacatgtgttacagccaaaccaaaacaaacaaacaatacaactaaagcaaatataagcaactaaagcaacagtacaactaaagcaaaacagaacaagactgccagggcctagaaaagccaagaactttgccagaggttaaattaatccccctataatgacagtatcttcaagatcttgaagaaatgcatatggaccaaatttgccgtttgctaagaatttctccttttcaattgcatgtgtacatatgtgtgtgtatgcatgcacacacccagccacaactttaatgtaggatcttgagtccttttcatgatgctagattgaatataccaatgttggggtttctgaagcagaaatattgtgttaaattattgtgaaggacttctaggaaacagtgtttgttgaaatagttttacatggaattcagtctttaattttagtattagtttaagggaacttctttgattccagaatcaattgcctgcttgctgatcttcttgataaaattcatattgtagcatcaaatagtttcttaaaagtactacatttggtacacttctaaaacatcaaaaaatgtttcttgtctagttttgataccaggagtgttggtatcaaaaatctttgatactgagtgtgtaactctggaatccagatgaagaaaatgttccaaggaggaaggattcaatatgtcaaatgctgctgataggtaagtaaaagaaaatcaataatttactgctggatttagcaacaactcatttcttatctgtatagagcaattttggtaaagtggtgaaaataaaagccagattagaatcagtaagtgtagatgattcttctgaggagtttgttttaaagaattcaggtaaattgaagtggaggtgggggtcaagagtttttaaattgctttgctttcaattttaagataggaaaaatatgtttgcatgctgatagaaatgaaatagtagagagagaaattgatgtaggagagagaggttagaattgctggagtgatgtcattaagtaattgagaagaaggtaggatccagtctacaaaaagagggtttaacttcaggaacatggatcacttat

SEQ ID NO: 4104 - DNA, 1223 bp, Homo sapiens
tgtggtacatataaaccatggaatactatgcggccatccaaaggaatgaaatcatgtccttttcagcaacatggatgcagctggaggccattatcctaagtgaattaatgcagaaacaggaaaccaaataccacatattcccacttataagtgggaactaaacattgagtacttatgcacataaagatggcaacaatagacactgaagactactagaggtagaagggagggcaggaaggagaaaggtttggaggactaactattgggtactatgcttaccacctgggtgacgggatcaatcataccccgaatctcagcatcacacaatatacccatgtaataaatgtgcacatgtacccctgaatctaagataaaaattgaaattataaaccaagaattttcctgtccttctcttttctttatttttgttttaattttttttttttttttgaggcaggttcttgctctgtcacccaggctggagtgcagtggtgtgatcatggttcactgcagtctctgcctcctgggctcaagtgatcctgcctccgacctcagcctcctgagaagctggaccacaggcatgtgccaccacacctggctaattttttgaattttttttttttttttagagacaagcttccactatgttgtccaggtctcaaattcctgggctcaagcaatcccccagccctggcctcccaaagtgctgggattacaggcatgaactattgtacctggcctaagatattagtttctaaaacaaggccgtgctgaatctgggggtctcctctagcctttgatctggtcaagaaaggacatcattccttacttcaagatcctttgcccagggcccagctcatggtgggctgatcagtaccaaactgtggaataaatgaatgaatgatactgtctctttcacaggatgttttgtattttgtaaagccttatatactttataagacattttcactgacaccatcttcataacatgtgagataaaatatgttgttgttttcccagtgtgttggttcaagaagcaggagttaggatggtattaagtatgcaagggattgattagaaaaaccactctcgaggggaaacagtgaagaaacatggagactggaataagagccatgatataggtcttattcatggggagcagagaggcaagaagttcgagtggggaaagtactagattgccatgcagtgtgaagaaagtttta

SEQ ID NO: 4105 - DNA, 1198 bp, Homo sapiens
atgtgtttttcctgcatttgctctgacttagtccatgactttcatctgcaggatgtgtcagaactaaggaatgaattacagcggaaagatgcactagtccagaagcacttgacaaagctgaggcattggcagcaggtgctggaggacatcaacgtgcagcacaaaaagcccgccgacatccctcagggctccttggcctacctggagcaggcatctgccaacatccctgcacctctgaagccaacgtgagcaaagggcagaggcagttggcctatgagtgggctgatgcgtgaggttggccacacattccttcctgtggacttgacattttggaagaactctttgccagataatgagttcattttagttttatgctcccattgaaaaattttccactatttttataagctgttaatttcttgagtactttataacatgtctgtagcttggataaaccaagtaagtattttttttttgtctttagcaaagtttagactgtgaatatgatgacacagattcttttttatggtggctttgcttgttttaaatttttgcatgacttttcatctttttatgtgtgtttcctgtagtttgatccgaaggaaaagagtatagtagcctgagaatcaggagatgggagttttagtcgtaggccttatgataattaccccgcggtggtgtgtagaaaagtatgtaaatttgctctgttttaagactttgaactacctcaagaagaggaatctaatacaatatttgtaatgtttccagagctctcagaatgaggatttttttgtaaataggtcagaagacgatggaactgtcctgggttagtatagtaatcttacagtaggatccttaggttgatgctgacttctgtttggggtatgtttatattttatgtggtgtttactttttttttttgacatagaaggatatagtgggagcagtgatacgctaacattcattacattctgcagtaatgaatctgtttaatgggtcagtcactgttttcagtagcatgacagtggggtcataggtgagctgtgaggggctaaatcttgctctgattgtctctttctgttttgagttttgtttgcgtgtatcatttttgttctacattttgggaggggaaacattttccgttaaggaaggttgttgccagtggatttgactccaagggactagagtgtcgtggtgg

SEQ ID NO: 4106 - DNA, 1157 bp, Homo sapiens
taaagcaaatcttattattctcatttttgtactcttcaattcttaatgataaaaagatcatgctttctctcacactctttcttttaaatgaaggaaattgattccagtggaaacattaactcctgaaattgctttgtattggtgtgccctttgtgaatatttgaaatcaaaaggagatgaaggtgaagaatttttagagcagattttgccagagcctgtagtatatgcagactatttattgaggtaaattttttttcttttagtttggagagtgattgtgttgctgcatgtgtcaatctcccagtccccttcctcaaagtcatgtttgattgtgaatatgttaaaaatcctttttttgtacatgtagggatagttatatacatcgagtctttttgaatatcttgtgctggtctgtatactgaaagagcaagtcactatgtttaggatcatttcttcaaaactgttaagatatgattatgaccatttctgcataaagttgatgatgatgatatattatttctgaaattggttggcacattttctgttaagtgtcagataataaatatcttagggtcctgtgggccataccgtctgtcacaatgactcaactctgccatggtattgtaaaagcagccaaagacaatgtaagtaactgtttttcaataaaacttttattgacttttatggccactaaatagttgaactttaatattcatgtgttaacaaaataagaaattttaaaaaatgatcagttaaaaatttaaaatagtcttagcttgcaagctatataacaggtaataggctggatttgatgcacggaacattgttttccaattcacagcgtggatctttgtggccagttttatttattaaaaacttactatctagcttcatgttttaaagttttttcaaaatatgcctttttaaaaaacaatttggattaccataattatacctcttaagaaattatttggattactttatttcactttaaaattatacaagaaaaacatgaatgcattcttgtcaaaattcaaatacagaggtataaggaataaaaatgtggaattccctcttttatttcctacttcctcaatcccattgattagcaactaagtgtatattctagcaacccttagaattagcaactaaacaat

SEQ ID NO: 4107 - DNA, 1160 bp, Homo sapiens
ttggatggttcgtgtaaaaatactgtaggacaggctacattgagaggcttaaaaaggagatacaaataaatttcttctaatgaatgtcatctttgttaggtatctgaacttaggactggagctgcagaaggactagccaagctgatgttctctgggcttttggtcagcagcaggattctttctcgtcttattttgttatggtacaatcctgtgactgaagaggatgttcaacttcgacattgcctaggcgtgttcttccccgtgtttgcttatgcaagcaggtattgagtcatactgataaatcaaaaatctgacttgacatcaaattcaagtcccccatgaattatatctataatgatattttgttgttgatactttttctgtctttagtagataaatgatgaaatgacaagaacgatacagattttatctatctgaatttttggctctttcctagatgaaaatgcacttaatgagtgaatttcctacatagtagttttgaatttcatactttttctctcatcaaataatgttctgccaacatactttgaatttgtttctcaataggactaatcaggaatgctttgaagaagcttttcttccaaccctgcaaacactggccaatgcccctgcatcttctcctttagctgaaattgatatcacaaatgttgctgagttacttgtagatttgacaagaccaagtggattaaatcctcaggccaagacttcccaagattatcaggtgagtgactgtggtaactgcatgcagatcactgttttggtaaaataatctctctcaaagatcccttgaaatactgaggaactgcattttggtctttagacttctgtctcaagcatataccacaaagcacgaaagaaacatgaccttgggaaatgtggagaaatcatatgaaaacagaagtaatcaatgctaacatttttgctactgaaaagaaattactaaaaatccaccacccacaccatgcccacctagtactgactgttaatctgaagtaataacctatgttatctaggactcacagagtcttcaaatgttggcttacctgctatgcttctggcacaagaaaggagaattcaaagactagaactcacctcaagcttttttggcttttaattcaaagaagataaatcaattgcac

SEQ ID NO: 4108 - DNA, 1230 bp, Homo sapiens
ggcaagaaaattagttggaaatatttgttagatgtgtaagactatataataatcataatcatcttcaatttacagagaattttctcttaattttttaggccttaacagtacatgacaatttggctatgaaaatttgcaatgagatcttaacaagtccgtgctcgccagaaattcgagtctatacaaaagccttgagttctttagaactcagtagccatcttgcaaaagatcttctggttctattgaatgagattctggaggtaaagtagtttctcattactctaaattagtttgtgtttatatttatacatgtagaatttacatggttgtattagattatacatatgttagcatattgtgacttatttgaagtattttcttcataaatttcatataatttagtgtttttaaacaacttgatatgtattggtactattttcaaagattagggaatgcggtgtttacaaaatgttaataatgttttcttttatagcaagtaaaagataggacatgtctgagagctttggagaaaatcaagattcagttagaaaaaggaaataaagaatttggtgaccaagctgaagcagcacaggatgccaccttgactacaactactttccaaaatgaagatggtaatcacatactgaacagaatatttataaggttctgtttttttttttccatctttactgagacatatttttttctactctaacatgtttggttggacatcagaaatgaatgaaattttttttctaattaatcctcttgggaaagagcattactgataaatgtttattctgcttttcaagtgttttttggcatgcatttctcaacatatgaccatctttttaagagttttgcttctttttccaatattcaaattttcgaaagggtgatttataacttttcactagctgctagaaggactttgtcatttcagttttataaaaactggtcttaaaaagacaatttaaaatatttcatgaggttatcttatttatattgttgtattattccctttaatagaaaagaataaagaagtatatatgactccactcaggggtgtaaaagcaacccaagcatcaaagtctactcagctaaagactaacagaggtagtgtgtggattgaccatctttatgataaaagttttaaattttatcttccaatgaaaaatacttgttttgcaagttttcttatctttgtttccttagggataaagatttttt

SEQ ID NO: 4109 - DNA, 1176 bp, Homo sapiens
gtggagataacatttgtcgtaaactaatttaagagctatattttgaggaagaactgataaatacagcagtaattggagacatctggggtctagggatatttgttttttagatgggcgttaccatttaccatacttagtaagatggggaatacttttctgtatcagtgataaccatgattcttttatatgttaatttcattaagctgagagctgatagtaacaaaatactgaggcaaatatattagataaagaaatgggatagagttggttttaatctcttagtatggattctacatgtatttttttttccccttcaaaaaagtttcctaatcaagttactgagatgtggtatgtgtaacattggtgcattacacattttaaaagaatgtttttttctacaattaatttactgttgtcagtcatcatttatcttgagtcctacgtgtgaccattgcttgggggtataattttatgtttcttctttactggattctgaactagaaatagactttggaataaaaaatcaaaatattagctttttaaaatggtaaggttgcattgaggaacttggcttggaactgaggccaaaattagacattagattgccctactgcctgactccctgaattgaacttatcagcctatcaaagacagtacagctggagctgcaggcgtcttaaaatacaaggaagctgtaccctagtgagtttaccatgcttgttggtaggagtgagcaggaggcttggccgtgaatgaaaaatgacttttaaaacattaatccatcccactagggaccaactgtaaggatgttgccaatattagttattcttccttcttttgggagaactgaataagtagtagagaaaagagccaagtttcttccaaagtacttcccccaagaatgtgaaaagtgtttgtgggagttctattttatggaaaagacaggaactgtggtgtggttcaaaaagcttactgtttacacaggagtaggatttaccttgcttttaaagagttcacagtgatcagggatgttaaatattagacttggtgtaatgtaatggaaagacagaagtgggaacaattaattttgacttgaaggattcaaaatgactaggcttcaaaacattgagggaaagcaaggattggcaaactttttctctaaagggccagacagta

SEQ ID NO: 4110 - DNA, 1176 bp, Homo sapiens
aaaaacctctgtgtggtagtggaaatgatctatatcttgttttgggtacataaaagtctatgcaattatcacaacgatcaaactgtcccaattatcaaacaaaatccttaagatccatgacattttattttatttaaataatatttcaatatgaaaacaggaaaagaaacatgtaagtacctagaatatattttcggagatgtttaaatttgtccaaaaattatcagactttattgaaaaacattaatgaaaatatgtaccatattcatgaaaatatacaccatatccaatctcatacatgttataaatctacatattctatgcaattgcattcaaagtctcaaaacctgtatgtgtgtgagagtgtgtgtgtgtgtttctgtgtgatcgccttgatagtggattatagaatttatataaaagaatatagatcctagactagccatggtaacattggagaatgggcacagtaaaaagatgagtagaaaaggggtacaggttagtaagatttgacttagcagattgcaacacttactatatagatacagtagtgggatcgtgcctgtgaatagccactgcactccagcctgggcaacatagcaagacctcatctctataaataaagaaggataatagagcatatgtaacaaatagatcaatgggatagggaaaaaattctttaaagtcctaatgaaagcaattatctcccccactgcataatcaaaattatcttctttagtgaataattcacactttcacacaaatgtgtcatttctcttatcctaaaaaaaatttttttaacctgctcatccttcttactaccactacatttcttcaccctcacttgcagcaaaactccctgaaaaagagttgcctaaaatcaccaactctgatttctatttctccattctttcttaaggccatgctgatcaattctttgctgcactgaaaaggtccgcagaggtcaacaatgacctcggattgattatttccatggagagttttgttttacatttcagctgcatttttaatacaactgatcacttcctttttcttgaaaaactttcttggctcccaagtcagcacactccctttgttttcctccctccctcactgattatttcttctcggcctcctgagtttctgctcttctacctgacttcttaatttttaagt

SEQ ID NO: 4111 - DNA, 2038 bp, Homo sapiens
tctgtttctgtctctctgtctcttgctgcgctgcaaagagtgagcagcccccttaaggatcgcgtggcaaaagctgcaggagaggcactggcagggctgtttatttatgagccgcgttcaaagccgacctcttcccattctcccactgcaaacgactatctccgagcccaggtcacctctggggccaaggagttgggggctggggctcgggtggctccttcttcgggccaagtttgcccgcgcgtgggagcgagggggcgagccagggcgcacgggaacgcgcgccgccagccgccgcctccgcccagcgctggcagccccggcctcacctctcccctctccccagcgaggtgcgggctcccagagcggagccagggggcgggcctgggcctcgaggggcggggtcagggggcggaggctcgggcggctatataaggcccgcgccggctcaacttcggacttggtgttatttatttgggaagcgcccggacggcggagcttggcggcggcggtggtggtggctgccgcagactgtggttaaaaaaaagaaggcggcggcggcggcggcggcggaggcggaggcagctgcgaggcatgggagcgccgaagcgcccaggcgcaggccgaagctgccgcgctttctgggcacggcgggagtgctgagcagaaaggggagcgccgggggcccgcagccggctccggaggcgcgggccgggtttttgtttggctacgctgagcgccagtcagccccagcgaacaactccagttacgacaacaacccaccttccttccagacaagcgagacttgggctgctgcgtccgtcctattgtttagacacttgccaggggctccggagtcggcagagccaccgagtccccgctctgagtcgtcgccctccctctccccgacctcgctccctggagcgggaggccaggaaagcagcgggagaggggaaggggctagaaggagaaggactacccgggactgcggccgccgcgtcaggtgcagcgccaggagccgggcggcgtcgccacgccggcaggggtaccgccactgtggccttgggggacggaattcaaagcctgggaaaagttgctgcactttgagaaggacgaaccactagtgggagaccgccgggggccggccgtggctctgcgccctccggaacccggctcttgtttcttctacctttgccatcaggtgtctgccgcggagctgcggcttatctgggagacgagcggggttgacacgcgcgcacacactactgccattcagctgccgcctggctctgcctggagtagtggatcccacccgcccacctgccaccgagccattctccagtacgccccagcaggacgctgacacctccaaccttggcctttgcctttccactccttccggtctgcctggtttttaagtccgcccccagtcagtccccactcagtcttcgcagcagctctcatcctccacttggcctcttggagttcctcgccggagtgctgactagtggatatttctgcccggctgcggcggcccgactgcccttttgtcttttctgcgtgacctcggggcaggtcctggtgcagagcgtcgccaaggacgccgagcgggaggcgggattgcccagacatccttcagcgaagtgcatgtgtgtttgtaaaccatcgttggctgtcgggagaccgcgaggaccggtccaggctgcggcggagtcgagggcgagggagaggccgcgtgagtgagcagagtccagagccgtgcgcccccagaactgcgcgtccgccccgtgcacccccgcgcgccatgcccagttgccccgcgcgctctgctacgggcccgctgggcttccgcgccttctagcttccggagcccactttgatcggggccataatacctattgagatcccctcttctgtcttgtaccttcgccactggcatcggatttgcagaagcgtgcgtgggatcagaggaccgccctccccacaacaaccggcccctgcatcttagcagccgttggaagccccagctcttttaccg

SEQ ID NO: 4112 - DNA, 1054 bp, Homo sapiens
cttttaattttagtgtgtttccattttcaaactaagacaggtgcaaagttgaggttaccagcggtacaagatcagatcacctagttagatattgatgcatagtaaaatgtagcctaacacactctattcataatgtggattgacaactaagaaaaaagtgaatgctttattcacacaaataggttaatattcctgaaatagtgtccaatgcatttaaagccatttaaaagaacatagagaatacattatttttcttagcttatttctccagtatttctccctgtattactctagctcatatttagactttttgttaatcttagaaaaaggataaacacacacagtgtatttctgcagactcccctttaatggatctctgccagtgttagccattgtttcagttgcctgtggctgctcaactgtgcaaggttgcctggaaacgctccttcttcagtgcaaagctctccggccactttccatacctcccagcccagggcttaaagattcagggactccagccactggtgtttctttttgaaatctccttagtaaactaatgatcttgtaaatgtagaaaacagaaaaattacttctcagtctgtagggcgtgcaagtttaaaacaaaacaaaacaaaaactttgaaaaaaatatgtatttgttacaagttaaaacaaatacaatttttcttctctattgaatttgatttaaaattttgttaaaccagcattttgtaatgtgtaatatttttggcaaatattttaagttaacatctaccactgtctttcagcctggaaattgtgtgctattcccatcaaggttacatcatgtttccattactcctttaattgggggaagtttcaaagtcagacaccttgatttggaatttcaatgcttttaacaaattttaaagcaagtaccactattaggtaacagaatattattattactcacttttttccttggttaaatttgtttgttagtcctaagaggctttaggaatataaaatgaatgtgatgtttgatagtatcaatacagttgattttacttgtctc

SEQ ID NO: 4113 - DNA, 1098 bp, Homo sapiens
ttcatcagttgatattttaatatttttaacaacctggtcattacaataacatctgcgtatgaacccatcaaaggatctaattttagagtttaattttatactttgtagatgtctgaaggaaaaaaaaagggacagtgtcatacataaaaatgcactatgtgctttcattttaaaaatattttatatcactgttcttcaaatattgaagcatcaggatccctttatattcttagaacttgtacagaaccaccacgagcttgtcattatgtgcattatagataccaaatttagcattttataaatttaagcagtacatttagagatttaggaatttattcaaaaacaatagacccattatatgttaacataaataacatatctataaaagaaataaaaaatttttcaaaacaaaaaacaatgagaagaatatcattgtttaacttttttttttttttttttttttttttacaaatctctttagtgtctggcttcttacaagacacctggattcttctctctgcttttactgtattcatactgttgtaatatcacacaacatggacctctgggaactccactgtacagtcatgagagattgagaatgaaaaaggcaaatgacatttcagtattgttacaaaaatagttctaacctatagggacccgttgaaaagtgtctcagtgacccatagatgaccctggaaatcactttgagaactaccattctatattttttaatatgagataattccattgtagaaagcatacttcaaaattcgaagttttgatgtatctttcagttacccaaaaattcaacttgacttttaatggtgcaatgatgccgaaatccccctgtccgtgcatcagtttatttttctactgcctatttgcatgatggttaaaaatatgggtgaaatgattttcttcccttttagcccctgcaagagaccttatctttacatatgcatcttctttactcgactataaactctgtaagaagagggagtattcctgggcagccataaaaaaggatgagttcgtgtcctttgcagggacatggatgaagctggaaaccatcattctcagcaaactgtcacaagg

SEQ ID NO: 4114 - DNA, 1148 bp, Homo sapiens
aatcatcttataagagaaattgtttttccaacaacaatttactgcatattttatttttatcctcaacctatatcagaactgctgatttaatataaaagaaaatccaaattaattgttttgtatgctatgataaaatctttcatatttatactgtaaactaacagagtagataggcaaatactattttgtcatgcaagcatcattttatttcagatatctgaggcctgataagttaccttattactcataatttttaaataaaatttttaaataaaaactttattgatatggaattcatataacataaaaatcatgcttttaacttatacaatttagcgattttatattttcatagagttatgtaatcatcaccactatctaattttaagactattttccataaccccaaaaagaaatcttcagcccattagcaatcattattaaaagacaattatttttctatggaattgtcttgggacctttaggaaaatcaatcatgaatgtaagggcttatttctgtactatcactttcttcttctttttcaagtttgttttgtcaattctggatcttttgaatttacatgtgaactttaggattaagattgtcaatttctgcaaaagcatcagtttacattttaatagtgattatattgaaactgtaaatcagtttgagtagtattggtattgtaataatggtaaatatcctgattcatgaaaatgaatgttttccatttatttactttttttctaagtgctgcatccagtgttttgctttctctgctatgattttgttttcattcaccttaaagtattacataattttcttttgttctcttcccttaaatcactgcttatttaagtatgttgttgaatttcacatatttgtgaatttcccaaattttcctttgttatttatttctaattttatttcattgtgttaaaataacatatttcaatattatttcaattcttttaaattgagacttgttccggagatgttccaggtgcatatggaattaatgtgtatttttattgctgttgcgtaaagtattctatagatgtctgttaggtttagttgatttatagtgttgtttgagtttctattttgttactgattttctgtccaggtgttccattcatagttgaaa

SEQ ID NO: 4115 - DNA, 1097 bp, Homo sapiens
tagtaacacttgcggtggtgtcttagaacacaaatacttctacagtatctagaagacatgtcaactgttgaaagccaataaatgtcacaagaacccccgtaattcctttgtatatgtgtgatttcatatcttataatttttatacatttaaattattttaataaaaatgtgcttacatacatgtacacacatatgtgtatgtatgcttataaatgtctaaaactgtataattatttaatgatttacttactactcttactatttctttctacctggattaatgtgacaagccactcagagaaactgaaaattcccatgggcttctccagttgttcttgggaaaaaggagactagaacagtgatttcagatctggaatacactggactccaacctcagattttctctttgctgcctgtattacctaaagcaattgacataacctctctgatattcaattttcccacctttaaaatggggaagatggcatatacctggctgtgttgctgttaagggtaagttttaagctgtgtgtgtgtgtgtgtgtgtgtgtgtgtgtgtgtgtgtgtgttgcaaaaataaatacagtgactgttatagagtagaagttcaaaaatggtggctgcattccgattacagcttgcattaaagttgaatattaagaacaggagagatcgatgatggtgtgttttgtaaccttcacacggttttctatatcataggatgagtcctagctttcagagatttccttgcgcctatgtctaccctttcttttggtcctagaaaaggtcacagatttaaagtaagtcaatgtggaacattaacatggctcatgcaggttctgtgcagctgtctctatgggttcttgaaataaaatagggccaaaccaggcacttcaaatggtagatttgaacaataaatgataaccactgtctctaatatccaaatcattccctactcatccttctttaggctcatagttcattgcactgtcttcttaaataactacccgaacacaactccacttttctcacttctaatgcgtacatttttagcaataggttttggttagggtcttctctgtccacatactacaact

SEQ ID NO: 4116 - DNA, 1204 bp, Homo sapiens
tgcagcttctgatgttaaacatatattattaaactccaccttttcttctctttcttttactttggcgcattatctaaaatttctcacagtagctaaaatgtttgaagctatggctttctacttaaatcattttctctccttacattgtatatctgatcttccaacctgtttttaaaatatagctaattgagctggttttaaagacagagatctttctgatgtcaaagagctagttctacatgaaatcagttacacacagaatttcattttcaatcatgaaaattacttttttatagattcttatatttaaaaactgtacttattgctttacttttgcttcactgtttatagaaaaacagcaactccctgctgaattatatgcagttgtttcttatttgtttatgactttacattcttctatatccagaattacaatataactccataaaaaagaatatttatgtgtgatgtgaaagcatcagaagttcatgggcacaaaatgccttgaataatttaggcagatggataaaatgtttctaagaaaagtaatcgcaatgttttaccacttcaatcgtaacactatcaagactgatgattctagaactagctctttaaaatacgtttctttacttatttttccttgcctgccaattgtgtaaaatgcctcttgacttgtttgttttaaaccattatgttaagtatcgattggccacattcaccgtctcttgggtatattctagactataaaaaattttaagagctatagattaaaagatatttctacagcgttagtgtacagagttagtctaactttccatattttcttaagaagaactctgggtttagtctctattttaaggagatatttgttagcttgccattattgaattacaatttgtataattttatggatttagtagatttggtgatatgacttattttgagcttgaatgatcaatagcattgtatattattatactggctgcataacaagtaacatgttgaaaagaacagttgattggccttcattgacaatgtttaatattaattactttacccaattaagtggaaagtaatctgatagctattatttaaccagaaaaagccatattctaaacaccagactacctatagaataaaacattaatatgatttaaatcctaaaattatggcagtaatgtaattggtatcaaattattcaaac

SEQ ID NO: 4117 - DNA, 1187 bp, Homo sapiens
catcacttctaatgaaacttctttgcatctgtgagtatatcccaatgctaatgctaatctcctctgcagcaggggttctttggaggtaagaataatgcattatttatatttgggtcctcagaaccttgcattgtgacttaagtcatcagtaaataattggtgaatgaaatagtaatgcactcggtgtgtttacactcaatataaacacgtctctgaaaatattaggagaccttctaaagcaacatgagtgttgacaccagtgacaactcactaaatcccagtgcacatcattcaggaaaatggggaatccccagtgtctctatttttttgctaaattgttatcctcaataaatctatggggattttctgctgagcatcactttgaattcttttgcccttaggaaataacaatacttccatacttgtgtgtgtgtgtgtgtgtgtatgtgtgtgtgtgtatgtgtgtgtgcttctgtggtgttgtttttccagagcaattggagccaaccctctttactgtgattgtaacatgcagtggttatccgactgggtgaagtcggaatataaggagcctggaattgctcgttgtgctggtcctggagaaatggcagataaacttttactcacaactccctccaaaaaatttacctgtcaaggtatggtttttaatcatttgtatttcttttaagaattactatattaagtaaaaaagaaaaagacaaccaattgtcaatccaaaggtatggttgaaatgcccagtaaatgattattttttcagcccatgcttggacaagacagagcagttacctgaggtgcccaagtaaagaattaggcttttcaaataaatctcagaaatagtccattggtaatgaccaagttttcttgaaagtgtatcaaaaaacgtagagttcacaatttctggaaattcctttcatagcctctaacaagtcaaatgttttgcttttgccctgtctgaacatgtgccctgctcctagggctgccagggccctgtggcttcctcataccaggtaaggagaaacaggccctccccagtgttcagcccaaaccttctgactcgccttatgtgctgcagccttcctgtgttgatgttcttgtttcttgcttgtttgtatccctttcttttccctttgtttgatgtatttgtgaatctaaatattgtcagaata

SEQ ID NO: 4118 - DNA, 1183 bp, Homo sapiens
gaatgatttcatttatgtcaagctcaaaaacagtcacagctagcctatggtcttgtcatgatagtgatcctctttgcagggaccggggggaaggcttctggggtgctggtacatggtgtgtttctagatgtgggtgctggtgacctgagtgggttcagtttgtgaataatcattaccaatttattcatcctttgggtctatgctatatatcaagaaaaaaaatccaaaataaacaacgccattgaaaagcattcagatttccttttcctaattcccatagtatattctgagggtgctcatattagtcacagatcacaatagtcctgttgtccaaaatcacaacactacttagcagcagactcagaattggataatggaccacctggttccatgccttgtggcttttgttttgggttttttgctttgttttgttttaaatcacaagctgccctaacctctaagacccatgacaatgacacagtctgctggcaggaagcctgttgacctttttctatgagctaacactgtttgccctgttgcaggtgagttgtgtgaggagaagctggacttctgtgcccaggacctgaacccctgccagcacgattcaaagtgcatcctaactccaaagggattcaagtaagtcaaaagctacctttttgctcacagtcagggtaggggacccattattttaggagcccttctcctccttcatccttagcttcacacctctgctcaggattaaagggacctattcactagtatcagtgacattttttaaatgtcgatatacaatatggacttttttttttttttttttttttttgagatggagtctggccctgttgcccagctggagtgcagtggcacgatctcggctcactacaacctcctcctcccaggttcacgccattctcctgcctcagcctcccaagtagctgggactacaggcgcccgccaccacgcctggctaattttttgtatttttagtagagacggggtttcaccgtgttagccaggatggtctcgatctcctgacatcatgatccgcccacctcggcctcccaaagtgctgggattacaggcgtgagccaccgcgcccagccccagactttttgtttagtacactaaagaaaaatgaaaaagtgtttccttttcatccatgattttttttgtgaagtcacct

SEQ ID NO: 4119 - DNA, 1101 bp, Homo sapiens
agtattcagtttccatgagaaatatttattgtatcaaagtacattgtacttaacattttaggccatccttttactgttccttgatgctttaatatatattaatttataattatcctgatatttttgtacatttttcaaacttaaaaatcaggatttttttttttttttttttggcaatagtactaacatagggttttatcttgggatacatatgtattggtctgtttgttgaccttgacatctgatcactgatgtcaatgacctactggcctcattcaggacacctgcagagagtatgcaaagtccgagagaggaaaacagaaatctgtatgtgagatggtcattgtacagaaagaagtggcccctctgcaacatgtcctcacagaaacgaaatggtgtgtagcaatcaacactagaaagtagaccttttgcaaattaatatgtccttgaccttttttgcccttttgtgggggtgaggtggggataaaaagactgtcatatcaagaactgtgacttttctttccctcaaacaataaaactcctttattatcttaatgctcccatgttaacatgtttgctgctaaattacaatgtagaattgataatggtttatagtgaactgtgctcttccctcattaaaatcccagggtgccctgtaaagatgcagatgtttcttcctgaaaacttctttttttacaaagaaaattagatgtacatgtataattcagtgtgctttgtctttctccagattaatatcggttacactgctgatgtttgtaaattaaacagatatttacttcattaacagcttggtggtgttcttagaaattgcacaataggccactccttaagaattttttaatcaaaatgatacagaaagaataaggaagaaaacctatacctttttgttgccaaaaaattggtttgagattcacacatcgttatttctggggactgatattggaatggccacataagagagatggatataaaaacatactatttgcctgaaaaaagatattcaattatttttttcaaaaaaattgtaagatgaagtctatctaagatgaaatgtttttgtttttgttcttctttgtttct

SEQ ID NO: 4120 - DNA, 1176 bp, Homo sapiens
ctcacggtcaggaactggagaccagcccggccaacacggcgaaaccccgtctccaccaaaaaatacgaaaaccagtcaggcgtggcagcgcgcgcctgcaatcccaggcacttggcaggctgaggcgggagaatcaggcagggaggttgcagtgagccgagatggcggcagtacagtccaacctcggctccgcatcagagggagaccgtgcaaagaagagggagaggggagaggggagagggagagggagaatgttttaagagccataaaaaagaacgagatcatgtcctttgcaaggacatgaatggagcaggaggccattagcctcagtgaactaacacaggaacagaaaaccaaacaaccacgtgttctcactaataagtgggagctaaatgatgagaacacacagacacatagaggggaacaacatataccagggcctttcagaaggtggagggtaggaggagggagagtcaggaacagtaactaatgggtactaggtttaatacctagtgattacctgggtgattgcttaatacctgagtgattgcttctctgtcttttggctaagatcaagtgtagtatctgttcttaccagtttaatacctaggtgatgaaataatctgtacaacaaacccccaagatagaagtttacctatgtaacctgcacttgtacccttgaacttaaaagttacaaagaaaaagtattactagcttctctgttaggtatagagagggactgggtgagagagggagaccagttaggaggctcttagaataatcgaggtgagagccgatggtaacctgaatcatgtggaaggaatggagatggcaagaggtggttggattctgggtatttatttaaggtagagccaatacaacctgctgattggatgtagagggtaagcgtgtgagatcatggatgattataaggtttttggcctaagcaactggaagatttggaggtgccagcaactgcaatatgggaaacgtagggatgaagcctttgggaggcgtaaaggtgaagaatgaagttttgggtagtgaagtttgagatgtctattacgcatccaagtggagatgttgaatacagttgtcgagtttagggcagaagtccaggcttgaattagaaatttgggagtcaccagtgttggtaacggagagaagaggactgtg

SEQ ID NO: 4121 - DNA, 1192 bp, Homo sapiens
tgtttttttaactattgtatccctagcacttacagcagaacctcgcacatagtaggcatacaataaatttgttgaatgaatggataaggcaagtatttagttaaaaccagactgtttaaaccagtatttgttgagtttttatgttaaattgaatatgtatgtagacctcttcacttaccgttctttgattccattgctcctggacataggcaggatattctagaatattttaaacttaccatctggcaaaagttatttaatgctaattgtgtgtgtgtgtgtgtgcgcgtgtgtgtgtgcgcgtgtgtgtgtaaacatacattcatataatacatatttataacaggtacttatcttcacagtctctgttgctcataaatggatgaaataaaaattataatgaataaatggtttaaaaaatgtcagtgaagtgaagctttttatctttttaaattggtaaaaatctctcttcttcccacagatcttaaaccttactcaggcattgagagacgggaagagtcctttccagctagtacagataccttgtgtgattgtggaacgcagtcaaggtggaagtcagggtcggattgtccacctgagcaattcctttacccagactgtcaattgcaggaagccatttttttcctcctggtagtaaatgtcagagtaagagaaacaaactgtttagaattatcatgtttttaaaacatcatagtaatataaatctgctgttaggagctccagttgctaaaacctcaatttaagtctttaaaaggttgtattttgaatgtaaccaaaagtttacagttttttgtccaaatattaaatttctatttcagggaagaagtgctatatctcctatattgtatttttgtagaaaatttgtattttatgttgttgttagtttaaaaggtaattttacacatgctggaatgactgtaattactctagaattccaagtagaatacaataacttttaatattgagaagaatgttcatgctaattcttcttacattacaaaaggcctttgaggatgcctacgtctgaaattgctcttacgaactttaataaaatagttagctaatagaaaaacaggtaagaataaagcaatgttgccttaatttcaaaagctgctattttagaatttgaataagtactcctaaagtgaccattattagggaccagaaaatt

SEQ ID NO: 4122 - DNA, 1186 bp, Homo sapiens
gatcatagggcatgtggggaagtttactgggccatcacagacttttgttctagtgattgtatgtattaggagtcatagcatgccctacggcagatctggattcttatacactaagatgtgtcttaagaatcacagtgcgtgcttcatccctttattgaagaacagaaaattatgactactctacaaggtggataatattttggtacctgtgcttgccacagccctgttcctcaaagctgaattgatagatttctctttgacttccaagacctagcagttataaggcaccttgaaataaattgtttgtgcctggaaatgcagggagggcaatagctttgtaaattggtttacatttttctccttgaatttttctagggtcctagtgcttccgaatcatttaatggcattgtcggatatcttttacatttcaattgcaatccatgaaattacatttagaagattcttagtacttaactgtagtcttctccatgaattacacgttagaatagactggcagcaacggaatatgcagcaagtaagcctctagcttatagtttcatccctacccctcatgcctgcgtgagtctgtacagggatatgtgtgtgtgtgtgtgtgtgtgtgtgttagagaggaagaggaagagcagaatgtctgtatactacatgctgctaaggtagtgaataaatcagtaatgcaatattgtgggtccaaactactctttgcactactttatttacagtagtaaataaaattatttttatacaattgactaccagaaagtggttttttttccccttttttataattactgtcaccatataaagtctaaaggtccatatattctccttgaggagggaaaaaagaaaagtcctcctggtgagagggcttatttttcataacccattaatatttgtggataggaaggtggcaggaggcttctctccaggaatcctgagctcaggtctggccttagaatgttcgcacagtatcagacattgtttcagggctttgtgctgctctgagcctgggctctatgttcattccaggctaagcttgtagttcatcctcctccttctcctatgagtgttgctcttgttttagcaaatgttgtccctcctatttgcaaaaaagccagagattgaaggctgacagtcctggattcaaattctggtcctgtaactgaca

SEQ ID NO: 4123 - DNA, 1205 bp, Homo sapiens
ctgctcataatcaggagatccatgtatttttggctcttttgcttagttttattaatattttggatgtttctactatggacaatgctctaacacaattttccaggttaattaccacattaagttaaatgcagtatccataatagtaatgtcactcattaatgattgtgtcattttgaataggccttaattagtaattacagatttttgtggtggtttatcgtgttttgtaatatgttagagtacactggatttgctgaactctggtaatttagaactctgagccatacaaagagaagttctgtactctaaaaagtatttaatctaactgtatgcataactccaatattttgcctgaacagatttagtcattgtggaagtcccgatttctgtcctgtgggcatgattatttgcattacaaaaggcttcaccaaaatttttcattggggaataggtgcatttcaatatgattttgtattcataatgttcaaggaaaggaaatgctttattgaatctaattgatttttgcttcttgtttttttttttcccctattattcttcaggtttttttgcccacctccttgtgtatatcttatgggcagtggatggaagaaaaaaaaagaacaaatggaacgcgatggttgttctgaacaagagtctcaaccgtgtgcatttattgggataggaaatagtgaccaagaaatgcagcagctaaacttggaaggaaaggtaaatcaagactgctagttcaccagaaaggggcaccatggtaccagaatgtagttttcatattcatttttgtggtggagatttttttctttaataactattggtaacaatttcttgaatatataaactaggaccaaaaaacatgcctctcatagctttggtctagtcactcatgaagcttacgctgctgacattggaaggtggcatgcagtaagcttccccagcttgcaagcagttttagcagactataaatcagatttctattggaagccagtaataaatttaggaggctgattgctcatcttctgtttgacagaggtttatcaacaaaaatacattgttcagtaatgttttactctgctattttaatcttagttttatactagacacgatgatatatacattgtggaaagcatttatctgggttataacgatcataaacgtttacttgacatcagagtgaagcagagtgatactgt

SEQ ID NO: 4124 - DNA, 1161 bp, Homo sapiens
caaagctatagttcatcaagttaatgacaaagggagaggcagtgactaaaattcatcttttaaaatagcgttaactctgatttagaaagaaaaatagtattgaaacaaaacataaaagtagctgagatgatagctgaatcacccgtaaaatttaacattttaatttatttgacaaaaaggaggtgtaccttatattgtctgtagtttgtaagatttctttattatggtttatgttaaaaatccagcattgagttttgagaagccatattatttaaagaagtaatgttctaattttgctgaaatgtatatagaatcatatcatttccctcttttaaatttcaaaaagcaatgaaagttgttttagttagaatgtctgctagtactcttaagaacatactgatttaaaatttgtacctttgtttgtgtttcattcagggaagtgccagacacagcttcagaatgtgactccttaaattcttccattggaaggaaacagtctcctcctttaagcctcgagatataccaaacattatctccgcgaaagatatcaagagatgaggtgtccctagaggattcctcccgaggggattcgcctgtaactgtggatgtgtcttggggttctcccgactgtgtaggtctgacagaaactaagagtatgatcttcagtcctgcaagcaaagtgtacaatggcattttggagaaatcctgtagcatgaaccagctttccagtggcatcccggtgcctaaacctcgccacacatcatgttcctcagctggcaacgacagtaaaccagttcaggaagccccaagtgttgccagaataagcagcatcccacatgacctttgtcataatggagagaaaagcaaaaagccatcaaaaatcaaaagcctttttaagaagaaatctaagtgaactggctgacttgatggaatcatgttcaagtggcatctgtaaactattatcccccaccctccactccccaccttttttttggtttaattttaggaatgtaactccattggggctttccaggccggatgccatagtggaacatccagaagggcaactgtctactgtctgcttatttaagtgactatatataatcaattcatcaagccagttattactgaaaaatcattgaaatgagacagtttacagtc

SEQ ID NO: 4125 - DNA, 1195 bp, Homo sapiens
catgaagaacttctactaggacactgcaacgagaaaatgtggggtaggagcccccacagagtccccactggggcactgcctagtggagctatgagaagagggccatcgtcctccagaccctggaatgatagagtcactggaagcttgcaccttgcacttgtaaaagctgcaagcactcaacactagcccatgagagcagctgtgggggctgaaaccttaaaaccacagcagcagagctactctaggccttggaaggctaactgttgtgtcagtgtgccctggatgtgaaacatggagccaaaaaagattattttggagctttaagatttaatgactgccttgctgggttttagaattgcatggggcctatggctctatttttggctgatttttcccttttggaatgagagtatttacccaatgcttgtaccttcattgtatctttggagttacctaattgtttttctttttttttttaatagtagaagggacttgtcttgttctaggtgagactttagactttggactgcagagtaacactggaaagaatgaagattttgggggactgttgggaaagcatgcaatgtgagaaggacatgagatttgagaggggctggccagaatgatatggtttggatgagtctctgttttcttctagtatctttatagatataaaactataaagatacttaaaaaaataggaaaaactggaaaaactcttctggactttggtctaggcaaataattcattactaagactcaaaagcacaggcaccaaaaccaaaagtagacaaacaggatttaattaaattaaaaaacttctgcacagaaaaacaaataattaattgagtgaacagatagtttgcagaatgggagaaaatattttcaaaatatgcatcaagcaagggtctattatatagaataaatagggaactcaaaccagtcaacacacacacacacacacacacacacacacacacacacacaaacccacaaataatcacattaagaagtaggcaaaggatatgaataaacatttttcaaaagaagatttacaaatcaccaataggtatataaaaaatactgaacatcactaatcatcagataaacacaaattaaaaccacaatgagatatactcttacaccagtcagaatggctgtttttaacatgtcaacagataacagatattggtga

SEQ ID NO: 4126 - DNA, 1197 bp, Homo sapiens
caacgggcagatcgaatacgtgttcggggcggccaccgagtcggtgaggcggctgctgcgccttgacgagacgtccggctggctcagcgtcctgcaccggatcgaccgcgaggaggtgaaccagctgcgcttcacggtcatggcccgcgaccgcgggcagccccccaagaccgacaaggccaccgtggtccttaacatcaaagacgagaacgacaacgtgccgtccattgaaatccgcaagattgggcgcatccccctcaaggacggggtggccaacgtggccgaggacgttctggtcgacacccccatcgctctggtgcaggtgtccgaccgagaccaaggcgagaacggggtggtcacctgcaccgtggtgggcgacgtgcccttccagctcaagccagccagcgacaccgagggcgaccagaacaagaaaaagtacttcttgcacacctcgacccctctggactatgaggccacccgggagttcaacgtggtcatcgtggcggtggactcaggcagccccagcctctcgagcaacaactccctgattgtcaaggtgggagacaccaacgacaacccgcccatgttcggccagtcggtggtggaggtttacttccctgagaacaacatcccgggcgagagggtggccacggtgctggcgacagacgcagacagcggtaagaacgccgagatcgcctactcgctggactcctctgtgatggggatctttgccatcgatcccgattctggggacatcctggtcaataccgtgctggaccgcgagcagactgacaggtatgagtttaaagttaacgccaaagacaaaggcatccccgtgctgcagggcagcactacggtgattgtgcaggtggctgataaaaatgacaatgaccctaagtttatgcaggacgtcttcaccttttatgtgaaagaaaacttgcagcccaacagccctgtggggatggtcaccgtgatggatgctgacaaggggcggaatgcagagatgagcctgtacatagaggagaacaataacattttttctattgaaaatgacacggggaccatttactccacaatgtcttttgaccgggaacatcagaccacatacactttcagagtcaaggctgtggatgggggagatcctcccagatctgccacagctacagtctcgctttttgtgatggatgaaaatgacaa

SEQ ID NO: 4127 - DNA, 1101 bp, Homo sapiens
ctccattatgcaccatactgtgatgacctttctactccgaaacctgctggagcctgcccttggccgtggggtgtcagccaatcactgcttgttccacttgttgtacattttatttttgagtctttttctttctcatatacagaaaaatagtatgaaaataaaataaatgtatgaaacagtattaatgcagaaatgtgctactaatggatgtctgagtcaccagaaattccattcttaaagaggcggttagcacctattagacgtaacagtgatgtcttttaaaaaatccaaaagcatattgcaacaataagtttgagactttgtgtgaacaaagggaaattcagcctcttatgtctttgtctttaatacattaaatactgattttgaataaaaatctaaattgatcaatatttttaagtgccatgtaatcacaggcctgtcagatagttttgttagagtgaaggataatatcttttgctcattctgtgtgtgtatttttaaatgctgttttgtgtgtttgtgtgtgtttccatatatgtgtgtgtgtgtgtgtgtatatatatatatatgctggaactttgagcaatatttataaaaatattgtctgtaaaacaagtttgagaaattaattttttatatttataatgggcactgtaatggattgatttttttcttaatcttgaaatagtgaccaagatatttatatcatttttgaatttattttttaattctttaagaaaatttagaacttttcactttcatttgctaaagtcactgtagtcacattcggaaggaatatgtggctttctgttctttatggactacgtttatcagaagtccatatttattaaacatcctatttgatgtcagataacgtaaactcaagcagcttcaaagagttcagcatgttacatattattgagagagcaagtgactgaattttagttgtataagcaatattataggtaggtcagggagtcctctggatggcccctctacctctttatgtttgtatgtttatgtctttatttgttatgtcgtatgtgtttatgagcctagaaaatagcctagaaaataagtgttccatatgtaaagtttaat

SEQ ID NO: 4128 - DNA, 1176 bp, Homo sapiens
gtaaacatcatgctatatgattgcaagattcgtgtgaaaaagtaggaaaccacttcttcctatttagaccaagtggcttgtttgggtttggtttttgttttcaggctagaaaattcagtctaactgcttcatctccattcattttctgctctcatacttatgggagatagaggagtacaaagaagaaaaaggggaaaaagaaagcagaaaaactgcgtggcaccatacccgactcctctctactgctgttagacaagtatagtaaaaatagttgccacttttgacacattattgccacacagtggtttcttaccctaacttaactggaggaagctgagacttaaagaggataacaaaggcctgtttttcactgttggaagaaacttgaaaaaatacaaataacaaaaatctgtggaatatttagagcagaccaaatgtaaagagctctcctaccccatactggttggatggactaaatatttcaataatttgagagataatatatttcatttatttacctgtaatcttttagcaaaacaataaagattaaatggaattaaaactgtttttaatttaaaaaatcggggtgatctcataatgtggtgtgcgactgtgttaaccaagtgtaataggcctgtgatttttatctggcacaaatgtcattttagtttttttaatttattttatttatttattttcatttattttttttttttttttttgagacggggtctcgctctgccgccggggctggagtgtagttccgcgatctcggctcactgcaagctccgcctcccggattcgcgccattctcctgcctcagcctcccgagtagctgggactacaggggcccgccattgctcccggctaatttttttgagtttttagtagagacggggtatcaccgtgtcagccaggatggtctcgatatcttgacctcgtgatccgcccgcctcggcctcccaaagtgctgggattacaggcgtgagccaccgcgcccggccacaaatgtcattttaaatgcaggttttgcatgccgcattctcagaaaatcagttctaggaagtctgttctatcgcctagaaacctgagtttttaacactaacccctattctccattctgattgcaaaatgtaagctacgctagtgaaattgggagttacagcttttgaaatt

SEQ ID NO: 4129 - DNA, 1147 bp, Homo sapiens
tggcaaagacatgtttttggctctggttgtcattcagtaaatatttattaaaccccttgactgtttttagctctgttcttattcttgtgaagcttaccttctaattttgaatgaagaagacataaacatttattacatatgcagtgcattttaagaattgtgatagagcctttttttaagaattcctcccaaaaaaataattaccagtactttctgatttcattgcacatataaatatggaatgatattggaagagaaaaacattacatttgtaacttcaaataaagcatgaattagatttgaatattatgaaatttaccaacaaaaccttgattttatagataagtgttactgatcatagaaactaccagacataacagcactgtatacttttaaaatatatttttataagttacattgaaaccctatacacacgcttctccaattgtagtcaggttgggcggtatgtgataactaaatttttatgaagcaggtagcttcttcttatctattcaaaactgtcaagatttgctgcaaacactaggtgtgtgtgtgtgtgtgtgtgtgtgtgttttttctggagggaggaggaagtagtagaagaggttactattagcctccaccatgactcattagaaaatgtcctgaaaaaagtttagctctgtatcagacaatatacagataattcccaagtcatttgtcaagtgaaaaagaaaagaggttgttataatcaagcagctccagggacatgagcagaagtgtatcactttattattttcccttctaccgaaagcatgatatattaatttattttagattgtttagggtccaaggttttctatgcttacaaaagttatgaattaaaggtcctaaattgtaagtccttaatgtgaattaaattcacacccaatacaggaaatattagttggaaacaataaatcttgtcaggctcaaggtacttttattgctgtaaaaaaaatgaaggtcacacaataatactattcagggaaataggtaagacattcaaagagattcatcattttctatatgacacacagatacccttctaaaggatttcaatattttatcttcaattcagtttggtatttaaatattttaagtcaatcctttagaaacttatatgtac

SEQ ID NO: 4130 - DNA, 1197 bp, Homo sapiens
taggaggtggggcgtttgggtaattagttcatgagggcagagcctttatgaatgaaagtcgtgttcatataaaagagatctcagagagttcccttgccctcctgccctgtgaggacacagcaagaagacagccatctgtgagcgggaagttggccctcatcagccacagaatctgcaggtgctttgatctcagattgtgaatttctgtcagggaggctctgaatacacagggctggtctggccataaattgaaaaaaattacatgctggtcataactccaatgtcaagcaaaatctagaatatatatacatatattctgtaatgtaactattaagaagggtgagaattttatttaaaaatggttcctttcggtggaactcttgtgataatattttttcagtaatgagagcctttcaatggaaattttcaacctaaatgaaaaagatattttcatagctaccagtgcctagtaagctgtgtcatgagcatcagtacattttacaaatggttttaattgagcaagctggttaaggaagccagttaaaggagcttataaacatatgtctactattctttttaaggaagagtaagaacttgttataatgtagataagggaagatgccagaaatctggacatcatgagctactacagaaagcagccttggacccatctcttttctagtcatctgtgtaaaatgctagcaggttggattaacagcttgctacattctgagagcatcatgaagagaaaggaagcggtcaaactgtagtatctatatataatgcattataatcagagatatgctctgccacctttgactcccagaaagcaattcaactataacttgacattgttatcacatttatgaaaaggatgtatcaagcagaagtgttgatcacaaatggagcaaaaaaagaaatacagataaactaatttggcagagcccatctaagcttggctcaggggggataaatgctgtacacagaatgcctggtatggtatagacttaaatatacctaaataaatgagagctatgatacaaaggcaactctacagagttatttttagaggcgaagtgcatgcttatgattttatgggaattttattcacagtttctgatgcctatctataaatattataaattttagaattttagggcattattagaatattatatttattttctgtttttgcat

SEQ ID NO: 4131 - DNA, 2263 bp, Homo sapiens
ccaggctggagttcggtggtacaatcatagctactgcaaccttgaactcctgggctcaagtgatcctcccaccactgcctcccaagtagctgggactacaggcacgcaccatcatgcctgactaattttttcattttttttcagagacgaggtctctctatgttgctcaggctggtctcaaactcctggccacaagcaatcctcccactttggcctctcaaaatgctgggattataggcatgagctgttgtgcctgaccgtgaatcatattattattgcttaagataaactgtcatcgcatggtcatgagaactgagtacctgctgtctgaggtctgttcacaaagtccatttgtacaattggaagacgcttttttttttctttcaatttaaactgcttctgtcatcacagggagagagatcaccttcgctgatatttcctttaaccagttgctctttttgttttcctccccacattagccccgtgacccccagcacaccagggagcccgccagtgagtcctgggcctttgtcaccaggggggacgccagggaagcacgtctgtggccatcatctgcatacggtgggcggtgttgtcgagagggatgtgtgtcatcggtgtaggcacaagcggtggcactttataaagcccactaacaagtccagagagagcagaccacggcgccaaggcgaggtcacggtcctttctgttggcaggtaagatcccttcagatgcttttggtttgtgtgtgacatgggtgctctggtgtgtggacttctgcttacctgtcagatgtagaatatgttctctgtgcctgtctcaggttatatctctgggctttttagatgttttctggtgtgagtcctagatttttccaacaacagaagaatcctaaaaggtggctgttgctagatcagatggtaaatgtattaagataaatacctacctgctctaacagataaagcccagattttcaactgtatacagaatagacatttatatttcacttatggaatccagggcaggtattgagatatcaatgggtggctcttcaagtacttgtccagggttccaggcccccttcgtttgtggctctgccaggtttgccagccaaaggagcaggtctgtggaaggttgttcacgaggggttttgaaagagctaggcctgagagtggctcgtatcattttgactcacactccactggctggaacttgatcacccagccaagctaactttcagggaactgagaaatagcatcaagccatgtgcaagggaagggagaagacgtggatctggtccacagccctccagtgtctgtctgttaagttccatgtgaattgctttgactgctttcttttagtgggtggtgctttccactgtgtcttggctttcttggtcctagtacctttcacttgtgacccatatgtgaggtggagatcttgcagttcaagtgatgaatccattggcccttacctgaagcatctttgcagtgggatgcttttgcagttctgctgttagatgctgagtcccatgcaggaactgcattgccgatgttgcatttggaaagacagtggggagtactggtaaggaacacacatgctggagtgagaccgggtgagcactgagcgaaagtcaacagtgctgcttacatgatccttctctctcagtatactgacaacccccctgggaagagtaacctgaactcgtcacttctacctccttcaagtcctggcaccactacttacaaactgttacgttgctccatgcctcagtttccccctctgtaaagtgagaaggacagtcacactcacctcatagagttgctgtgtgtagactaggtgaggtgactcacataaaggtcttaaaccagctttgggtacttacgcactcaagaaatgttggctggtattatttttattttaattcagttgagtttcatcatgtgttgcacaagcatcatggagaagacttgcagggctgtttgccacttacagcaaaacagcacaattcatgaccacactgttttattaagaagcagagtcatgggaatttatgaatgcaaagcagtgagaacctgtagcttgtttggacaaagcatgttttgttggccttaaaaaaaaatctgctgaaattttcaactcagattcaacatgccttttttttttttttttttttttttttttttttttttttgaggtggagtctcactctgtcacccaagctggagtgcagtggtgtgaactcggctcactgcagcctctg

SEQ ID NO: 4132 - DNA, 1199 bp, Homo sapiens
aggacatgaaacatctcctaagagagagcccaggtaaagaagatctaaactaaggtaggagtccagatatttgcagaaacaataaacttgacgggtgtaataaacattgatagtagctgcaaaataaagccaaacttcatatttgagtattggaaaaaagaactgcttatcctgggttggtcttttcagatacattcgtctctatatggataacaaaagtaaccatatgtgatatcgtttggacatttgttcccttcaaatttcatgttgaaatctgatccccagtgtttggaggtggggcctggtgggaggtgtttgggtcatggggcccaaacatgaatcttggcttggtgcctttctcttggtaatgaatgacttctccctctattagttccctccagatctgattgttaaaaaacagtctggcaactcccttctctctctcctgctcctcctcttgccatgtgatctgcgcactccagctcctcttcaccttcttccatgagtggaagcttcctaaagccctcatgagagcagatacaggtgccatgcttctgatacagcctacagaaccatgagccaaataaacctctctctttctctctctgtctctgtctctctgtctctctctctctctctctctctatatatatatatatacattacccagcctcagatattgagtagcaatgcaaaatggactgagacaatatgtcatcaatataccatcttttttcaaaaaaaaaaaacacaaaaaaaacagtctcactgtcacccaggctggagtgcagtggcacaatcatagctcattgcagcctcaaacttctcggctcaagtgatcctcttgcctctgcctcctgaggagctgagaggatacaggtgcatgcacatcagctaatttttttttttttttgagacaggggtctcactatgttgcccaacttggtctccaactcctgggctctagcggtccccccatctcagcctcctaaagtgctgggattacaggcatgagccaccatgcctggcctatcaccatcattgaatacaaaaaatgactgtatccaggagataaatcatggacaaggcacaaaactgataatgagattttctcatcaaaatattgacactattacaagtgtatacatgggtaataaatgaataaattatcttgcccatcagagcccctcaactgaatt

SEQ ID NO: 4133 - DNA, 1100 bp, Homo sapiens
ttaactattaaaaaaaaagccatggtatatttatacaccatattttgtctattctaagacatattttaacacctctgaatttccatgcatattacaaccaatggtgacttgtcaaagagatggcagtgatgaaacagttgtcactgccttcatgtgcagtttgttttccttttcatgtatatacagagtgatatatgatacttacatgtgtcatttcaaacatagcatacttttttaatgacacacacattgacagtgtgttttataactgatggcaccttaaattcaatgagataacaacataagaagagcctctttgttctaagcataatggcacatgtcttatttatcatttcatatattctttttgcagactttatgcagttggtggtcgtgatggaagttcttgtctcaaatcagtagaatgttttgatcctcatactaataagtggacactgtgtgcacagatgtcaaaaaggagaggtggcgtaggagtgacgacctggaatggactgctgtatgctataggggggcacgatgctcccgcatccaacttgacttccagactctcagactgtgtggaaaggtaatttcctgggaagaaaaactaggaacaaaaaagatatatataagtctctgatacttacatatatttggagaacgtgttggagaattggaagggaaagtcggcattcaaaaatgcaaagcaacttcactttataacagcctgctctcacaggaagtgatacttccagaaaaataagtttgtattgagcatgcactacatgcaaggcaattttattttatatgggatattggacctaataagaagaggagcttgatgaattttaggcagaatgacttaagggctgtagactaaataaaaagcaaaaaggatagggacatttctatgtgttttgatatgaaataaaaaactaataataaggcttacaaacgtaagtcatcccaactggcctcacaaaactcaagtgtggtgccaggtagagagccaaatagcagtggaagatttggatggtaggtcaggttcccatttattatgtttagtctagtacaaggaatagagagaattgaatggattt

SEQ ID NO: 4134 - DNA, 1146 bp, Homo sapiens
tctgtcctgaagaaagaatttgatgcctgcagagagattagtgtataaagtcattaatccccctaatgcttttatcagcagtcctgtcagatgcaaaaaatatctaagaggcatgaaaggaaactcatggaagtgttgcctcaaggggtgcaggtcctagtgttacaaggcagaacatggtgtcatcaaaggaaaagcacttgatgggcagttagcctgaccccacagctacgtactttcctcattaaacagatcatatctggttctttgcagaaaaagcaaagttcagagaccatgaccctgttttcctacagaaccagggtggaatcccgcctgtatcactgaggacagcagacactgtgctgttgctgctctccccttttctcttgcagacattgtacccatcctgacgtcaactgtgattgagtgtcacagggcaggcctgaagaactctgctttcagcttcgcagctatgttgatgaggcctgaataccgcagcaaaatagatgccaaatacaaaaagaagatcgagggaatggtcaggtaggcagagatggctatttctgctatctaatcgtatttctcaaagtatttccaaaaatgtagctgccagtgtgcaagctcaataagaaaacggtggggggccaggtgcagtggctcacacctataatcccaacactttggaaggctgaggtggacaaatcacttgaggtcagtagttcaagaccagcctggccaatatgatgaaaccctatctctactaaaaatacaaaaattggctgggcgtggtggtgcacacctgtagtcccagctactcaggaggctggggcaggagaattgcttgaacccgggaggcagaggttgcagtgagccgagatcgtgccattgcactccagcctgggcaacagagtgagaccccatctcaaaaaaaaaaaaaaaaagatgggcatatcaattaggattgtatttagctctaagcatcagaaaacctaacagcagcttaatcaagtcagtatttatttgactcatacacaaggcatcacagtccagagctggtgtcaccgtgccttgatgccaccagaccagatccccgtcttccagctttgacatccatagcatagaggtttcctcttcatggtggcaaga

SEQ ID NO: 4135 - DNA, 1184 bp, Homo sapiens
cttatacagtgaatactggttgaagctgttgttcactggcgtttagacaaatataactgtttaatttcaggaaaattttttctctacaaattgctgagcactttgcatttgttcttcccagtgagatggctgttatcatcagcatccttacttcattacaaaggctcaagagcttacccacacaattttagtcagttggcaaggctaatactgaaacttgatgcggattacagtctagagatttctaacttgaatgtttcctgttccacattctagaaacaggcaaaaaaaaattctttttagtatgtttggctttattactaaatgccagccattacttgaaacccttctagaggcatgtgttctgtttgtcctttctagatacaatgctcctgagaagacagcattttccacaggaggctgtttcctcccctggtggatttaagagacggtcctttctggatacagagaaatgaaacaacggtgacctctccaggtcggcactttccacttctgtacggtggcaaaacgatgacatgtaaccttgctgtttattgtactttgtatattatttcctcttcaaagtctttcttacacactctatcctctgcactgttaatagtaacctatgacataattgtaaatattcagctttttgctaacttttgtattttgaaaaactttaaaataaaattgttgactagatatctgtgacgtttttctggatttggagacagaaaaagagataaaggtagttctgaaggacattgtcaagtttgaacacagatgtgaatggtgtaaaaagcttgaaatgaaaagctgttgtttatacaaatcacagctattaagcagaatcaatcagcccagaagcaaaacatcaaaaattaggaaaaccaatcttgtaaagaatgaatgaaactatcagcttatatctatctgccgagtcattctactgcatactacagaattcccgtcacaaaattaagtcatttgacttcccctgaaaacatacattgtttgtttggaatcatcttctctgaggctgtgtgaaggttctttttccccatatcacacatacaacacacaccatctgtacacacacacacactctctcttgctccaagggagtacatacttcttcttcttttcccacatcagtatatgcttccttgccatccaaggcc

SEQ ID NO: 4136 - DNA, 1215 bp, Homo sapiens
ctgcagcttctgcttcccaggtcaggcagttctcctgcttgacccagtagctgggattacaggcgcatgccaccatacccagctaattttcctatttttagtagagatggggtttctagccaggctggtctcgaacttcagacctcaggtgatccgcctgccttggcttctcaaagtgctgggattacaggcatgagccgtcgtgcctggcctgtatgactgtatgagggaggttcttgagctaggtgccttttttttttttttgagatggggtctcactctgtcgcccaggggcacaatcatagctcattgcagccttgacctcctgggttctagcaggccttccacctcagcctcccgagtagctgggactacaggtgtgtgccaccacacctggctaatttttattttttgtagagatggggtctcattgtgttgcccaggttggtcttgaactcctggcttcaagcagtcctcctgcctcagcctcccaaagtgctgggattataggcatgagccacctcacccagccttcttgagctgagttctagaggaaagttaagactgacctcaaatttcaggagacagtcccaaaggaattctggtaatattgcaattttttttttctgagacagttttgctcttgttgcccaggctggagtgcagtggcacaatctcagctcattgcaacctctgcctcccgggttcaagcgattctcctgcctcagtctcccgagaagctgggattacaggcatgcaccaccacgctcagctaattttgtatttttagtagagaccgggtttctccatggtggtcagtcaggctggtctcgaactccgggactcaggtgatctgccagccttggcctcccgaagtgctgggattgcaggcgtgagccaccgcgcctggccgagattcttaagtaaatgaacttttctttaggcacatgaattggaactatggaacaaagagattattgatacaattattcaagaagcacatttgcatatttagaacagaaaggttgcacagctcttacatactcaaacatagttttagagttagatcatgatcttaactttcttcatggttaccttttggggaggaaaaccaccctttttcatattaaagtaaaatgtgtacgtaataaagtgtgactggcatccaaatcaagaaacagacccttcccagtaccatgggaatctgcctgcctt

SEQ ID NO: 4137 - DNA, 1111 bp, Homo sapiens
taactacacttcagcatccccagtgcccaagaaattggaaagtacaatatttggtttgagacattcttcataaaagattctttattataaaaatttacctcatttacatttaatgtgatgatcttttttttcctttctggtatatttcccactgtactgtttggtttttgttattctcttgtctgtgggtagatttagttacccaaacatagaaactaaagcaattgcttttttcctctggtcttaaatatgtttggacaaaaagacactaaaaggtcaggcctaggggaaaagtaccctggtggaaattatttttgtaattcttaatatttttgagttggctccgtttgtcagttttaaaagcctcaaaaattatgttaaaaaaaaaatccagtgaaatcccatttagggcaggccgatttgttagaagtcactgatgctccagtaggcttttgttataatcaggcctgtttcctgagtatgtgcctcttttaaaagaagaaataattagctgtatagtatttcagtactgatgaatgaatgaatgaatgaatggcagttagtggacccaaataagtattcagtggtatataaatatttgaggaactaggtactgaattaggtgctctgagttggcaccccgaaatgtttggaatcacgactatgatttacttaaacacgtaacacattcaaggatatataaatggagtctaagtattttgcttttgaagagaataatctatgaaatggaagacttgattttttttttcattttttagaagtaatacacatttatgattgttggcacataaaactatgcaaaataattctttttaagtatctgtaagaaagaattggcagtttaaacggattttgcttatttatgcactacagaatgcagcatactgtattactgttgaggctgcttaataagtttaccaatgtgaaaagcagatcttgggtataagtgtatgcctgatttgagcttttaaaactgtgcagtaggtgtatggtaatgttttacaatcctatgtagcaaaataggaaattatgaatttttgttgttattgttttaaagatttaagatggattggggtagggaacagctgga

SEQ ID NO: 4138 - DNA, 1099 bp, Homo sapiens
cgctgtccgccctgcgcgcggccgcctcgggcccgagggaggcggatgcacggccggcggaggaaggggagggagcgaggagcgcgcgctgctctcgcgtgctctcgcgccgctcgcgtgaccggccggtgtgtgcgcgaggccccggctcccggggcacggacggccgggcgcgcgcctctgcgaggggcgtccgggtccgagtcggcggtccgggccggcgcgaggtgcgtgcgggcgggccgcgggggtcccggacggacacaagcgcacacactcccggaggagccttcgaggctgctcttcctcggccagacggagagcggcactgtctccccgcccagcgctcactcgccccgcgtctccccccgcggcggctgctcctcctcggcaccgccagccccagcgccgctcccgggcgggcgggcggcggcggcggcggcggcgggacccgcggagccgctttgtgtgcagcccgactaggggcggcggcgcaaccacctgacagaggcccgggcgctcgatgcaccttccgcccgcatgaggaggaggtaaaggcggcggcggctcggctcccgccctaggctgctggagggaggggacggaaggggagactggaggggggggccgcgggtccgaggcccggtggggccgcccgagggtgccgggaaggcctcggcggtgccggaggcgccaagcggccgggggccagagaagcagctggggtccctcagccgaagttgaaggaacaaaatgtgaagtgcggaggcgcgtcagccgcttcctggcgtggggctgagggtggagggcggcttgttttcccctcccgcgggggtgagggagcggaacaggggaggggtggcagcgcggcggggactaccccgggtccgaggctcggctgggcaagggcgttttgttcccggcagccgccgctgcgcgtgggtccgctgggtccctagttttgcggcctaagccgagccctataggcctcgggtctggtttcccggaggggactggccgggcgggactgggtgcttccccaccgccgagcgggggccttggggtccttgccggcctcccggggccgccaaacttcgga

SEQ ID NO: 4139 - DNA, 1145 bp, Homo sapiens
tttaggccagttgtggtggcttatacctgtaacgccaacacttttggaggcagagacaggaggattgtttgagaccacacattccagaccagcctggtcaccacagcaacaccctgtctctacaaaaaaaaaaaaattcataaaaaaattagccaggtattatggctgtagtcccagctgctcaggaggctgaggtgggaggatcactttgagcccaggaggtcaaggccgcagtgagctatgatggcgccagtggactccagcctgggcaacagagtgaggccttgtctcaggaaaagaaaaaaaaaattcctcctttggcgtgggaaaggcactcatccaaaaatttaaagtgtaggggtatattagtgtgtagtttctagaatgatgccaagggctcagttatctcttgatgtacaacaaaccaccctatattcactgagtgcctactatctcatgatttggaccagatttgggcagagcttagctgggagattctgctacatgtgcattacctggggttagttggtagtattcaacttgtggctagtctggcttgaggattttttttttttttctaattcatttctgtattctcatctgaaggcttgatgatttaagatggctttgctcacatgcctgacaccttggcaggaacgtttcagggcctctccataaggcctctcctgctgggtggttggacttcttacatttcaaagtgtcccaagcgtgagtgtcccaagagataggacagcaaagctaccaggcctgggtttggaagctggaagagtgtcacttctgggttgaagcaggcacagagcccactcaggttcaagtggagaaagagtggatcccacttctcaatgagaggagtgtcagagagtttacagacattttaaatctgccacactaaggatcaacctaaatgggtttccattttcctgggttgggggtggtaagtgtaagtacctatttggatttgaaaatcctgctgaacttattttctctattttgtggcatttgaactttagggacttctctttctttttttttttttttgagacggagtcttgttctatcgcccaggctggagtccagtggtgtgatctcggcccactgcaacctccgcctcctgggttcaagcc

SEQ ID NO: 4140 - DNA, 1237 bp, Homo sapiens
tacccggagagcgcgaggccgagggagggggagccgagtcgctgatcggttcggttttgcctttttctttgcatttgcctttcagatgctgaacaaagtgagtggcgtctcgcgccgtctctggccccctcccccgcgagcgccgaggcgggggcgcccaccggttccggctgctggcagggaccaagccgcccgctgcgagcaccggagacggccgggctggggcgtgggctgggcgcctttcctgggcccctgcatttagcgggtgactctacgaaaccggtcacggggagacggagggggctgcgccccgtggcgagcgagcgccaggcggagctcccgagggcgtggcgcgggcagcacagactcggctgcacgggcttcgcgggcgccacgtgtgggccgcgctttgtgctgtgtcattgcgccggcccgggtgggggtggcagggcgggactggggctcctcccaggctcgggtgcgggcgcggagggcgcgcgcctcctggccccgccccctggcaggtgcccgcgacccgcgtgtccccgtgcgcctggccgccttgtctcctctccgcaggtgctgtcccggctgggggtcgccggccagtggcgcttcgtggacgtgctggggctggaagaggagtctctgggctcggtgccagcgcctgcctgcgcgctgctgctgctgtttcccctcacggcccaggtagggcgtggggcccaggatgcgccggccgccggcagtgcacgccgctccccagcttgagtcctcgggggctccccgccccgccccctcccctgtaggtgatgcggggcgcgcctacaaggaagggaggagcctgcattttcgtggtacctactccctgggctcctgttccagcggtgcctgtcgccttcttgcccatccgtccacaattgccttaaatttggaagagaggcagtatctcagttccatctatcccgttatccagggaaatcattcatcctactcatgagttccctcgaacttgggctttttcgagcctccggttccggggaatggctgctggtttccctttaagggctataacctgtcaactcattgtttgcttctcagactcccacctagctgtagaatggagggggaagggctgacctaaatcgcagggaaacaattaggttcgctaattctccgcctccattacttgggtttctgatggtcttaaggggttcttctctcttctccactcccacca

SEQ ID NO: 4141 - DNA, 1199 bp, Homo sapiens
gaaattgtattggtcattgaagtcttgagtaaattcaaattgacagtattttgtttagatccaaatgagtcttataggtcaggcatagtggctcatgcctgtaatcccaacaatttgggaggccgaggagggtgaatcacttgagcccaggagtttgagaccagcttggccaacatagtgaaaccccgtccctacaaaaaatacagagtagcgaggtctgtagtcccagccacttgggaggctgaggtgggagaattgcttgagccctagaggcagaggttgcagtgagctgagaccatgtcgctgcactccggtctgggtgaccctgtctcaataacagaaacaaatgagtcttatagagtgtacacctctcctagtaagtgagcatttcaaataatcttcacaggctgttggggagaatgaaatgcccaacgaaggacaagttctagaaggcttgaatataccataatctgatgagaacctctgagtcagctgctaaatttaagtcagatctcagtgtcctttttaaaaaaaaaaaaaagttgacaaggtcagcctccatttcccaggctggaatgcagtggtgtgatcttggctcactgcagcaattctctcatctcagcctcccgagtagctgggattacaagtacacaccaccacacctactaatttttatattttttgtagagatggggtttcaccatgttgttcaggctggtcttgaactcttgtgagctcaagtgatctgcctgcctcagcctcccaaagtgctagtattgcaggtgtgagccaccgtgcctagccagatctcagtgtctttataactacaactggctgccactttctagcattgaccttggttgagatagttagcctctctaagcctcaattttctcctcagtaaaaatcctgtagtaatagcatcctcatagagttgttctgacagttaacagtatatttaccttagtgggcttagaatagggcttaatgtaagacatacattaaatattagctataatttctaaaaatcaagtcagttcaagcacatttcacttgaattgcaagataatttttaaaatacagcttacactcattttcaaaaatttcttgactttctttaggtagatgacaaggtgaatttccattttattctgtttaacaacgtggatggccacctctatgaacttggtatgttttac

SEQ ID NO: 4142 - DNA, 1270 bp, Homo sapiens
gtgtttttgttgttgggtttttttgtttttgttttttttaacttttccaaaaccaggtacaaagtgagagaagcacaaaaccatttggtggaagtgataagtcaaatccatgatgtaaccttgtctttcccatcacctgattttttgctttaagccctggttttcaaattaatgatggaattaaagttgatgagggtgaactttgagcattaatagaccttggagcctttccctatgtgactttcattttgagctcttgctgtttggattttaatgacatttctcctttccaggacgctgccaaggtctgcagagaattcaccgagcgtgagcaaggagaagtccgcttctctgccgtggctctctgcaaggcagcctaatgctctgtgggagggactttgctgatttcccctcttcccttcaacatgaaaatatatacccccccatgcagtctaaaatgcttcagtacttgtgaaacacagctgttcttctgttctgcagacacgccttcccctcagccacacccaggcacttaagcacaagcagagtgcacagctgtccactgggccattgtggtgtgagcttcagatggtgaagcattctccccagtgtatgtcttgtatccgatatctaacgctttaaatggctactttggtttctgtctgtaagttaagaccttggatgtggtttaattgtttgtcctcaaaaggaataaaacttttctgctgataagatagccacagctgattctcattttcttttaccctctcctcaatatgtcaggttattttggtagtaatatatgaatgtcttccacataagtaactcatacagtgctgccaagaattaccataaaagcattggtttgatgtgtctttggatttttttttgcatttgtattccctatgtatacctgtagaaactaatttttaaagatttttaaataggcaaattttgtagcacaattttagacttataaaaatattgaagacaaaaagaaaatactggacattgtagaagtcccataaacccaccacccagtttcctctattgtattaagcggggttttctagaggacagaactaataggatatatgtatgtataaaggggagtttattaaggagtgttgacccacacgatcacaaggtaaagtcccatggtaggccctctgcaagctgaggagcaaggaagccagtccgagtctcaaaacctcaaaagtaggaaaaccaatagtgcagccttcactctatagtcaaaggtccaagagtc

SEQ ID NO: 4143 - DNA, 1177 bp, Homo sapiens
agatatttccatgggccagtgtgatgacttttttttaaatgaggttcagtaccataatgtttatttactggaagataatgcatttataagcattttaaaattctgtaaagtgggttagaaatatttataattttacaggcaggacagcatttgacttttatttaaaaggcggcactacttatgtaaatctgagctgtgggatatttcttgctttaagagagagacagaatctctcactgaaactcatggtcatgattttgtataatatagttcatactgtgtctgtgagtttcttcagttacaaatgggcatttagtatagttatattgactataacatgtaagtaaatagctttctactgaccctaagttatcaaggtggaaaaaaaacatgcaattcagtaattgaaaatgtggtgaaaagctgcagctgtcatcatcaaaacaactcataacatactttaaaatgttcaggtagcagtgagcattgttcatatgagaatggcggctgggtgatctctttgctgaattaatgagttcttaacatgtggacccaactgcctgtgtgagatctgtgtcttaaaacttactggaatggaaatctatgaattattgcaaattgtaatgctggaaacaaaaaataaatccttggttaaagggtttgtaatggtgatttttgacccagaaatctcatttactggaaaattgtgagactttacgttggtgtatttttcttttttttttttttactattacagagtattttgcatgctgtacattttaagtgaaataacattccagttttatttttaagatagaaaattgttatatatatatataatttgatactctattcttacagtttcaaattccttatcccttctttacaaaaaaaactttttttttacctgttatgatttattctatacttttttcttcttccttcccctttcccacttgccatttattacttcatgtcattgccatatgagaaagtaccaaattatatccagtttcctcctagtgatattactctgaaaaatttcacaaagccagacaagaataattactcattttttttcccaagacgaccctcaaagttaatgtgcagcaggtattccaaatggtaattttttttttttaggattccctaataaaaaaaaaaaaaattctgatat

SEQ ID NO: 4144 - DNA, 1169 bp, Homo sapiens
gactctgtctcaaaaaaaaatttattaaatttagagacagtcttgctgtgtcactcaggctggaatgcattagcacaattgtagctcactgtaacctcaaactcttggctcaagtgatccttctgcctcagtcttctgagtagctggaattacaggtatgtgctaccatgcccagctaattatttaaaaaatttcttgtagagagggtgtcttgccatgttgcccaggttggtcctgaacccctgacataaaaaattctcctgcctcagcctcccaaagtgctgggattacaggcgtgagccaccatgccaaccctcatatgtttttcttacaggtaaagacagtagagatgctgctgtgtacataatcttgatctgatgtcctagtctttctgccaggcatggcatgtgtatcttcttatttacattgcttgatgatgacttctgtctctccatgctgagaatttaagagatatcattgcgggagaggctggaagtcttcctgaactggttgggacagaatcatagaatctaaaggccagggagagtttacagcttcctgaggccagtcatgctctgaagtttaaatcttcacctacaaaaaatggtcagccagactctgttagaaccttcatggcctctgtcgttgggtagtgttgacacttgggttttgactggaacccatttgaggttccaagtccaccaccgtggagatactcagaacaactgaattcctggcctccatgccagttccaatttaggttttcatgatgtttctccttctccgttaacaagtcttttaacccgtgtttctcagtcttttgaacaccaaggcagacattgaaaatgatgatatttgcatggcgccctggggtaaaccagaggggagttaaggatgtctgtctggggcttggcgaaaattattacacttctctttatagtgtataattataagaaaataaaatacaaaatattatgaaagatgttaaatattgaatttgtattaaacttccaaataaaatcttttcaaatgtttgaaagcaaaatttagcttgcttccatgaacataacttttaataccaggttttatgcttgaaatggctgcatgaaattcctgatccagacttgttaatgaagatttattcaaattcttgatagccatgatggtca

SEQ ID NO: 4145 - DNA, 1196 bp, Homo sapiens
gctcatggaggcaaagctgaggataaggagtggatgcccgtcaccaagctgggccacttggtcaaggacatgaagatcaagtccctggaggagatctatctcttctccctgcccataaaggaatcagagatcattgacttattgactttttcctgggggcctctctcaaggatgaggttttgaagattatgccggtgcagaagcagtcccctgcctgccagggcaccaggttcaaggcgtttgttgctgtcggggactacaatggccacttctgtctggatgttaagtgctccaaggaggtggccaccgccatccgtggggccaccatcctggccaagctctccattgtccccgtgcgcagagcctactgggggaacaagatcagcaagccccacaccgtcccttgcaaggttacaggccgctgcagctctgtgctgctgcacctcatccctgcacccaggggcactggcatcgtctccacacctgtgtccaagaagctgcttatgatggctggtatcaatgactgctatacctcagcccgaggctgcactgccaccctgggcaacttcgccaaggccacctttgatgccatttctaagacctacagctacctggcccccgacctctggaaggagacctgtatttaccaagtctccctatcaggaattcactgaccacctcctcaagacccacaccagagtctccgtacagcggacccaggctccagctgtggctacaacatagggtttttatacaagaaaagtaaagtgaattaagcctgtaaaaaaaagaattaacttcttcattgagctagtggttgttcaggagcatgttttatttccatctatttgtacagtttccaaagttctttttattatttatttctagttttattttaaaaaaaattgttgaaacctgttttgtgtcccaatttatagtctatcctggagaaggttccatgtgttgatgcaaagaatgtatttctgcaggtgctgtgtaaagtattctgtaaatgtctgttaggtccatttggtttaaagagcagtttaaatccactgtttctttgttgcttttctgtctagatgatctgtccaatgctaagagtaggatattgaagtctccaaatattaataatgtatttgaatccaattgctttatatacctgggtgcattggtgttgggttcatatatattca

SEQ ID NO: 4146 - DNA, 1158 bp, Homo sapiens
caataaagttgaataaacaattagtgtaatattgcttttcttttctttttagtctataccataatctataacagtggtaccagtggccccggtagttaatatcacagtcatgaagactcacagcctattgtagctagcaagagggaatccatgactcctctgggaagaaaggtgatcatcttttctttgacattggtatgttgatcaattcattctgtggaacctgtgggttgtactccagtagagtccttaggatggtctctcctgaaggatgcccaacagtagctaaaagtaaatttaccagaatagagtgaaaaggtaaggaaataaatgaatacataagatatgtgtttcgcagagctggaccaaaagaaacctacttagatctgaggctcattttctcttcattgtgtcagaatagtgtgcctgcaatttaattttgttttacaatgctcacaaccaagcttggcttgcaggatgtattgccctgaaacatctgtggtctcttcagcttttcctgaatcttccgttattgcctagtgacacaggtttgaagagaagggcaagaagctagagtggatgaagggctaaacaaacttaccaataatgggatgacactgaattcactggtctactacatgtatttcaaagggatgtggaaacttcatttttatctaaggtagtgtgtttccaccagggctctgagatcagaaacaagacatggaaactttaagaagtattattcaaagttcattctcttagatagttttttcagttgacttttgggacatcgttctcttactactttccctccttgcctcattgctgctccctgtcaatattttctgctagatcatcttcttcattatgacctctaaatgttgaagtcccgaggctctgtccctggaccctttctcttgtttaaatgtgttcacttcctacattatgttttaattaccatctgtatatggaagattccccaggttctatttattccttgaatctttcccttggacatcagactcatattcaaatgtctacttaaatatgatatatccaaacttgatttcttgatctgccaaatctgtttctaccatgatgttctctttcaagtaaacagtaacgtctagttacttaggtgagaaattttgggataat

SEQ ID NO: 4147 - DNA, 1249 bp, Homo sapiens
caaatggctttttatacatttttactactaatttgtacataatgtgatttctgtggatgctgaatggatttttcagcaggtgatctcattacaagataatctcattacaaatccctgttagaatttctcaccgtggtatccagattgaaatgaaattcttcacagctgtagaaaagttcttccgaaatttgttggtatcataagctctaaactgctctactctatggactttcaagaaaactaccaacttttgcctttccgtctggcggcagccatcaggtaagccaagatgggtgcatacaagtatatccaggagctatggagaaagaagcagtctgatgtcacgcgctttcttctgagggtccgctgctggcagtaccgccagctctctgctcttcacagggctccccgccccacccggcctgataaagcgcgccaactgggctacaaggccaagcaaggttacgttatacataggatttgtgttagccgtggtggccgaaaacgcccagttcctaagggtgcaacttacggcaagcctgtccatcatggtgttaaccagctaaaattttgctcgaagccttcagtccgttgcggaggagcgagctggacgccactgtggggctctgggagtcctgaattcttactgggttggtgaagattccacatacaaattttttgaggttatcctcattgatccattccataaagctatcagaagaaatcctgacaccccatggatcaccaaaccagtccacaagcacagggagatgcgtgggctgacatctgcaggccgaaagagccgtggccttggaaagggccataagttccaccacactatttgtggttctcgccgggcagcttggagaaggcgcaatactctccagctccaccgttaccgctaatacaagtaaagtttgtaaaattcatacctaataaacaatttaggacagtcatgtctgcttacaggtgttatttgtctgttaaaactagtctgcagatgtttcttgaatgctttgtcaaattaagaaagttaaagtgcaataatgtttgaagacaataagtggtggtgtatcttgtttctaataagataaacttttttatctttgctttatcttattagggagttgtatgttagtgtataaaacatactgcgtggtataataggcttaataaattcttaaaagaagagaaaaaaaagaaaactaccaacttttctcagcaactatcctatgaaaattttgtgaca

SEQ ID NO: 4148 - DNA, 1148 bp, Homo sapiens
ttaggagtgtaattgctggatcacatggtaagactttgtttagctttgtaagaagctgtcaaacagtttactaaagtgtctgaatcattttgcattctcacaacagtgagtgagaattgttgttgctctttattctcaccaacatgtggtattgtcagtgttttggattttagccattctatttttaattgatacataataattatacatatttataggaaatgtaatgctgtttcagtacatacagtgtgatatacagtgatcagatcagggcaattagcgtatccattatctcagacaccatttctttgttttgggaacattcagtatcctcttttctagctatttgaaaatatatattattgttaactatcgttatctgtaactatagttatagatatctatatctatagatatccattgttataggtaactattgttatctatagttaacaatagataacagtagttttatagcactgtaagataactataaaaccccagaacttgttcttcctatctagctgtaattttgttttttaacaaatctctcttatcccctcctccctctaccttttccatcctgtaactattctgctttttatttctataagatcaactttttagcttctacatgtgagaacatgcagtgtttaatttaacatgcagtgtttaatttcctgttcctttttgcgtttttttttttttttttttttttactcattaattaggtttactgtttactatgggcacagtttgtggcaccccaaaagaatccaatagtaacatcaaagatcgctgattacggatcacaataacagatataataaaaaagaaaaactttgaaataatgcaagaattatatgaaaattgtcatagagacatgaagtgagcacatgctataggaaatatggcactgatacatgtgttccacatagagtttccacaaattcttttttttttcatttttatattgcgttatttgctttcttattgagtatattttgaagacaagtcctttaccagctgtgcattttccaagtattttctgccagtctgtggcttatctttttaaccttttttttttttttttttttttgagactggatctcagttctgtcacccaggcttttcatggagaaggagtg

SEQ ID NO: 4149 - DNA, 1159 bp, Homo sapiens
tactcactcactattggagtatgcagatccttcccagttcagcttctgttcagcatttttttgtatgagtacttgttggttattttggaattttcaggacattgagatattcctctgcttccttctgcacagatactgataattcatatggtcttgtagttgtcagtgacttcttcctacccacttgtattttgggcctcatggagatactccatcacctggttttattgtagctattgtaaatgggttttggtttgaccttcctagttgctctgtatgtttttatggagagagttgaggaaattcgtaaattacaccaatgccggtaccatctttcaagaatcctcataattatgtttcttaatcttgacattgacattttttccgctttcctcactagacactctaaggttagttatatgttaatttattaaactaaaatacaataagttatataggtatagatgtacagctgtttatatatactgtgtactaaaactaacgtgtctctcaaatcttgatatcatgtattttgatacctaatcaattccctaattttggaaatgtggctattttgttaaaaacttcccctaccagggtggagatatctaatgaatcttaatagttcctgtaatgtatgtttgtatatgtacacacacacacacacacacacacacacacacacacacacacacacacacattccctctctctctctctctctgtgtctcagctttggcacccaaagggtggctaaggttttcagttgaataaacatatttctttctaaaaagtttatttctaaaagtcattattgaggttggggcaattatcttgaagaggatcagttccaaagttattttctatttagagtaaattggaagattaagctgtaaatgtttgctggtagcttatgcattcatatatatctttttgtatttatggaagaaaaggtattgaagccctattttcggggcattttctgcatcttacatttaataaatttttctaataactaacaatttttgtatgcttacaaaataatagtcgtgtacgttaatggaagaagaaatcaaaggtttctgtgtctttctcttttatggttacttgtcagcaattgccatttttatatgctttggagtcataccttataaaacct

SEQ ID NO: 4150 - DNA, 1200 bp, Homo sapiens
agcagcaatttgtaaagtgcttaccatgtgtttgctgggcatgtacatgcatcatttcaaaactatgaggtagatactaatatttttcccaattttaatacagggaaattttggcttatgtagggcaaacaacttgccctagcaacgcatagctagcaagtagcaaactcaggatctgacccacagtgaagttacaaagccctttccactacacccacctgcacagttgaaagttccaagcagaaaactggtaaaatatgataatggtagttttattttattgtggtcagagaagatacttgatataatttcaattttcttgaaatttttaagatgtattttgtggcctaacacattttctatccttgagattgatccatgtgctgagaagaagaatgtgcattctgccaccactggaagaaatgttctgtaaatatgtattagatccatttggtctatagtgcagattaaatctgatgttcctttcttgagtttctgtctggatgattttggtccaatactaaaagtggagtggtgaattctccagctattattatatcagagtctttctttctctcgctctctctctctctctctctctttagctctaacaatatttgctttatgtatctcggtgctctagtgttgggtatatatatatatatatatatatatatatatatatatatatatttacaattgttatatcctcttgctgaatcgactcctttatcattatataatgaccttctttgtctcattttatagtttttgtcttgaaatctattttatctaagtatagctactcctgctcttttctgggttccattggcatggtatatcttttctgatccctttattttctgtctatgtgtgtctttataggcaaagtgtatcttgtagcaacagattgttagggtcttatttttttgttttgttttgtttgtttgtttttaaatccattcagccagtctatgtcttttggttggagagtttagttcatttacattcaatgttattactgagaagtaaggacttatccctgccattttgttatttgttttctggtcttctctgtcttctttccttcctatttgtcttcctttccgtgaagatgattttcctggtggtatgttttaatttcttgcttttattttttgtgtctttactgtatgcttttaaatttgaggttaccatgag

SEQ ID NO: 4151 - DNA, 1186 bp, Homo sapiens
atcttttttctcaccattaaaatgagaattgtgtttagaagtttgttatgaggactaactatttatgtaaaattctagatacaatgcatttgtccaaccccaagttcacaaaagtctggtcatcccctttttgtaattataatttgactctcatgtgcttttattcaaatgagagagaaacataacttttcatcatagcaacaaacttaaaataatgtcttttacttattattgcttggaatcatcaattatttatgcttttttcctagtcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttctgtattatcttaatgtttatggcaaataaaatgtaaaggaacatgcaacagccctcatcttccttgattttatggttttattgtttgtaatttattgatttatttttaagctagttataatcatgtaggtataggaaataaagtcatctataatatttctataatatggctataatatggctataaatctataatatggctggaggcagtgggcagtggttcatgcctgtaatcccagcactttgggaggccgaagtgggaggattgcatgagtccaggagtttgagaccagcctgggcaacaaagcgagaccctgtctttacaaaaaaataaaaattagctggcgatggtgtcgtgtgcctgtagtcctagttacttaagaggctgagttgggaggatcagttgaacccagtggttctgggttgcagtgagctgtggtca

SEQ ID NO: 4152 - DNA, 1199 bp, Homo sapiens
ccccctcgtgcttgttggtgcccaaagtttgaagggggctgaggtggcagggggctggtgtgtcagcattgccccaagcatgtgcacacctggtcaggtcacgacagtgcctgggctcagcctcaactttactctgataacggacaaagcaccaggagtagggagatgccaggaagtgggagcagtcacttttgaggctgtgggggcagggggccttcccagtccttgagagtgcagggatgcctgggtccgcagccatggctgggcggctgcagctgttcctggaagggcgagactcctgcccccacagctcagaatggggtggggctcctgcctgttccaagctccgtggagtgtgcagcccctgctgctcctcctccactgcagcccacctcatggcagtgattgctccagacgggctgctgctgccatcagtatgacatgctggtttattgcctgttaccttgtaagtgcccagtcaatgtcagttagtgttagtaatttcttggagtagtcaacttcattaacatttgccatctggttatagcatcacttgtgattccggtacccaacagagtatactttaaaaactgagcaacataaaatctatgatgtttagaaatctgaaatagttgagtcattgtagtacttctttgagtctcttggcctaacagtagtctgggcaatgctactgtgtgtggaagagccaaacctaagtcacagagatcgggtatcttcctgctctgcctcctctcaggcctttcttttgtgtgtcacaatcttcctcctaccaaaaggaaaaagagagaatgaattagtggctaatcttggagaaatagcacaaaataggagtgaattttaaagagcccaatcaggctgggtgtggtggctcacgcctgtaatcctaggactttgggaggctgagaccagtggatcacgaggtcaggagttcaagaccagcctgggcaacatggtgaaaccccgtctctactaaaaatacaaaaattagctgggcatggtggtgcatgcctataatctcagctactcgggaggctgaggcaggagaattgcttgaatctggacccggggggccgaggttgcagtgagctgagctcatgccactgcactgtagcctaggctacagagggagactccatctcaaaaaaaaaaaaaaaaaaaaaagtcaatcagagaggacc

SEQ ID NO: 4153 - DNA, 1204 bp, Homo sapiens
aagaggaggaagtttttgtggacaatgaaaagttattttcgtacctttctaccaaaaccaagtttcaggaaaataactctatgttgtttattttcagtgacacttatgtaaggccctgtgagttgtatttatcctgtatccggcactgctaagcttttcaaggtatctttccaatcctgctgatgtggcagtcaatggctgcagggctggcaaacctccccttagccagtcagcacggcattgttccttatcaggaataacaaaggtactacatctttccagccatcagcacgttgtacaacttaactttttaacatagtccgtctgtttactgaggcactggcgagtcccagggctgatacagaaccttccctagagggaataccagagttagctgggtatagaggtggctcaaaggaagtgtccgtgggcagggggaggaatgaacaaaatggcgctgtttctttggctcagactcctagaatgcttgacaagacagaatttttttggaagaacctcatctcactatagttacttttttcacttttgttatatatgtatttattagagcatttgaatattggtacctttaaaagggtcatttggtgttttgctgttgagctggtttttgagtcatagatcttggcttcctttagaagccacttaacttccatacactataataaactgtgaacatatttttgttacctaatgcatccactgatgaacatgcaaactttgggcataatgtgaactaaaattgaaatggaaaatgttagtggccattttgcaacaatgaagaggatagcactttatctagatgaaaactggatttcttatctttgaaatatcttgaactgtttattgctcagaacttaagtaagcatgccaacatttcgtttgtttatgcttgaagtgaaatgttttacttttcactggagaagacaaaacagggtgatcttcatgttattgttttatacaagtgatggaaatgtaccttgccttgtttagaggcaatttcacatttataaatatttttttttcctccatgaaacttacgcagtaatcactacctggaaggtgagttttgatctctttttaaggagaggcactttccaactgaaggtgattgatgtagggaaatgtttgtactatatagaatccatatatttgactgcaagttacaaagttttaagaacatgat

SEQ ID NO: 4154 - DNA, 1202 bp, Homo sapiens
ctctctaaaaaagatgctctggaaacaaaaaaacacccttcactttaactttgtaattagtctcaagaatatatgtggaaggaaatttgaagctgtattttcattacgtgttttgtgctttagaaaattccaaaaatagcctggctgtggtggctcatgcctgtaatcccagcactttgggaggccgaggcaggcagatcacctgaggtcaggagttggagaccagcctgaccaacatggagaaaccccgtctctactaaaaatacaaaaattagctgggcctggtggtgcatgcctgtaatcccagctactcgggaggctgaggcaggagaatggcttgaacccgggaggcggaggttgcagtgagctgagattgtgccattgcactccagcctaggcaacaacagcaaaactccttctcaaaaaaaaaaaaaaaaaaaaaaaagaaaagaaaattccacaacagataccctggataaaagctactttttctctttgctactttttctctttttaaacacacacacacacacacacacacactctctctctctctctctctctctctctctctctctctctctctctctctctctctcaggctactttttctcttttaaaacacacactgtctcactctcactctctgttagtgtaagaaaaactagattcctgctcttgtagttaatgtaactgacaaatgtggagtttgaggcattgcttaaatgtttgtaaagagcaagtaaataatgattaagatgtttttcgtaagttattatatttgggctgggcgctgtggcacattgcctgtaatcctggcactttgggaagctgaggtgggtggatcacttgagctcaggagtttgagaccagcataggcaacatagcaaaaccccaactctaccaaaaatacaaaaattaattgggcatggttgtgtgcacctgtggccccagctacctgggaggctgaggtgggtggatcactggacaggtgaggctgcagtgagctgtgatcgtgccactgcattccagcctgggtaatggagcccaacctggtctctaaataaataaataaatacataaataacagttattatatttgaagttgtggccttatcatatgctagttactattaatttgtataatacagtgttttcccgattttaacagtattcttcaagccaaatctgtaagtgttttt

SEQ ID NO: 4155 - DNA, 1173 bp, Homo sapiens
atgcaaattgtaaaacatcgcagggaaacgtcgataataaggcataggcagttaatgaaattgtgacaagaataaaagaatatttcgacgtgatgttaggcactcagctgctctacaaatttgagaggcccctgtatgcagaaatcctcttggctcaccctgatgctcctgtgtcccaggtttaaggggcacacacctactgaggttatttgtaagaataggagaaatgttggcctatatatcccttgatgagaagagccttgcgttattgttgggccatttgcatgatttcctaaaatatctggcaaagaattctgcatctctttttactggcggtgattacaaagtagcttctgctaagtaccaccacaaagccctgtgctggtctacagaccattcactgttatttccctgagatctggaaacactttttgttcttagtctttttcttgtaaaatggatattctttaacattgttaatgtaaaacagggcttatgtttcagtttgttttctgttctgttttaaacagaaaataaaaggagtgtaagctccttttctcatttcaaagttgctaccagggtatgcagtaattagaacaaagaagaaatattcagtggaacattttattgcctagttgacaacattgcttgaatgctggtggttctacccctttgacactacacaattttctaatatgtgttaatgctacatgacaaaatgccctgactcctagtgccaaacattcaatttgatatatatacccaaaaacccatgcatttgttctcttttttttaatgatgcttgaagtaaaacagcccatcctctgcaaatccgtctatgttgttccttaggcattctgtctttgcgcaaattgttgaagggtggtcgtttgtttcatggtttttgcatttgagtctaatgcatgttgtaacgtgatagaggcaatgcattattgtgtaagccacagttttctgaaaaagttgatattttaggaattacatttcagatcttaaataaaatttgtttctaaatttcaaagcaaaaaagaaaaaagacagtaagaaagtgtctttggaggaaagacctaaaggtgaggaagtaagacgtgtgagcttgtaggggaagagttctcaacagaggggaaggctagagagggccagaccagcaaggaa

SEQ ID NO: 4156 - DNA, 1107 bp, Homo sapiens
tgacagcagatggaggaggtgtggtatccatgattcgagactgtctctcctgcactcctcaatgcctctttcagtgatacgaagttaaaagcaggtattatgattcctcacctaatttttggtttttgggatggtgcttttccatgggcaggtagttattaaaatttggtgttccagtaaaagggatgaaaggtgtaggattctattccaccatcttgctctgcccctaacaataatttttgttataaagtaagatattattatcttagagataacacaaaattaggacagttttatctccataaaagcaaggatgagtctgcgccgggtgtaccttatcgccatgcctcagaaaattgaggaaatcaagggttttctgcttacagcctggtgaaaggatgccaaatctgtcaagatcaagaaaagtaaggacaatatgaagtttaaagttccatgcaacagattcctttataccctgatcatcactgacaaagagaaggcagagaaactgaactagtccctgccccctggtttggcagtgaaggagctgaaatgaaccagacacactgatctaaactgtattaaaatattaaaaatcctttaaaacaagaaagcaaggatgattcaacatcagaaaatgagccaatgtaactcaccacatgaatacactaaaggagaaaaactataggatgatcgtaatagaaccagaaaaagcattggataaaattcaataacttcatgattaaaaattaaaactcttagaaaatcaggtctgaaagagaatgttctaatttataaaggtcatgtgacaaatacctacaataaacattatatttgctggaaagattgtagaattccatctaagatagaaaacccccaaaccagtaacctgaggctaaaattgatggatttaattacatcaaaataagcttttctgttttcatgaaaatagtcatggataaaagtaacagagaactgatgaggagtttgggaattccagtagaaatctagtaaaaggaaaaaaacatgattcatgagaaaaagaaactaaaatgataatttttaaatgatatctaacttatgacaagatgctcagactcgttgggg

SEQ ID NO: 4157 - DNA, 1051 bp, Homo sapiens
aaaaaaaggacatgaaatttttaaatatttcacttgtgttatcagttttatgtaatttaagtgggtttaacagtctttatattattttgcctcaactgttaaatcatatgtgtttatttctacatcttctcttttatagctttatttagttttatagatttaaccactttttttttatactttatgttctgggatacatgtgcagaacgtgcaggtttgttacacaggtatacatgtgccatggtgatttgttgcactcatcaacccgtcatctaggttttaagccctgcatgcactaggtattggtcctaatgctctccctccccttgcccctgacccctcaataatgtcctttatatcagtgtttttcccttcggtctaggtcagatattgcatttagttatttattatctttttagtcttttaatctgaaatatatccatagcctttttttaaaatgttttctgacatcaacctttttgggagaattacagtgtatccctcctccctccaccccaggaatgggctgttccccattttttgtttgtctgatgtttcctgatggttagattgaggtaggcattcctgactagaaaactgcataggtgatactttgtctctccaagaatgtctcatctggaagcacatggtgtccatttattcctcattggtgacattaattttggtgacccagtcaatatttcttttctgtgttgtcttcccttgcaactactatctaatctgtagggatatacttaaagacagtacaaataccctcttcctcatcaaaatttctccaaagattttgcatcaattgatgattcttgcataattagatctttcattgatgcttgcaaaatgatgcttttaattctaatacttcttgcatattcaccagtgagccttggtattctactgccagcaagagctctccttcctttcccatttgtttgtctttttactagcagtacaaacttatggattccttttttcaatggtttataattaattatttaactattttgctgcttaaattatccgatgttaggcc

SEQ ID NO: 4158 - DNA, 1245 bp, Homo sapiens
atagaaggagttgaattggagataagtagagaaaacttttttgagttttactgtaatgtggaacagagaagtggaatagaagccatagaagggaaacaagggtcaagagttatttttttaaagatggaaaacaacatgtttatttgttcccatttgctagtggttgcttaagtggagaaaggaaattaatgatgtagaagaattgggtagaatttctggagctgtgcccttgaatggataataatggatgaggcctggtgcacaaagttggaggttggccttagacaaggaaacagacgtgccatccatagtgataggagggaaggcagaatactgtccatgggcccagctacaggcagattagtataagtagtggtgagggcttttggctctatcatcagctgagagtgaggatggaggaggccctgttggggatttgaaacaagagggtgaggtacaaaatagttttctgggagagtggaagatgaatggtgtggaagggtgttaggattgcttaactgcagtaagggctctgctgcttgaagttagtgactgtgagttgagaatgtgacctgtcctctacggccataccaccgtgaatgcgcccgatctcgtctgatctcggaagctaagcagggtcgggcctggttagtacttggatgggagaatgtgacctgtcagtctagttgagtgtgtttttctagccatgttcaaaagcacttgtacagttgtggaagaggtagggattgggtttggctaggtttagtgtttagacaggtaagccagatggaatgagaagagaggctagggaggtgaaggtgtgtgcaaggacatgattgtgatgatagactatggatctaagctggctaagaaatttgaggacaagaaaatagtgaacaatggtgaaagggtcaatggcatgtaggtccaatgggatcaaggaattgttagatggagagagtgggagggaaaaaaggaagggatagagaacaggatggaatgattgctgtcgttaataatttcagagaagtagcattttcatttatggtctggtttttagttggcaactgttttaaagaattatctctttggtgtatccctctcctgaaattgttaatattctgtaaatcaacacttaaatttactaaaggaaacccagaatgaaaaaaaaattggtatgtatttttagttttccaaaaagtttttaaaactataaatgctttgcttataggtttgatttttgct

SEQ ID NO: 4159 - DNA, 2242 bp, Homo sapiens
atttagctgaaggaaaatcaagcaagatgaaaaggtaattttaaattagagaacacaaataaaatgtattagtgaataaatgcttctctagatccatattaataaacatgagcatctaacccctcctttcttaggctagacaccaagatatttcagccagcctttatcattcctcttactttatcctttttccttaagtattggtggtcactactattgagtttcttccttaacactgattaaatgatcttaactccctcagctaaaactggcattactgactcccagctatatttctccagacttgcatttttttttttttttttgagacagggtctcactgtcgcccaggctggagtgcagtggcgtgatctcagttcactgctgctttccctcctgggctcaagcagttctcccacctcagcctctcgactaacagggactataatcttgcagcaccatgccgagctaattttattttttgtagagatgagctctcactatgtcacccaggttcgtctcaaactcctgaaccctagtaattctcctatctcagcctcccaaagtgctagggttacagacatgagccactgtgcctgtctagacttgtactttcaactgtccatttctccctgtctgtcccatgggcactcatgaaaaaacagaatgctcccaactttattcatcttccaagcctgtagctcttggtatactcactgttgcaagtcagaagcttgatttcatcattgatgtttttctcacgtttcacatctcactcatcaccaagtcatgttggtgttaatttctgattaacccttgaatttaccgtcttctcatcctctgtacaaaagcctcaagtgagggtcaaattcaacattatcctgatctagacagcccccattctcaatccacccttttccaagttgattgcccaaggacttctaacaataaactctcttttgcaccacagacttctttgaaaatatacatgctgttgaccctctctgtagaaaaccgcacacataaaacttaccaacagatttcattggttcttgggttctcccgaagcctatccatggtttatagattaagaattgatgaggtagctgggcacagtggctcacacctacgatcacagcacttcgggaggctgaagcaagcagatcacttgaggtcaggagtttgagaccagcctggccaacatggtgaaaccctgtctctactaaaaatacaaaaagtagccagccgtgatgacaggcacctgtaatcccagctactcgggaggctgaggcatgagaattgcttgaacccgggaggcggaggttgcagtgagcctagatcatgccactgcactccaacctgggcagcagagcaagactctgtctcaaaaggggaaaaaaaaaattgctgatgtgacccatgaagggaactcattttcctcgtaattttggactgccacacattggtacctttagttctctgaaggcccacgtttttatcattaagacctatttgttagctagtagagctttatgttcgctgtccatgaaaccttctgtaaccacagtgactacaagtagttctttctctattgaattattaggtccagaatagaagatgtcattgtacactttatttccctcacactgtgttatgctctgatgtgctatgcttagctatctgtcagagattagtaaattataaaactcatgtgtactacttaagtttatatcttatgctagtttataagaacaattaaaaggacttagaagattaactttggtttcatggtctctgaagtcactgactgctatttcagcttgtttacccttacctagcattaagactccatctacttctgtgcagtatatgaaaatttttaaactttcatttagactggtggataggactgaccattacaaattgtcgttatcaattttttttcctttttttttttaagagccaagttctcactgtctcccaggctggagtgcagtggcatgattatggctccctgcagccttgaactcctggactcaagctgcagcctctcgagtagctgggtgcatgtgctaccacacccaattatgaatttcatcattagtttcttagtagagtccacatgtcctcagtagtaagttcatcagtgctaaatatttgaaggtatttctactgttttgtaaaagtaacttaagcctacctggtctgctatcttttgagtatttatactttctacgggctt

SEQ ID NO: 4160 - DNA, 1104 bp, Homo sapiens
gaataggtaaagagaaaagatacctctacagaaatcatcaaattataaagaaagacagaaagagagaaagacggaaacaaaaggtgataaaatgccagaaaaaaattcacaaaatgacaaccataaatttttacctatcattaattatgttgaatgtaagtatactaaattttccaatcaaaagatgtagaatggctgaatggataaataaacaagagctaatatgctgtctatggtgtttgcaagagattgtttttcagctttaaagtcatatattgaccgaaagtgaagaaatggaaaaaatattccataaaaatggaagccaaaggagagcagcagtagctacacttttattagaaaaaatagactttaagccaaaagctgtaaaaatatgcattaagctaaagagcttctgcacagcatagaaaacaattaacaaagtgaagaggcaaccaacagaatgggataaaatatttgcagttagtaactaaaataatatacaaagaactgaaacatctcagtagcaaaaatagaaacaaaaacaaaaacaatctgatttaaaaatgggcaaaatatctgaacaaatatttcttaaagtaagacatacaaatggccaagaggtatatgaaaaaatgtttaccatcactaaccaccaaggaaatgcaaatcaaaacctcaatgagacatcatcccaccccagtcagaatgtctattgttaaacaagacaaaaaataacaaactctgatgaggatgtgaagaaaggaaaatgtttgcctattggtggaaatataaagtagtacagccattagaaaaaacagtattgaggttcctcaaacagctaaaaatagaactagcatatcatctagcaatctcacttctaggtatgtgtattgtatgtattatagtcaattctaggtatatgtattacagtcaattctcacattgctatgaagaaataccagatagtggctcatgcctgtaatcccagcacttagggaggccgaggagggcagatcacgaggtaagtagttcgagaccagcatggccagtatggtgaaaccccgtctctactaaaaatacaaaaattagccaggcgtggtggtg

SEQ ID NO: 4161 - DNA, 1175 bp, Homo sapiens
atgaacctcaacctttccatgaattccaaatgcatcacaaatattttgtttaaattgcaataattttgtagtatagcatgtggtgaatttcatattcaagagattgcaatgcaaaaagacaagtcacatgaacatagaattccaggaagcaatagaggctgtaaagacattaagtaacctggcaatgaacaaaaaatcaggaaaggaactgtcccaggatctgaaatcagaattttacaatggtgctatcaagatctcccaggtctgaaaggactggatgatatctaggttaagtatcatatgtgaatgaggtctgtttgcatttttatgttttttatttcatttgtctagatggtaatcaatctcctaattataattatgtctttattgaagtgatttcagagaatttctagacacttttcatttcaataagagatatttcatgaagcttcaaaaacattagttatgcagaatttcactttgttccattaccattaagaaatattcacactgttaagttccaaatatccagcacctgccttcatgagcaggacataacaaaaagatatttcttgtcctgaaaacacagggctgtgctaaatggaactaatatgagaacaaatttgaggagcttcccaagggcaagtcagggaaattaaaacactggatagttagttttcagcatcatccaggctgtataagaagcattcagagataaaaaataaaatgataaattgtaagttagatactaggtaaaacctatgacatctaaaacctatgatgagataagagcaaattagaaagaggagagttaattcagtcaggtgcttctccagtgatagaattgaaaaagctatccaagtattttccaccttcgtttatcccctaacacattcatcaacacagatcaataaggatttactagaatgtgatccacattaaatactagttgaaatgatgtgtttatatgtcctgtatctgagaaaatgttgaaaagtattatttgggtttaaatcatgtgaaatccaaaatgttttcattgtattgtaccatccttctttttctttctagaacaaagctgtagaaattgttaatttaagtaacactattttaaaaataatgtactccgctttttaccaaattaaaagaagtgtgagaactcatctctaacctca

SEQ ID NO: 4162 - DNA, 1195 bp, Homo sapiens
ctgagtgtcgaattttataaccatgaaatataatgtttttcctcccacattcaaatgtagggcttacgttttcatttatcattcatggatccatcttttaaaactattcttttgtcaaaaatcaaagggtaataagccattattgttaaacacagtcgacatatgctgcaatctgctgatattctaaagctttgaatatttgaaatggttattgttaatgctctgtagcatctgggctgctcagactgctactatgaaattttgtgttaaaagaagtagggactgttttaaactttttattttggatcaattgttgacttagataaaaattgcaaaaatagtacaaagaattcctgtatactccttaattatctgcttctggtattactatttacataactgtagtccacttatgaaaatctgaaaatttaacattcatacagttctattaactgaattgcagatcttgttcaaatttcaccagcgtttccattaatgtaggagttttttaaaatgtgaagtaattcatagctgtaactatgtaaagttggtaagttttgctattaattgactttttaaaaagtaatgacagaattttgacaagcctctgatgctatgagaatgatgatgtccttttcttcttattctgaagtacatttttgaatgttaccatttgagaaaaggaatatcattactattttaggaaatcattaaatgttactgatactaacattttatttttatcccatttcagtgatctcagtagcatgatacattccacatttccatgtggttgtggatatagagtcaagttccatattctaatttgatgtttagatctgtaatactatgaaagttatagaactcatcagtgtcatcaatcgcaataaccactatttatatagtagagagtaggaagtgctaaaatgtaaatgttctagattaaaactagactgagaggacctttaagaagagcaaaccatgacagatgaaaatttggattatttgtaaaagagcttccttagtccttaatatgtttaacaacccattatgtggagaaatttgtctttatgtctgaacttacactgcagcataaattaaatccctcttattttgtcaacagtagttaataagtgcaatggcaccgtctgggctcactgcaaactctacctcccaggttcaagtgattctcctg

SEQ ID NO: 4163 - DNA, 1222 bp, Homo sapiens
gaaattgaaccatataaacatgtagagttaaaatatcttgttttaaaaatataccgcatacaagaagaatagtaaaagacatacaaaggtagggttttcatcccaaagtatttgttgctgaaaagatcttatgttttgtgtgagatctatgaagtaaatttccagataaaactgttctaaataaatgtaaaattgattaaaatgctacaaattagcattgttgattttcttctactccaatcatgaatcttatgaaactaaaaaaattaaataattggtttagaaagcacttcatcattcaaatacttatttattaaaaagatttgttttaaattgacacataattgtgcacatttatggggtacagtgtggcatttttatacacctatacgttgtgtaatgatcaaatcagggaattagcatatacagcacttcagaaattaatttctttatggtaagaacattcaaaatactctcttccatctattctgaaatatataacatgttattgtcaactatagtcaccgtcctgtgcaatagaacaacaaagcttaaaggataagtccttcccatctaattgtaactttttacttgttgacacatctctcctcattcctcactcctccccatcttccagcctctggtagtcactgttctactcttacctctatgaaatcaacattttttgattccacatatgaatgagatcatgagatattcttctgtctctggcttatttcacttaacataatgtcctccaggttcatccatattgtcacaaatgacagaattatattcttttttatgtttaaatttaacatgacacctcattaaaattagtaattagtaaaggaatatatatgttaatacttttgtttatattttggaaaaaatgtatcaaatggtaggagatcataattcctgttaataccataaaatttttaattgcccaattttttttttcaaaacgctttaataaaatccaaagtcaaataaatacttattatatgataggctcaataaagttcccccaaagaagtctatattctaattctcagaatgaatatgtcaccttaacagtcaaaagagatttctcagttgtgattaagtatattgagatgggaggttattctggattatctgagtagttccaatctaattacaaatgtccttataagaggaagtcaagagagtcaatgttgggaaggggatatatgacaat

SEQ ID NO: 4164 - DNA, 1174 bp, Homo sapiens
tgggaggctgggacaggaggcagctacttgggaggcttgaactcaggaggcagaggttgcagtgagccgagatcatgccattgcactccagcctgggcgacaagagcaaaacaacgcctcaaaaaaaaaaaaaaaagtctctggaaagtgagaatatagcaaggtgaaatagagatgttcattatttttactttgtacactttttatttatttagtgtaaatgtgttataatcctgttttagtttattaattttaaaacaaagaagattataacttgggaaattatgcttatttacttattcttgtttcttctttcttgtttctcatgactttcttaccaattaatatatattcctaacttcgaattacccatggctatcaaatttgttctagtgatgatgaggtattaggtctttatctgttttaatatttttggagtgttgaccatttgacatattcttgtagaatgtacttgaaaaaatcagcatgtagtttcagagaagaaaaatacttgaaactaagcaatagtttgctacccagcatactgggagcaaaattccttatacagttagtaagaagatgaaaatcactttgaaaagcctggattttatttctgtcaattttcacagagcttagtagctgatgagtattcactgtgaactaagtgctaaaccagacacaaaggaaaatttgcacttgcctctgagaacttacaatgtggttggggatttacaagacacacgcaactaagtccactttagaaactcacagagaaaataatagggcaaaccttagacctaacgacccaaatagataattaaggtaagcatgatttttcaaagtaagtttcctcaggaggagctttctgaagacatgcgtttaaagtcaagttttcaagaaaaagattaattcgcaggaaaaattggggagtgtattccagatgaagatgaagtttaacaactatttcttgaatcgatgattacaattacatgcaaacatgatcgttgaaagaaagcaataaaagtatttatgtgagatctctttcctttgtattccatttaaaaattatagttgaaatctggtgaaacagctgccaacattgctagagagctggctgaacagacaagaaatcacttgaatgctggggacatcacctactctgtccgggccatgg

SEQ ID NO: 4165 - DNA, 1599 bp, Homo sapiens
caggcctgtaatcccagcactttgggaggccgaggcaggtggatcacgaggtcaggatatagagaccatcctcgctaacacggtgaaaccccgtctctactaaaaacacaaaaaattagctgggcgtggtggcaggtgcctgtggtcccagctacttgggaggcggaggcaggagaatggcgtgaacccgggaggcagagcttgcaatgagctgagattgcgccactgcactccagcctgggtgaccgagccagactccgtctcaaaaaaaaaaaaaaaaaaaaaaaaagaagctctttcccatcttgcaagatggcgggtgaaaaagtttagaagccagatactaaagagaagaaacccgaagccaagaagactgatgctggtggcaaggtgaaaaagggtaacctcaaagctaaaaagcccaagaaggggaagccccgttgcagccgcaaccctgtccttgtcagaggaattggcaggtattcccgatctgccatgtattccagaaaggccatgtacaagaggaagtactcagccgctaaatccaaggttgaaaagaaaaagaaggagaaggttcttgcaactgttacaaaaccagttggtggtgacaagaacggcggtacccgggtggttaaacttcgcaaaatgcctagatattatcctactgaagatgtgcctcgaaagctgttgagccacggcaaaaaaaaacccttcagtcagcacgtgagaaaactgcgagccagcattacccccgggaccattctgatcatcctcactggacgccacaggggcaagagggtggttttcctgaagcagctggctagtggcttattacttgtgactggacctctggtcctcaatcgagttcctctatgaagaacacaccagaaatttgtcattgccacctcaaccaaaatcgatatcagcaatgtaaaaatcccaaaacatcttactgatgcttacttcaagaagaagcagctgcggaagcccagacaccaggaaggtgagatcttcgacacagaaaaagggaaatatgagattacggagcagcgcaagattgatcagaaagctgtggactcacaaattttatcaaaaatcaaagctattcctcagctccagggctagttgcgatctgtgtttgccctgacgaatggaatttatcctcacaaattggtgttctaaatgtcttaagaacctaattaaatagctgactacaaaaaaaaaataataataataaaaaataaaaaaataaaaaaatactcaaataactcaaatacatgtattcatactcttgaggctctacattaagaaaataattataaatgtagttaaatatttgtgtaaataaaaatttattaaaatgtcattccacataatgtagtctaaatgtccaatactggaaaaattattaaataaattgccagaataaatatgtctctctctatatattgctgtatatatatatacatatatatatatacacatatatatatacacatatatatacacatatatatatacacatatatatacatatatatacatatatatacatatatatacatatatatatacatatatatacatatatatatacat

SEQ ID NO: 4166 - DNA, 1141 bp, Homo sapiens
cttgaatacctatcattattagattaatcatcctaaagtgtagatataatttggttattctttgctcaaaaatttgcagggccatttaatagtttcctaatatctattgcagtagttctcaaattttagtgtgataataagcagcatctgggaagctagctataatgcacatattggaggcctgctggcagagattcctatttattcgtgaatggggctcaggaagctatttttaacagctatcccatgtaagttgaaatacatttgttctttgggctaatatccaaattttttaaccttaatgataataatcaataacttgtttctagaatactttttgaagtctttatgcaccaccccctaaacatatacatgctttaatgatatgaaaccattctctctaaataccaaattttccagacttcactgattttcttaatcttttatttccagttaaagtatactgcctgttaattgctgcctatcccgctcatgtatggtttgatacttagctggcagaggaaataccatgatcacaaaggtggttttcccagggtgaggtttatccattaaactcaggatgtgctgacccctgcgatttccccaaatgtgggaaactcaactgcataattggtgatagtgagagactgcgttctcactttcccctaaggggggtgtggggatgaagtatggtttgaatgccaccctctaatgaagcatttcccatcccctgacccaatgtgagctctcctttctctgaaaccccgtagtattgtaatagggtgaccctgcatgatattagacctaggaatttttctgaattttagtgaaaaagacagaaaaaaacaattaaagcagaggccagtgttctagatcctaataggcaaagtcctagatttatctgtaaggcaaacttccctttgttctgggaagcaagttggacttagtgaagcaccagtcatctgtgcagtttgtgcttacatgccaatctagacagtgtattcacatagagaagttagcagacaatgatgtgctgcttcttgattttaaaaaactctaaatatgattagattcagtgtggtatgcaaaaatgaatggtgactgtatgaatttgctaaggttgccaaaaaaaaaaaaaaag

SEQ ID NO: 4167 - DNA, 1178 bp, Homo sapiens
ttgccaaggcatttgtaaactgtcgtggtgcaggtgggagcatctcttaacatgctaatgcattgtaacaattagcatataatgagcagtgaggacaaccagaggtcactttagttgctatcttggatttggtggcttttggccagcttctttacagcatcctgttttatcagcaaggcctttatgatctataaagaggtcttttgccaacctcgtatctcatcctgggaatgcagcccagtaggtctcagacttattttacccagcccctattcaaggcggagttattccggttccagtgcctctcacagtgccaccatagttcactgtgtaacctctaactcctgggctcaagtaatccttctacctcagcctattgaatagctaggattacagttgcatgccactatgcctggctaatttccttttacattttttttttttttttgagacaggatctcactatattgcccaggctggtcttgaactcctggactcaagagatcctcctgcctcagcctctcagagtgttaggattacagatgtgagctattgtatctggcctaagctgagtctttctcagtctctcttttttttttctcctcttacgtgagacagaaacttgaagtccgtctactttttatatactattttttcttgcaaaacacattcatgaacatttaatttgattaagatatatttttaggttaaagatttttaaataatgaattacagcccaatttgtttataaatcatatttatttgctagtttgtttcataattctgaagtttaatctttcctatgtaattttctaatttaatcctaatttctaaaaattttgtgtccaaggtgtttcttctggaaaataagaaacataaagtttttggccttttttcaaagaagcactgattttgacatgtactcttggatgcttttctggtgtttttctggcatttcagtcacttttctggtgtttttgctttatgcattttgctttctccaatatctatgcgttaaagtgggtgtaggtgtgaatgtatggttttgtgttccttttctagtgtaggcattttattgtactatgtaatgctagtatacaaaaaggtatttttattaaaatcttaatattagtagcaaactgttccagttatctattactgtgtaaaagcaacagcca

SEQ ID NO: 4168 - DNA, 1157 bp, Homo sapiens
ggttaggaaagttagcatttatgttcttaggttgaagtcaattgcttggtgatatttgctcaattttatattttgttttgtttttcactttcagaaatcagcaaggctgcttctgaaatgcttaccaacaactgtaagttaaggaccttttaattataaatttgatggactcacaggtattttctcattatttttctattaaaaatacttgaaatatgtcatgtggaaatcccataacacgctttccgaattactagatataccagatattgacttagaatttctctttgaaaaacactggtctattaattttaacatttattaaaaaatatataaaaagttaaatgaaaattgattccaaataataaaactgtgagtgaaaaatatcatatttgaatatgttaaaatgagaaagattgaaggaaatgacaatttaggataagaagaaaatataaaaccaggctatataaaatatatttattaaagataaaaacagttctgcatcttaaaaattattattattttttgctttagaggtgggatgttgctatgttgtgtgggctggagtgcaattcacaggtgcaattacagtggactatagcctggaactcttgggctcaagcagtcctcctgcctcagcctcccaagtagctgggcctataggagcatatcgctgtcctgttacatcttttaaataaattctctttagagtatcatgttttccacaagatacatttatgcattcattcactccatggatatttatggagtatcttttgttcacatggtgtcttacagacagcagtgcatatactatgcaagatgtagacaccaatgaggcaaagctcctccttcaagaatctgcttagagagacaagagttataacacatagacacaacaaaaaatagtggttgaaagatgcttgagactggaaaagaggataagtaagaaccactcaaaccaagatagaatacagaaacatcacaggagtatcttgtaggaaagaaacgtcatcaattaggagaagttgaataatcactgaaaggtttcaagtaatttttaatgatatatttttttataatgcgtaatcaaagatacctgctctcgtgtaaataaatcctttctctaggttgtgggagacaagtagccaacagta

SEQ ID NO: 4169 - DNA, 1258 bp, Homo sapiens
gaagctgagtcaaatgaagttcaagtaacttgtccagtcccacatcattatacagtggtttctaagacttgaatcaaggccatctggatccagagtgccagctcttaaccaccaggttatattgactctcctatttggggtacagatattttccaagtgtagtatcacagtttcccattatgtagatatatattaattgtaattttattacatatataatttaaaatatgtagaattattattccaggtgtgtatcactgcataacaaatagttttcaaatgtagggccttaaaacaactgtaatcattttattatcatctctcagaatctgtgtgttaggtggggtcagttatgtgttccttcacagagtttcttaggtagctacttttctatggtgcctgggtctgtaattatatgaagatcattcacttacatacttagagattcgtgttgaaaggctcaaagtgctagtgggctaccaggattccttaggcatatatttgtatctctctacaaattgtcatttattatggggactacaggttgagttatttagtaatagtgagcgaaaaaaaagacatgaagagaagaaacagacggtggccatggaagtcagaatccgctaaggagtgtgtaacaactcacctgccgaatcaactagccctgaaaatggatggcgctggagcgttgggaggctaccaggctgttgccggcagtcgagagtggacggcagcagcctgggcagtgcgggcgtgcgagtgcagtggggggtcctcccccctctcttcctcccccatcccccggagctctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacttaggaatccagcttacaagggacacgcaggacctcttcaaggagaactacaaaccacggctcaatgaaataaaagaggatacaaacaaatggaagaacattccatgctcatgggtaggaagaatcaatatcgtgaaaatggccatactgcccaaggtaatttacagattcaatgccatccccatcaagctaccaacgactttcttcacagaattggaaaaaactactttaaagttcatatgaaaccaaaaaagagcccgcatcgccaagtcaatcctaagccaaagaccaaagct

SEQ ID NO: 4170 - DNA, 1194 bp, Homo sapiens
gtacccagaaatatggtattgggggtgggggtgaaatgagaggaaagcaatctgattaacttccagcctgataagcagaaaagagaaaacaagggagcaggaaaactacgctagcactagactgccggtcgcaagcgccgggtacacacgcagttaaacctcaatggaacgcccccgggacttctccggggcgtaaagcgcagcgccctctattggccatcgggacctcgcctggaggtgccgtcaggattccgtcccccagccactcccaggcactcgagagtaagcgcattagcccgagaaagcgttctgtggaacggaacttccttatcctatcgtttccacacggaaagattttaattcaccggaatcgactggcgttaaagggcacagtgaaaaggaagttggtatcaacgtgatctcgactaagggaccgagcggaagtcctcaatcgtacgccacgcggagagcatgctgggggccggaaggaagaggaaattccagtagccgatcaggagtctgcaaactccggtggtaggggagcgcgctgctgtttagagccacgagttaccggagcgcctgattcctgcgccgaagtcagtggtggccgaaagtccggagtcgctgtaaaacctgagattgtgagccatggtggggagatcccggcggcgcggagcagctaagtgggcagctgtgcgagccaaggcaggtcccacgctcaccgacgaaaatggagatgatttaggattgccaccctcaccaggggacaccagctactaccaagatcaggtagatgactttcatgaggcacgatcccgggccgccttagctaagggctggaatgaagtacagagtggagacgaggaggatggcgaggaggaggaggaggaggtgctagccctagatatggacgatgaggacgacgaagatggagggaatgcgggggaggaggaggaggaggagaatgccgatgatgatggtgggagctccgtgcaaagtgaagctgaggcctctgtggatcccagtttgtcgtggggtcagaggaaaaaactttactatgacacggactatggttccaagtcccgaggccggcagagtcaacaggaggcagaggaggaggaaagagaggaggaggaggaggcacagatcattcagcggcgcctagcccaagcgctgcaagaggatgattttggt

SEQ ID NO: 4171 - DNA, 1129 bp, Homo sapiens
attaaaggtactataaataactctgagaattcacataaatggttgtatattttagtttagtgtatgtttaatatctttgatttatttttcttccacaaccgtgaatctataaatgctcaggtaatgattttttttttaaaggttgtaaatcagattctgtttgagggataagaggtaggaaaataatagaaaaaaggtttttatcatttttttccattagttcctagtatattgcaaattgaagagtacctccttagttttttaaaagttttattttaataaaatatatgctagatatatattttgtaaaatgcatgctctatattcataggtgtggactggaccctgggcacctcacatgaacagtgtgcatatgaaccagcttggctgatgaggatcagcttgttagcctgcagattccttttcatttggaggaaatcacaagtggccgaaaaaaaaaattatgctcccaaatcattctactgatgtgcttgactgaagtgtgtaggctttttgcagaagatcttactaactgacctattttctgtgaacatttgtgactgcccattccccatcatcatccgttttaccttagttagcatttttcttatcatttttctttttttctttccctcttcccctttggacataactttctgttgaagctgttctttggctggttggttttagtactgtaaactgcttctgagcaaacacggaaatttagcaaaattatgtaaacttgatcctgaagttttagaatggcaaataaatgtacaattgtttacataacagaaaaggctaagcagaaagtaaatttcaatatgtcagtatagaggctctactttatgtagacttaaattaatgtgagatatgtaccttcatattcagaaatctggatgtttccttcatacattaaactattaataagcataacttttctactggtgtaatttaagtataaagtaaaataatgggcattatcattggatgtttccccacattggcttttaaaatacccatcttgctttctttttggtttatttgtagcaaggcacatatagaagaagaaatttctggcttttccatgttgttttattaccttttctcacttttaaaactaatacag

SEQ ID NO: 4172 - DNA, 1117 bp, Homo sapiens
ttgctgctcagactttccagcagatccgtccaccaaggttgcccatgacccactttggaggtacttttccaccagctcaatccacttggggtccgtttcctgtcaggcctttgagccctgccagagctactaactcgcctaagcctcacatggtgcctcgccatagcaatcagaatagcagtggttctcaggtgaattcagcaggttctttaacttcaagcccaacaactacaaccagttcatcagcttcaacggtgcctggtacatctacaaatggcagtccaagttcaccttctgtccgaaggcagctttttgtcacagttgtgaagacatccaatgccaccacaacaacagtcacaaccacggcaagcaacaacaacactgcacccacaaatgccacatatcctatgcctactgccaaagaacactatccagtatcatccccatcttccccatcaccaccagcccagccaggaggggtttctagaaacagccctttggattgtggatcagcatctccaaataaagtggcatcttcctccgaacaggaagcaggtagtccaccagtagtagaaacaacaaacactagacctccaaacagcagcagttcttctgggagttcatcagctcattctaatcagcaacaacctccgggatctgtttctcaggaaccaagaccacctcttcagcagtctcaggttcctcccccggaagttagaatgactgttcctcctttagcaacaagttctgctccagtggcggtgccttctactgccccagtgacttaccctatgcctcagacaccaatgggatgcccccagcctactcctaaaatggaaacccctgctattagaccaccccctcatggcacaactgcccctcacaagaattcagcttcagtgcaaaattcatctgttgcagtcctcagtgtcaatcacattaaaagacctcacagtgttccctcttctgtccagctaccttcgaccttaagtacacaaagtgcttgtcagaattcagtacatccagcaaataagcctattgctcccaatttcagtgcccccttaccatttgggccctttagcacattgtttgaaaacagccctacttctgctcatgc

SEQ ID NO: 4173 - DNA, 1165 bp, Homo sapiens
gatttttgagatgaactttatttaagtaattaaaacttgatatagagtttgaaaaatattgagtactgtttcttatgatactaaatgtaaacatcttagaagcttttattaagcaagctaatacatgctttaagattgaaagtttatcctaataacttattaatcaccttccagcctaagtcattatgttgagtgaaatacaaaaaatattctaataaaacatttctaatggagtcttggtagtatctcagagacttactaaggttgagaaaaatggatattttaaacaatccttcaaaataatcttagattagaattatatatcatctccaatttttctgtcatttaaaatatatatttttccatttgttttccccatacctgcacccctagaactggtagcaaattgggcatctctcctctgatgttagcagctatgaatgggcatacagctgctgttaagctcctgttagacatgggctctgacataaatgctcagatagaaaccaatcggaacactgcccttactttagcctgcttccaaggaagaactgaagtggttagtcttctgcttgatagaaaagcaaatgttgaacacagagctaaggtaagaaaaagtctgagatttacacatgaatttattgctttgatatttaagatatatagtagcaacatgttgattataattttagttctttctagtaacatttatctcctatgtatatatttaattagaaatcattctgtataactcagtcaaacattaactcttgaaaatacctgagtgataaatttttataggcaacaatgacagtaggattatcagctgaaaaagagagactattttgaaaaggaagggaatggaacatttattgagtaccagttatatgccaagtgcttgcatcttaaacagatttttttttctttctttcttttttttttttttgcaataccgttgagattaggtagaattattttcttttaatagatcagactaactcaaaggagctaataagggtcagtgattaaatttagttgtgaatcttggtaacagctgtatcatattccttcttcaagttgttattctttacaattttagatctttccagtctcttacgtgtcattacttttaattttacactaaacttagactggtctcacacca

SEQ ID NO: 4174 - DNA, 1141 bp, Homo sapiens
aagcagtcctgttttaggagtctcaggctcctaaagcgctagcattacaggcgtgagcgactgcacctggcctaagattgaaaatgtttaagaatgatattttctactgcttcatgaaggaaactgggtttttctttttctctcttttttttttaatacaaaattgtgagtgcatgcagagaagaatatgataactactaactagtacagattggtatcatggccttgatcgatgttaagaaactagcaggtttacccaccattgcttttgtgtcatcagtgcaagtgtcaacacagtgcaacaggcaaataaccatcttagttgtttaaaaataattttgacctcacagactctttaagagtcttggagattctcatagatcccatggaccacacttgcacaactgctgttttacagtatattgcccagtttacaagtttacactcattaagggagtaaaagtaagatttagacaagtctgcttgattcaaatgtattctttactattttataaaatttattaattaatcacatagtaccaacttctccagtctctttgacacaccctgtaggtcactctatcctttaactacaatatagcaattttaaagagccggagaaaaaccttgtgtggaaatctgtgtgggaatttgaatattgctttaaaattatcagtccaagattagtcattcagaatttcaggaagtcaggagtttgaggattcctgaaggaagtagtgaatgcaaagagaagctattaatagaaataagtagaaaaatattttgcttgtggagtaatattaagtggtaagtgaaacagatatatgaaatatttgtcaaatttgagtattttttttgaaggctataaagtgtctttcctatccttcccttctttcacaggtatcactttggttttcatctggtcaagagaagttctttctcttattttatatagtctatgaaaatgaaaaataaaattcagataatgtagatcttcctctatttaaaaactaaggtttttcaaatttcttcatatagaggtaaaattgagtcatttaagatttacttctcaccttcttttgtttatataaatatcaatgtttatatataccatatttttgcaacaatttatttttgatat

SEQ ID NO: 4175 - DNA, 1127 bp, Homo sapiens
ttttttttttaatttaggagaatcccttattttaaatttctaattctattaaatttggttatcttattgaatttatagattgctagtaaatattttcagttctaattgtacattttggttaattgttttaggtggagctgatagtagataggttaaggggttgggattctgtaatgaacagttcacaaaataatggttgtattctgaatttgttaagtttttagaatttatgtagaatatgttcttaaattccttgagaacttaaaaatttgtagtactttatcatactgttaataaagagggagagataagggttatgggaaatgcacatccttttctgactcttaagtccttttctgggaatatgaaagcaaaccatatgcctatggcgtctctgctataggcttagcagataatactagggttctagataaaatgaaaagtatgaaggcaaagatttgatcatgctgttttctaaatctcaggacctttagaatgtatctctaactcactttgtggactcctttcacttgtaccttttcttccttttcttactctgcatccagatccccacctcacagtccaagatcctctctaccactcagtccagctttctggctgccacctaaacttcagtacctggcttctcttggccagatcgaaggactgtaatatgatttaagttgtgaatatgccttagtatgtgagatgtcttttcatatgagggagttcttaacctactttagcttaatcaccagatccttttgtcttttatgctaacacataaaaaacacaggcttggtattacagctttttgtcttctatgcatgagcagttttgttttgtatcccagggatcccagaagaacagctttgcttggccagggtacccattcattggcttaggcaacctagaatgttaagattcatatatcttaatcaaatacgaaggtcttcctgacctcactaccataagcagaagtttttctgaaaactttgatcagagagcaagtaggaagaagggccagattccagtttcattaaaccacaggcatatgaatacttcacagtttctgtgcttgacaaaaattacatttaattctgaaataacccaatgcctttgtattt

SEQ ID NO: 4176 - DNA, 1099 bp, Homo sapiens
gaagcagctgccttttccatcctgggaggccccaaattactggactcttgtaggtcggagtttgccactgagaaagcttctttttagtagcactgttttcatgtctgtctctgcttgcaaactgctttataggtgaattgatctttcttgttgatctttaaatagccaacacaccatatttcgagtttttctaactgcttttcttagaactacaaacttagtaggcatatgatgtgcccttccaattattgcaggcaagagttttactaaatgttctgcaactgtatagcacagatcattagatctccagcctgagatgtttccttgctacctgttctctaagccttaccagagattttaggagtttgttagagcagcgtgtcatttccaattaactgtattagttaaggtataggatggatcatttgaacaaagagactccagaacacatcaggcaagatagaagtttgttattcttttatgtgctactccagaggtagaccttcaggttattcacacatctaagtatctgctgtcttgcacttgatacaccatcccttaatcagtgctgtccaatactgtagccactagccacaggttgctgctgagctcttgaaatgtggctagcgcatctaaggatttgagttaaattttttttaatttttaatttaaatattacatgtagctagtggctaccatattggagagtgcatatgtagaatatttccatcacagaaagttttattggacagctctgctttggagtgttcatctacaagatctactgtggctcactagcatcatgtccatgtttcagcctgttatgggctgaactgtgtgtccccaacattaatattaatattttgaagccctaaccccaagtatttcagaatgtgattgtacttggagataagtcctttaaaaatgtaattaaggttcaatcaggtcatatgagtgggccttaatccatctgactgatgtacttataaaaagaggacatttgaacacaggacaccggagatacatgcccacagagaaaaggccatgtggggatacagcaagaaggtggtcatctgtaagccaaggagagaggcctcag

SEQ ID NO: 4177 - DNA, 1218 bp, Homo sapiens
aaggacatgcccactgaattcaggtcctttgagtaaaaaaaaaatcttctgctgcacattttgtttaagtgttactgtttctgcctgttaatgctgggaacacaaatagtgcaatttgtgcaattggagaatcttgccttttttcttggctccccccaaaaatacaaaccaacagaaacttgttatgcactcatcaaaatgtactaatgggtactctgaactcattaacattgacatctgcaacaggaggcaacagggaaaaaatctcatcttcttttccagtagaaaatagtttgtgaaatgatgagggcattttatctgcttgctgtgaccagcgtgtgtacacataaaccttaacaagactacaagtatattccagaaggaaatcattttagttatgaactaaataataaaaattagaacttcaaatgcgatggtcttgactattagaccagatttagtagctccatatctaagatttttctacctgcccctcttcagtacagggatggctggctgctcaacacactcctcctccccttttttcctttctttaagctgtgtacagtgaaaattgtctttactgtatttttgttctctggtaatgtaataagcatgatggtgccttctattaatacatcattccagtcttgctggtaattttgtacagtatagtgtatgaattgctgtgctgcaaagccaaacagctgcaaaatgttgaaaaatcatcgaaatgtataaaaattgcagtatctttaaaatcagtaaaatggactagcatattatttatcttgttcttcagttaacaactttgtgttctctgtgggagggagggagtcctgtgtgtttgtggggagagggaaggaggaagtcagttatttgagtaagcctctagttgacttttctcttagcctgaatgtggacgttgaaacatatcacttcagggcttggaaaagtcagtcaacttgacgtacatttttagtgacattttaaaagcagtcagattctataaatggcaagtaagcctgaagtgaggatactgcaattttcggagaaaagaacagcagctctttaagtgtttgcattttctatttggggggcagggaactgtcattcattttgcacaattcttgaactgatgtcagcacccgagtggctcctgaatttaagtctgggacgacatcttttatttttacatgaatctttaaacaattctgt

SEQ ID NO: 4178 - DNA, 1215 bp, Homo sapiens
ctttgtttggtggtaaaaagggttactagacacccctcattccactgccactggagggcgcatttctcagctcttgctcttcaaacctgctgaaaggaattcctagatctaaacaccaggtacacctctattttcaagtgtcgtcaggaggaaacccatcaaaccctacatttagcttactagagaaatacattgttctgctgtgtcagtttggcgagtaacataatgtttcgttattaactctcaacccctgtgttttcagtttttttttttttaacatgaaaaattgtcattttctctaattggtatgcctgttcctttggcagtgaggttgtcagtacacatgcttctggaatagtcttgtaaatttcttgaggctaaaaagcacaggtctagttagctaactgactcatgcacctctccccttggattccccacaggtctcagattcagcatttaaaattgaactcgtcatctttccctgcctcccttaaagaaaaaaagtcaatatgctgcttctactgtgtgcgtgccgtgctcagtagtaccactgtccaaataattgcctaagctagacagaggaagctgggaagaatcttagactctggctttccacccacacatgtccaatcaatagtcatgtcctatcatttctatttatagaatatttctcaaataggtgttctgctctccatcctctgtgcctgtgacatagattatgttcttctcatcatttctcattgagatgacagcaacagcctcctaattagtttgtctgcattcagccctggcttccttccagtccaatctccagtccatccttgggtgagactaacaacaacaaaacatctgttcatgtcattcctcttaaaatcctccagttgttccccattctgtccagaataaagtgcaaactccttagtttgtcatacaggcctgttatgatttagctcctgcctactttttcagctcctgcctcccccacatactctgggcatttttctcagacctggatatgcccttcccttcctttctcttcatcaagcaaactcctgctaattccttaaggctcaactctgacatcattcttgaaagctttccctaaaatgtaggtacacatctatatgttagcactttgcagttattgatactgtatatggtgtacattgaataaatgcttgctaaaccaaactgttaagggcaggactatgttat

SEQ ID NO: 4179 - DNA, 1232 bp, Homo sapiens
cgttattgatgtatagaaatgctactgatttttgtacattgattttgtatcctgaaacattattgaagtcgtttatcagctctaggtgccttttagtggaacctgttgggttttccaggtttagaatcatattattagcaaagagatagtttgtcattttttcctattcggatgtcaattctttctcttgcctgattgctctgattaggacttcctcctttaaattttaagtgtactttcaccatcctagttctatgctgtcttctttttaatcttttgatagtttttctttttttggaaacagggtctcactctgttgaacaggctggagtgcagtggtgtgatcacgtctcacttcagcctcaacctcctatactcaagcaaccttcccacctcagcctcctaagtagctgggactacaggtacaaggcaccacgcttggctgatttttaattttcttgtagagacagggtcttgctatgttgcccaggctggtcttgaattcctggactcaagtgatcctctcaaagtgctgggattgcagccatgagcccctgcacccagccagtagtttttcattttcacattcctcatctcagttttttctttcctagtcactcctgttcccattgtgtcttttttggtcatctttgtgtagcaatgaatataaataaatagccctattggctagcaaaaaatgttttttttaattgaccagttgttagactataattctgattatgcccaatttaccagttgttaaatggattgtttgtcattttcatgtttcccttggtaagtgaaattgtgaacatcatgtagcaattatcattttttgattttacaaaatggcagacaaaatgagtaaagtttaagttctctttactcctgtcaccaatttcagttctctttccagagataaccactattactagtttggcataaatccttccagacctttatacgtaatcatgcctctgtgtaatatacaaatatatatttgtattagcatatttattcttatttacataaatggtatactgtttattgtgttctacagcttaccttttttttttttttttttttttttttttgaggcaaagcctcattctgtcacccaggctggcgcaatttcagctcactgggttctcagctcacctccgcctcctgggttcaagcaattctctgcctccacctcccgagtagctgggattacaggcctggctaatttt

SEQ ID NO: 4180 - DNA, 1214 bp, Homo sapiens
agttaactgatatatctcattcatattagaaatgacagagagccttggcatcaaatcaaagaaatcagatggcttatattctactgtagttactagaatacaaaatttgtctgggcacagtgctcacacctgtaatcctagcactttggggggctgaggtgggcagattacctgaggtcaggggttcgagaccagcctggccaacatggtgaaaccccatctctactaaaaatacaaaaattagcagggcgcttggtggcaggcacctgtaatcccagctactcgggaggctgagacaggataatcgcttgaacctggcaggcagaggttgcagtgagccgagatcgcaccattgcactccagcctgggtaacgagcaaaactccatctcagaaaaaaaaaaaattatcagtagtatatattgttaaatgttgaatgtgacatgaacagattttcacaatattaaatacgtctttttcctctaggttgaagaagaggatgaacttgaatctggagaccaagaggatgaggatgatgaaagtgaagatcctggcaaggatctagatcatatctagttttcaaatctctaggaacaatagagattatatcataactctgaagatggactctaaactttggtttacctccatggaaaataaagatttagaaaccaggtggaaaacattcactattaagactattgatatatttttgtaatgttgccacccatgttgaaaaccttaaaactgaatttatgtagaacacacatcttttatttaaatccatctgaactgtcccaaaatgtaatttgcaaagagcttcaaacaccaaaaatataccattttaaggcatgtggtgacaatgctatttgccttagttcattcgttgtttactttgcaaaatttgtgacttttaagtactaacacatttgattgaatgtgtattgaattggaattattatttctaaattcagcatttgagtccttagttgatgattttcttttaaagaaattagtttatttaaaagcaagatagcctgggttgggagttagtgcatatcatcagccctccatctaatgtgattgctaagatgtgcaggataggacagcttagaatgagtgccttgacacctacatatggctgcattccatacctcagtgaagaagccgaaggatgctgacacacagtgatgtggagggcattccggagaaactt

SEQ ID NO: 4181 - DNA, 1522 bp, Homo sapiens
ccttctagttattaaccaaacattttaagtttgttaaatagtttgcaaaaatgtactagaatataatgcaatgctgacttttctattatttatttgctgcaacagagtagcaaatattattaaaaataatatcttaggctgggcacagtggctcacgcctgtaataccaacactttgggagctgaggtgagtggatcacttgagctcaggggttcaagaccagcctggccaacatggccaaaccccgtctctataaaaaatataaaaaattagtccatcgtaggccaggcgcggtggctcacaccggtaatcccagcactttgggaggctgaggcaggtggatcatgaggtcaggagttcgagaccagcccggccaagatggtgaaaccctgtctctactaaaaatacaaaaattagccgggcgtggtggtgcacgcctgtagtcccagctacttgggaggccgaggcaggagaatcacttgaacctgggacgcggaggttgcagtgagccgagatcgtgccattgcattccagcctcggcgagaagagcgaaactctgtcttaaaaaaaaaaaaattaggccattatgagacaggttagttttaccctactgatgatctgttgttgccatggtaatcctgctcagtaccaacccgcaggttcagacattcggtgtatgtgcttggctaaggagccaatgggacaaagctaccctctgtgggattttgactgaatgcctctaagtcagaatcccgcccaggctgaaccacagggcagcgctgcagggcctcagttggcctcggatagccagtctcccaatggcctgggatagccagtctcctgccatccccgccggcccgcagttcggctcagcaagcgcgcaggtacccgaggccggtgcggagagtccctcctcctgggaaaccgggtgcggccggaaaggcggccgcccctcacccgtcatgcaacggcacgttcgtggggaacctgacattaaactgttcgtagatgacctgcttctgggtcaggatttcgcactgagcagagcagctccctcgctgtgatctactgaaagtcagccctcgacacaagggtttgaaaaagaaaaagtgaaaaaaataaagaaattagggcatgttggcatgcactagtggtcccagctactcgggaggctgaggtgggaggattgcttgaacctgggaggcagaggttgcagtgagcctagatcgcaccactgcactccagcctaggtggcagattgagacccccatctcaaaaaaataaaaataaataataatattttaaaacttcaagtaatatttaagcatttgttcaattgatactgaatttgagcttctaaattaagcttcagagcaagaaagcaacttaatttgaacattcataccttataaaatataaagattaagtcatccaattggccatgtaagtctcctaacaaagatagaaaaagaatatcaattctgattgttccttaccagtgcttctgatttttattataaga

SEQ ID NO: 4182 - DNA, 1248 bp, Homo sapiens
tttgaaaactggcacaagagaaggatgccctctctcaccactcctattcaacatagtattggaagttctggccagggcaatcaggcaaaagaaagaaataaaggatattcaaataggaagagaagaagtgaaattgtctttgtttgcagatgacatgattgtatatttagaaaaccctatcgcctcagcccaaaatctccttaagctgataagtaacttcagcaaagtctcaggatacaaaatcaatgggcaaaaatcacaagcattcctatacaccagtaatagacaagcagagagccaaatcatgagtgaactctcattcataattgctacaaagagaataaattacctaggaatacaactaacaagggatgtgagggacctctccaaggaaaactacaaaccactgctcgaggaaataagggaggacacgaacatgtaagccattaaatcttttgaagaggcagctttgctggtggtattgtcttgtgccacagtgagttgtaagtgaagtttggaccaaaaatgagtttatgaagactggtgggcaggagctcaagagctacaggcttgtcctccagccagtgcctgatgtgccccagctgggaagctgatgaatagctgacatctgtatctctggacctgaatgttgatccctcgcttcaggttgacatacctgatgtgctcagtgagagagataaagtcaaatttacagtgcacacaaagaccacactgcccatgtttcagagcccagagttttctgttacaaggcaacatgaagactttgtgtggctacatgacactcttattgaaacaacagactatgctgggcttattattccacctgctgctatgaagcccgacttcaatggtcctcgagagaagatgcagaaaccgggagagggtgaagggtctatgaccaaagaagaatttgccaagatgaaacaagaactggaagcctaagtgttaggtggaaaaatactaaagaaatgtttggtggcttcttcaaaagtgtggtgaaaagtgctgaagaagtcctttttactggagttagggaggtagatgacttctttgagcaagagaagaacttccttactaattattacaataggatcaacgattcttgtgtgaaagctgacaaaatgaccagatctcataaaaattgttgccgatgtctatatccacactgcagcctgcttacattgcctggctttagaagagcccacagtcatcaaaaagtacctattg

SEQ ID NO: 4183 - DNA, 1248 bp, Homo sapiens; identical to SEQ ID NO: 4182

SEQ ID NO: 4184 - DNA, 1176 bp, Homo sapiens
attggtgaaagaaatcagaccaatcattgcctctgtggttggagactgactagggcacaagggatgatgtgcgctagtgcccttttgatgcatgaaagttgtaaatttctgggatgatggaaatgttctatatcttaatagtgatatgtgctatgtggatatatgcatttgtcaaaaactcattgaactgtttccttaagatctgcacattttactgcacgtaagtcatgccttaaataaaatctgataccttaaataaagtgagagacaggaagaaattggctattggaagcacaaaacaaaattgaaagtttagaaatggacccattagatatataataatttagtataggatgaaagaagaatttttaaaggtttttttagaaacagagtctcactatgttgcccaggctagagtacagaggttattcccaggcacaataatggtacactgcagcctcgaactcttgggctcaagccatcctcctgcctcagcctccgagtagctgggactataggcgtgcgccaccatgtctagcagaaattttaaatcagtgagggcaaaaagggatttttaaataacaatactgggatcaggaaagataaaagctggagtcatttcattcctaacaccaaaattaggtcagatgaataaaagattcagatagaaaaagtgaaataagtttacttcagatatttatgtattgtttggagacttttatagcaaatacattttaaactttttgtggtaaaatatacataacataaaattaaccattttagccatttttaagtatacagttcagtggcatcaagtacattcacattgtgtgcacttacttatcaccaccatccacctccagaacattttcatcttcccaaactgaaactctgtatccattaaaaaccaattctccattccttccagtccctagcccttagcccctggcaaccgccattctactttctgtcttcataaacttgattagtctaggtgcttcatataagtggaatcatacaatatttgttcttttgagactggcctattttacttagcacagtgttttcaagattcattcacattgtagcgtgtgtcagaacttcatttattttaagggtgaataatattccattgtatctgtataccatatgttgtttattcatttatccattgat

SEQ ID NO: 4185 - DNA, 1158 bp, Homo sapiens
tataattgttctcttctattattagttattgttgttaatctcttactatgcctaatttataacttaaacttgattatacatatgtatgtataggaataaacatagtatatatagggttcagaactatccatggttttggatatccacgggggggaggttggaacgtaagcctggtggataagggggactactgtacatatattaagtatctaatacgtaagtgttgagtatatggttttcctaattcgtcctttccattcaatgaataaattcagaaggttaattaatccaaatatttatagaatgcctgcaatgtgtcaggcattttttttttttacctgtgggataaatccatacacaaaaaagaaaaaaattctgtgcttatgaagcttactttctagtgagtaatgtaagctcatgtattgaaattcagatgctccagccccatgctttagacaaggttcctgcagtcttccctatcgctttattatccagaccccagttttcaaggctaggactattcttggcatccttacagatcttcctcttgattgtcaaggcttggggagtagaggagggagtgaaatgacttgagaggcatctcagttctctcagaattgttctctcataagccatcctgtgccctgaacttctttctgcccagttacacgtttgttagctgttttggagccaacttctggagacagtatttgcaagtctgcatgcaggccgagaaaacggaaaggcacatgccttcctggcatagcattagccagaactcagtgctttggtctagtcccagagaggtggctggtgccacctttgccaggacctgtggctgatcagctgctccctattgttgccacaataaaggattctggcttttctaaggagagagagatgccagatcccaggcccacatgtttgggataggtggtagtgtgtattttgataggggatgtgtgtagaacaaagaatgtgttctctagtctcattttgactttcagcccccagtaaaccttattgctatgagagccagtctctctgtagctaatttgaggcatgaaggtggctggtggtggaggaagaatgccagtgtatcattcagactgtccaataggcaaacacatgtttgaagaataatcctcagttgtttgg

SEQ ID NO: 4186 - DNA, 1220 bp, Homo sapiens
caggacatgagactatgacacaaatttttggatgacacttttcaacccaccacaaaatggatagaagagcagtgacaaaaacaaaaactcaagggaccatgactcccaaaaaccaacatgtagccaaagcctcaaagctttctgaagtcattccagaacaacacaaaagaaaagagacaactgcaaatgtagggttcccaatagacacataaccttctggattgaatttccaaaaactgagaacaatttaaaacacacatggaatgtataaaaggagaaattttgtttcaaaattatatttgagtttgaaatgggcaaataattaaaagcatgaagtctagagtcagatggtcctagatttgattcccagtttcttaagttacttgctctataatttgggcatattactcctttctccacacctcattttcctcatcaataaaatatagataacaatacagcctggctcctagagtcggtataaagattaaaagtgatagtgcacttagaatgcttagtctagagcctggcatacagaaactgctcaagaaatgttatctcattatttttagatgctgatagaagtggacaatgaattcaatgaggggacggagaaggttaggaaactggacattaacaggatattgtaacggaatgtttacattcaagaagaaaaaataatttatgttttccaaggactggggtatattcctatttaactgtaatatctagtgtggcagttcttaaagtatggtttggggacaccagggaatctccaaaaccctttgaggtagtcgatgagggctttcccactctcattctctcttgagggtgctgtggagttttctaggtgccacatgacatgtgatgttgcagctgaacaaaaacagaagcagatatgagaatccagctgtctttaataggccagacattaaagatatttgcaaaaatgtaagacattgactgtcctattgctaacttttttaaaaaaatttatattaacatatatattgactgttacttttaaatgaatgaataaattaaagatgtatctattttagtttctaatacagtggatatcaataaatataacccacataacaaaagcactttgaaattttcaatattttttaataggaaaaaagatcctaaaactaaaaagtaggagaatctctggtctagagaagcacatgacatgcctggcaacacctctgcaaaat

SEQ ID NO: 4187 - DNA, 1172 bp, Homo sapiens
aggccgaggtgggcagatcacttgaggcctggagttcaagaccaccttggcgaacacggtgaaaccccgtctctacaaaaaatacaaaaattagccaggcgtggtggcacgtgcctgtagtcccagctacttgggaggctaagtcaggagaattgcttgaacttgggagatggaggttgcagtgagccaagattgcaccactgcattccaacctgggtgatgaagtgagactctccaaaaaaaaaaaagaaattattaatccctgcctgtgctctacatagcctcatgggcatcattggatagctcagagggcccttgattctggcaaggcaaataaagccagaatgagaaattaccatcttctactagagaaaaccaagagaaaaatttttatgctaggatgcctttatgaccacttaattttttaatcttagtttaatggtctctccctggtgctaactgctgacagtggccacctcttttttggggattgaggggcctacataactagctggccttaccccatatcttttgttcaaacataataccatctttttgcttcttctgaactttagatctccataacacatgtactgtagaatgtgatggaaaagcattgatgagaatttattggcagttcagattgtgttttcccaacttaggctctttattaattggttaaggttttctccaaaaagggcatttcaacaatgggaattatttaatgtaacagtgggcacagattacttatcttccttctctgctttgtgactcaccagcagtaacacacacaatccacatcttgtgcacctcaaatgaacagacttggtttccttgctttcttgacatttccatgactgtttcacatacaaactattgggtgaggtttttcagctgttaccgacccacgtcctgctgtctctgtgtggtcctacaaaaactgtccattcccacccctttgctttgccatttgcaagagtctggaattgtcaggtctcagcttcgaaaagtcctggttccactgacaggacacattctttagtgggaattaagacctacaaagtctagtttgtatgtaggtatgaagggaattttttaaataaattgaaaagctgtgaacagcattagaactttgtctatttcttaattttaaaatatgctgatatgcctta

SEQ ID NO: 4188 - DNA, 1231 bp, Homo sapiens
caaaaattcaattaaaattcatggccagcaatcctgttccccctcagcatcctgatttaattttcctgttgcttttgcttgcttctccatttaatagttactgaactttatgcatgttgatctatattgattttcactgcagttgaatgaacaaattatttcagtgtgacagccatgactcaagttccaattagtctgaaaagggtactttggaattgtcccatattaatcagagatggcaaaagaaaaagttctcatattaccaggttgattttgtgtctcatttcaaattttaatttaaaattatggttttcatttttgtttaccttaaagtgatgcttaaaagtggcatgtaattaggacacttaggtttgttgaaagcattttcgacatttgtataaaagaatttgtgataaatatatccaggtgctcaccaaagaaacatgtattaacaacttaaattagatttttctaactgatagttttcactcatttataatcagtaggagagactgtctagatgttggggcagctctatgatttaagtctgtaacatgttataactgaatttagtaccctagttttgttaagctattaggattttctaatagaacttactccccctgcctccccagccttatgtttcttttaatgacttctggatcctgagctccctttgcagtctgaaaaaggtattgcagtcagaactgtgtactgatgataaaagcctctggtagcaataaaaagttgtccttaacttttgtttttgtgacttttttctggttgtgaagaggtacaggttcctgattggctaggcactgctatttcaactagagaaaacaatagaaagaccaagaatacacttactgaaaataaaacatgaagaggatctgaatgtgatcgagggatataggttttagacataagaatttttctttcgtgatattttttcactggtgcactgtgaatcctccaaatagtaaatttacatcttaatgtgactgcttgtgagagtaggctcagacccctatctttaaaatgtcatttttagccattttgtaatgttcagatttagcagaacaagagtattttcaggtcatcatctgatttgtaaaaaattcttgtggtagggttgacttacctgttttatgaccttaaaatccaattaaatgggaagcatttactcacatgtcagtaaagggagtgggagggaagatagcaaaggattggc

SEQ ID NO: 4189 - DNA, 1140 bp, Homo sapiens
ctattttaaaattcttagcttccctcctcatccctgattaaaaaaaattttttttttgccctttggcttcttacatttttaatgaatgtgtttatgagtactttggactccactgaaaaaaattagaagaggccaagagagtaggatgaagggccttccagacagggggaatagactgaaaaaaaaaaaaaaaaaaaaaaaaaacagacgttggatacaaaaaagtagtttctgttctcatgtaaatgttcagcatacattgcaaatacaaaactcaagttccaaagataattatattagaaatacagatttggacctaatttctaagatgatgttgatggatgggtagctggataaataaatgagttggaggtagatgtggggagagaaaagactcagcggggacggaaagcacagggaggaaaaatggccaccagagataacagagcagcctatgttaattaatgatcaactgtgtgtggctttttttttttcctggcccagatggatagctcccagttgatccattgtcgggagcttgtggcacatcacctttctactctgcagtcttccctgcctctgaattccgtttatgtctaccgtcccctcaagcacaccctggtgacctgtgacaaaggagtgttcagattacatccctcctctgtcccaggcccagacttctccaaggacaacagcaagccagaagtgccagtcagaggtacagcagccttttaccatcatctcccagctgccagtgggtgcaagcagacctctactaaacgcaaagtagaggaaatggaagtggatgacttctatgatggaatcaaacggctctataatgaagataatgtctcagaaaatgtgggttctgtgtgtggcactgatttatcaagacaagagggacatgcttccccttgtccacctttgcagcctgtttctgtcatgtagtttcaacaagtgctacctttgagtgtaaactaaggtagactactttgggaatgagaacatgcaaaatcaggaaaggctgtagaaggaaatataccttaacaggctgatttggagtgagccagaaaaaaaaaataaaactctcattatttgtgtggctaattataattcagcgttatttaagcacataaagac

SEQ ID NO: 4190 - DNA, 2073 bp, Homo sapiens
taaacttgtaggcattagtatgcaaaagaatatgtaaactgggggaactgtcaattaaatgctttattaggtatacagaatagaagccaaataattacggagtgtaagactgaatagctgctcaaacttctactcttaagacacttactaaacatgacaggacccaataaataagaaatatgaaaaaatgagatatttggcaaaattctctaattgttccacaaatttctccaactttgtttcaaatgtttaataaacacagcaagaaactcatgatagaaactacaacaatgtgttcactaataatttttgaaaaatgtactgtccaagaaaggacactaactttaaactcatctttctgtggaattatctgtgaaaagtaggttagatgtagtagagagggagggaggagtgatgtggacttgttgctgagataaaagtaggcatttttcagatatcccagattgcaagcaattagctttaaaaaatgtttacatacacaaaaaattttttaattttgggaatattatttattaaaaacttctaaatcaagctttttttctgctggatagaaatgaactttggttaattggctttggttgaactttgagcaatggaattgatattatttttgtagaatatcatatggctaggattgtaatgctaacagttagctctcaggccgggcacggtggctgacgcctgtaatcccagcactttgggaggccgaggcgggcagatcacgaggtcaggagatgagaccatcctggctaacacagtgaaacccccgtctctactaaaaatacaaaaaaaaattagctgggcgtggtggcgggcgttgtagtagcagctacttgggaggctgaggcaggagaatggcatgaacccaggaggcggagcttgcactgagctgacatcgtgccactgcactgcagcctgggcgacaggccaagactccgtctcaaaaaaaaaaaaaaaaaaaaagttagctctagacacacttgatcttgcaagtgtactttccttcctttcattactgctctaaagctttttaataaactttctttcctgttcttaaagttagctctgatctaaaaagtaatgagtggcagtcacattaattgaattccatagtattttgtgtatacctgtctcatctgcatatctaggtttttaaaacagttacaaaaagttaaattgtttttgaaaaatcactaaagttgctttttccctcttcaaaattttaggctcatccaaaatacttgagttgtattgcaatcagctgttttttcctagctgccaagactgttgaggaagatgaggtaataaatcctttcaagataatgtttcttccgtgaaaatttctctccacatttattaacttgcttcgtttgctaaaacaaaaatcataaatgagtttcttttctgtccttttctccctgtccctgttcccctttgctttggatagagaattccagtactaaaggtattggcaagagacagtttctgtggatgttcctcatctgaaattttgagaatggagagaattattctggataagttgaattgggatcttcacacagccacaccattggattttcttcatattgtaaatatacctgaagtcttttagtttcttatttgagtgtgtagttttcagtaaattaaaaaatagattgcctactcatttattttgtactggaaataggaaaaagaaaacttgatatccaaggaaaaattataaattagtatatatgtcatatcactgaagcttaattcgcagacttagaaattgaataggttaggctgggcgcggtggctcacgcctgtaatcccagcactttgagaggctgaggcaggcggatcacttgaggtcaggaatttgagaccagcctggccaacatggtgaaaccctgtctctactaaaaatacaaaaattagccgggcatggtggcaggcgcctgtaatcgcagctactcaggatgctgaggcaggcaggagaattgcttgaatccaggaggcggatgttgcagtgagttgagatcatgctactgcactccagcctgggcaaca

SEQ ID NO: 4191 - DNA, 1140 bp, Homo sapiens
tatatatttatggggtacatgagatgttttgatacaggcaggcaatgtgtaataatcacagcatggaaaatggggtatctgttccctcaaacatttatcctttatattacacacaatctaatttttttttttagttattttaagatgcacaattaaattattataaaccatagtgactctattgtgctaacaaataccaggccttattcattcattctaactttttgtactcattaaccttccctacctccctcccaccccactacccttcccagcctctggtaaacatccttctactttctatctccatgagttcaattgttttgatttgatttttaggtcccagaaataagtgagaacatgcaatgtttgtctttctgtgcctagattattttacaccgcataatgacctccagttccatacatgttgttgcaaatgaccgaatctcattcttatggccaaatagttagtactccactttgtataagtaccaattttatgtatccattcatctgttgatggacacttagattgcttccaaatctgggcatgcatttcttttcttttttgaggcagagtctcgctctgttgcccaggctggagtgcagtggcgtgatctcagctcactgcaacttccgcctcctgggttcaagtttggctgaacttatatatgaaaggagggctgagaagtcagaaactgaggagctagagagaaccaagtgtggcgtgggccagcagacagctcctctaaacatgtaaacacgcagaaccattccttccatgcaggccctagtatctcccctaggtgagccaaaccacactagaaaccctcccactccactgagtggcccttcccatcttcagtaaccctctacaaacttttcagggtcatgtgaaaaacacccaaactcttctgaacctaccaccatcctttctttgttctttcttagtgaaaaggacattcctcctcctgtcccaggaaaatctctctgcatctgctctccatctatcccctcctgtctcctgaacaaccagagtgatctgccattactcctctcccttgcatctcctgacactccttttcctccagttgtgtgtctccttgacttagtcaaaaaaggtgcttacaattctgtaat

SEQ ID NO: 4192 - DNA, 1166 bp, Homo sapiens
tttgcaaaaatgtagggtctcttgttcaaaaagaaagaggagaaaaagcttttttgttgtttttttgtttgcctctgtgatctctttctctcaacctgtcatatttggcatgttttttagttgctatttaatgttttcctcctttgggcctgggaatgaagggtgggaggataccctcacagacaccccaggctctaccctgtgacttggtgcatagggcgcatgcaacctcctggcaccagcccccacgagggttggggatgacagcattcattgggatggagtggaggagctggtagctgagaactcatcccaggaagccagcagcaggtgggaccacacatgagctgagcctcaaaacttcacctataaaacacaaattcagagatttcaaggtagtgactgcagagcattgaacaccaaatgcaggacctccttctgtgcactgggcttctgaccaactgcactggctgcacgcccatgcagtcagccctgggatcaacaaatgccatccccctagtaatccttgtttctttgaccttccagaaccctgttcctatgaaggccatgtgtttcaggatggggaggactggcggctgagccggtgtgccaaatgtctgtgtagaaatggggttgcccagtgcttcacagctcagtgtcagcctctattttgtaaccaggtaaggaagacaacctcagcatgcagccttcacgggctattgaagaacttggagtctcttctgagattatggcaggcaggcctcagaagcactagaaacaagaagcaaagccctttttgttttcctcatacttttggagaccacctctgagacatttcttttacccttagaaactacagataggtctaattaccagccacttaggctaattgttatataatgcaactgagccttgaggattcacacaaggaagcctccagctctaatggcagatgctccaaaaatgtcaagctaaacatctgcaaaattcaataatgtgattagatttgttattgtttttcattgcataggtatagtctgcttttttaagacataatgcatatctttgaacatgattatccagatgtacacaatttaattcttataggataatgattcaaattatgaaaggattttctctgaggacgtttaagatagtgggatttt

SEQ ID NO: 4193 - DNA, 1204 bp, Homo sapiens
aattaccactaaattcagtgataaccccaattactgaaaatgagatttgaaattttggagaaaaagaagaaaatggggtgcatttttcttagataaaaataactatttttcaacattgtgggttttatgtctgaactgtttgtacatgttgaagcttaagaagaacatcggaggtatcataaattattgaatctgtttaaataatacattatggaagtagtcattcctgtttcttgaagtattccagcaggtagaggctgttcttttagtatcttcatgctggggctatgggagacagtgatgaatttcagacaaggaaaacttccttgcaatcttgcattggaatgtatttttttttttttttttttttttgctatttaggaggctttttcctaagtcccacagttttctgttcttcatgttctatgtaatgctacatactttgtagattcttttctgaaggatgtaagagaaataatagatggagttcacagagttctccccttctttgtccttgatttcagttcattgccatccagattgtttgacatgctctcagtctccagaccactgtgacctctgccaagatcctaccaagttactgcagaatggatggtgtgtgcacagctgtggactgggtttttaccaagctggcagtctctgtttaggtatggctccaagtggacaacccagaggtggtggtgtgtgggagatagactcatcaaaggttgtgattcttaaactgaggctcagtattgtcaaggagggggtcatgcatgcagcatgtttttgagatgcacaacgtctaaaaacctctagaaggtagtaatgtcatctataggttacttgccctctctacctgcaggtctttttttctgacattttataggtattttggtgcttattggaagacaggtgatgtggaggttgttaggtagtcatagttaaatatttttatttttgaagactttcaaggatagtaatatcaggatacctgggctcatttcttaaagcactcaattaatccgggatagaaacttagaattgacatagaccttcaagatcatttactgcaactttctaattttgcaaatggggaatctgtaggccagagaaattaaccaacttgctcaatatcaaacagatagttggtaatagagcttatctcttatgggctaccagaggatccagaatgggtttatgt

SEQ ID NO: 4194 - DNA, 1111 bp, Homo sapiens
atctattccttctttgtctcccacttacaatcaaatacacatatcattggttgatctgagaagtttagctgatgtgtgacatatttggaacttagcagaagcaaatgagttctgctcttattaccacctcttaatctcaaactatgttagagatgaatatactccactgttactttgagagcaggaggcagccgtctaatacctgcacccctgtcccagggaaacatatatcccagtataggaccaaataggcagatgttgagcaaattgaagtcagcagagtattctcttgacaatgtacatgaaatctcatgcatatgcacctagaaactcaccactaaagctagtggaaaacaaaaaaaaaaaaaaaaaaagaaaagcaggggttgaaatcctagtctctgataaaacagactttaaaccagcaaagatcagagaagacaaagaagggtatattacataatggtaaagggatcaatgcaacaacatgagctaactttcctaaatatatatgcacccaatacaggaacacccagattcacaaagttcttagagacctacaaagagacttagactccaacaaaataatagtgggagactttaacaccccactgtcaatattagacagatcaatgagacagaaaattaacaaggttatttgggacttgaactcagctctggaccaagcagacctaatagacatctacagagctctccacccaaaatcaacagaatatacattcttctcagcaccatatggcacttattctaaagttgaccacatatttggaagtaaagcactcctcagcaaatgcaaaagaacagaaatcataacaaacagtctctcagaccacagtgcaacaaattagagctcaggattaagaaactcactcaaaaccacacaactacatggaaactgaacaacctgctcctgaatgactactgggtaaataacaaaattaaggcagaaataaataagttctttgaaaccaatgagaacaaacacaacataccagaatccctggaacacagctaaagcaatgtttagagggaaatttatagcactaaatgcccacaggagaaagtgggaaaggtctaaaatcgacaccat

SEQ ID NO: 4195 - DNA, 1233 bp, Homo sapiens
tattcagaatatgcttaaaaactcaaagacaaggatttgttatatataatcccacttttaaaccaacacagaaaaaacatgcacagaagtattttgttgttgtctgtttctttgaaaataattgaaattactgacgtatgataggaagaatatagaacttagaactaaggcctagttggtaccttttgctgtcaatcaacaggcttggacaagacataacctctctgaacctcttctgaaattgtactaataatctcaacatgagaaggtgccttgcacagtgtgcctggtgtagaataggcatgcagtaaatatttgttgggtttttttttctttttaaagattagtgagtaatatcatgagggctaaaggaggataaacaaaaacaaatgaggaaaaattaattttgccaatcagctagagattttattgaagttctgatagtgtgattggagcaggtgtatttagcaaaacctgtgtataagggacagaacatggtacaaggtccaaatacaatctggaaattttctttaaaaagaacaaaaagaggggctgggaacagtggctcatacctgtaatctcagtactttgggaggctgaggctggaggatcactggaggccaggaagttgaagctgcagtgagctatgatggagtcactgcattctagtctgggctacagagagagaccccatctcttgaaaaacaaacaaacaaacaaacaaacaaacaaagtaaggcatgtcaaaatggaatttttcaatgagtatggagttagttgagtcttttgagaaagttggcatcaaattttaaatccctgacaactttgaatattaaaaaaaaactttagaaaaatattaaaacatttggttttttccttaattacccatagaaacactttatactgtattttcaaacaaaagaaaaatataagtcccatagtatattatagtaattagccaatgataaaataaaattgttttaagctaagtttttttgttgtgtatatatatatatatatatatatatatatatttatttatttatttatttgtggaaaaaagtataaaaatattttaaaaatgtgtgaactaactccccattcacacacacatatacagctagcttcaccacaaaagcttctgctaccattctgttatctttccatccagttttgttcattacatagtaaaatgaaaatgattgggccaaattaaaagcaggaacacaaact

SEQ ID NO: 4196 - DNA, 1195 bp, Homo sapiens
atgatcatgccactgcactccagcctgggcaacagagtgagaccttttctcaaaaggaaaaaaaaaaagatatgcagaaacacatgagacccatttgaaataagtcagcagtcttctccatctcatttgatgactttgttcttctatttcctcagtccaaaagccctgaaaccttgcagttattttaaactgtttttctctcatatccagtcattcaggaaatcgtatcaggtctgccttcaaaatatatctagaattctttcatttctcactaattcccactgccctgatcaaaaccactattaaattgcagcagatttactgatttccctgcttctgatcttgtctgtcttcactctgttcttcacacagtggtcatattaaaatttgagtccagtcatgccactcctttgctgagaaccctctagtagctttccatttctcttggagcaaaagccagtgacattaccctcatccgtaataagactttgcatgatctggctctctgtttactctgacctctcttattttactccccattatttattctgctctaggctttctgatccctttgctgttcctcaaacttatcaaccatgcctcctgccttagggcctttgcacttctgttctctttacctggaatgtacttgcctcgaggtctgcatggcccattccctcactttcttcctatctttactcaaagtcacctcaggtcttccccatgtaccttgattaaacatttcagcctcctccatccttctcccaacacaattttccaagggaccatctaatcttgatttaatttttttcttctcaggacttaccgttgtcttctatgtactgtatattttacttgtttattttgtttcagtcattctagaatgtaagctcacaagggcagttctctgatttgcttgtagttagtcttgttcatagcacgtagatcagtatttggcacattctgagcatttaatatatattgttgaatgaataaatgaattactaaatggtgtagtttctttgacttgaagcagatgctccagcaatgtaagaatgagtctaggggagtgtgaaaaagcaaaatggggacttggaatgagatgaaaagtagtgttttgtagtgggtgaaggtagggaaatgttccttggcagtggtgacatggtgtagacatctgtttccctctgtcctcaag

SEQ ID NO: 4197 - DNA, 1127 bp, Homo sapiens
aagaacattagatattttagttttccagaacaaaagctttaaacttctgcagtaagttgagagaagggttgagaagaggaaaagaacttctcattttctatcagataagaatcacattagaaactaagtacaagattagacaacaaattatgtggtcaaataatatagtcattagccacctaaacattttaattccagatattatttaattccatataataactgaattcttgtgagtggattacaggtttttgatcccaaaattccagagctttcaactctctgaatttgtagtcctgaatatcccagtggtgggggttcccagcattgtgggtgctacttgcaaggccatagaatctagatggccctgtcttgaccctgaaatgaaccttaagccttagaacaaagtcatgcagatgccccatttgataataatcttattcacctgtgctctggtcctcggtttctgcatgtgttagcattgcattgataactcagaatcttgataaacacttaatatttgggcctgaagcattaaactttctttttattgtatatacttaaaaaatagaactcactgccctatcatacattgtagccctcttattctttggtctttcatatgcattagttaaatcccttaaagtagacattcataaaaacttacattgtttattggagtataaaatattacccaagtttcttcatgagttgacatgagctgttttaaatactggtgtattttcagaacagtaaaattactgaatatcagaaaaaatgttaattgatgatgaagcttattcccaaaatgccttttgtgcatatgatacttggaaagtcactaatgtgcctcagttaatacatcagtaaaatgttgtgtttcttttccagtgtagtgtttttggaatataaattccccatgctagtatagtatctcagcaaagagaatttccccccaggaggctcagtaaaggaataccgtgtcttacccatcgttatgatggaaggctgctttgaaaatggctgttttaccttataaggttaaaattttgatccatatgttaagtgatagaagattttggtgcaacagtagtaggatatatttctcctagaacatcccttattgg

SEQ ID NO: 4198 - DNA, 1189 bp, Homo sapiens
tttccttataaattacccagccttaggtattcctttatagcaatgcaaaatggacaaagacaccattctaactggggtaagataatatctcattgtgattttaattttcatttccctaatgattagtgatgttgagcattttttcaaatacttgttggccatttgtatgtcttcttttcaaaaatgtctattcatctcttttttgcactttagaataaggttatttttttactgttgaattatttgagtttcaactttttgcattcaatgtgatattaaccatgactttgccatatatggtgtttgttatgttgaggtatgttccttctatgcctaggttgttgaagagtgtttataatgaagggatgttaaattttatcaaataatttctccacatctattgaaatgatcattttttcttcattctgttaatcatatgtatcatgtttattgatttgcatatgttgaaccatccttatatcctttggataaattccacttgatcatgctgtattatctttttaatgtattgttgtctctctctttctttctctctgtctctctctctctctctctctgtctctctctgtgtgtctgtcttctgtcttactctcttcctctgcctgactttctgtcttctgtctctctctctgtctctctgaccctgtctgtatgtttctctccctctctctgtctctctttctgtctgtttctctctgtttctctgtctctgtctttctctgtctctctgtctctctctttctttctctctgtctctctgtctctctctctctgcctctgtctctctctctctgcctgtctctctctctgtgtctgtcttctgtcttagtctctttctcttcctgtctgtctctctctctttctgtctgtttgtccctctctctctgtctgtctctctctcttcctgtctgtctgtttttctctctctctctctctgcctgtctgtttctctctctctgtctctctctgcttctgtgtctgtgtctgtcttctgtcttactctttctctgcccgtctgtatctctctctctctctgtctgtctctctgtctctgtctgtctggttttttctctctctctctctctctgtccctgtctgtctctctctctctctgtctctgtctctctctctgtttctctctgtctctctctgtccatctctgtctttc

SEQ ID NO: 4199 - DNA, 1190 bp, Homo sapiens
agtgagtttaacctgaaatgtcaaaacctagatccataatatagcatcacatctcaataaatttatttggaagcagtttcttaatagtgcagtttatcaatgaactaacatttaaggatgaccctaaactatcataaaatttgattttttttgaaagctacctttcctttttttttttggtgggggggggggtggagaaagggtcttgctctgtcgcccaagctggaatgcagtgatgtgatcacagctcacctcagcctcaacctgggctcaagcgatcctctcacctcagcctcctgagttgctgggactgcaggcaagcaccaccacatccagcttatatatatatatatatatatatatactttttttttcttttttttttttgagactgaatctcactttattgtccaggctggagtgcagtggtgtgatcttggctcatcaaaacctccgcctcccgggttcaagtgattctcctgcctcagcctcctgagtagctgggactacaggtgcacgccaccacatccggctgatttttgtatttttagtagagacggggtttcactggattggtcaggctgatcttgaactcctgacctggtgatctgcccgcctcaatctcccaaagtgctgggattgtgtgagccacctcgcccggcccagtttatttatttttttttttcatttttattttttgagacggagtctcggctctgtctctcaggctggagtgcagtggcgcaattttggcttactgcaacctttgcctcccaggttcaagctattctcccgcagcctcccgagtagctgggattacaggtacacaccaccacacctggctaacttttgtatttttagtagagacggggtttcaccatatgaccagcctggtctcaaactcctgagctcaggtgatccgtccacctcagcctcccaaagtgctgggattacaggtgtgagcaattgcacccggcctaatttttgaaattttttgtagagatggggtcttactgtgttgctcaggctggtctccaactcctgtgctcaagtgatctgcctgcctcggcctcctgaagtgctgggattacaggcgtgagccactgtgcccagcctaagatacctacttttgatagggttgagaagggtatatcctttctttaatactagccatattcaaactgttacta

SEQ ID NO: 4200 - DNA, 1207 bp, Homo sapiens
ttgcaagaagttcttgagctgaattcctgttgtgacaacttcctataattacagtagataactttttcttttagtcgtatataacttttctataacttgtgatggacaagagatatgcttatccaataaaataagcttaaatattagatgctcttgggtcaaaatgtccttttaccaaattgacctttttatgagttctttgggtaaatactttaaagctttttatattttaaagaatacttgtaaaagcatatcacatcttaaaccagtggtgcacatgtggatttacagctcatggactctactgttcagctttaatttataaaacatatcacacatttaatgttatacagtatttacatatagtggaacatagggataactcagttttatgtaaatttttgttaagtgttgtagcctgcccagagtgacttctattttttcttctttgtctccaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggttttttaataaatccttttgtataaaaatgtattggctcttttatcatcagaataggaaaaattgtcatggattcaagttattaaaagcataagtttggaagacaggcttgccgaaattgaggacatgattaaaattgcagtgaagtttgaaatgtttttagcaaaatctaatttttgccataatgtgtcctccctgtccaaattgggaatgacttaatgtcaatttgtttgttggttgttttaataatacttccttatgtagccattaagatttatatgaatattttcccaaatgcccagtttttgcttaatatgtattgtgctttttagaacaaatctggataaatgtgcaaaagtacccctttgcacagatagttaatgttttatgcttccattaaataaaaaggacttaaaatctgttaattataatagaaatgcggctagttcaga

SEQ ID NO: 4201 - DNA, 1128 bp, Homo sapiens
agaattttccattttatgtgctaagagttttgttaatgagagaactgttaaaatagaaaaggagcttcagcatagacaccaatgctggttgctgagatcagtggggaactgcatagcattttaacaagtttaatgaacatttggaagagaaatttgaagctaagattctggtttttttgctgttaactttttaatctaaggaaaacttttatgtacagtatttttactttgggtatatgtttatcttttagcaagttgaaagacttaatttgctgcttgctcactattttgtaattatttgggagcagcagtaataagccagctttttggaataggatgttcctgatgtgtggttatgtaggaagaatgatgttttaatatactgcccagtaaactggtgcagtttggaaaaggtgtgttattgatgtggataatatttaaggcaattttttttaagcattttaatactgctttttgtctttacaggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtagtgtgttacgtgttctgatcagttaataatataaaatattaacatatggatagtttgatacaatgagtttgcctatttgtggttccccattttgatagtataggaaggaagaatagttcttgccccaatacgttttatgaagatagaggtaggttcaggaattatttcctgaataatttgtgttccaggctctgctaaattttgaaattaactttaaagatactatagacttaaagatgcctagttaaaaggatgtgttttagcaattcacagaagtccatattttgaaattttgttaggcaagcaacttttaactgaatcattattttgatcctgggctaaagggaagtagcagttatgtttgtatatagtgctaaagggaagtagcagtcatgtttgtatatattgaaggtaatggttatctagtaattggttaaatttgtgtatgtcctaccattcttacctttaga

SEQ ID NO: 4202 - DNA, 1177 bp, Homo sapiens
aaaatgttttctgtttgggcatcctgaggaagttgtattagctgttaatgctctgtgagtttagaaaaagtcttgatagtaaatctagtttttgacacagtgcatgaactaagtagttaaatatttacatattcagaaaggaatagtggaaaaggtatcttggttatgacaaagtcattacaaatgtgactaagtcattacaaatgtgactgagtcattacagtggaccctctgggtgcattgaaaagaatccgttttatatccaggtttcagaggacctggaataataaaaagctttggattttgcattcagtgtagttggattttgggaccttggcctcagtgttatttactgggattggcatacgtgttcacaggcagagtagttgatctcacacaacgggtgatctcacaaaactggtaagtttcttatgctcatgagccctccctttttttttttaatttggtgcctgcaactttcttaacaatgattctacttcctgggctatcacattataatgctcttggcctcttttttgctgctgttttgctattcttaaacttaggccaagtaccaatgttggctgttagaagggattctgttcattcaacatgcaactttagggaatggaagtaagttcatttttaagttgtgttgtcagtaggtgcggtgtctagggtagtgaatcctgtaagttcaaatttatgattaggtgacgagttgacattgagattgtccttttccctgatcaaaaaatgaataaagcctttttaaacaaaatccaaacttttaatcaagtcttgatatgtatgactgagaaaaaatacactacatctagagatgattgagatgttttgcaaagaattgaagggggagtgagaattggtttttcttgcaggggctttgaactctagatttgggctttgaactctagatttaattcagatttcagggtctatcagttcaccaactgatgcaaatttgaacagatactctaaggctaagtgtcctaggttggatgaactgaagctactatcaagatctcgttcccaaggattaatttagaacaaagtaattggacaagtttattggggaggggatagaaatgaattctaaagtacctataacaaatactctgtgtatgttttttacatcgtatttgccttttacattgtt

SEQ ID NO: 4203 - DNA, 1100 bp, Homo sapiens
tttcaaaaaactgttaaaagtgtggccactttgacaattagtgtcatcactgataggaaaagtgtaccattacatgatacaccgtggtgtgataggttttcttgggcaggagtccttgttttaaacagaacagtgtacctgtcttcggctttaatggaaaattgaatgattttccattaagtttaggaagtttgatactggcacaattggactttctgcctccttttttataacagctggaaaaatagtttttcaagcagatagcaatatatatgtccattctgccctttaagatttgcagagtgagagacaagaacgcatcattttatgttagaattgggggtcagaagttgtttcctaacaatcattgtgcattgtttcaggtcagggccaaaactggaaccaaggatttaataactattatgatcaaggatatggaaattacaatagtgcctatggtggtgatcaaaactatagtggctatggcggatatgattatactgggtataactatgggaactatggatatggacagggatatgcagactacagtggtaagaatatttaacttaattttataaagcagtggtattaaaattcattgttaacatacaatcctgttctgaaattgtgtgtatgggctttccattaaagtgttcggagttaagtgtttgaggcatgttacaatcataggatgattatactaacatagactggtggttataaatgaactaggatgtatgatttatgagtagcatctaatgggtgctaaaatatcttaatactttttatttagcatgcaaagatttgtagatttaatagtttgtgtttgtaaagaaagttttgtagaaaactatcttaatgagaattctgtgttttcaaaataggccaacagagcacttatggcaaggcatctcgagggggtggcaatcaccaaaacaattaccagccatactaaaggagaacattggagaaaacaggtgtgtataagagtacaggaaaacagtagaaatgtctaatttaatttaaagatcaatagacaaatgaaacgtaaaaacaaaatactatgtagcctgtttttactaaattgttgatttttt

SEQ ID NO: 4204 - DNA, 1285 bp, Homo sapiens
tttttgagacggaggctcgctctgtcccccaggctggagtgcagtggcgagatctcagctcactgcaagctccgcctcccgggttcacgccattctcctgcctcagcctcccgagtagctgggagccagcgcgcccagcctaaaaaacttttcaagtcaatattactacgatttaacattagagtgtggacatgtgatttaatcgctatagctaaaatacgtcaaatatacgttgtcatgtgcttgaacatgatgctaaccctgacaggatgaaggaaagtaatattctttcagtgtagttcaggagagcatttgttttcttttctaccaattaacccatcattgcttttaaacaaccatctgaaggagcagagaggcagggtagaagacagaagggggatctatgtggtaactaaagaatgtttctgttttgttaattattgtgtgtgtgtggttttattgtttgcttaagagaatcaaaaactgaaaaaaatgagaatacaggaaatggctcttgtttatttttttgctgtgtttacagcttgttaatgctctactgtctttgtttcaagagagatttgttcactgcccagctcgttttgtgtcctgagccctatggccagcccaccttataaatcatgcctgtttagatgtttgattttgttctgtttgctattgttatcttaaaggtgtataactctgacatgccagacatcaaattaagctcaaattaagctctcgtttaaatgtttaagcacctaatttatattctaattgatcccagccactgatgcatgtactttagctacttctgctaaataagcatattaattttccacatcagaccatcagatcttgagaaccaacagttatctagaattccgtgtctactaatgtttcacctgcatgcagccttcattaattttgtagcaaaatataaagtgatcattatgtagcttctggattaaaaaaatttgtgtgtgaagttgctttgtaaagtgcatgtggaattaatgggacagtgtgccctttgtgttagatgttagagcaaaagaaagggcttatagtgttagtattggagcactttgaagatagatattttcagaaaagatgtaggatttaaaagttaaattttaaattttagaaaaagatatgatggcaattggaaatagtcacaatgaagttcttcatccagtaggtgtttaacagtgttattttgccactggtaatgtgtaaactgtgagtgatttacaataaatgattatgaattcattggtgttcttgt

SEQ ID NO: 4205 - DNA, 1157 bp, Homo sapiens
ccagtttctccacatttttgtgcatgtgaagtggctgtctcatcgtggtgtttgccttttcttaaggactcaaaagtttgcagatacaggcattcacttgccattttcttaaggtagagttgaaagtactgctgccagttcatcatctgaaatgagggctgttttctttcctgtttaattggattgcaactatttgcctttcctaaagatgaaatagtgtgcttcctacattattctgacaacattcctttaattgttaatttcagatgaatttctgaaaactgcttttatcagaacagatttacttaaatgaaggcaatagccgcaaggggtcactgctctagatatttacttctgcataggaaataagtaatcctttatagatggaatttttttttcttagttgtatttttgtatctttacatttgtttataacttatctatactttttttgttgttgtgattattttactgttgacatggaagttctcaatctgatcatttggttatatcattgcttcttctagtaacttcatatccagtgattaaaccttttcactgctgttcacataatgaaccgttgtgattattgaatacttaaatgaggatatgtaagctgtattaaagatagtgttatttgcaaaggcattgactattgcacaaaaaattttaaaagaaaatatctcttttcaggaattgtactctcagagatgttgagaaaagatacatgggtcttggaagataattactcaaaatatgcagggaaggtagtatatctttctattttaaatgtattaagtattcctggaactatagcagtgagttggaaatggaggattgtccaagtaaaaaacatttattaaggctttaatgaaatctacctattttatggtatataatctcattaattgtccacttggaaagaataataacagatatttatttattggccagttactatgggccacaaattatgctgagctttttttaatttcatttcattttattttattttttgagatggggtctcactctgtcacccaggctggagtgcagtggcgcaatctcagcttattgcaacctctgtcttccaggcccaagcaatcttcccacctcagcttcctaagtagctgggaccacatgcatgtaccactaca

SEQ ID NO: 4206 - DNA, 1153 bp, Homo sapiens
agcaaagaggggttgaaggttacatagcactgtgactctagagataggactgttattcacaatgccagacaagttcttagaaggggacatatttatgcctcttaagagcatggataatattgctacaaaagatactgctatgaaagtttgtacctacattttgctgacaagctgacccattataagaataaagatgtaaattaaagagcaaaacatgtctgcctaaaagtacacagaatttcctgaaagacatctttgaatgacattcaaaaaaatttttctggatgtgagggcaatctggctgcaatatctttcgccccattgattggcagggttgatttggctgatctggctggctaggcagatgtccccttcttccctcaccactccatgtgcatccctaccaaagctgtgcactcggtcaaagaggacgaccatccccgagagagaaggactggtcttcagtcaagggtatatgagtagctatgtccccttctagaacctccaaataagctctcaaggtcaatttgtagcagaacgtagggtagtcaagcttccaagactccagacacatccaaatgaggtgctgcatgtggcagtctgcctttttaaaaaaaaaattccttactttttcttgctatttttaacctttactttgagaatatgcacctgatttttgtattaattaaaataaaaagatgaaagaaaaaggttatgtttttagaacactggatggtatatattgacctactgttatttctccatggttttacttaaatcacaccttgtatacatagaaaatgttgcattaatcctcttataagtgagcttagattttttgatagtaaaaagcaaatgactttttcataaaaccctctgacttgggtgttttgatgtgcataatgaagtttatgaagctctttaaatatattcactgtaaagcccttgttgagattatgaaacttgtttttaagaaatgattattttaatgatagtctttattacagaagttctttttcttattgttactctagtattttccttcactttcacggtagtgttaacattcaccatataattcatcattatgaatagagagagcaacggataaaacaagagtgttttgtttctggatgaatcccaggaaaatttt

SEQ ID NO: 4207 - DNA, 1146 bp, Homo sapiens
acagtatttgtggcttcaacatattttaagaccacaatttctaagcaaaaatttttagaaaaatttcatttttgcaggtcctaaatagaactaaagaaacatttttattttcaaatataagtgaatcagaaatgacattatttcatctgaaaaataacaggtaatattttctccccctgttaacagtggagagtgtccaggttcttggagtcttgaacaaagtattggacaaaatgcacaaacaaagcaaggaaggaatgaaaggttctattgaaaatgaaagtacactccacactgtgggagcaggcctgagcataggggctcaaaaggcctgttacagagtttttgtgagtttaaataccctctccctggggtacgccctgtgtaaatgaagaggatgaagtagagttacaaagtcatttacagtatacaccctgtggagagaatatttcctgttacagctgtagtgtgaattgaccttatgttcccctgcctccagaccctattttcctgcctcacccctatacagtttattgtatgatgagtttacacatttcagaatcttatcttgtctttctactctgcaactttttttttttggagacaggatcttgcttctcactctgttgcacaggctgaagtgcagtggtgtgatcacagctcactgcaggctcaacctgcctggctcaagtgatcctcccaccaccctcccaagtagtgggactacaggtgtgcaccatcatgctctgctaattttgttgtatttcttgtagagatggggttttgccatgttgcccaggctggtcacagctttgtcttttttctgtagtctgtaatttttttttaaaccttattgtgtgaatccagtgtcaaactacttttcttagatgttcacaaatggataattattcacatcggtatttgaagatctcttaacaagatccataaataccacttagaattgctcttactagtttaaaaactttgtaggaaagtaaaattgtagaatacataatatcaatctactgaataaaagcatttaaatgaactaaaataaaattttattatcaaatgtttgtgtgcttctcaatgttttatttttcaaacagaaaactctttaacttgaaatgttcatcaatttaaaga

SEQ ID NO: 4208 - DNA, 1180 bp, Homo sapiens
aagggaggagccagcacttacgcatttttcactctcctcctcactccctagggtcatagttttgattctgaagttagaagtgtgggggtcgtcggctgcattttcaacttggcctaaaagttggagttcaccacactgcaggcgctaggaactctgccgctcggtcaccaacctgagcctctggctagtccgaagaacgcgaaaagccaggcccaaggcactggttgtcatggcaaccggggcgctggtctccctggcgacctcgtccctagggaggaggtggagctggatgccaggcgggccaatgaggtcgaggggagctcggggtgggagatctgcggtcctcccagtgccggggaatggttgagtgacaggaccgggggggcggagccggcgcggctgcccgaggtggagccccagtggtgcgagtagctccagcggccacgctgaggcgagggtgacacaccatgctcacggcccctggagaccgtcgtgctggcgagccgtgctccgtagctccccggtccgcctcggcagcggtcagagtcgcctacaggagttgagccgcccgcgccagaaggttttggcgaagctcttggagaggcgtcgagcacagtagggcggcgggggtgcgttgagcgctcgggggtcaggcagtcggccgggatcgccgctggggagcgtttccgaggcgaggaggaggaggaggagatgctgctcctcttctccccctccccaggctccttctacagctccttcagcccacgcccgcagccgcttgtgggagaagtggtggtggctctcggcgcccgcggcggctgccggcggcccgccccgacgccgcgtccctgcagccctcgcccggcgctccagtagcaggacccggtctcgggaccagccggtaaggacgagagccgccctgggctctgcgctgcatgtgcagaagtgcaaaacaaagtacattgcgctcgttctcttcctcctctctctgctttcgctccagtccctaaacccaactcctcggttgccctggtagaaggaacttttctttggttttggtggtgggtgtttttgtacgttagagtgggggtggggtgactggagtggggaagaatgagatgaaactccattgctaattaggtagatccatctcctctgcggaagaaagccggattctcgg

SEQ ID NO: 4209 - DNA, 1110 bp, Homo sapiens
tgccaaatagtgaaaaccctgtaaaacagtgtaaaagtgaggcattatgtttgacatcaatagtagaaaacaaagatggggaacaacttgtttcaacttaatgtaaggcatactccatttctgttattggtaaattccagtatacctcttcatgaaagcttcaacgtttgttttagatcacctagttctaatgtggtgattttgtagtttcatatgtaatttattattcttacattatttttcctttcaaggaaaaaactagaataaatagtaaaaaatattgattctgcttatgtgatttgcagaatttctttggccctgagtttgtgaaaatgacaattgaaccatttatatctttggatttgccacggtctattcttgtaagtaataaaaccaatttgtgtcactcttagaaaataatttcagtagtgttaaaaaccagttaaaattcttataatgcttattttaataaatgccgtttattttttcaattgtagactaagaaagggaagaatgaggataaccgaaggaaagtaaacataatgcttctgaacgggcaaagactggaactgacctgtgataccaaaactatatgtaaagatgtgtttgatatggttgtggcacatattggcttagtagagcatcatttgtttgctttagctaccctcaaaggtaccaagacattttatattcagagtacagtatagaaatttagcaacaagcagacttcctatgtttgttaccatgcctgacctcattttgacaattagtaactaaatgaactagtcagtagaagtgagttaggaactccctttcttctcccagctactttcattgttttaatagttatgtttgttaggcaccttctgtatctgactgggaagatttttttattttttgctatggttatataaaaatatattttaattatattttagggaccgttttatatgttaatggtctacatgtgtactctagaaattagtatcctaatatgagcctgaatgtatagcaagaccttatttctgaatttccacatcagtttatttagtctactatcctaaaatcacagtgactttttaaaatgtcaattgaaggctaaaaattagt

SEQ ID NO: 4210 - DNA, 1173 bp, Homo sapiens
gtctgagtctacatttcttataatgtttttattttttagactagtgaaatgcagtagcaagaagtgggaaaagaattctattataaatagaaattatggctgggcacagcggctcacgcctgtaatcccagcactttgggaggccaaggcaggtggatcacctgaggttaggaattcggggccagcctgccaacatggtgaaaccccgtctctaccaaaaattagccaggtgtcggggcatgcgcctgtagtcccagctaattgggaggctgaggcaggggaatcccttgaacccgggaggcagaggttgcagtgagccaagatcatggcactgcactccagccggggcaacaatagcgaaactttgtcttaaaaaaataataatacctcgggatgagacatgggcagcatctgccttgtccggtgctggcccaagtcccatccctgccctgctccctttcagaactgcacctactactggggcttcgccgcgtggatggcctattacatcaatcaccctctctacactccccctacctacggagctcagcaggtgaaactggcgctcgccatctttgtgatctgccagctcggcaacttctccatccacatggccctgcgggacctgcggcccgctgggtccaagacgcggaagatcccataccccaccaagaaccccttcacgtggctcttcctgctggtgtcctgccccaactacacctacgaggtggggtcctggatcggtttcgccatcatgacgcagtgtctcccagtggccctgttctccctggtgggcttcacccagatgaccatctgggccaagggcaagcaccgcagctacctgaaggagttccgggactacccgcccctgcgcatgcccatcatccccttcctgctctgagcgctcacccctgctgaggctcagcccctcaacccggtggcattctgggggaggagtggggcccacagctctccagcacccggaataaagcccgcctgccccagtcgggaaaaaaaaaaaaaaaaaaataataataataataattaataaatagaaattatgataaaagtaacaataaaaacaactctgcaattgctagaatgttactacaaggggtagtagtaacatttaaaaacatttaatacgtttttggagtagcgcagaggctcacg

SEQ ID NO: 4211 - DNA, 1221 bp, Homo sapiens
atcaaataagggatgtggtagaatttagaaaggcccccaggtcagtgaggtacagttataaggaagtgaagatttagacagtaaggagggcattccacctggctattaaatataaaggttaatttacaaaacaaccttttgtatgtgtgaaggactgttatgggaagtggggtgaaagatggtctctatctctgccaaaaatagatcttgaagagataaatagcaaagcccatgaaggaaaacacagaagtggtgttcttttttatatatttagcaataggaaataatcttctgccttggatagtttaggaagtagcagatggtttaagtaccagtgatattatgattatatattggttttcgtccatggttcctggcccataactcccacagtccttgttagtcttttgttataatggtggggcactttaggcctcaggagacagaatctctctgtgaccttctcttatcttcctttcacttgcccaaggcaggactctaatctaattgtaagtctaaagacttttattccagagagttcctgccccatactctggaggaaggaatgctgtacagagaggccaagaaaaatctgaactgaagggtgttggttgatttagatcataccctttttgtccagtcacatttctacatggttgtcaatcttgcctacactatgaagtcttcataaaaggcccaagaggactgggtctccagagagcttctggatagctgagcatgtggaggtttagggagagtggtgtgcccagggagggcatggaagcaccacgccccttcccccatatctcaccttacacatctcttcatctgtgtgctttgtaatgtcctttacaataaaccgttaaacgttaagtaggtgtttccttgagttctgtgagccactccagcaaattaattgaaaccgtgggatcccaacttgaaaccagtctatcagaagttctggaggtccagacctgtgactggtgtctgaaggggtcgggggggggcagtcttggggactgagccctcaacctgtgggatctgactccatctccaggtagttgtgtagatagtaggaaaatctcctcctcccacgtttgatcacagaagtcttctgtgttgacgattgttgtgtgagagcagaggaaaaacacagaattttttgaaaacagcacctttttctcaagggattctgtggcttcttgaaaaaatgtgatcaca

SEQ ID NO: 4212 - DNA, 1155 bp, Homo sapiens
ctgtgtgagcaaaaaatatgtgagaaatgggctaaggatggaacatggaaaacatagaaggaaatagatgattggagacaaaaggagactgatatagaaatcaaggaagtaagatgtttcccaaaaaatgggatgatcagcatatcaaatgttgcaattgtgttcaataagaaattaacttagaggctgattggttttgttacgaccttaggaagagtaattttagaaggtaggtgagagtataaaccatattgtagtgggacattagcaagcagagatagttgatataccctattctttgaggggacaagaagaaaattttattagatttctagtaacataataacattgaatactatccaaataacttttttttgtctttttgcttttatccaaagttttggctttctaatttttttcaacttggcagctatgatttatctctattttgtggctttacctttaggtgtgctgttttgtgtaggtggtcgaggtggatctggtgacccctttcgcagtattgaatgctattctatcaacaaaaacagttggttctttggaccagaaatgaatagtcgaaggcgacatgtgggtgtaatctctgtggaaggtgggtccactcttgtctgaaatatcatatgatcacaatgctctttttaaaatatttcaactctgagaatttatttttatataagaaaatgactaaattgtaaattatttttaaataaaatgcttggttagtgataatttacttgctttgtgcccacagatgctcagtgtgcataatgtggagatgaatatcagagaaaagagatataaagagttaaactattctgagttatagttaccaaaaaactaaaccaaggaaaaatgtttatagaactcaaattataattacatatcagcttttttatgcccatctaattaaaattaatgattattagtacaattaatttttttttacttattcctgaaaatgaattaattttagaaccatggataaattgtcagaaaactctaaaagatcacttttttattataaaagtataaatgaatttttaacaatataaaaacattttcataaaaaatgaaaaccacttgcaacacaaacacccagaagtagtcacagttgacattttggtgtacaatcttgcc

SEQ ID NO: 4213 - DNA, 1111 bp, Homo sapiens
acctgtaactgcaatttgggaggtcaaggcaggaggattgcttgagcccaggagtttgagaccatcctgggcaacaaagtgagacctttctctatattccaaaaaaaaaaaaaaaaaagaggccaggctcggtggctcatgcttgtaatcctagcactttcagaagccaaagcaggccaattgcttgatcccaggagttccagaccagcctgaacaacacggcgaaaccctgtgtctacaaaaaaacaaacaaacgaacaaaaattacccagatgtggtggtgtgcacctgtggtcccagctactcgggagactgaggtgggaggatcacctgagtccagggaggtcaaggctgcagtgagccatgattgcatcactgcactccagcctgggtgacagagtgagaccctatttccccccacccccaaaaaaagcaagagatgagggaggataaatgtttcataaaataacaaaatgttgttttcagtcgctaaaattcacttgactatgtcttttttttttttctgaacaaaatggtttatattagccaaagaaacaagagggagttgagcattttaaataaattaatttttgtttactcatgtcaagatatgtctgcaataaaaatgtcacccattagtctatttttaaaaattctgttttctctgttttgaggagcttttatggaagcaccagactataatattgttctgagctcacttctggtactacacaattctctattagaatcccagatctccacttattggctgtgtgagcatggcaagtaattttctaaacctctttccttagctgtggaagggggataaaaataatacgtacttctattttaccagaattgaggattatttggtgttgtatgtgaaaacattctctaagctataatcaactataatattcattgatattactagtcacatgctgtattttaaaatgctgccagtacaatttattttctggtggatattgctatatagatactgtcagctgctttttttttaaatgggttggtcatgcaagaaagtatattgtttggtttggttatgaatgatttagttggttcttatgagtcagagagagaattatggaag

SEQ ID NO: 4214 - DNA, 1160 bp, Homo sapiens
gcctcaacataaaccttttgaaaagtataaaatttcttttttctcatctatgcgtgatttttctaacaaagttaaattgagttatgctaaaatacagacttgctctaaaacttggatcaagatgagattttaattagttataactgtttaacattgtcccatttttactattacaaaaaaagataagcatgtgtaagaaactactcccctcctaaaaatatatattccctaaagcatgttaataattttctcagaaaaaaaaatggaacattaattagctagcactgtggctggcacaggagagattcattaaattatctatgaggagagtagcagcagtttagtaaacaaatctcttttttggaaagctaaatgaaactttttttaagcaaaaacaaaggcttttttatgatttggagtttttgtggtctttaaattaaaactatgtatcttttttttgtaaattcagaactaagcatctcttttctgatactttgttatttcacatttcttcttatgaagattatgagtttaacgaacatgaaagagaggcaagaagctttgccatcttccatacaagtgacaggtggaggagagaaaaggccaaagagaatgaggaggactggttaactttcttgagaaaatctaagtgttaaaagttagtgctacttcttttgtccttcgatctcaatctttcataatcatttaagccttgaatataattttctgtcctttcctaatcacttctcagagtacctgatgaagaatatggagtccatgaaaagaacacagttagagtttgggttttttggtttttttggggttttttggttttttgtttatttgttttggaggtggggatgttgagacagggtctcactctgtcacacagatgagagtgcagtggcatggtcacagctcactgcagcctcaacctcctggactcaagccattctcccacctcagcttcccaagtagttgggactacaggtggactctacaaggcctggctattttttttttaattattttgtagagacagggtctcattatgtcactgaggcttgtctcgacctcctggtctcaagcaatccccccatcttggcctcccaaagtgctaggattacaggtgtgagccaccatgcccggtccacacttag

SEQ ID NO: 4215 - DNA, 1200 bp, Homo sapiens
tgtctttgatattatgaacagtgttgcaataaacatatgagcacatatatctttttgttaggatgatttgctttcttttttcttttcagacagtctcactctgtcacccaggctggagtgcagtgatatgaactcagctcactgcaacctccgcctcccaggttcaagtgattctcctgcctcagcctcccgagtggctgggattacaggcacccaccaccacacctggctaatttttgtatttttagtagagatggggtttcgccatgttggccaggctggcctcaaactcctgacctcaggtgatccacctgccttggcctcccaaagtgctgagattacaggcatgagccaccgtgcccagctgatttattttcctttgatgtatactacccagtaataggatctctgggttaaatggtagttctatttttagttctttgagaaatctctaaactgcttttcacaggggataaactaatttacattcttaccaacagcatataaatgtacccttttctctgcaaccctgacaacatctgttgttttttgactttttaattatagccattctgactggtgtgagtgagatctcattgtggttttgatttgtgtttctctaatggtgagtgatgttgagcatcttttcatgtttgttggctgcttatatgtcttaggaagtgtctgttcttgtcctctgctcatttttaatggggttatttattttattcttgttgactggtgtaagttccttatagattctagatattagtcctttcttggatgcatagtttgcaaatatttcctcccattctgtaggctgtctgtttactctgttgatagtttcttttgctgtgcagaagctctttagtttaattaggtcccaaattgttatattttggctttgttgcatttgcttttgaagactcagtcataaattttttgcctagcctgatgttcgcaaggatatttcctagggtttcttacaggatttttatagtttgaagtcttacacttaagtctttaattcattttgagttaatttttgtatatggtgaaaggtaggggtccagtttcattattctgcatatggttagccagttttcccagcaccatttattgaatggggaccctttccccttgtttatttttgagagacattaattttaaaccatgtacaacagtgtctgtgatacaatc

SEQ ID NO: 4216 - DNA, 1197 bp, Homo sapiens
aaagtgagaaaaagaggcaagtgaagaaaaacaagatggcattgcatgaagaactttcttaggaaggaaggcagcaaagaggtaaaattggaggtgtagtcagagatggaagatgaaaaaggaaaataacaatatttcagaaatgaaatgaaaaaggtcttttactaagtaattggtactactacttgtcagtttcaagtgctgtaaaaaaaatgggaagaaccacacatgtgcactttcagtactatgtattttatgcttcagggatgcatacctgtttaacaaaagtatgttttttctcaaagtgtgttgaatagtccagaaaaagatggaggtagaagtcagacttcaggagataaaggaaccagaaagatcattgaaggctgtgatggtagaaaacattttgacaaagagttgtgcaatgagaaagctaggggtgggacaattaattttgagggtaacaattggggatttgagtagattttttgcttctgttctttaattgttttgtcttctttttaaagaaaccaagagactgttaatgtagtaggagcagagtttcacaatacagagcagagagggtgttggttgataaagaattgtctcaaatgagaggaaaagaatggagccaataacagagatgatgtttaatttgggaaaggtgggacatgttaacatgagtccagagaactaaaatgagcttatggcatgcagatgctgaagatgaagaaaggaaaggaaggaaaaggaggaatttatatttatttattgaataatcttgtaaaactgttaatcacccctttttactgacgataagacataaatgtcagaggtgttttgcctaaagtaaaaaattcgatagtcaagctgggtttaaaaccatatcagtcttacgtcaaagcatgttttaattgctgttgtgtggttgtgattttaagggaagaagaagagttttataatgggttctctgaaaaataaaatatcaattagaaagaaacaaaacaactgctgagaagcagtgaatccaagcagaatctgagtatcatcactttttagttaaactaaccagtccaatatcctgatttttctttaacaggcaaagaatttttgagtctttcccatagactgagttcttgtgaactattttacagcaataatggcatccaatcctatagataacaataacaaagctgcaga

SEQ ID NO: 4217 - DNA, 1177 bp, Homo sapiens
ctacatgtaacagaagtatcattctgcccaccttagtaaggatatccaattctgagaactcagatgctccacttctgttttttaccattttcttcttttcctttcccttccccctccttttccacttcctcgtccttcacgctgtactgagacatcatttagttcatcttattaaaatgtacaattaaactattaatagtaagtttacagagttatatggccatcaccaaaatccatttgtagaacttttccatcacccaacaagctctctcaagtccaatcaattgacagttccatactaccttcaagccaaccacgaattgtttctatagattagcctcttctgggcatttcattaaatggaattagataatacaaaatcttttgtgtctggcatcttagaatgagtttttgatgtttatctatgttgtagcaagtgacaagatttttttcttttaatgatgaatagtgttctattatagggatatatcattttgtttttccagtcaataattgaagaaacttagtttccagcttctcttaggaaaagtgctgtaatgaatatttattgaatagtctgtgtgtgtgtgtgtgtgtgtgtgtagctgtatatatatatgtgtgtgtgtatatatatatgtgtgtatatatatgtgtgtgtgtatatgtgtgtgtatgtgtgtgtgtgtgcatgtgtgtgtgtgcatgtgtgtgtgtgtgtgtgtgttttagcctgcttaggctgcataataaaatacaacagactgggtgtcttaaacaacagaaatttattttcttacagttctggagtctgagaagtccaagatcaaggtgccagccaggttgaagtctgttgaggactctccacttaggtttcagagggccaccctctttatatgtactcatatgatctcttctttgtgtgtgcatgaaaacagagtgtgctcaagccctctgatttctctgcatagaaagacactaatcctatcagataaggactccatccttatgccgtcatttaaccttaattacctccttagaggccctgtattaaaattaatccacactgagcattagtgttcaacatatgaacttttgaggggacacaaacattcagtcatagcatcttactagggtagatatttagggagaaattgctcagttttatgatacatta

SEQ ID NO: 4218 - DNA, 1202 bp, Homo sapiens
cgccacgcccggataatttttttgtattttagtacagacggggtttcactttgttgcccaggctggtcttgaactcctgagcaatccacccaccttggcctccgaaaaatgttaggattacaggcgtgagccaccatgcccggcccgaccatgttttatatattcgtcactgaattctagaactgaccactgtttctgacatataatagtggttctccttaacactaactttatgcttggaccaaatcaggtttcccgtcagtattatattctacagtatatctttcatagtaatactgtgttcaactttaaaagcttgttaattgtgatcatactcttactaggattatactaaaggttctacttgtgtttgtgaacatacatgacaaaaacacacatattaaaattatttgtttccgagttttatactatctaatgacacaactgtgtaagcatggtattttactgtttaaaattgtaaagtatcctgttaaactttacttttaaatttttcttaagacttcttaagttgcagtaactgtctatcagatgttgaccttaacaacatctcctgttaggtagaatgacaaaattaaaatggagcttagttgaaaaaaaaaaaggtttggccgctttgaagataaagatgcatatgctaggaacaggcatggtatgctctgtggtcagggaaggcctccctgcagaagtgacttctgagctgtaactggaatggtaagaagatcatgatgcatattactaaggacagagccccactcccttaaaccattccagggagggaggaggcccccagtgaggaatggctcatgctttccaggggggtacacaccagaagcaaggcttgcaggtgcagaagttcctgaactcacgtatgatgtagttgcagagagttttcaattttcatggagctgtgtgagcttgaaagatgacagtcagtttgaaagatgaccatggaccagttgccagaggggtcttcctgaatagcctgctatgcagaggaacttaaggatttttatatgtccttgggagagggaagagaggagagaaaactctaacaatggctaaaattgaatttccctcaattcagaggaatggggacttcacagtcagcttcattaaagaatatgtgacatttctagcaaaaaaaaaaaccaaaaaacaaggtttggcattgtagttatttg

SEQ ID NO: 4219 - DNA, 1200 bp, Homo sapiens
aattgtctcaggtaatagttattactatttttagcactatgacttaccaaattgaagtttttgtttgtttcttttgtagaagtgtcaaagtctcatctctgcctaaaccatatatttttttctggttgcctcatgttctgtcacagtcacagttaacatcctcattctcaatcctacccatgatgcagacagattgcctcatttcagctcaataaaacatcaccaaattcccttaggcagaaaaagggtggggagtgccctttcttgaaggaatcccttaagtgcacgtctcccgttttcttttcacatcaatgcagagtccctctgtgaatttacaacacccaacacccatgagttcagtccttaagaaggaaaattgagcaagtatttaattggttggacattgcataaaagaggtccatatccaggctaactctagaaattttattctcaaacttagttggcctctttttcttctgtcagaggaccattcttagtggcactggggaaatcttggcacccagaagaattcaactgcgctcactgcaaaaatacaatggcctacattggatttgtagaggagaaaggagccctgtattgtgagctgtgctatgagaaattctttgcccctgaatgtggtcgatgccaaaggaagatccttggagtaagtattggaaacgtttttattctgaatgagttttaaagtagaataattttttgatatgaaagtcttctatcactttaactttttattttcttcttgctttatgccctctctgctttcggcactatttattattgtaaagcaaaactaaatagacctctgtggaaatatatcggactcatggggttaggttgtctttggttttgtctcactgagtgctggcttgtctggtgaaagtctagccactgtggggaaaaaataatttactgtgggtgtgcttcctcaacaggagcctgtttgctcaggaatgaagaggtcgcataggaccacacacatctgagttcttagaactgacaccttcactgttttaaattaaattccatagcttttataagagcagtatttccctacttgtcagagttcaagcacaggacactgatttcatgaaatatataaaacatgaggtttataaatgatatatttttcttgaatacatacagtgtttaaaaatataacctcagttttatgagagtgca

SEQ ID NO: 4220 - DNA, 1176 bp, Homo sapiens
atatatttgaagtaaggagttgaacaaactgacttgagtgaatattaatcatagtgaacaaaatgggcccgttaagttattacagttcatcatatggtcttcattccaaaatatttacttatctaactgggaatgttgaccagtacttgatattttataataatgcaggtaagcataatgtgtgcctgacataattatgtgagcttttgaaaacactttattgtcataagatgtagcgaggacctgctgattatcattagacagcttgtgtatttaggtaatgaatgatttggtaatagtttttattcaggcttatgccagaaacagatttatttttaaattattttgctaaaagataggaaaagctgacatgtgatgtttagcagtaagttttcccaggtgggtagctgtttgttttagtatgggagaacttatttttaaaacccttttttgtgagtttaaaggggcaatggacttaattgttctggtcatgcaaaatatcttttattctggatgtcttctgactttatattttgaatatatatctatttcaaatatctatctatctatccatctgtctgtctatctgtctgtctttctctcctgactgtcacaggacagaagcaaagagagaggatccatcaactgaagagtcattagcactggttgtttttaatatacgccatcattgaattctctcagcaaccctttaaaaattgggtgttattattaccctccctttgtaaattgggaaattgaagcaacttcaatttcccaatttcccaagtaatgaattaagtaagacccaaaatgggtcttggattcagattccgtgttctcacatgttcccttcaataatgtggatctttcatggggtccccagtggttttcatcatcttagtcaagaggagagagtataaagacaccccttaatttaagactagattatcccttcatcattgggaaagttgaggcatttgacctaagctaaaagtgaatgaagcaggaggtagaaccctaggaccactcatagatggagctgcttgttagactacatagcaggctctggcaagtgggctctctgggatgaagtggtgcaagcaaggggagaagatcaatataaacgtgcttgatggtatagggtaattgatatttatttcataccaaggcactgta

SEQ ID NO: 4221 - DNA, 1100 bp, Homo sapiens
aatataaaagataaaaaagtggtacaccaatgtagggcacttaccacgaatggagcttgcaggactggaagttgctctgggtgagtcagtgagtgagtggtgagtgaaagggaaggcctaggacattactgtacacaaatgcagactacattaacactatacttaggctacattaaatttacaaaaaatatctgtcttcaataattaacctcagcttactgtcacattttattttattaacctttttttagcttttttactcttttgtaataacacttagcttaacagattgtacagctgtacagaaatattttctttatatccttagtctataagcctttttttaaaaattattttttatctttaaaacttttttgttaaaaatgaagacaaaaacacacacattagcctagacctatacaggatcaagatcatcaatacatcactagacaataggaatttttcagtttcattagaatcttatgggaccacagttattccgtcattgattaaaatgtcgttatgtagtgtgggactgtagatatgtgctctctttggagaaaaaaaaagagaaactacctaaatgaccgtatcacctctaaatattttcattcataagagactaaaatttctttactgtagtatactataaatatgcaaactaaatgaaacttgttttaaagttaaaagctggagatccattttagaaactaacacataagcagaaaaaaaattttgtggttattagttggaggctagaaaagaaactctttgaactatgaagttactaagtcttagctagagaccccaacaaatgattaattattgctaagaatcttttaaaatccagttttaaagtttaagtgttgtttctgtggaatttttccctcacctgcccccttctttctgtgattctaattccaaaattgagaagacagagctttttacttttagggaagctaaacctctttcttgctctaagaaggttgacctgctgatgaaagaacagaaggttggaattcttttgagcaggaatagctgtgcaaatgcttatttcattgttctttggccaatctttttagcactcaagtattagaact

SEQ ID NO: 4222 - DNA, 1174 bp, Homo sapiens
ggattggccagcttctggccacgtgacggatatgtccgtttggccctggcggcacctgcgcaagactgcggctgcgtgagtaacgagaggcttctgggaagtggagtctctcccccaccttttttttttttttttttttaaggtaaagaaattttttttaaaaaggactggtcacgtggccgatgggtagggtgcgcggttctcaacgcggcggacactcgcttgctggagggtggtttcagtcctctgctcttccgcctggatagctgcggtcacacttactgccaggcaagcctactgtgccctttgtcgccctgtcctcccatcttccccggaaggttgggaactgcaggctcagcacacacaataaggcttcatttgcttagttgaggtcccaggacaagttgcctgtgtgtttatttagttttcttttgatctcccaccattttctcttagtttcaaaaagaggcggcgatgcagagtcgtttaggcaatcaaccctcccacgtcccctggctcagctaatgctggtggtcattcgttgccatttctgcgaaaggggacggacggaaccgcccgcagtacccgcttgccaccggctggacgagggggagggacgacagcttttactgtcccaaatcctgagattaagacctcagggctaaatcttgcgtggcggtaaaaattatttggaagttctgtgcaaccgttccaatattccgcttttacgtgcacggaaatagcctaagtccagatgccagccagggaagccactccgggccccgctgactaagccctggactgatggtctggagtctttaggccgggtcaactatgactcttgacgttgactcattctccttaggcgagtgacttaatcgctcggcgtctcagcttttttatttatgaaccaaaggtgatgatacacttacctcacaagggtgtgcttcgtaatgactgtaaccggctttgaaaatgcatcggactctagaaatgattcataataagcaactgcgtgccttcctaaagatcaagtgcttctgctttttttttttagcaaagtttaaatttttttctgtttactttgtttgattatgatgtacaccagtgtagttttaaatgttcaggaccattttttttcctttacaactgcagctgccctcaatagaggctt

SEQ ID NO: 4223 - DNA, 1241 bp, Homo sapiens
aactggcaggaaatgcatcaaaagacttaaaggtaaagcgtattacccctcgtcacttgcaacttgctattcgtggagatgaagaattggattctctcatcaaggctacaattgctggtggtggtatgttaacttctaacattttaaaaaatttcttcagaggaaggaattttttgctgcttttaattagtttttccaggagaggaaatttaagtatattttcaatgatggaagtatggttgtatcatgaaatttgatttatatgtataactcaatgaatttttacttcatacttgagctgcatgtttttaaagatacctttcaagttgaacagtatacactttcttggtttcaaatactgtgattttttaaaaaatcttaagtagaattaattcctgtcactctcctaggtgtcattccacacatccacaaatctctgattgggaagaaaggacaacagaagactgtctaaaggatgcctggattccttgttatctcaggactctaaatactctaacagctgtccagtgttggtgattccagtggactgtatctctgtgaaaaacacaattttgcctttttgtaattctatttgagcaagttggaagtttaattagctttccaaccaaccaaatttctgcattcgagtcttaaccatatttaagtgttactgtggcttcaaagaagctattgattctgaagtagtgggttttgattgagttgactgtttttaaaaaactgtttggattttaattgtgatgcagaagttatagtaacaaacatttggttttgtacagacattatttccactctggtggataagttcaataaaggtcatatcccaaactagttgtgtattaaatttgcttggttgtaataggaacttgttttgagtatctcatctagcagcaataactaagcacatttctttgtgactgaactgtcaaatctgtagatcaacaaagtgagatagcccaagtatatttttttaatgttatatgagctactaaagttttaatttaaaaagttggcaggagctggagtgggattgtcagtttcttaggctaagtgtgaccatttcagtttgtacattggcttcgcttgctgtgtgacagcactgcactagtatgctgttagcatggtggacttggggagggagagaataggtaggaatgtcctgtatatccacagaatgaactccgaatttaaactttaaagataatagtgctacgtgccaggcc

SEQ ID NO: 4224 - DNA, 1374 bp, Homo sapiens
taaaagcctagttctggccttggtggaaatttctgtggatagatagaatgtgtatactattttaacatttgtccataatgaactgtaaaaatttcttcacgttaaaattagagcatgagctcggtggtagagaaagaaagggtcttttgatttttgttagcctcccaattttcagtgctgctttcttagttgtttttaaaatactactttcagagcatcaggctctcatttcccacattgctttgagtaccagtgctatttctcccttgttggcttttattctaatcatagtcattagagatgacttcatgatgagtctggagatgataaaatggaaatctttcccttccatttaaagtattaggaattctttattttaacttttaaaaataacatctttatttacaggtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgttt

SEQ ID NO: 4225 - DNA, 1176 bp, Homo sapiens
cacaatagtcttttctactaaccattctgagacaatcggacagtctcatgcaaaagaatgaagttgggcctcatcccatacacaaaattaaataaaggtagatcatagacctaactataagaactaaaactctataaaattcttagaagaaaatatgagaataaatcttcatgaccttagcttgggtaaaggctaagacactaaagtacaaccaactaacaaaaaatagattaattagacttcactaaaattaactttttgcctcagaagttttaccattagaaacaaaacatatatcataaggaaagctaaaagataatctcaggagaaatatttgcaaatactatatttgatgagagaattatatctggaatatgcaaagagcgcttataattcaatcataaaatacaaacaatttagaaagtaggcaaaggatctgtaaacatttatctatggaatatgttaatgcagatgtccattaaaaacaggaaaagatgctcaatgtcagcaacagtaaaatgcaaatgaaaaccacatgagatactatttcacttttattatgataactaagataaaacagacatagtaagtattggcaagaatgaggagaaactgcaatcctcagacactggtggtgggaatgtaaaatggtgaggctgctttggaaaacattctggatgttcctcaaatggttaaatatagacttagcatatgatacatcaatttcactcctcggtgcataccccaaagaaataaaaacatatgtccacacaaaacttgtacacataatttcataacagcactatgtataatagcaaatcatggaaacacctcaaatgtcaaaagagaactaatatatccatatgatggactatcatccaagctaaaaatggagtaaagcgttgatacatactacaatataggtggaccttgaaaacattatgctagaagcattcaaacaagcagtcacagaaaatgacatactgtgattccatctttactatatgtctggaataggtaaatctataaaacagaaagtaaatttgtagctgtctagggctgaggggtttggaggggaatggagaataactgttaatgggtacaggttttattttgagaatgatgaaaatattttaaaattgattttgctaacagttgtatacatttataaataaa

SEQ ID NO: 4226 - DNA, 1182 bp, Homo sapiens
gagcaaagggttaaatatacctttctccacagaatatatatgaactgccaataaggacatgaaaagtacattattagtagtaattaggaaaatgcaaagcaaaaccacaatataacacttcacattaactaggatgactaaattcaagaagacagcaataacaaatattggcgagaatgtggagaaattgtaacactcatatatgttgatgtgaatgtaaaatgatgcgaccattttggcaaatagtttggcagatgactgtttactcttaaatatggagttattatatgatccagccattccattccttggtatgtacccatgagaagtgaagacatgtccacataaaaattggtacataaatgtttatagtagcattatttgtattagccaaaaactggaaacaaccaaaatgtccatcaactaatgaatcgataactaatacatggtatatccatacaatagaacatggtttgaaaattaaaaggtgaaagaagttactgtctgctgctaatgtttccactacagatacaagaaaaagtctcttcacactttctgtctgtctgattgtagcagcctgagattgaatagaggaatacaggagggaaaacccagaaagagaatttttacggctcaggaataatcttgtaaacactaaagagcctgttttactacaaagaaaatcctaaaatttggtttacatgagaagtgttgggaaatagctcctcctatcctaacctagctggttacatttgtaagaacttaaaggctaaagctaattaaaagcaagccaataataaaaagaaaaggaagaacataaaaaggaatgaaattccaatacatcttacaacttgaataaaacttgaaagcattatgtgaagtgaaagaagtcagtaacaaaaaaacaaatattgcatgattccattcatatgagatgtccataatagtcaaatctatagagacagagagttgattagtggttactaacaactgggttggacagtgaagagagaagtgtaaggaagggtgaatgactggtaataggtatcaagtttctttttggggtgatgaaaatgttctaaagttacataatagtgacctcattccatcttacttgccatctatcttcataaatagccctgcttgtgtttttgccagtttcctccctccccagcttctact

SEQ ID NO: 4227 - DNA, 1180 bp, Homo sapiens
taaaaaaaactgtagaaatgaaggcttgttattctcatttccattacataaatggttgctcaaatgtgaatttctaatttatcatagtttatggtgatacattaagagactaatgtgtcatttgtgttttgatttctacattctagagagacagtttaatcagtccgtgaccaaaatcaaacagagtaaactgtgtcatcatggagatctgcccaggaaatccccaaaatacagaaggatcagaagtagatggaaataatgtcatagaacgtctctcacaactgtgttataagaatgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtgtaacagggtattttagttcctgttctgtggaaagtgtaaagcattccaacaaagggttttaatgtagatttttttttgcacccatgctttgattgctaaatgtaatagtcagatcgtgacgctgaataaatgtctttttctaaaaaaaaaaaaaaagaatgacacatatttgttcttcattcttgtttcacattagtagtggcatttctcatgctctattttcccagccttgttctatattttgagttatgtgaataaaagtatgccaggatgcaataggaagggtgcttaatattcatccttgtaggttcagggagatctttccatggaagtaacatttgaactgagatctaaaggatgaataggaattattcaggccaagtggtaagtcagagaaaagtgcttgctttagataaacgactgtatctatattagagacataagagagcatgacatgtttgatgaaataaaattaattccaaaagccttacagaaagtaaagaggaagagttcatactattgggatgcagcagtttgcagggatcagattatgagggttactttaaatcatggtaagggttttggaatgtggcttaagtggactgagaaatcaataatcgatttgaaaagagaagaaaatgattagatttgggctttgaaaatatttttgtagttgctgtggggaaaatggattgagagaacacaataacagaggctaggacacctatgaggagag

SEQ ID NO: 4228 - DNA, 1191 bp, Homo sapiens
ggtaagactgttactttccagaaagtgaaagcaaattagtgtgtcattggaattctgagaacttaaaagaagttcacataggggagttaaatgtactttttaaaaaagagagaggaaaagatgtagatagacaaattatattttaaatgaagaaagtacattctactggtttccctctattccctttttcttccctctcctgtcacctctctttcactttcttcctcttcctttcactccttccttccctcctttcttctttccttacttccatgattttgatggtccaactgctgttgggaactgttttgaaagcatcctttgactaggaataaaagcatacgatactggcatttttaccctgaaatctcttttgttcatatgactaacaagaagaaactaaggaaggagtgttcatcgatgacaaaagctatttctgcacctagtttttgtctcttcttgtacaaatgaagggaaaagtaactgccctctaacgaaattttgatgtcctagaaattttaagttctggaaatagcttggcatgatttaattttgtttggagtcagacagacttcagtttaagttctggctgtgctacttcctggctgagtgactttgggtagatcattcctgaatttcagttgctcatctctaaagggagatgattatacctacttgtaaagttgttggcaatataagaaacgatttatttaaagcatctggctttcacataccagtgttgaatatatgacaactattattattctttgaccaatttttcctctatttttctttcctgttttattcttgctcaggatcctctttacttgtaaacctcgattctaaactggaagatattaccatttctaagatgactgaacctcattaacaatgtattaatcttagtttatgtacctttttttgcacttgaaacaggaagagatttcttttttgtcattcttgtatataactgagaaagggagaggtctgatagcgtgaagtgcatgtaacctcaggatcaaaagtaaaatgtgaaaactacaattaaaatatgagctcaagtctataaaccatatatattccttatctcattattttaccctgattttttctatttttatacttttcatatacatatatatgagaacagtaaataaattttatttagttaaaaacattttttagcatctt

SEQ ID NO: 4229 - DNA, 1197 bp, Homo sapiens
gaccatcctggctaacacggtgaaaccccatctctactaaaaatacaaaaaaaaaaaaaaaaaaaaaattagccaggcatggtggcaggtgcctgtagttccagctactcgggaggctgtggcaggagaatggtgtgaacgtgggaggcggagcttgcagtgagccaagatcgagcggctgcactccagcctgggcaacagagcaagactccatctaaaaaaaaaggaagttgtatgctttcaactcccaaaaccaatgttcatttgatttggacatttaactggctattaataacataatggtgttgaaacagaacgtgattgttaagtctcaactctcttctttgagtctcacccatcttatattttggtaagctaataatggcaacagttaacatttttttgcataaagcttctcatgtatgttccagaagcataatttcttacatttaaatgataatattgacgatctattatgctgttatttaaataaaatctttatgtaaatcatacatttgtgcataattttggagtattttaaactactattgtacaacgtgatagtgtagggaaaaaaatcttaagttggtcgtttacaacttcagtgtccttaaatagagcaggtggattataatcaatatttgtataatttgttttttgttttcttccttctgtgtatgactaaataatacttttaaaaatgatgatctcttgtttggaattttttaaaaaattgtatgacgatggattgttcatttataatgtgtgtgttgtccttgggaaacaagatgacagtgatacatttttaagaaaattaaaggaaaagagaaaccagaagaaccagaaactattgtttataaagtatctaatgcattctttttaaactctaccaactgtatgtaattgtttaatatatacttgcaaagatttttagggctaaaattgacatcagttcaaagttgactcttattaccttcttcctggtgtgaagacgagcacatcccagctcctcttgaccaaggcagtgaacagcctcttttccaacccctggatcaccaagccacaagtttgccttcaaggggtgagcgtgcattgtcccaggtggtctgctcttcccacctgcatggcttcctgcagttatgtcacttcttgcaaatgttctgaagactagcccaggagtgtccagccttcagccct

SEQ ID NO: 4230 - DNA, 1131 bp, Homo sapiens
agaagattatcggtatttatcttcggtgatagaaaaacagtgctttattctgttagagagtaaggggtaattcaagaactgattcaaaatggccttgagggaactttttaaggggatgaacatttttgtatcttgatcagatattacctatatggtgtatgtgtgtcataactaaatgaaatatgcactgaaaatgtataatatatgcattttacctatgtaaattataccttaatttaatttttttttttgagacggagtctcgctttgtcgccccggctggagtgcggtggtacgatctcagctcactgcaagcttcacctcccaggttcaagtgattctcctgtctcagcctcctgagtagctgggactacaggcatacaccgccatgcctggctaattttttgtattttagtacagacagggttgcaccgtgttgcccaggctggtcgcgaactcctgagctcaggcagtctgcctgcctcggcctcccagagttctgggattgcataccttaattttttttttttttttttttaagaaagggttgttgagttattcacttggcttgagttctcaatccctcatagagaaacagtattgtgttgttaatgaagatgtttgagccactgacttttttaattttttggtttttagaagaaagagtatgaattagttattgcttaacaagttacctcaacactttgtggcttaaaacaacaataaaaatttattaactcatataattcctttggatcagaacataggaatagcataactagatggttctagctcaaggtctcacaagatttcagtcaagataacagctggacctccagtcatctgttataaaagcttttctggagttgggtgatctgtttctaagatggtttacttataaagaaggtgctagttgttgacaagaggcttaattcttttctacattgagggcctttccacaggcctcttgacatgctcaaagcatggtggttggcttctctcagagtgaacaatctaaggaaagaaaacaaggtggaagctacagtggctttggtaacctagtgtcaacaaacacacactgttattcctgcaatgcaatatcctgttagtttacacaggtcagccattaac

SEQ ID NO: 4231 - DNA, 1200 bp, Homo sapiens
tgacttggctagtgattaacatgtataaagccctatccatgaagtagatcatataagttctgaacatttggaagtgcttcaaataataccaaaagaagccctcttacctttgatgttcagtaaactaatttattagacaaatatttaatgactactatatgccaggcactgtgccagacccacgataggagatacttctggttctggcctacaaacttacacagttaatcagtttcctcagatgtactataagagatactaaattcagctagctaagtaaaagggtctttagaaagacatttaattctaatctacatggcaacttttaagctggcaaactcttttcacctacatgttttcattccgatggtgagttaaccaaataactggtgaggtacagaaagcaagtaccccctacaagctgactttgtttcaatatataaccatccctgaatgagttaataaaacctataattaaagaataggggaatgggaaattcaatgtggtgcagtggttcccagagtgtggtctctggatcagaaacattggtatcacttggaaacatagattttcaggccccacacagacctactgaatcagaggctttgaagttggaaccctgcaacctgtgttttaacatgccctccaggtgattctgatgcacactaaattttgagaacctctggtctggtagagaatttgcaattagaaaaactgggttctgtttctagctctaacatttactacctgcataacatttgacagtctcggagtaggcttcctcacccgtaaaactgaagttaataatgcccactcaaactgctgaatggatacagagttttatttaggagtgatggaaatgttttggaactacagctagtggttgcatgacattgtgaatgtacaaaatgccaccgagcagtttactttaaaatggttaatttgctgagtatgttggctcaggcctgtaatcctagcaactcgagaggctgagacagaaggagagcttgaagccaggagtttgaggccagcctgggcaacatttcaagaccacagataggcatggtggtatacacctgcagccccagctacttgtgagactgagaggggaggattgcttgagcctagtagttcgaggtcacagtgagctatgatcatgccactgcactccagcctgggtgacagagcatgaatccatc

SEQ ID NO: 4232 - DNA, 1180 bp, Homo sapiens
tgaaacaaacacggaatataaattccatccggatgaatttttgcccaccagtgtgaaatgcaagatttacttaatttctagagctctgcttctcaaaagtgcgtataaattacctggggatcttattacaatgcaaattctgattttgtaggtctgaggtctgatattttaaattttaataaggtcctatgtgatgtgatgacgctggacccggtcctgagacaggttagttttatactactgatgatatgttgctgccgtggtaatcttgctcagtaggaaaagaatctgcaagttcagacatctggtgtatatgcttggctgaggagccaatggggcacaactaccatctgtggaattatgaccaaaaatctctaagtcagaatctctccaaaggaaaatgttagggcagtgctactgatctttggttagcgctctgtgcaatgaaggtatatgctggtgaggttgcccaccaaggtgggctctccagacctcttcaatcttctggggtgcaaattagagaccagtcttgtccagagcatccaagaagtagagcgtgagcacaatgctagggcctaaaagatggtgaactatgcctgagcagaggaaagccacaggaaacttggtggaggtttgtagtggtcctgatgtgcagatcggtcatctgacctgggtaaaagagtgaaagacggaatcttctagtagttggtttcctgcaagtgttcctcagtatagttggcacacacagggaggatgctatgtgaaattaaggcagagatctctgagccaaagccactgaaaattgccagtaaaccacgaaaaactaagagagaggcaaggaacattctccctgagctcattcagaagaaccccttcctgccaccacttttgaggaacaaggttccagtagacttgagctaagaaaagtctcactttcaatctactcataatcctttagtaggtatcatgaattatgtattattcctcatctgtaagagtgttgaattacctaatgctatattaaggattttttatgttatctaatttaatcaccacaacaatgctaagagatgggtattctccccattttataggaaagaaagagagatgagaaaagtcaagtgatttgtccaaggtcacacagtttgtaagtgtcacagttgaattcaaaagcatccac

SEQ ID NO: 4233 - DNA, 1200 bp, Homo sapiens
accgcactcagcctagcttaatttttttttttttttttttttttttttgaaatggagtttctctcttgttgcccaggctggagtgcaatggtgtgatctcagctcaccacaacctctgactcccgggttcaagcgattctcctgcctcagcctcccaagtagctgggattacaggcatgtgccaccacaccgggctacacccagctaattttgtattttaagtagaaacagggtttctccatgttggtcaggctgctcttgaactcctaacgtcaaatgatctgcccacctcggcctcccaacgtgctgggattacaggcatgagccactgtgcctggcctgcttaatttttaaataagagcaataacgacattatgcttccacctagcaatgtaactatccctcatacaattgaaacatgctgtctccccaaaacaggaaacaaactccttttatccatttttgggtgataatcatctctcttctaggtgattcaatattccctctttgatatccggttacttaaacactgagagcttaaatattatcaacaaattgtatatcacatttgactaggagaatgggagcctgaaaaaaattggttaatatacacaaaaatatatttgtatcaaaataaaatactcctaactattacagtgcttatttctaaaactgcttacatggtcatagctggtatttataactacattcttccactacccatttcatattgtctttgccctcagcaaaaatctcagctggttgtggtttcttgcctgttggagtgacctaaaccttaatccctgaaaggtctaagccactaacagtcctggctctattgggttgttgtaattttccattgaagtttatcacaggatatgggattactaaggcatctcaggggatctactgcattccagacatactcctccttactactattttgtgatgacaatctaatttcctcttgattgtcaagataaatctgcctagcccataaagtattcttttatctgtttcttgattcattggcacgaggacttgtgaagtggctagctgacagtctcatctctcaaattaatggaaccattaatgtgttccttggtggaagtattcttctttggtactaatacttctagatcagtagagccctaagttgagtaaaagcaagaggagccattcccattccctacacatgat

SEQ ID NO: 4234 - DNA, 1193 bp, Homo sapiens
ggtatgcttataaaacacttagcaaaatatctggtgcagctgttgataaatgtcagaagacagctgttattgttgctatgtgatacttggttctgaacagaaaaattctataactcatcctcaaccctgcttgaaagaaggttcatgaactcctgagagtgcttcagtagtgagttggtgcaactaacaggaagggaggggctggggagacacataaaggcagtgttggcactaggtgtcacaaagcccagaagcaggccactgtctcctctggggaggctggctctctttggcccacccagctctaggagtggtggcaggtattggtctgactcaggaaatctgggtttccttttcccagtcaggcaggtgacacccaagaatgtgttcatgcctctttattcttcttagactaccttaccttccagtaaggccagtgagtaactatctcagaagcatgaattagactttggggtaagagtactatctgggagggggggtcagaagagagagccccatctatcagctttgtgatcttagtagtcgtttaatctctctgggcctttttccccatctagactaaatcaatgcttcctactcatggattttttttttttttttttttgagatggcgtttcgctcttgtttcccaggctggagtgcaatggtgcagtcttggctcgctgcaacctccgcctcctgggttcaagtgattcttccgcctcagcctcccaagtagctgggattacaggcacccaccaccatgcccggctaatttttgtatttttagtagagacaaggtttcaccatgttggccaggctggtcttgaactcctgaccccaagtgatccgcccgcctcggcctcccaaagtgctgggattacaagcatgagccactgcgcccggccctactcttggattttaagatgccaccaaaaaccagcctggtcataatgactaaggataatgccaccaagatatttaatttcataagtgattcagatatgccatcaccattggattaggagatgcccaagatgcttttgatttctaaaatgcaacaatttattttgtccatacaacttaattcttacttaaatcataagtttcagataattataaagttgaaaagacctcatagatatctatgcaagttccctgatttcatagatgataaacttcaggcccaaaca

SEQ ID NO: 4235 - DNA, 1176 bp, Homo sapiens
tggagctaaatatagtctagaaagtaccattgtgtatccgacactaggagccagtgcagccggcttgcgtcttaccttggtgtctaacacttcgttaggccctggacatgatccttttgttagatgccagcacaagcatttcattacagattcaggaaatgatgaagagataaatgttagaaagaatgtttccaaggaagatattaatggagtgttaatgcatcttactctcttcccagagcagaatcctctagagggattttagatttatgggagtgagagttcatctatgccaacagaatctttaccttcatttagcaacaaagtaaatatgaatgttaattaaagtgcctggtttagcacttccttgtaagcaaaattccttgaaaactgctatctggaacaaagccatatccttgctcagtcatggaaacctagagccaagaaaactaatgtatgctttcctacctctgaaatggaagacaataacaacattgtattctccaagctgaaaaattttggacaacagcatttttttcatgaagcaggcctcaaagagagttgtgaaaggacctttgaaagagtttctggagcccaatcttttttttttttttttttgaagttggtgtgtgttttaaaggtataagtaatatgggcttcataaatattttaagtttaaacatcagtttattctttacctttcaacttggacactggaaatcatgatgctattatcaatattttagctattattaaaagccagccagggaaatgcacatacgggcatacgtgttgtgcctctctcataaagtttgcctttaggtttatcatttatttctaatgataaagaatgctttatagttggtagcattttttcacattaatcatttctaatgttttcaagatgccccagaaatctgaaatacctcgttatagttcttgatctatacaaagataaaatactgcacttgctacatctacaaatcaatttaaaaattacctcctagatttgaaatcacttggagtatgggaagaagaaagagaaaagcacagataagtcaggcaagcttgtaaaatgaaataaaagtctttgcatttttctcatgaatcacaaaagtgcttgttgtttgctcctgagggttgaggtgtgataatctattaaattgttatgtgttc

SEQ ID NO: 4236 - DNA, 1145 bp, Homo sapiens
atgacttgctaatgttagaaagggcttgtatgcgtctatcaaagcaacggtggctgctgttagctaaaaatccttgtcagcttgtcccacgtttattctctatgtggaggtgaaagggtctgtgcttggcattcacttccattcttagacttaatttggaatcatccttttaaaaaaatcagagaccaggtcttgccaaatcaaactcctgggctcaagcaaccctcctgcctcaacctcccacggaatcgtcttgtcattaacttctttttttaatatgcagtagttgggagtaagatctttttatcatttatcaaaaaggcataaatgttccaccaaccataaagtatagttggtactttttgaacttcaactgaaacagtgtatataaacgattgcttttgaacctgcaaatcacaagtttcaggtatcgaagccaaaacagttaactttcttcagcctctggcagattattaacaaaacagtattattcagattctatatcatattaataagaattgaaccttgaaagtaacatctgttattctattaatgtgattgtgtgtgaatgggtctgatgactgttggactgtttgtaggaacttaacatggaagatgctgacagaatcagattttgcaggtgttcaacctatagtggctaagaattatgttttctatttcatcctcagaatgccatacaacaattctggaatgctgattttttttaaagtaggaattaaagtcatacacaaaatgtggtaattcatatgtagatgaaatattaaacatttaaatgaccgagtaaaaaacatctatcaattacacaaatgaacaagaatgtgagttagaaaaatgtaataaaatatgaatttcgaatattttattaagggatgatttaattcctggatttcaaaaacctttaaaaacatcaaacaataaacttttataaaaaagtgacaaaatacaagttaaatcagctagatttttgtgtaaccctgcagtttattaaaaaataatacaaatgcttataaatttttatttatctaatttcctgaggattttgtttctccatatcaaaccctttcaccatggccaacatgaactttttttttttttttttaaggcagttctctgctaggcattaa

SEQ ID NO: 4237 - DNA, 1164 bp, Homo sapiens
agctggacctctcgcagcgctctctgcgagggggcacaggggttattttctccgatgttgtccacacccagaaaagcttgtctctcggggctactgtgctgagccccgactggtcaggttaggccaccggggttagctctgcaactcttgcttcacggttaacagcccggagagctttcttaaaaaataccgacgcccactgccacctgggacaacgtaatcaggctccctagaaaaggggctcaggcctgggtactttttaaggttctcttgtgaaccaggaccaagggtcttgggagggtgccgcggagaccacgtgggcatggaggccccgcccccgtttcccgccccgcgcgcccctcccccggttccccgccccccccaaccccgcccccgccccgccccacccctgcgcgtcccgcccctcccgtgcgccgctgacgcgccgtgctccggcgcaggcgcacaggggacggttgctggcccaggtgagcgggcgcgctggtccaggtgagcgggcgcgtccccgcgacggcgctgcctgcccgaggcggttcacgtaaagacagcgagatcctgagggccagccgggaaggaggcgtggatatggagctggctgctgccaagtccggggcccgcgccgctgcctagcgcgtcctggggactctgtggggacgcgccccgcgccgcggctcggggacccgtagagcccggcgctgcgcgcatggccctgctctcgcgccccgcgctcaccctcctgctcctcctcatggccgctgttgtcaggtgccaggagcaggcccagaccaccgactggagagccaccctgaagaccatccggaacggcgttcataagatagacacgtacctgaacgccgccttggacctcctgggaggcgaggacggtctctgccagtataaatgcagtgacggtgagggggcacccgggcccagcgagggctcgtgctttcgggggattggggtgacggagatcctggaggtgtgagtgacagatgcaaggcagaccttgacggtgtccttcggctgtggaaaaacttaaccactgctagaatcttgccgttctagtgattgagcaagctgggtacaagttcgcaccactattgttagaatgtgagaggtcacattctaacggagaggtgtacc

SEQ ID NO: 4238 - DNA, 1171 bp, Homo sapiens
atataagcgttcactttcctctgcatccttaccaacatctgttatttttttgtcctttttaaaaaaattattttaaatttttgtgggtacacagtaagtgtatatatttatggggtacatgagatgttttgatacaggcatgcagtgtataataatcacttcatggaaaatggtgtatccatcccctcaagcatttatcctttgtgttacaaacagtccaattatactcttagttatttttcaatgtaaaattaaattattgactatgcttaccctgttgtgctatcaaatactaggtcttattcattccttctatttttttacgtatgtgcccattaaccattcctacctccccccctcccccgcacaacccccttctgggcctctggtaaccatctttctactctctatctccatgagttcaactgtttagattgtacaaataagtgggaacagagaagatgcagcgtttgtctttctgtgcctggcttatttcacttagcataatgacctccagttccatccatgttgtacatgtattttttgtcctttaataatagccattctgattggtataagatgatgtttcactgtggttttaatttgaatttttctgatgactagtgattttgaacattttttcatatgcttcttggctatttgtttgtcttttgaaaaatgtctgttcctaccctaaacccacttgttaatgggatgattatttggcttttttttttttttttttttgagaccgagttttgctcttgttgcccaggttggactgcaatggcacaatctcggctcactgcaacctctgcctcctgggcggattctcctgcctcagcctcccagatagctgggattacaggcatgcgccaccacacccagctaattttttgtatttagtagagatggggtttcaccatgttggccaggctggcctggaactcctgacctcaggtgatccacccacctcggcctgccaaagtgctgggattacaggcgtgagccaccatgcctggcctttttggcgtgcacgtgtgtgtgtgtgtgtgtgtgtgtgtgtgtgtgtgtgtcctgctctgtcacctgggctgcagtgcagtggctcagtcactgctcactgcagcctcaacttcccaggctcaaatgatcctcgtacctcagcctc

SEQ ID NO: 4239 - DNA, 1156 bp, Homo sapiens
tgaagaagcaggaggctaagaaagtggtgaatcccctgtttgaggaaaggcctaagaattttggcattggacaggacatccagcccaaaagagacctcacccgctttgtgaaatggccccgctatatcaggttgcagcagcagagagccatcctctataagcggctgaaagtgcctcctgcgattaaccagttcacccaggccctggaccgccaaacagctactcagctgcttaagctggcccacaagtacagaccagagacaaagcaagagaagaaggctgttggcccaggccgagaagaaagctgctggcaaaggggacgtccccaccaagagaccacctgtcctttgagcaggagttaacaccgtcaccaccttggtggagaacaagaaagctcagctggtggtgattgcacccgacgtggatcccatcgagctggctgtcttcttgcctgccctatgtcgtaaaatggtggtcccttagtgcattatcaagaggaaggcaagactgggacgtctcgtccacaggaagacctgcaccactgtcgccttcacacaggtgaactcggaagacaaaggcgctttggctaagctggtggaagctatcaggaccaattacaatgacagatacgatgagatctgccgtcactggggtggcaacatcctgggtcctaagtctgtggctcgcattgccaagctcgaaaaggcaaaggctaaagaacttgccactaaactgggttaaatgtgcactgttgagttttctgtacataaaaataattaaaataatacaaattttccttcaaagaaatacattgggtaatacataatatgtgtcctctgtaatgactcactaatcattaatgatcatataatgatcatacatggaggatgtcaggagactgcggcatttgagacaggctttgcctaaccccttaagatttcagctaagttcagaacatgtgtaaattcatggagaacactctatggtcaaaaaggagaggtgccagcaaatgcagggaggtgagatgctccagacatggtctggatatgacaatcccagggtcacacagaaagtgccccccttccaactgaactgcctacccatgacagtggtgctactcattctttacgcagaagtggccactgattggaacaga

SEQ ID NO: 4240 - DNA, 1176 bp, Homo sapiens
tctggttaatgcatgaataaaatttattcatttagcattcaaaaaagagtttgttccattgattctcagtgccatctcttatcactatgacattatgacattttggaaaagactagtaacattttcactaaatggtaaggatttttatttttattttttgagacggagtctcgctctgttgcccaggctggagtgcaatggcatgatctcagctctatgcaatctccgcctcccaagttcaagcgattcttctgcctcagcttcccgagtagctgggattacaggcgtctgccaacatgcccagctaatttttgtatgtttagtagagatggggtttcatcatgctgaccaggctggtctcgaactaccgacctcaggcgatatgcccaccccggcctcccaaagtgctgggattacaggcgtcagccccggcgcccggccggtaaggatttttaaagtattttaaaaaaacgtttacttggtcaaaggtgattcattagctcatactatgttttgatataatataaaagcaacgaagtgctatgatgatggcactttgagtggctgttaagagtagaaaccagccgggcgcggtggctcaagcctgtaatactagcactttgggaggccgaggcgggcggatcacgaggtcaggagattgagaccatcctggctaacacgttgaaaccccgtctctactaaaaatacaaaaaattagctgggcgtggtggtgggcgcctgtagctccagctacttgggaggctgaggcaggagaatggcgtgaacccaggaggcggagcttgcagtgagccgagatcgcgccactgcattccagcctgggcgacagagcgagactccatctcaaaaaaaaaaaaaaaaaaaaaaaaaaaaaaaaaaaaaaaggagtagaaaccagagattcattggtcttagaaatagcattagtgcaacatgtggattatgtgtactctcatctacccaatggtatgagcacttcatctgctgtcaaagtaatggagaaaactctggtttagcattagaaatcaccatcttctctagtacaagtcatgaaacttaatgtcggcagttttaaaaactgcagtaaagaaattcaccttctcaccttttattttatcacataactttttgaaagctctgttattataattacagtga

SEQ ID NO: 4241 - DNA, 1332 bp, Homo sapiens
ttctttaaaattgataataatgacaatgcttagagttgaagttcttatccaaaacattggtgttaaaccattcattaccttgtatattaacagtatttttctctgtataatttctttgaaatgacttataaatatcaataaatttacttgctttaaagattttccaaaagcttcattaaatctacatctgatatgtaaaaatataaatattagctcttgcacattcaatttgtcaagataatccaattaccaaaaggaattttcaccattggctaaaacctgattactggtttatagtcatattactaatgtaaataggaagatatttttgtaataagtgtttgaattccctaaaatacagcatgatttctatatttgaagaaaagcattatagctgtttaataaacctgagaactattatcaatgactgataaataatacagactgaatgcaatgcttatcttcctaatcgtgaaacagagtataaataaatgaagagtaaattacattttaaaatactaagatcatattaatacttgtaattctcacttcttgggatttaacaaaaacctgctttccactcttctggactatagtctggcctctgttttccaatgtatcctccccattcctcgccaagtaatatctttaaaaatcaaatgtgtctgtgtcaaacccccgtacaaaaaccaattcctcgcaaggctttcagaataaaattcagactcctcagcacggcagacagggactgatccctgcctatctaagctgcttctccccagtaacaatgcattaattgtaagtttccgtatgtcctgtgttgtctcattgcacggtgttccttctctttcaaataccttgcctgcttctgtgtcttcagtgtcttccagctgttactcccagtaacttcgttcagatatcatttccttatctagttgaattatgggtctttcatctgtgttctctttatatccaacacataatttaaaaaaactaattatataggtgttcactaaagtgtaatacagaattttgctaacttgtccatctcagtctctgggctgtgaattctcaaaacaggaaccttgaattttgtctctgaatcattagagctgaacacaatgcctagcagtgaaaagtcaccaaacatatttttgttgagtaaatataatgaataacaaataattcatagttttctatggacaggagtaatgttcaaaatatttaataaccagatgctaggagcacctgttggtcacaccagaactactgtaacaactggtaatgctgtacttatttcacccacccagtatcagcctgggctgtggatat

SEQ ID NO: 4242 - DNA, 1167 bp, Homo sapiens
acctgtagtcccaggtactcaggagtttgaggtgggaagattgcttgttcccaggagttctgggctgtagtgcactatgccaatcaagtgtccacactaacttcagtatcagtatggtgacctcccaggagcaggggaccaccaggttgctaaggaggagtgaactggcccaggtcaaaaatggagatgatcaaatctgctgttctcatcagtaatggaatcacccctgtgcatagccactcactctagcctgagcaacatagcaggaccctgtctcaaaaaaagaaaaaaccaaaaacgaaaacccaaaacaaaaacaaaaaaatgataaagagaaaacattaaaagcatccaaaggagtgggaaaaatacattatatatacaggaatgaagaaaaaatgacagcagattcagaaataatccatgccagaagacattcaatcagcaaagaactgaagaatactatacttacctggcaggggagataccatgatcacatagatggttttcccatggcaagtcttatccattgcactctggatgtgctgacacctgtgatttcaccaaatgtgggaaactcaactgcataatttgtggtagtgggggattttgtttgtgctttcccctggaaaaaaaaaaaagaagaacaacactagaaatggtaaataagagggtaaaaatgaaatacactttttcttattttgagtctctttaaaaaatcattggctgtttaaaatatgttgtttagtaatagtatataatggaattcatagggattagtgaaataaaatgtataacagcaatagcacaaaggctgatggatggtggctgtgggggcagtggtgaaagaaagtttactgtacctgaagtggtataatattactaggaggtagactatgataagctaaagatatatactataaatctaagatatagatatatatctaaagatatatactagagatatatgctaaatactataaagacatatactaaaaagatatatactataaattctaaagtaactgttaaagatatatactataagtcctaaagtaactacttaaaaaacaaataaaaagttatagtaaataaacccactaagaagatatgatggattcttaaaaaataataatccaaaagaagtcaagaaaaggaagggaacaa

SEQ ID NO: 4243 - DNA, 1179 bp, Homo sapiens
aggagaagcattcaccctccagagactgctctagactagatcataacacatctttctgaagttttcctacaatccagttttctctgttttaacaactacggcttaatatcattgtggatcagccacatttaatttactgttgtctatatgacttaaattgtgttaacattatattctcctccaggtgtcattctctatattctacttgtggggtatccacccttctgggatgaagaccaacacagactctatcagcagatcaaggctggagcttatgatgtatgtaataactatttatatcactttagatgaaggtttgtcttttgcctgttgaccaagagccagatcttttcatttttcttttaaccataatttttaccactttctcatattatttccctctctcttaaggaaagggagaaagaaatgcagcatttgtatccagtttacgtttccttttaactcactgtctcctaagattgaaagaaaagccatgtgaagtctctgaggaagaactttgtcaaaatatttggaccttagtgcattttaaaaacataaaaattaaaatatttctgctatagaaatgattattgcctgtttagttgaattatattctcaaatatctatcacataattttatattatataccaacaatattttgctgtgatcacatatcaaatagaacattatcccactataccagtttctgggttttgttttttgtttttgtactgtttgggatactatgcaagctttcatttgaagaatgagtttcacaattgaaaaatttgaaaatcataattctaataatatatttaatttataattagaatatttgaaagtagatatatatatatacattcataaattaagttcagaatctgaagaggaaggctttatctactttctctttatggcttaactttgtgtttatgatataatttgctctcctttgatacatattcttgtaaatatgatttaccactttctcaggtttcccctcatacagccctatggaaatccatgtgcagggtctgggcatgctttccatgtgttattaagtagagtaactacagagtagcaatattgggttcaccttttgtgcacaagttgaaagctcaatgtgaaagtgagaggagaagatataaaatgtctttattatattctataatgtctcg

SEQ ID NO: 4244 - DNA, 1194 bp, Homo sapiens
catcattatttgttcattcatttactcatctatttaacaaatatttattgagcaactgctgtgtgtaggcacagttcttgattcagggggtaggttggtgaagagagttaagatgagagacatgggaaaaggcatttggatagataagtaccatgcagtgctatgaagaaaatatagcagggctataaattagataatgacctcattggagttactttagatagagctgaggaagaagcatttgagctgaggcattaacgatgaaaagaagcaaaccgtgagaaaatacgaagaaagaacattccaggccaaaggaccaaggtgacagtgagcttgcacaggagtagaaagaaagtcaatgtggctggagtgtaattagcaaggagagaagtacatgatgatgttgggaggtaggcaggggatggattgtgtagagtcttttagccaagttaaggaatttggatcttattttaaatgcattgataagccgtttaaggatgtgaagcagggaagtaatgtgataggattttgttttaaaaaatatctctctggctgccatgtggagaatacattgtaaggaagtgtgagtgaaagcaagactatagtagtctccccttgtctctgggggatacgttccaagacccccagttggtgtctgaaactacagattgcacaaaactatatatactgtatttttcctatacatacataaatatgataaagtttaatttataaattagtcacagtaagagatgagcaagtactaataaaatagaacaattataataatatactataataaaagttattctgtgcatgtaacttttgcagtttgaagtgcgacagcaaaactgcatgaatttctttctccttcttcacaatttcatggatagaagatttattcttaccatagatcttagcatatacattttttatttccttattaaggggagaactttcacctttgcacttaaaggaagcacagtttcctttgctgaacggcttctccttggcatattccaattgccagtatcactactcttgcactttggggccattactaagtaaaataatggttgcttgaatacagcactgtggtactgcagcagtctgtgataactaagatggctgacaggcaggtagcataaacaatgtggatccactggacaaagggatgattcacatcctgggctg

SEQ ID NO: 4245 - DNA, 1302 bp, Homo sapiens
aaggagccgcgaagggggtggtagacggaacaggtggagccgcggcggggctaggcggggcggggagtgaaacagcataggctccgcccctcgcggcgcttcccccggaatagcgtcatcagttctataagagagcgtgtgccgaaggcctcggcctttcacattcgggaagcgtcgggattaggtgaaagtacgtagttgtctttcgtaagttaaaatgataattgggccgaaacttactgccttacctaaaaggcagcgcagtcaggatattggtaggtcgggggcggctttggaaacccttaagtttacaagcatgcgcggacttgagtgctcattaggtcgccgggcgtccacgtgcagccctggaccctgaaccccggcgtgcgtgggccgtgggccctcggggaaaggttccgtgcactcggggactccggtgaagcctgttcagccgtctgtgtcatgtggccatcttgagtctactctgtcgctcttgtgccctagcaccccgagaaccgtcagtttgagccagatggtgagtaataacctgtagcagtttggttgctggttaattctggattgtgaatctccatgtatctttgggacctgtcagccgtggcagtctcccttcctagccatggaagagcatatccttgtttattggcaaagctgtcaccatttaattggtatcagattctgacttgcacaagtaacattcactgttaaaaacctagagggtgccgggttattgggcaaaatttctaaaccgttgttcaatgtttctaggaagctgagctgaacacattacgatggatgatggaaacataaggtacatttcttttttgatatttctgagttaatctgaaacgccttagcggcaggacgttggaaagctaaagttggcccgttttgctggcttttgtagtttgagttaacaaccaactgaattagctgataagatctcaaaacagtgaggtaagtacacagctcggagttttataatgctttttttctcttgcagactatcaagaaatccaagtggtaatgggcgaagtttattcagcatccggcaatggacttatcgtagttggggaaacgggtgttccgaataatatcctggaagttatcaggacacctattttaaatataggcctgaattttgtaaagtaatatttaaggtggtccgtgataattaaataaaatgcttaattcatgtggctactcattgttccttgactgagtgattaatagacggaaaggtagttaatagcataatacctcctatttagtgttacacgctca

SEQ ID NO: 4246 - DNA, 1302 bp, Homo sapiens; identical to SEQ ID NO: 4245

SEQ ID NO: 4247 - DNA, 1230 bp, Homo sapiens
ccaaatatcctggtaatgttgatattttgccctcctcttgtgaatcctgattgttctttatggcatctagaatggtgaatccttttcagaaggttttcagtttactttgcccagttccatcagaggaatctctttctgtggcagctgtggccttatgaaatgtgtttcttaaataatgggactttaaagtcaaaattactccttgattcatgagctgcagaatggttattgcagggatgaaagcaacattaatctctttgtacatcaccatcagaaatcttgggtaaccaggggcattgtcaataaacagtaatattttgaaaggaatattttctgagcagtaggtcttcaactgtgagcttaaaatattcagtaaaccatgctgtaaacagatgtgctgtcatccaggctttgttgttccatttgtagaatacagtcagtctagatttatcatgatttttaaggccctagaattttcagaatggtaagtgagcattggcttcaacttgaagtcaacaactgcattatgtcctaataagagagtcagcctgtggccagaaaggtggccgccccctcgcccgtcacgcaatgcatgttcgtggggaacctggtgctaaactattcatagatgacctgcttctgggtcggggttttgtatgtagcagagcggctccctcgctgctatctattgaaagtcagccctcgacacaagtgtttgaaaaaattaaaaaataattaaaaaaaaaaaagacagaatcagcctgtcctttgaagctttgaagccaggcattgacttctttctgactgtgaatgtcctagatggcatcttcttccatctgtcaatatcactgtcagtcttcaactgtttcttccacagatgacagtcttcatctgtcaaacagttgatgactgtttcttcaacactgaaaatctgttaattagtgtagccactttcattagttatcttagctagatttctggataatttgctgtagcttctccatcagcatttgctgactcaccttgtatttttatgttatggagatggcatctttccttaaacctcctgaatcaacctctgctagcttcctacttttctttagcttcctcaccctctttttctcagctttcgtagaattaaagagcgttagggccttgctctggattgggctttggcttaaaggaatgttgtaactggttggatcttctatccagaccactcaaattttc

SEQ ID NO: 4248 - DNA, 1178 bp, Homo sapiens
tactagaagccatcacagacatttactcttacatcctgttgtctagaacttagccagatggcaatactaagccactagggtggctgagaaatgtggtctttattctgggtggccatatatgtccagacaaacagaaggggaggagaattattgaaggacaactggcagtctctgcactagactctacccaaatagtccatgtaatttaaacacattattcattctgtttcagtcttctactagattgtaagctcctatgacagttactaacctatgtaagtttgtcgcccatatactgctaagggtgcctctgatggagaaggtattcaatctttatttattgagttcaggaactaaaaatttatcaacatttcttatagagtaagaaacaaacatagtatcatgtaactttaataaatctaatgctcatttttcacttaaagtaaccatcaggaaaacctaaaaatttcaaggagttaaataaggtatcaggtatttgttgatttagaagtagtttttctacttctctttctctatattaactagtgtaagtctgaatttatgaactctgacaaattgcttaaccattttggattttttcctggctcctactcttaaaataatgatgatgataattaaaataatgatgatgaagaataataatagttattgatatgataattatcattttaaaagagattttacaaggatacttacttctccaatatacttcattctcctggtggtcaccttttcatttttcttcttttgttcactatagcttcttattttcttctctctaggctgttgctatttataaaatatttgtagttttaaacattgttttattaaactaaaccctgcatttatataaccttttcttgagtgtcactcaaataatatgtatgaagtaggacctcaggagtgtattaggtctgatgtgtatggtaactggcatgccttcacagactctcagcctagtctcaagaaatattcaatttaaagttcatttactattatgtcactcttctgtcatttccttttcattctttttcatgtatacataatactagacaagtggtcagtacttggtttgaccaaattacacttaaagtaaaatgtacaacaaagggaagactgaaatattttgaccaggaaccaggccacagggttcagga

SEQ ID NO: 4249 - DNA, 1174 bp, Homo sapiens
aattttgttttatttcaatttctgattatttttattgtatggagatacaatagatttttgtattataatatcatgtcctacaaccttactaaactcagttactggcaagttgttttttgtagattctgtcggatttttcacagacaatcatgctgtctgcatgaccagaacctccagtttatctttttataaacctccagtttatcattttatttctgatctcaagataaaagcattctgtttttcactgtgaactattaagttagctatagattcttgctaacagttttattgggtagagaaaatccctttctattcctggcttgacaaaatttttatcagaaattgatgttgtattcttcaagtgctttttctatgtctattgagattatcatatactttttgggttttttacattgttagtatagtgaattatattaattgatttttaaattaaaacaaccttaagtttcttggcatcaatccttcctcctgactctgaggtttgtgagatatgagagacatttaagacatctgttagccaagcgaaatgtaaagcacagactcagaaaaatgggaagtggtaggagagctttctgactacagagaggccaatcagaaggtgtaggggaagagttatgctagtagactacaaggcctgggacgggctgatggtgagtggcatgggctacactaggacaagaaggttcagagcattaagagacacaaatatggttgaggattaagccatttggagaatttacactatggacgttgactgaaaattgaaaaataaagaaacagacaaaaaatgatgagtagcagatagatggcatgctctgagagtccaggcattaaaagcatcatccctggaaggtgtcagttgcagcaacagcaatatctgcaggatttgactgtagcattttctaaacagctcacaccctgtggtctccatatgtgcaggttcttaggataaagcacatcccagaggttgtgatatctgtcatagtctaggccagagatggtcacagagactcaagcctgattttgacagctgttgaatttgaagtactaaactcttggtcacttgttgtttcagcaggataccatctgttttatctccaatcagtctttgccaccttagctgttgatatttcatccgtgaactttcatt

SEQ ID NO: 4250 - DNA, 1399 bp, Homo sapiens
cagatgcaaagcatgttctgcccttctgtctcggagggagagccatgacagccctgcagccccagcactgcccgtgttagctgatatataccaagtgatagaaactattctgtctagaaggcttgatttgactatagttgttaaagttgcctgattctttgtgttaccagagggaatactgagtgtctgaggttacattggtaggaaactccctgcataacattcctgatgtgaaagtcacagagattacccacttgggagaagagtcttatgaataaaatttgttgccagttatttagttttaaaattttctatggcttctgtgagtcatggaggttaatggaatacatttggtttcagggagatacatctggggactataagaaagctcttctgctgctctgtggagaagatgactaacgtgtcacggggaagagctccctgctgtgtgcctgcaccaccccactgccttccttcagcacctttagctgcatttgtatgccagtgcttaacacattgccttattcatactagcatgctcatgaccaacacatacacgtcatagaagaaaatagtggtgcttctttctgatctctagtggagatctctttgactgctgtagtactaaagtgtacttaatgttactaagtttaatgcctggccattttccatttatatatattttttaagaggctagagtgcttttagccttttttaaaaactccatttatattacatttgtaaccatgatactttaatcagaagcttagccttgaaattgtgaactcttggaaatgttattagtgaagttcgcaactaaactaaacctgtaaaattatgatgattgtattcaaaagattaatgaaaaataaacatttctgtccccctgaattatgtgtacatgtgtgtttagatttattattaaatttatttaacaatgttctctctttttaagctaataattgacagtggtgttagttgagaactgaatttacagttggtcttttgggcagtaagaaatgcaaaccatagactgaatttccttcatagtacatgatttttcctaaatataggaaagatcgaaggggtctctggtttatttgcaccatgtttatttaggcatctattaaagcaatgcttgtggtgctacttgcttagtagaaaagctaattataaaacttaatgcaaaaattcagagtactacctttctctttcctctttcctattgtgaacttgcctcccatttactgtctgtcactttctttgagataaataaaaaagacaataattttttctagaaagaagcagtttatcgatctcttctaatatttgcctttcagttttctgttttcaaactgccatttcagttggtgtcatttttctttttgtacttatgccc

SEQ ID NO: 4251 - DNA, 1162 bp, Homo sapiens
atacacctttataaagttctaaattcaaagatttgtattcctctggcacgtgaacgatcatttcaggctttgctgggttatcgtaaagtccctaagtatgtatacagaaacaggacttagatcaaaaggcacgtaacaagagcactgcttaaaattgagtactcaggatagggtattaagatttagtgcgggctcagtatgcttgtagatcaaaatggtgtgagacttaatgggaagggaacctgcaaagatgtgccctctgtgaaccaggaggtgttggtggggtttcgtcacagagaagagggagccagccttcccactgatggtattacaggtgatcaggatagcttctgtgctgaatcggccatgccaattcccattgtaaatggttcccttcccagttcaaaaggggtcacaaatcttatcaaatggtaaatttatttaatgactgaatatgatatatagcaagcggcttcctgtttgtgttatttactttgtcatattagtcatgatatgaataataccactgtgtttcgtgaattaggttctcagaggcactgtgactgacttccctggatttgatgagcgggctgatgcagaaactcttcggaaggctatgaaaggcttgggtaaatttagcttcctctttctaaagcaaatgtgatatttgtttttccaaacaagtcattaattacagtaagaataattttagaatattttgatctgaaatctgtaggagaagagatatgttaagataacaaaataatactataaaccagagtgtccagtcttttggcttctctgggccacattggaagaattatcttgggccacacataaaatacactaacaataatgatagctgatgagctaaaaaaaaaaaaaaagcaaaaaaatttcataatgttttcagaaagtttatgagtttgtgttaggctgcattcagagctgtcctgggccacatgtggcttgcaggccatgggttggacaagcttgctataaaccatccctaatattcagtctctagaactgaacaggcagttaaattcagcctctgtgcttttgagcttgtcaccctcacctgtgtggtagaggcccgagtcgataaggcagccatccctgcaggtgggcagctgtgcagctctgttcccaatcagatatc

SEQ ID NO: 4252 - DNA, 1284 bp, Homo sapiens
tataataccctcaacaaaaacatttttgaccccaaatgtcactagtactcaggttgagaactctgctaactttataactagctaaggacaagacattaaaagggaaatgtagaataactcatccagacttgtggagactaccaatttttttaaaattttttatttctatagggttttagggaccaggtggtagttggttacatgagtaagttctttagtggtgatttgtgaaattttgttgcacccatcacccaagcagtatacactgaatccagtttgtagtcctgtccctccccaacttcccaccctttcttcccaagtccccaaagagactactctttttttaaaggatacctgtaccaggcaatagactgacaagaatacaaatctaaaaatgacaaatttcatctatttctatgtagcccaacctggacataaatttaagtacagtatattattttctcacatattggatgtttactgatagttgaccaaaccatgaggagaccccccaaaacaaataaaactgaccagaaaacatggagaagagttaatagtagccacagtttcctactacattatggctcagatttctagacctgtttgaaaagttgaaaaatctatggtctcattcctcagactgttttgtccaactgacctgaacatctgtcactggaattttttttcctttggcatgacactttgtgcctacatgttttctaaactgcaggtaacttttgaaaggccaagttcaaccattatcagattttaacatttagtatggattaaattgtgagtgcaatttcttccccaaaagctggccagaaggactggagtttggggagggatgctttgaagactgtgatataaatgatggggtcctggagaggtgcaggggaagaggaggcagagtgggaagctgtgaggtaggaaagagaggaaaattttctaaaagaagaggtaggagaagatgacacaacacaaatgtttccaatttttcagtgttgctgaaggtcaactgtgcttcacacctgggcattctcctgaatttgcactcaaaagggcccattttctggcgtttttctcatagtcctggaataatcttcatttgacatgagagtcttgataaaaacaagatgttaaaagtggttagagagtttctccttctccagcatgtgcgctgcactcctgcctttcttttggcatccttaacttttggcaggcctctttcaatgcggtgggaatggataatattaagtatgtactctaaagtagcaagctgtg

SEQ ID NO: 4253 - DNA, 1221 bp, Homo sapiens
tagtaatgtggattgatgttttctcagagtaactcgttgtcttttcgcttgaaatttttgatcttgtcctgaagactagctgctgctaaaacaatgctagcctaaagatacaggagtctctgacaaaatgactttcatgttaaggggaaatgctgtttatctactcagacatgcatctgtgatgttcatagccttgtttcagttataatagttgtcttgtttttttcttaattgattttgttaataataccttaacacagggtaggaagaagtggcacagtgtattgcattatatacatttatcattgatttacctaatgttaccttgtagattaaacactattaagtggtaatacttgaaaaggagcacttataccataagtcttaggaaataatgtttgtaataaacttaactatgttacatatcaacaggcaaaaatatagaatgttacatagtgttgtgtgattaaattatagttcctgctgttaacattaccttttgaaaccttggctccagttttggtgcttcttatacaaattaaatgcgaaaagggactgtaaacttaagatgtattttaaggactttatctgtgcttcatcacccaacttgttcacattgttaatttctgtccagagacctgaaactgcttaagtatgggaacagactgaaatggtgtttcaacctgcaagagacagaagcatagacaagtatatgagcccttatgtccttaatgccaatcaactagattgacctaggttaaaatttcaaaaggctcattttctcccaaagctaaatctttatattaggaacaattaaatattgacttaagttgtaaaaattgagagtacaatatctttagggatagtcattatttctcacaactagttctctacgagagattttgtttctacaatgtagtcagcacttaatggagagtatggagtagtgcattttgcagggatttttattccgtcttttgaggggaagaatctcttttttgcattaaaaaatcatataaacttaatatatttttaaactctcctagtctttaaactttctcttaattctcttaaaatgaaataggtatatccaataggtgatgaaatacattttttacaaacatagatgctttttatttgtatgttgaatgtacagattcatttcaagaaaagcatgaagataatgaaagcaaatatgtaacaatacaagtagggacttta

SEQ ID NO: 4254 - DNA, 1181 bp, Homo sapiens
aattttttttttcttagcatcattactccattaacaatggatatgtatgcctggactcaagaacaagctgtgttatataatggcataatacttgctgctcttggggttgaagccgttgttattttcttaggagttaagttgctttccaaaaagtaagttaagtgtttttggttttatgtctgtttttaaaaaataaaacaaaaaacagagctaacaatgcaaatggatataccaggaaaataatttaaagcttttttttgcacacaaatttacaatttattaagagattatcatatttctatacattacagcatttctttggtaaaacaaaatttctcacaaagtatataattgactcttatttatcttttgtctactatgttttcctgaaagtatatttcataaaccattgttctactgtattgtaatatatattgtgcaacaaaaaagattcatggttaagtttggaaaatcttggttaagattaccaaacttattctagaacttctatccatagtatatatattctatatcatcatcatggcaaataaaatttgtgtcatttcccagaccacacaacactctttttttttttgagacaaggtctcgtattgttacccatactggaatgcagtggtgcaatcatggctcagtgcagcctgatgggctcaagagatcctctcatctcagcctcctgaatagctggactacaggcatgaccaccacacctggctaatttcttttatttttattttttgtagagatattatctcactatgttgcccaggctagtctcattcctgggctcacgcaatcctccagcctcagtctcccaaagtgttgggattacaggcatgagccactgcgcccagcataagtgttttttaattgatacatgatagatgtacatatgtttggggtatgagtgatcatttgatacattcgtataatgtataaagatcaaatcaagataattgggataccatcactttaaatatttaccttttctttatgctaggaacatttgaattactcttttctagcttttgacatgtacactaaattattgctaactatagtcaccctactgagctattgaaaactaggtcttatttcttctaactgtgtatttgtacctattaatcaactattgtttattgcctccttcccgctattattcg

SEQ ID NO: 4255 - DNA, 1229 bp, Homo sapiens
ttgagaagtgtctgttcatgtccttttaccattttgtaatgggatgattttattttactttaattttgtttattgaattaagttccttatagattctggatattagatctttgttgcatgcagagattgtgaatattttctcccactctctaggttttctgtctactctgttggcagtttcgtttgctgtacagaagctctttaattagatcacaccagtttttgtttttgttgcaattgttttaggggacttattcataaaattttgccaaattcatgtccagaatcatatttcctaggtgtttctcaagtattttcatagttttagggcttacattaaaatctttagtctatattcagttaacttttctatatggaaaaatttagaggtccagttttatttttctgcatatgactagctgattatctcagcaccattttttggatctgtgtatgaatctacaattatcttaactcttgattaaaaaagaaaactcatacttacctggcaggggagataccatgatcacaaaggtggttttcccaggacgaggcttatccattgcactccagatgtgctgacccctgcgatttccccaaatgtgggaaactcaactgcataatttgtggtagtgggggactgcattcgcgctttcccctgagaaaaaataaagaaaaacgaaaactctcaaataaagttaatataacaaggattaaaatacctaagaaaaactgaatacaagtttttgaaaaaacaccacacaaaagtgtttatatgggctgggagtggtgactcatgcctgtaatcccagcactttgggaggccaaggcgggcagatcatgaggtcaagagaatgagaccatcctggccaacatggtgaaaccccatctctgctaaaatacaaaaattacctgggcctggtggtgagcacctgtattcccagcctcttgggaggctgaggcaggagaattgcttgaagcagggaggcagaggttgcagtgagtgaagattgagacagagcgagactccatctcaaaaaaaaaaatagtgtttatatgtcctggaatgagagagagatggaggagggaaaaaaagatgaaaaaatgggaggaagaaaaggaggaaaggaggaataaaggaaggaaataaggaaaggagagataaagaaagaaaaacacattaaaaatgtgtttgtacattttctttgcaaaacctaaaatatgaaagg

SEQ ID NO: 4256 - DNA, 1193 bp, Homo sapiens
aaagtgcatgtaattggtgttgctttctgtagattctctacactgtacagtgtgttgtttctcagattttttttttttttttttttttgctgccagactgatttggctttgctgggtctgctaacccactccatactcatccagacactttcagtcttccaggattttgttgttcttacctcttcttgtttgttgctctcacctcttgtccttgtgggtttaggtataaaagagtcttttactgttgttttagtcagctttcataattaagtgaaattatatgcatgtttttaatctgccaacttaatcctaaagcacagattatttaaaatgtttaatctatgtcttacctcttgagacttgaaaggattattaaagttagcccttttcatctcttgttttggcttttacattcatatttataatatttgaaactcattatgtggactgctcgagactgtattagttcaaggatttataagtgaattcagaatttgtaaatacaaaggttgattgttctttaaatttgctcttataggaaagtgaaaaggtttctgaatatccagcagtgattgtggagccagttccaagtgccagattagagcagggctatgcagcccaggttctggtttatgatgatgagacttatatgatgcaagatgtggcagaagaacaagaagttgagaccgagaatgtggaaacaggtagacatctcataaaatgttcattatttataactttctcattttgtaagcttcaacaatactattgccagatgaaaaatatactgaaaaacctttttaatgctatttagtatagcttggaaaccagtgaaacatctatgtttaagggaatttgtgtagatataaaacttctattgtataattctatgaggtgtaacagtctcatatcatggactctatgcacaaaattacagcttcacataatgataaagttattttattattttttttctgagagtataaatcctagctgttatttatacaagtcaataggctagtattatgaggacagctttttaaattaaaaaaaatggtattctatcattgtctaattgattatgagtttctttgagttaatattgatggagcaataagatttcttttcattaatatcagaagcatcattgtagtgttctatcagtttcctctttgctttttgtcgtcttagag

SEQ ID NO: 4257 - DNA, 1217 bp, Homo sapiens
gtttatcataaaccaaatgattttaaagctgtcacatactaaattagctaagggaaaagcagggcttttttctttatgatgaaggtttttattttaaggatacaagtattacctgattttgacatagaattattcagtccagatatttgagaatcatctttgtttctgtttctaaaaagttacatgtaagttgaaattttgaaccatattttgttatgtaaaacttcttagtaaattgttttgaaattgaagaatctctttgaaattgactgttttctccttatttatctgtattgtagatctgaatttgcatgaattatgttttcttagcacaattcgagtcataaaattttttgttactttaaaacaattatctgtatcttcaaatattttgacaatcagatcagttttatattagttttaatgtaaagtagaactacagaattttagaccctgaaaggtagaatgttacagtaattgtctctcatttcatagtgggaaaaatctgagaccttaaaagatgacttattctaggtaacagatagaaacttagtaacgcaacagtgactagagcccacatcttcatattgttctttctactgtaagaactgtacatttataataaagtactcctgtagtcaggttgtattgttgtttggatttttaagtgactggtgggggagaaatagaacctttaacagaataatctatagaatttggaaatactattaactatcacattgccaactccatacatttaaaactgaggaaattaaatcaggcatcccaatcaccaaaaaaatgctaaattgtcccaattgagaacatcattttggctgggtggagtggctcacacctgtaatcccagcatttcaggaagccgaggtgggcggatcacttgcggtcaggagttcgagaccagcctggctaacatagcgaacccccgtctctaccaaaaaatacaaaaattagccggccatggtggcacatgcctgtagtcccagctattcaggagggtgaggcaggagaatcgcttgaacttgcaaggcggaggttgcagtgagccgagatcacgccactacactccagcctgggcaacagagtgagactccgtctcaaaaaaacaacaacaacatcgttttgactttccagaaagattagacttaaattatactacgcttgtccaaaaactaatttgtgttacaaaaactgaattg

SEQ ID NO: 4258 - DNA, 1185 bp, Homo sapiens
gttttgctttgttttaaaacagttgcctcaagcttctgtcttaagagtagtgacttagaatccagatatcttttgttttagaaaaacaagcaaaactatgttgcaagactgacagttgtaatgtttatttgccacagatcaaaggttcacaaagtatatcaaatttacatctacttggggtaccttgatagattattattgtttttcttttatctttcccttcaggaatttggaaactcgttgtcactttttttaattttaaaaatactaaattgtaatagttttcttttgccaaatgtgtgcgtacatattcaaagcaatgaaactatttcaagccatacaaccacaggggtgggaacccttttcacaaattttaatgtgtttgtatgtaaatagatgtttgtatgaaatattttcatgatagaatgaatatatttaaatgaagttgaattattccagtgctacttaaacacattacaaaaattttggtgagaattatctgagtctattgagatgtaatgcagatcaattttgatttttaaaaatcaaaagcctacaataactctgactctcagcaacttcctcggcgttgttgcacctgacgtggagagagctcgtaggcttccccagtgcctcagccgcttcctggtggaagttaggtgctaatggaggtgtgttcaccttttagtgatatcactgcaggcctttgaggggcctgagagtgaatcagaggcattagagacaccggtgcagttatctggagcacaatttctttgcagggcagcagaatcagaagccagacttggccatgtgaacctcgaaactcggtttcccggccgccatcaaccgccacccttactgcctagtcacacacgtcagggaggctgccctcagtggagttggggttgagaccccagggtgggacttcacagttttgccagcaatctctaccttctgacttctgcctcgcagagaggaaggagaggggagcatctggcaaggggcccatttctcagcacagtacatttcctgtctcagctctggaagactatgcacccaagcaccaaacttccaaccagagagagagacgtcctccgataacaaaaatccttgcttcctctgtctgtgactttacacacagttgttcaaagttgttaaatgtcaagagtcaatcacatccctagg

SEQ ID NO: 4259 - DNA, 1308 bp, Homo sapiens
aaagagaccgttctatacactgtgacggatgggccagggcctctggacttgcattctgataggtgctttaatttaaatgtgcccaaagggagtgactgtcttcaggagaaagatggcttgcattaacctcgatcaagtgggttgtgcagccaggtcagggaatacggtcagggagaggatagtgctggtcatgcccccgatgcagctatgctctgaatgatttcattcctgagagtgatagcattctggtcctggctgcagtggggtacaatttacgtcctaagtgggggctactctaattatcccattcaaatggaatttttttcaacattggatagaaggaattgaagagttgtaagtagtgattagtctgctaatcagttcttcagatgagatattgaatggtaacactctgagcttaaaactcagcagtgtgtctgtgacctccacgcaaatcagaggaagcaatgcatccacgctgagcctcaccatgtcttcctcccaactctcttcatactctctgtgtcttccagctcttctttctctggccggctctctttcctcttctctctgcatatgtgagaacgcctgggcatcctgggtaacagcagccccagctgccctctcctgttccctgttccaagtcccctgcactgacctttcttgagtctctctggctctgtgcatgtctttgggactctgctcatctggcttttcctctgtgtgtgcctctctgtttgcttatgtctctggctctgtcttccccacccctcccctcacacacacacatactcccaaatgtaaggctctgtggcaggttggaatcggagtaaggcttgagattcactgagttctgtaggtagggaaagaagtcaagggagtggaggttctataaggaattaacagctgaggacggaagggtttgtttcccgtttgaacctaaacgcaagtggaaaagaatactcagaatgtatttttctactttacatctgctggggaaggaaatgtgtcaggaagccgctgcatctggtcatttcatcgcatcagaatcacagcagacgtggaagattccatgtggtggggaataaagaaataactttatgctctcctgaaaaacagcgggagcctatgtgtgtgtgcgacactgtaatctcaaggagattcactcagagctgtctcagtccaactcctgcatgaccagatcttcccttagcatcttttctgtgatgaaatattatcttgtgttagagttaggaataggaactaacctgtaggagcatgtccccaaatggacatttgaatggacta

SEQ ID NO: 4260 - DNA, 1099 bp, Homo sapiens
cacatacttggctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctggttcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacacagcatacgtggagaacgtgcttaagaatccactatgatgggaaacatttcattctcaaaaaaaaaaaaatttctcttcttcctgttattggtagttctgaacgttagataatttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatggtgcttgtagcatttttatcatacagtagattccatccattcactatacttttctaactgagttgtcctacatgcaagtacatgtttttaatgttgtctgtcttctgtgctgttcctgtaagtttgctattaaaatacattaaactattaaaagaaaaaagaaacacatacttgtagactctaataggattcgagaaaaagcaaaatccttgtatgacaactttaag

SEQ ID NO: 4261 - DNA, 1320 bp, Homo sapiens
tctcctgacctcgtgatccgcccgcctcagcctcccaaattactgggattacaggtgtgagccacggcgcccggcctacttttttttttgttttaaaaccttctggaacttctattcatcatggactaaacctcccagattgtctctaattttcttcttaccagcttcactttttaaacattaatacataatatttacacatatttatggggtacatgtgatattttgttacaggcatagaatatgtaatgatcaagtcagggtatttagggcatccatcactgtatttattctttctttctttctttttttgagaaagagtctcactttgttgcccagactggagtgtagtggcactatcatagctcactgcagctttgaattcctggactcaagccatcttcccacctcataccccaagcagctgggactacaggcatgtgccaccatacctggctaattttttttttttaattttcagtagagacaaggtctcactatgttgcccagtctagtgtccaaccactgaactgaagcgatcttcctgccttggcttcccatagtgctgggattacaggcgtgagccaccgcacccggcctgagtatttattatttctatgtgatgggaacgtttcaagtcctcacttgtaactatttgaaatatacactacatgttctccaatttttaaaatatgtgtttttgttatgaaatagaacttactatggtcacatctggtttttttccgtcctaatcctgttgtttctcaagggcaggatctctctctcttctctcttacacacacactttagctgatttttgcatagtgcctagcactgtgtcttaaacataaggatattcaataaatcatttgatggtgatcatcaaagtttgggtcaaaaatatgattacagttgattatcagctccaatggagaaagcattagcacaaataacacagagccgcttttgagatcaaatagaaaagctgaaaaggcaagtctagaatgaatcctttgataggaggtgattatcttgaaccagcggaacaacagtgagattgctgggaaggcaaccacaatccctgtgtctgacaaacaaaaaacaatggagcaactatgaaagaagtaaaccaaaagcagagaccacttgctggtcaaggacggtcacaggccagcccagagcccaagaataactcctgtggggaagagcagaaagggaatcatttccaaaatgtggtgttaatttttcatacttgcagtcttaggactagatacatcataggtgactctgctactttattctttacacgtatgttttcta

SEQ ID NO: 4262 - DNA, 1176 bp, Homo sapiens
attttttgtatttttttgtagagatggggtttcatcatgtttcccaggctggtctcaggcagctcggctcaagtgatctacctgcctcagcctctcaaagagctgggattacatgcatgagccaccatgccaggtcacctttcctgctttttatgtttttctagatttctgattactctagtccctccaatcttgattacattgccttggtctcttcccaaatctctcttcaactttgatgtgtcagaacacttcacgactctaccattcagcattacattctgggactcctccgcttgtattattaaacactacatcactctcaaaagccataccccttgtcttatttgcagattattctttctcctctgacattatcacattgtattattctgatgaaaagttgcctattaaacaaattataaatattatattcaatcatcctttcaataagtggcaaataattttggagatatgttaaggccttaaatttcaaggttagagattagatttcatgctgtgggtaatgaagggtcattggaaactattgaatgagctgaggattaaactacgaagtgtaggtgggaggctctgaaggggggcaactagttaggtaactctgaacaacagtttctaaagtagtgagaatctaaactagagaaatggcacagggactggagggggtgaggacctcttttagatgattttatggagttagagtttaatttatggaggcagtgaatgtagcagccaaagagtaaaaaaatgttctcaaggttttgagtactatgtgaccaagaagatactactaaatcttgcaaaaattcactattcttacatttttagttttcagcttcctcactgcaaactttgaatggatcctttaaaaaatccctctctagcagttcaagtgtatttgttatgggccacagaagtatgttgaataatagaagtcagaaggacggaagaaagaaataaagggtataatattgttacaaagtatctcaaacaaaatgtctttttaaccagtaaattttaacactatccaaacactctcccagagatgacaaagtcaaaagtttagaaatgctggtcttaattagtgaagcaatgtgaaaaaactcagtgatcttgacccctagccaataatgatacgttgtgcacggaatgccacca

SEQ ID NO: 4263 - DNA, 1154 bp, Homo sapiens
atttttgttttaaacatgccttaatacctttggagtggtctgttggtctaatttgttttctagatttaatgaaattacactgtaatttttattttttatggtgttgtatatagactcaggtgaaaaaattaggaaaatgtgacctattttttcatttgggattgaagcagccaatgaaatccatgaaattttatagaggaagatgagaatgtagagaactggaactaacaaaatgccttgtacttgtctgtcttctatagcacgctccctgaaatttggcaggcagactggaggtgaagagggagatggagcttctgggtatgatgcttattggaagaacctttcatctgataagtatggtgataccagctaccacgatgaggaggaggatgagtatgaagcagaggatgatgaagaggaagaagatgaaggcagaaaggattcagatactgagtcatcagatttgtttactaatttgaatttaggaaggacctatgctagtggctatgctcactatgaggaacaagagaactaggggagctgctctggtggccgtgtgtgagaggagcaggagtgagtgtgtgtgcttgatgaattgtgtgtggttgttcaaaagtaccttagccacttagccttgtgcagaagactagttacacttaatgggccaagcaatagggtgtagcgtttttatagaactgataatcaggcttatggcataagaaaaatgagtttcaaatttaagatgtttattgatcgaagcaattgaagtatcatggattggattgttactgatttcagtaaagtatgttttgccaattagatacatatatacaagataaaggaataggatggtaatatatttgtttgaaattaaattactgtttttattaaaaaatactgcttcattgggctgattttgtaaaatgtaatgagtaaaatgaattactgtatttttccttttatgtccacagaatgagagtcatatgttgttatattctaaattttcattaaatattcatgtcaccttgagttgtcatgataagtatgttttagtatttgacttattcttctctttcttcacaatgtatgtcctcagtggtacctattattgatgccttaaatgtattgataaggtgactagttagccatttttc

SEQ ID NO: 4264 - DNA, 1208 bp, Homo sapiens
atatcttcaagtttcatccaggcacatattatgggatttcctattttttaaggctaaataatattccattttatatgccacattttctttatccactcatatactgatgaacgtttaggttgtctccacatcttggccattgtgaatagtgctgcaatgaatgttgcagtgctaatatctcttagaaatcctgctctgttattttggataaatacccaaaagtgagattgttgtatcctatggtagttctatttttaattttttgaagaaaggtctgggaaaagtctgtcaactctcggattttgttttattttggtttattaaacttggtttcctgatgagttaaacaaaaactattatttttatagttcgcttgacttctcagtgttagaatgcgggtaacagtctctagcaacttttaatattttaagcagaagcagaactattacatatcgatgttatttcttttagcattgatgctactatccatacatttgcattttcatttctgcctctttcatttccttttctctggaatttacatatcaaagtacattgcactctgctgatgctcttcacattgtttctccctttctgtcatgttcctgtcctctctgttttactattatctgcactcacacagtagttgttctctatcatctcttcaaaaactttgtttgcttttttgttttgggctctcacaacagaggaaaggataagcattgacactttccacaaggaaataatgatgtttgcatggagaaagactgactttttgatggtagaaacggaagtaagtttaattatgaatttcttaaaaaataaactttggtcatgaaactaaaaggaactagaagaaaatgtgggggaaaagttctgtcacattgatctgagcaaagatattttggctgtgaccccaaaaaaataggcaacaaaaacaaaaataaacaaatgagattgcatcaaaggcttctacacataaaaggaagcaattaatagcatgaagagacaacccatgaattggaagtatttgcaaatcatacatctgataaggggataatatccaaaatatgtatgtaactcaaacaactcaataatgagaaaacaactcatttagaaaattggcaaaggacctgcataaacattcgtcaaaagaaaatatacaaatggccaacaggtatattaaaaaaatgctcatcatcacaaat

SEQ ID NO: 4265 - DNA, 1198 bp, Homo sapiens
cgcgagagcggacccaccctccggcttgacctgcgacctccctgcgcccgccgctcagaaacgccccgcgcttcgctgccaaccctgcggctccctctgtgacccgggaccagccccgcgcccgctgcccgtaggcggctcgcggcttcccctttcctcggcgttcaccgagcgccgcgaagtgacccaccctcccccgaggagagggaaggaggatcgctccgggcgcatcgaaaccgagggcgggtgggcgggcgagcgggcaccgcgcggggcattgtgtgtgtgtgtgtgtgtgtgtgtgtgtgtgagcagcgctgtgtctgtttcggaaagcgctctggggaggtcttgtccctagggggcggagcgcaaaggacagaagctccggcaccgagtcggggcagagtcccgctgagtccgagcgctgctgaggcagctggcgagacggcacgtctggaggcgaggcgggcgcactgaaaggaggccggcgcgcccgcggccccggctcgcgttctgttcaggttcgtgggcctgcagaggagagactcgaactcgtggaacccgcgcaccgtggagtctgtccgcccagtccgtccggggtgcgcgaccaggagagctaggttctcgccactgcgcgctcggcaggcgtcggctgtgtcgggagcgcgcccgccgcccctcagctgcccggcccggagcccgagacgcgcgcaccatgagcggtggtgaagtggtctgctccggatggctccgcaagtcccccccggagaaaaagttgaagcgttatgtaagtagagctgcgggcaccactccgcgggcctcggcgtccacacccctccccagtcggctcgccggcggctgcagctggccgcgcgcggggctggttcttaaacgaatgccggtctctttccccttggcccctacccctggcgggctcgggacagggtgccttgcactccctcacgcccaggcatccacttggccggacaactttcttcctccaggttccagacagcctgctttgcgggcctgttcgccccataaaaggacctagacgtccagctaaactcctgctgcatgctttttttcttccttaggaaggatggggtgcgatggagagaggagccttcttcctgctttattcctgcatctgattattgggctgatgtgtgctaaagctcccgcaccgggaaaa

SEQ ID NO: 4266 - DNA, 1386 bp, Homo sapiens
cttagtcccaatcaggcagttgacatatgctgtcaactttatcttaaaagtatttctgttcatttaacagggccaacgtatccatcagacagaaggcacagtgcttggggcccatgatacatttaggagcacacaaaaagtgtcttaatattttcttttaaaaatcagcttcttttccgagaaaacaccaaatggcggatgacgccggtgcagcgggagggcccggaggccctggtggccctgggatggggaaccgcggtggcttccgcggaggtttcggcagtggcatccggggccggggtcgcggaggcaaggccgaggataaggagtggatgcccgtcaccaagttgggccgcttggtcaaggacatgaagatcaagtccctggaggagatctatctcttctctctgcccattaaggaatcagagatcattgactttttcctgggggcctctctcaaggatgaggttttgaagattatgccagtgcagaagcagacccgtgccggccagcgcacgaggttcaaggcattcgttgctatcggggactacaatggccacgtcggtctgggtgttaagtgctccaaggaggtggccaccgccatctgtggggccatcatcctggccaagctctccattgtccccgtgcacagaggctactgggggaacaagatcggcaagccccacaccgtcccttgcaaggtgacaggccgctgcggctctgtgctggtgcacctcatccctgcacccaggggcactggcatcgtctccgcacctgtgcctaagaagctgctcatgatggctggtatcgatgactgctacaccccagcccagggctgcactgccaccctgggcaacttcgccaaggccacctttgatgccatttctaagacctacagctatctgacccctgacctctggaaagagactgtatttaccaagtctccctatcaggacttcactgaccacctagtcaagacccacaccagagtctccatgcagcggactcaggctccagctgtggctacaacgtagggtttttatacaagaaaaataaagtgaattaagcgtgaaaaaaaaatcaaaataaaaaatgaaaaataatatataactactccaggttagaatattttaatctaggaagggggggacctatgaaggcaaatgtacctggggctcacaaaagtcacaacatggccccaccatgggaggggaaataagcaagtaaacaagcaaatatcaagtgtggcaagtgctatgctatgagaataacagagcatgacaggaggacaaaacagatgctcccagcacagtatgtctgtgtgtacatgtggcagtggtggtggagttcagagaaggttcccaaagttagcctggttgtgagaca

SEQ ID NO: 4267 - DNA, 1169 bp, Homo sapiens
ggtccatacggcgttgttctggattcccgttgtaacttaaagggaaactttcacaatgtccagagcccttgatgtcctgcaaatgaaggaggatgtccttaagttccttgcagcaggaacccacttaggtggcaccagtcttgacttccagatggaatagtacatctctaaaaggaaaagtgatggcatctacattataaatctgaagaggacctgggagaagcttctgctggcagctcatgccattgttgccgttgaaaaccctgcagatgtcagtgttatatcctccaggaatactggccagagagccatgctgaagtttgctgctgccactggagccaatccaattgctggtcacttcactcctggaaccttcagatgcagacagccttctgggagccatggcttcttgtggttactgaccccagggctgaagaccagcctctcatagagagaggcatcttatgttaacctacctaccattgctctgtgtaacacagattctcctctgtgccatgtggacattgccatcccatgcaacaacaagggagctcactccgtgggtttgatgtggatgctggctcgggaagttctgcgcgtgcgtggcaccatttcccgtgaacatccatgggaggtcatgcctgaactctacttctacagagatcctgaagtgattaaaaaagaagagcaggctgctactgaaaaggcagtgaccaaggaggaatttcagtgtgaatggactgctccagctcctgagttcactgctactcagcctgaggttgcacactgatctgaaggcatgcaggtgccttctgtgcctcttcagcagttcccttctgaagactggagcactcagcctgccatagaagactggtctgcagctcccactgctcaggccactgaatgggtaggagcaaccactggaaggtcttaagctgttcttgcacgggttcttaagcaacatggaaaataaacatcagtatctaaataaaaaaaattttaaaaattacaaaaaaagaaaaaattaactccaggtataaggtgttagagtttgttagatgagctatgaagacttgacattacatggagtatagtaaagataaaaagttagaggttggttcaccttctatttactcaggccagattctctaacagaatatttttgaact

SEQ ID NO: 4268 - DNA, 1225 bp, Homo sapiens
aaagatagaaataaagcccatctttagggcagaattcaactgccggacttgggactggacgccaccaagtggataaaatatggagctcggaaaagattggattcccggccctgaactgaccacacagttgagaggaagttgaggcctagaagagcgcgcaacagtaagccgtgtcggcaccagactctgttggtcctactgacacctccagcgttagaatgactaaggctccactcctgacccaccggccttgaggaaagcgcaaacgtaaaaaaagattgaaaccggagaggcgaatgcatctgtttacgctaggaccacgctcgacgtcggagaaaagcccacacactcacagtttccagacctggctgcttgccgaaactcagattctcggcacctccagcagctggcttcgccaacggcgttgaacaagggtcgcagctcaatgacgtcatatctccctacctacctccagggttccgcctcacgctctatgtcgcgcgcgcgcactacgtcctatggcttgcgcgtgcggcggctgggcaccgccattttggccggtggccgtgagaacacgctgtgtggctgaaaagtgaaggcaagagctgatttggcctctgtgctcccctccgcaaggggatcgttttctccaggtacgtgaatagcccggagaggtttggccgttagctgccatctgccaggttggaaagaatgtagggacgttctccgagagcctttggttaggccttaggtggcggagacagcagcagcgcgtggcagcggttcctgcgggacagctggaactgatggagcgcgggcgacgccgagagcttgggggcgcctcggtcttcccctccagccgacccggctgtcgccgctgttgcctgccacacccgcgagggacttcgagaatggacctagatgccgtagtctccactccccctttaccccactcccgccctgaagctaaacctgctggagaggaaggcacctttagaacttacagcactctctagtacccccacactcctccagcacccaaaatggatatattgtcacatgtgcatatttggttgtgggaagtcgtggcttccacgttttgttgagtggaatgagtcatggcatcttgccgccatgaagtcgaatactcgctgtccactcccaggctttatagaaatgatgcccacatgtcactctgcttttctcagaacagcgtgtacgcagc

SEQ ID NO: 4269 - DNA, 1184 bp, Homo sapiens
ctcggtctcccaaagtgctgggattacaggtgtgagccaccaagcctggccgatcaaacagaatttttataaagttgtctttaaaaaaaagaaaaaaaaagtatccagctgttaaacattttcaaagtgaagttaatcaataccctgtacttttagttccttaattcttttgatctttgtgccatgattttttactattagttaagaaagtgtaatgaaccaaagaacaagaagtagggggagaaaagagttgcctgcttcatttgacaatagaccatttatcttctgttatttgcctttcttaaagtacggagagtttttggatttttttcccccagtcactttttgtagcctgtattttttgtttattttattgaataatacaattattccctcaatatttaatgggagcatttattttgtctgctgaattccatactggtgcaagaattataaaacagcctctagtctgaagctgatacagagagtggttgaacattatttgtctcctaatctttttattaaagggggttgtaacatttggtggttactccttcctttaaaaaacaattatatcttcatatacaaattagggtaattaaaaaaaaactttctgtgggaatttgggatctgtaacatattaaatggaagagagtgtattttgttgatattcacaggagttggataatttacttgttgctttactagatgaggccaaggtgaagaaaatgcccatttgttctgcaattggctgattaggcttcctttaaatataaagcaagttacatagcagttaagagtattttaacatttttttcttttaatattaaggaataacacataagttggaaaattaattagccgtgtcgagtagtataagagtatttttctaatttcacttctggcagttctgatagaaatccttcccatgggtgagactccttaggaaaacgttctgagttcagaacactgctttaaactacattatattttttttgcttctcaaaccagatcacactataaatccaacctgatttctaagtagagtatagatgtggcttgagataatgaattgatttttgtgggttttttttttttgtaattagcaaatatttgcttcgaaaacctttttataaaaaatcagaagttacattttttcattaaagaacgtttgaaaagtttag

SEQ ID NO: 4270 - DNA, 1118 bp, Homo sapiens
cagctcagtgttctggccaggaagttggccgagaagcaggaacagaatgaccaatacactccaagtaaccgttttatatggaatcaaggtaagtggttgccaaactcaaccaccacctgcagcttgtctccggattcagccatcctaaaactgaaagctgcagccaatgccgttctgcaggacaaatctctcaccaggactgaggagaccatgcgatttgagtccttttcctccccttttagctcccagtctgccagttctaccttggccgctttgtccaagaaggtcagtgaaagaagtttgactcctggtcaggagcaccctccaccggccagctccttcctttccctggcttctatgacctcctcagcggcccttctgaaggaggtggccgcaagggctgcgggcagtcttctggctgagaaatcatcgctgctgcctgaggaccctctaccgcccccgccttcagagaagaaaccagaaaaagtcactccgccacctccaccgccacctccaccacctccaccaccaccaccacaatccctggaattattattactcccagttcctaagggaagagtttctaaaccctccaattcaggtatggcatcttttctttcaatcatcgtgtaagtcctttagactataaactgcgatgtcttattcattgcttttttcagttgggttccccatctgatctgaggcaggaataaaaaagcaagagcacaacaaaaatactttaagtaagcagcatagtagtctttcatgtacgtattacacaaagacttcacaaatagcttcacttttgaaaggtaatgaataatcttagagacatacagcattccctccctttcatacaaatgatttttttttcttactaagttcaggctaggtccatacaagatatatttaatgggagaagatcaaagcatctttgtcatggagtgcatggcatcactgaacataaggggaaaaaaacccactgcttttgaaatagtggacaagggagagcccacactcctgctgcctccatcacaaatggacttttgtacaatcaggaactactctgccctaatttatcacaccatatacttttatgttagcatttttattacttt

SEQ ID NO: 4271 - DNA, 1397 bp, Homo sapiens
taacatgaaaaaatgcgggagcttagagggataaaattactggcagttgagacaagataaaatttttttaaattagtggattattttggaaaggggaggtttaaaatttttttggcataattgagatctgtgagtctgaagagtgttgagtaatattataatagctctttgatgcaaaaataaaaggacagcaaatacatccctgatgacttggttcaagattctttgccctgcccacttaaagtgcaaatagtgtgattttttgataaaccttctccaaaaataggaaaagaaggaaagagatttacatttgattatttcttatttctcagtactgagaagaggctttgctacacaataaccttgatagcattgctccactcatcgggttttacctttattttgctaagtcacatagtatgtggtcattacacactgaattcttgtatcgaaccatgattattgacaaattttgagctaagctgtgcagcatgttaaatgtgcctttacggtgtagttatttaaatctcaatttctttccccagctctactttacgaagtgtttctactggatcttcaagaccttcaaaaatatgtttggtgtgtggggatgaggcttcaggatgccattatggggtagtcacctgtggcagctgcaaagttttcttcaaaagagcagtggaaggtaaatgttcatgtgggtgttccttttacatattttttcctagtgtgtagtttacttgtacagctaatgctatagcattattgggaattcttcaaaaagatttttgatttaatctgtcagtgataaacagtaatagtgccttgtataaaaaccacctggagattttccacaaagcaatatttaatgagcaaaatttgaaattctgagcaaggatcaaccaaagaggattttttgttgtttgtcacagtttgtttttcagtaagactcagaaaaataattccttgtcattgtaaatttaatttatgtgatctggaatagaagttttactaggcacacacagaatacatgatttctgccttttctgggtttctgtataaatatgtgtttgtggcaaattaaaacgttaatatcagaatcaagtctgtgatttgtgtttcatacagaataatttcatttaccagctggttcaagctccaggtccctgtgtgagtctcacctttattcctcctgaaagtttccaaattttgcatattaaatgaaaaacctgactgagattcactatgcacagttaggctagcttttgcttctgccccaaaatcgtactccttaaggagaaatggtctttaatttatttttacctttccccatcctcacttataagcagttagttaccatcagacttagaccagatggttttattgatgttgcaaac

SEQ ID NO: 4272 - DNA, 1164 bp, Homo sapiens
taggtctcatttgttacacatttctacttttaaattacttctgaaccacagaatctggcaggcctttttggaaggcatttgaggataactactctatctggaatccagccatttacagtatttggaagcaaagaacaaagcaaagcaaattgagattttgttgaatgtttaaaagttttggaaagaacagttaaaaagaaatccttcatggatgcatgctttgaaaacaccaagttttctcaacctttaattttgtgcatctgaaaaccaacttgaatttgtctttaatcccctgctagtcagtggaaagtaaacaagcagaattgctaattctatatggccttggaataatgtttaaaggaacaggatagtttaatggattaattactcttctttacagtattagattcaaatccagcagagatgcaactcttgataatgtgtgtcattcccgttttttctcaagataattcatacgtaattgtctgatttttagaatgtctaaaacctcttgataatgttaagcatgttgaacaatagtagtaatgttgacctcacactaataatagagaagcagtggaggtaaacagatgtggactcaagtcctggctggctgtgggctgtattccagctcctgctaatagcagctaacattcattgagtgctgaccaggtgccaaacaatgcactgggtgatttaggtatgttatctcattcaactttgaggaccatattggtatctccattttataaattacagaggttgagtaacttgccaagtttatgtagctcccagtggagtttgaactccattcctgatgtttagcttcaacgctcatgcttttttcagccatcctgtctctatgttgtttagatttattatctttgtcgttacttataattccagtatttcactatgttagatatacttctaatcatgttttagttgacctgaatataaggaatacatttgagtattttcagaaagtttaaaaaactctagctattaatatttctgaaaatataaacctgcaaatggccatttatgttattttagagagaaagtgggtagaagtttctcttccttgttgtagttaagtcagtcctaaaaagacgaataaggactttggaaccattctttacattttgaataaaacatatgtct

SEQ ID NO: 4273 - DNA, 1184 bp, Homo sapiens
gaaatggccatcgtccttccactctaagttgtgtgaacacgcccttgagatcatttatgtctgactctgggagctccgtgaatggtggcgtcatgcgcgccgttgttaaaagccctatcatgtgtcatgagaaaagcccgtctgtttgcagccctctgaacatgacatcttcggtttgcagccctgctggaatcaactctgtgtcctccaccacagccagctttggcagttttccagtgcacagcccaatcacccagggaactcctctgacatgctcccctaatgttgaaaatcgaggctccaggtcgcacagccctgcacatgctagcaatgtgggctctcctctctcaagtccgttaagtagcatgaaatcctcaatttccagccctccaagtcactgcagtgtaaaatctccagtctccagtcccaataatgtcactctgagatcctctgtgtctagccctgcaaatattaacaactcaaggtgctctgtttccagcccttcgaacactaataacagatccacgctttccagtccggcagccagtactgtgggatctatctgtagccctgtaaacaatgccttcagctacactgcttctggcacctctgctggatccagtacattgcgggatgtggttcccagtccagacacgcaggagaaaggtgctcaagaggtcccttttcctaagactgaggaagtagagagtgccatctcaaatggtgtgactggccagcttaatattgtccagtacataaaaccagaaccagatggagcttttagcagctcatgtctaggaggaaatagcaaaataaattcggattcttcattctcagtaccaataaagcaagaatcaaccaagcattcatgttcaggcacctcttttaaagggaatccaacagtaaacccgtttccatttatggatggctcgtatttttcctttatggatgataaagactattattccctatcaggaattttaggaccacctgtgcccggctttgatggtaactgtgaaggcagcggattcccagtgggtattaaacaagaaccagatgatgggagctattacccagaggccagcatcccttcctctgctattgttggggtgaattcaggtggacagtccttccactacaggattggtgctcaaggtacaatatctttatcacgatcggctaga

SEQ ID NO: 4274 - DNA, 1406 bp, Homo sapiens
ttgggggggattagcaaagcagaaaactggctgctgggttctgtagttttaaaaaatctatatttttagtcataatgagaagtctattttcaccaattatggaaacatacagtggagcaagtaaaccacttattccagctataatattatgaagaacatttcccatgcatctacaagcttgagaaataggattttcacagtggggaagtgggttacaatattggaataggaaaatttgatgctgtaatttgggtcctgtatttttccaaacaactgtgcttcttcagcactaatatttctgggatttaaatagtaatgtttaaattatggtaaatgtaatttaaaacatctcaattaagtctgtctatcaatattgttcttcaagcatgttttagacctagaaaagtatggtttgggggaggctattttattgtgtggttagcacaaggaatctaatttatagcaagtgtgaaatagttaccattttttcctgatctgtcatcttcatagcacaacaaaacgaaatgatggaaatgctcttgagctcacaacatttgtttttcttttaaagtaaatgcaagtaccaaagctcactactgcggtttgcctgtgcctggacaatgaggcggagccactgttgttttgttggggcacccccttccctccccgggtttgcaaatagaggctaccgggtgctgtattcagcaacacctgttttactatttgttattaaactatcatctccaccttccttttgattagcaatttgtactaagaaacgaaacaatgttatttggtggtgtataattctacttttctagtagattactgtgtggaattctgtgaaaaatatttgagaaaaggcctgtattgcataaataaattctttgtatgttgtgaactttgatctctatttctcttgcaacagacttcaagtggtccctctttttttcctacacactcagctcttctctaaaagcaaggatttggaatgaacaattcagtttgacagaaaaagctgaataaaatggcatctgtaattgaattgttggaaatgccttttttgctcctaaattttaaacatcattaataaaataatgattcacaaagaaagaaaatgtcaaactctgattcagtcctagtttttgatcaataaccaatgtgagagatcctcctgactgaaaacaggaaaatgagctttctttggccagatctctcctctttcttactgagactcacacaaatgacctagacctgaatcttacaaatgcctagcaaggaactttatgtaccacttcatctgagatccatcattaagaaaataaatagacgacggtgaaatgtgggggagggaaagtacattttagaatcaaagaaatacccaagttgctgataaattaattaac

SEQ ID NO: 4275 - DNA, 1179 bp, Homo sapiens
tatctgctggaagccttcagtttacatatttctcctacttttgacccaaagaccaagagcccttctttttcaccttataaattaaaaaacagtcttggtaatgattttgattggcctgacttagctcacattctcagtcttgtattaatcactgtggccagtagaagggggaagtatatatttagccaggcctgacttaagtgacctctctgtgacctgggtgtgaggtactgagactttcttgtcagaattccataaatggaagaggatggaaggaagagtaaatacaatacagacaaaaacaacattgtctattacagtgaacattttggtaatttccagtttatttccctattgttaatataatctccattttcacatctgataaatctccctacataaggatattggtatgaaattattataaagatctaaaagtacattttttttttttggtggagaaaacctaatatatagatctttctttcatgtaccctaaattttggtgttcttcaaagtaagatttgtagagtcttcaaattatgaactatcaaatttaaaaatgtattttaaaatacaggtagtttggacacattgagggaatcatgacataaaatatttggggtactgaagtattaagtaatgtatgtgatgctatagttttaaacacttataaacataaactcaaattgatttgaatatgaaattcatgacattttgctatctctttcatatcctatgatgtttgagttcaagtaatgtaagttcagtggactttgactggttgtcacatagtgagagatttctgatttttgaaatatgtcactgctataaatcactagtttgctagattgaaccagcaagctattaaagaacatgacagaatttactgtagataaatgcaaatttaaaaaggttctctgtatgaaggtttagatgatttattagccttcagtgcacacatgaatctgaagttatgtaatggatttagaaaatttcatttcctgtttgaaggttcaaatttgcatatttattctataatgcaagtattagatgtgagtcagtaggatatatagttaaactctgtgtgatatcaatatatgcttcatcttttttgtatagtatatggcaaacattttttcaggtgtagggcaagtaattaaatatactgattttttt

SEQ ID NO: 4276 - DNA, 1199 bp, Homo sapiens
atttgagtcagagtcttgctctgttgcccaggctcgagtgcagtattgtgatcctccttggctcactgtaaccactgcttcctgggttcaagcagttcttgagcctcagcctcctgagtatctgggaatacaggggactgccaccatacccagctaatttttttaaatttttagtagagatggggtttcatcatgttggccaggctggtcttgaactcctgacttcaggtgatctgccagtactctaaatgataacagttttttcgtgtttatttattttgaatgaagctgtctcacagtagatggagttgaaggacaggaaatgtttttcccctacttggaaaatacactgaataagttgagtggggtgggatgtgcctggagtcccagctactcaggaggctgaggtggtaggattgtttgagcccaggagtttgaggccagcctgggcaatatagggagaccctgtcccaaaaaataaaaaatatacgtatatatatatacacacacaaagaaaaaatacactgaatagacaaaacctttcatgattaatgatgcacgggaataagtgatgaaaaaagtttcggtcccagatgatggccagtgataacaacatttttctgatgttcccatgcaatatacagttagctaagagggtgtaatggaaaaagcataaggcttggactcagaagactctactaactttgccactagctagctatgtaattcagatcatctatcctttacatgtgaaaggtaaataatggcttatcttaacaggaggatttatgcaggttaaatgaggtaggtgttatgtgtaggtttattccaaggcttctctacttttaaaggaaatggcttatatctgagaactaggacttttagaaaaaaatttactgttactggtttgcaggattccagacagcattggaaaagacatagaaaaggcttgccaatctatttatcctctccatgatgtcttcgttagaaaagtaaaaatgctgaagaagcccaagtttgaatgtaagtgagaaatcacatgattcctgtagggccaaatacattgtttttgggtggaggaggagtgtggggccatatcatggccttctttttcttcctgtcatgcttgcatagtagtgatgaccattatttcaagatatactaacagttttttggttttttttttttttttttttttt

SEQ ID NO: 4277 - DNA, 1199 bp, Homo sapiens; identical to SEQ ID NO: 4276

SEQ ID NO: 4278 - DNA, 1157 bp, Homo sapiens
ttttctttgcattattccagtaatatataaaaactgtgtcttgttatagtagtacattatgaatcacatataaaatcttacaatacagaacaactgttaagatggaaaacagtgccaaacctccacagctcatttctttgtaatataatcagaatgaaaaataatttaagaggacagaagactggtacttttttgttttattttttctctagcttatccctgcacaattattagagtgaatgaaaaaccactttcctgctttccattgttataaattctaagcttaagataaaagtggttctttacatgactgaatcaattacaatttatgggctagagccaaataggttgaagacaatcatccaaacagatcaatggaatagaatttcattggaaatgtaaaacactttcccaacaatggtcatgactttcttctgtttttgagaagagtttcatatgctggaccacattttagcttttattgttttttttttcccattgtccaaaaagttaagcaacaagtggccacacttttacgtgactacaacctggagttctgcaaagaaggtaatatttacttggtctttgactaaagttatctccccattctatggttacattttattttggactatggggacttctaatacgttttggtaaagaagagagtataaagaaaattcttgtcaaatttcactcaaaagtaatttcatgagaaatcaatgatttaaagcattatccaaattaaattatcatttgcagcaaactgtacaacagcaggaaggatatggaatggaacatgaggtatatatctttgcctttataattttaacatcttatattgaagattctgaaaacctatctttattagaggaaaatctcaatcttcagttttggccttctgtcagcagaatgataagtgcaatagttgtaaatctacttgacactgtaataaactgaactgaactttcaaagtccctttctcatactagactgagttttttgagaatggaggtggtatcttttttttttttttttttgagacaggatttaattccctttgaccaggctggagtgcaatgcaatgttggctcactgcagcctctgcctcctgggctcaagtgattctcctgccacagcctcctgagtagctggga

SEQ ID NO: 4279 - DNA, 1203 bp, Homo sapiens
atactagtggaaataagcggaatttaattttcagtaaacttaagccttagtttgggatttgggggcatgaatcccttcattttctcctcttaagtaagtaatttctgtccttctaggtaatggatgtgaagaacagaaaccccagagctataaataaactgattgggttggtccggaaagcgactcaaagccgagcagatccagtcatgataaaggagatcctggagaagaagctgtcattgtgagatgtttgggatccccttgcccaagggacaacaacaaacagtgcagcctgactgggaacaggatcctgtgaaagctgatgcccatgtgccctgagagctgcctctcaatccctgtcccaagccacagctatggcattaatgtcaccagtgttctcaccctctaggccctgtgcctggaggtgcctccacagccgaccagcagccaccccgcctgcttcatccacatcaggagggtccggtgaggctgcagcagtggttaaggagtaacaccttcttgtattaaggaattttaaactaaataaaatgtatgttggagatactgttacccattctaagaaaacttttcattctgcagttccttcaacaaatatttttgagcaactcctaagggccagccattgtaggtgatgggcattagcagtggtcaagagagactgtaatttggatgtattgttttcagacctaaacacaggttaacaaagatgaaaatacaaccaaataaactggcacagtataaacacatttgtttgtttaaggaggtctcaagagggtggggaaggaggatattattagaattaatcaacctatcgactgagtagaagtgatattgcctgttaaactccctccccatcccagaaggcacagtctgagaataaatgaattaaaaaaataagttttccaataaatttaatcaataaaatatatactgaaatatcacataaaaattaacttacacttcaaagattgtgcagctgacaactcccccaaatcccccaaccctcaggccaaacaagataaaaagaaacaagaaaaaagttgtaacatgaaattgacttgttttgcttggaaataagattataaattagtaaatcaaaatcttgacctctcatgataatcgtggtgtgctgcaggcatcacgatgaaggcggggctgtctgcactcctgtgcttgcgacac

SEQ ID NO: 4280 - DNA, 1140 bp, Homo sapiens
acctttcacagtatgtttaaatggaatgtattttctcaaagtacgtgacattttctgaacactatgggatatatatcttctagtaattatatttttacatgcaagtatctttaaaaatttcttcctattacaacttaagaattgtgaaacatttgagggagcatctgcagtttgagcacttgatctggatattggaatgacaaacttaacatttaactaaatttttctgaggtgttcttttacaatttttgagttaacacttgatttctgtaaagcagaaggcttataagaagaaaatatgagagccagtgttcgtcttgtattatcctgccatgcacgtagttgaaaatcagaaacaaacagaaatgcacaagagaccttattgcttgagtatcttctgctcttcccccatcagacctaagggacagctagtggatcagtcagatactgtgcagtttctgttgctatgctgtgtcacctttgccctttctttctatctggaagatagctactggaaatctggctgtaagaaagagatagcatgtttttttcctctctctctctgtgtgtttctgtctgtctgtgtacctgtacctagtgtattgtgttagatgttcatttctgcatgactgctctggaatttaggaaatattaaaagactacaaaatatttttaatattatttagccttttctctgagaggatcacatcctctggctttggcgttttcatctcacagcatcttaaacgaacccgtcaatgtttattatcagttccaaatgtgaagtctcaaggcaaattgttggtttgtttttggaagaatgtatgtgtgtgtgtatatatatgtgtgtgtgtgtgtgtgtgtgtgtgtgtgtgtgtgtatataatttttaaatttttaacaaaaattcctgatctagtcaatgcttatgagagtgtgtgtggtttgtataaaattattttttttagagacagggttgcttgttgtcaccaggctggagggcagtggtgtgatccttgctcactgcagccgtgaccccctgggctcaagtgatcttcccaccttagcctcctgagtagctgagtagctgggactataggtgtgtactgccacaccctgcaaatttaaaaaaaaaattct

SEQ ID NO: 4281 - DNA, 1288 bp, Homo sapiens
ctggtaacatgttggaggggcagccttctgaggatggtgtcagattcccctgtcctctgattagctccctctgccaaggtgcccaggctcctacttcagtgtcacctccaggtttcaaagcatggaaacccaagcatgttactcggagaaagtcccacccccagcatgggcgcatcggcttagaaccctccagggttagcaggcaaagagctgtggaccccggacacgggaaaaggccacagtcgggagaactcctgttgctggagggccaggcgggggcgatccccagggctcccagcttttaatgctgtcaccgcgggccttactccctcctcttccccacatcgccaccacttgaatcagttcttttacaaagtggttctatttcctggtgagacaaaaaggttagaaaaggaaacctagagggggtgggggaaagacagaggttcggaataccggcgcgcaatcgccatctgggtggaggggacccgccttcttttcttccgcctgagcgcagctcggctcccgcctcggggcggggcctgttgctatggagcccgggccccggcagagcctgcggggtgaaagcccctagggctccgcctggcatgcgtggccggggctgtctgagatttccccaggtcggtggttatgaccgcaggatggaatcgtagaggtcgggtgatttggtcagtagagaggaacatttgcgaggttctctctgaattacatgttggtctaaaagtaatccactatctgggaccgagaggaaagcatgtgtggaagaggcaggcattattagcagcgcgtccgcctcggccacctccctgctcccgcctcggccacctccctgctcccgccccggccctgggggcctctgttcagcctccaccagctcagtcgcccacggagactcccgaactcttaaatcccagccctgtagtcaaaaccactgcattaattaaacaaggtaaactggtgaggcaagcaggaacttgacaccgccttgaatttaattgttaaaatgagaagtgtggtaatggagctctgcttaagagaaaaacaatacttgataccgatgtgcacatcgatgtggacacggatgcaatcaggaacccatagttagcaccgggagattacattccgggtatactcaagatagatagagtcaactttgaattctcgaggccaagcaatgggcgaaacaaaagagctttgtgtttgcgtgcttttgctttttgttacagtcagagcaggacaaagaataatgaaggagtagacatgttat

SEQ ID NO: 4282 - DNA, 1209 bp, Homo sapiens
tcagagtgctgggattacaggcatgagccaccgcacccagcctgaacttggaatttaaaaggaccatgttgagctttttagaaaaagattctataaagggaagaagagaaaactgggagtttgccgactttataaaattctaggtgtctgtttttttgagtttttatatttttactcttatgtaaagaaagtttaatagaagctgaatgcttagtagtttagttgataatataaataagctgaatttatcataacctcattgattttacattctgagagggtgctataattttgtgaaaaatctttattgtgaggctgagcgcggtggctcacacctgtaatcccagcactctgggagcccgggctgggcggatcacttgagctcaggagttcgagaccagcgtggccaacatggcaaaacccgtgactctaataaaaatacaaaaattagccggacatggtggtgagcatctgtaatcccagttacttgggaggttgaggcacaagagttgcttgagcctgagaggcagaggttgcagtgagccaagatcatcatgccaccgagttctagcctgggcgacagagggagactctgtctcaaaaaaaagagtctttattgtgaaaagaaattttgattcaggacctactttaaagaatatatgttatagattggtagatagaataatagtagtagtaagtatagctattaggataataattccagttcataggttcctggctgtctaaaatatttactcttcagtaacgtaaaaaaatcctatagtcgatgcacatgggggtatgtttacagttgtccctcgttatccacatgggattggatccaggacccccatggataccaaaagctaaggatgctcaagtccttggcatagtatttacacacaacctcccatatactttagattatctctagaggccgggcacggtggtttatgcctgtaatcccagcactttgggagactgaggcaggaggatcacttgaggccaagagttcaagaccagcctgcgcaacactgtgagaccctgtctccataaaattttttttaaaaattagctaagcatggtggtgcacacctgtacttccagctactcatgaggctgaggcaggaggatcacttgagtccaggagttcaaggttactgtgagctatgatcatgccactgcactccagcctagatgacagagtga

SEQ ID NO: 4283 - DNA, 1129 bp, Homo sapiens
tctcatttaattatcagaaggaaaaataatctttatagtatttaagatatctgtcttcttgaatagtgtccatttatatatttctatattgtttcactgatgccagtgaatccatggatggctttaattttatcccaacttcctttgttatagttgctgggaaatgttgcaccaagaataacagcaaataaatagattgctatgtaaattaattcgagaatcataagctttggtgttagtagaatatccaagtagaaatgttattttagatggaaaactacaaactaaacataatgaatccatccatctgttattagacttggataatgccagaagtttatcaactcttcctaaaactgtcaaagaactaagtgtataaagccaatgaataatgttagataccttatttttgttagaaaggaagcctattagacatgaagcaaactaataatactttattttaactcacttttctatttttagacagaagaaactcatccagtcagctggaaaccagaaattatcaagagaaagagattttaatgaatgtggaattttttctctctctttttttttctttttaattaaaaaaaaaaaagcttggcgttcatgaggatatccagtcattttgtgctctggctgggaatataaaggagaaattcacttgcttcaatcattgctgcttcatattttacaataaactgtcccctgtcccctacccctgtgtttttatttctaaaacaatttgtgatactaggaagatgcagatatcaagtaaatgcaggtttattgaacataactattctagatgtaatattttgacagtcttattagaaaacccccttttttaaaaaaaatgtatgaaaccgataattaggacatttgaaggagcagtagtttttttttagtcctttaaaaaataacatctgtgactaataatttgagattaaaagatttgaagtcttaatttatgtatgtttattccaaaaacagtttttgagtgtatgttctacaaagttctgcactagatactgttcaggaaatagacaagtaagatgtgtctatcctctaagacttccagtttggtagcttagtatagaaattctgtaacagaggtgcaggtgaaatg

SEQ ID NO: 4284 - DNA, 1177 bp, Homo sapiens
ttcaccagtggacaaatgtagatctctagttttcagcttatcagatttcccttggagaaatgaagagaaacagccagatgagtacataggcatattgtttatatcttgtgaaaatggtccaattactccaagcttctgtaatttatgttttgaatgatgatgaaatgagcaaaaagagtaagggaaggtatagagacatatttaagatggttatttaatttagatggtttattaaatggaaatatttaaaaatctgttttccaagaatgctaaatttagtttagaagcattaggtcatttataaactttgatcatatcaaaagagttattacttctgaagatttgaaattagatatgaataatgcttttatgcctggcaactcagcaaacagtatagtgattagaacacaatcagcaatatacatttattttacaaagaaaaaaaaatcctttaattgaattcaactaatagtgcatatgtaagagtctataattctaaaattggctgccaggctggtctgaggcagtgatgtttacaactaattgatcacaaccagttacagattcctttgttccttctccactcccactgcttcacttgactagcctttaaaaaaaataataccaataaatatatttggctgccagaatttctaccatgtcttctggctgaagccttctcaatattaagtagctatggccaaacagcatttcatcattgagtgatgaggcaatgtacctctcatgtgaggtaagctgtctttctgctgggcacttatctctcatatctgggccccacttcaaacccacccccaagagaatggggtgtctagatcaaggagaaattagtttctatctatggacatacaatgaggtagagatacaagatgcatatgatattttacagtgacattggaaaatgtgacagtgtttttttttttttttttttttttttgaggcaggccttatgttgcccaggctggactgcagttgtgctagcttgactcactgcaacctctaccttccaggctcaagcaatcctcccgcctcaagcaatcctcccgcctcagtcttttgagtagttgggactacaggcacatatcaccacacttggctaatttttgttatgttttgtagaggtgtggtttttcaccatgttgcccatggtgagccactg

SEQ ID NO: 4285 - DNA, 1137 bp, Homo sapiens
acaacacccggctaattttttctgtatttttaatagagacggggtttcaccatgttggccaggctggtctcaaactcctgaccttgtgatccgcccacctcggcctcccaaagtgctgggattacaggcatgagccaccgcacccagcctgttagttgctatcttaaagaaatataagtaaaaggatcaggtgattattagctggaaaaatgttataataattttgggtataggagccaggatctgccactttttttttttttttttaacttttctacaatgggaaagacaattagggtagttttaaaggagatttttattatttcaactttcatttggtgatctttgctagtttacgttaagtcttcctatacctgcaaaactgttcagttggtatgtatagtagtacatagtggaatgaggataataagcccaaaatcttgtctggattgtagcattaactagaggcttggccttgactttgttacttaacttttccacacgtgttttctcctgtctaaattacttatgggtttagactagattatctctgaagacccttgtgtacttaatgtctgtgaatcaaaatgaccttaatattggctgggcatggtagctcatgcttgtaatcccagcactttgggaggctgaggtgggaggatcacttgagaccaggagttggaaaccagctttggcaacatagtgagatgctgtctctattaaaaaaaaaagaaaaaaagaaaaacccctaaacgaccataatactacccagcctaagtgacagggttgtgagtgggagttggaagctcagttacttgtaggaggtaggctgtcactcagtgtatgacaagaatagtagtaaaccggaagctcatgccccacctaatgccacttacatagacaatgataaaattgccaacttattctgtgtttattgagctcctgaatagcaataaaatgcttatgtaaatactaacattgtcgtattagttggaatgtataaaaacagcattatagtacataaatgagccttctcacataaatctgtgaattggacagtgctgcacatgacttcagctgtatagcttttatctctcattattacgatagtgcacttctacaatttagggttatttt

SEQ ID NO: 4286 - DNA, 1128 bp, Homo sapiens
gaaaaagttcagaatattgggagaattaccagaatgcgacagaatacatgaagtgagcatatgctgttgggaaaatggagttgatacacttgctaggtgtgggattgctacaaaccttcgatttgtaaaaaatgcaatatatatgaagtatagtacaatgaagtacaataaaacagtgtatgcctgtagtattatctgactggatgtttactatctacagaaacatctgaattataccatttgatctttgctttaaattaagttggtgtcttaaccacttaggtctggttgccttcctctctatacaaattggccctctatgtctgtgggttctgcatctgtgggttcaaccaattgtggatcgaaaacatatagaaaaaataaaatgtgtggttgcacctgtactgaacatggtagactttttttttcttgtaattattccctaaacaataaagtataactatttatataaggtttacgttgtattaggcattataaataatctaaagaaattgtttaaagtattgggaagtgattaagtcatgagggctctgcacttatgtatggattagtgccttataaaaggggctggaaggaactggcttagatccattttgctcttcagtctcatccaccatgtgaagaagactcagtattcctccctctggaggatgtggcaacagggtgccatcttgtaagcagagagcaaccatcaccggacactaaacctgctaatgccttcatcttgacttcccagcatccagaactgtaaggcgtacttatttattttagagacagggtcttgctatgttgtcttagctgccctcggacacctggcctcaagcaatccctttgtctcagccttttgagtagctgagattacaggcgcaagccaccatgcccagcataaatttctattgtttttataaattactcagcctgtggtattttgttacagcagcacaaaaggactaagtcaccaactgtctcttattggggagagagaaataatgcagttgtcattatcctcaccttaatcttacagtgcttctttaaaattgtgtccctagatctttaaactgatgtaaaggcaaatacttaaaatgttccactcacacagtttctcac

SEQ ID NO: 4287 - DNA, 1196 bp, Homo sapiens
ttaatgttatgtggtactcttttgaatattttgcttaactgaataaccttgtagaccatacagatgttagaaaattaaaatataataatcttacaaaacagacaataattgctctttcatggatattccagaagtgtggttaggatcttgcatttctttaatgccatcgttacgagtatctgttatcacagaagcacagtaatttttttattgggatctagtatataatttctgtattaatgtgttgtctttttgattacatgcagttggacatttaaattgtcgttagccatttgtgtaactgtttagaacttgtgctcagtttccttactattcgtaggtaagaaaaatgaaaccagaaagaaagagacttgtctgaagtcatattagtggggaggagcagatctgaactggtaatagatacattccaaactgctgtgtttttagtatttgtggagacctgcatagcaacgttggaatctggtcgtttggactttctcattatttggtttctgaataatcatgtagcatattttctcaaagtgaaggatgaatgtatcatctaatgtaagctttttaaaattgtatttgcttggattatattgcctctcaataaagcttttgacttggaactgtgtagtgtgtgggaaataaatggtggagcttctttagtatgttgaattttagtagttcatttgcgaaatgctgtggtgtttggggatgtttatttccatgcaagcttttcatttgctaatgatgtgaatgaaatagttttcttcctttcctttcctactctttgttatgtgtagaagtattgaataaatgagtccagaaaaactttttgctgttctttgattttttgttagtaaacatttacaaaaatttcatttgtatgataaaatagttatttctaatggcagataatgtacatccagaacaggcttttagttgcattttaattttgggaaacaatgaaattaaaatatagatttatcacaaatctccatttccaagtagagtattcaggttagcattaagacttcattagtaatatggtgcatgctgttaaaatgtggtcttaaaattatacctgtgttaatggccagaaataaattgatattgttaatgcctgggaatatgttttgtaatggagggcttttttgatgtgtgagaatgtaaagcagtgctgtgtaata

SEQ ID NO: 4288 - DNA, 1221 bp, Homo sapiens
tggaaactaaagaaatctcaaatgctagccaatctgaatatatgaccaacatttttttaaaaagagagaattgggccgggcgcagtggctcatgcctataatcccagcactttgggaggcagaggcgggcggatcacaaggtcaggagatcgagaccatcctggctaacacagtgaaaccccgtctctactaaaaatacaaaaaaaaaaaaaaaaaaattagccaggcatggtgatggacacctgtagtcccagttactcaggaggctgaggcaggagaatggcaatgaacctgggaggcgaagcttgcagtgagctgagatcgcagcactgcactccagcctggatgacagacagagcaagactccgtctcagaaaaaaaaaaaaaaagagagacagaattggtttatgatatagatagctctgaattctaaataaatagtttatttcggatcaaattccaggattttatgcctcaacccatttccagaaacttgtaaaattagtaattcttaaatacttaaaaaatttttttcccttgatttcacaaatatggccactcttcccaaggggaaaaaagatcgcttcttggccttttggctaagatcaagtgtagtatctgttcttatcagtttaatatccgatacgtcctccatccaaggggggaaaagactatcagtgcaatgattgaaaaccttacaaagaacgaatcttttgtaaaataacctttcttgcaaatctgcctcacaagggaatgtggtggtttgggctgcggattcagacataccagggttgaatcccagctctgccatatgctagcttgtacaaccttgggcagttaacgtaatttccctaagccttggtttcctcatctgtaaaatgaggataataaaaataagattgctgtgaggattaaataagctagtggtttataaagcacctagaactgtgtctgtagagagtaaggattcaataacttagctcttgttaatattataaattctaaagtaaaattttgctagaaaatctaggttaatttctaggtcgtcacaatgaaccatatttatttcaccttataaaacccttataaatagagtttataaaactgttttataaggtgaaataaaagattcatttcaaatatgtatttcaacataccataaaaaggaacagttggcttccccttcaatgacatttgaaaaataaaacctgcattttcata

SEQ ID NO: 4289 - DNA, 1209 bp, Homo sapiens
tggcacagtctcagctcactgcaacctctgcctcccagttcaagcaattcttctgcctcagcctcccaagtagctgggattacaggcacccgccaccacgcccagctaatttttgtatttttgtagagatggggtttcacgatgttggccaggctggtctcaaacttctgacctcaagtgatctgcccaccttggcctcccaaagtgctgggattacaggtgtaagccactgcgcccggcctttttaactttaaacatgttttagaattcacctaaagatcaaaatatcatggattgaacctcatcaattgatagcagtgagtgactgaagcttccaaatcaagaaaagccggcaccaagaacttccattctaatctagagctgaccagtttgagctgattctctctttgaagagtccttcttgattgcagtgcagtactggcatttctgaatggatgtaagtggagtattttagtctaaaggcttttcaaattacttgaatttttttaaaaattgaggagctttatttctatttacccttccatttttgtatatcaaatttccattgtcattaaaaactgtatcttgaaactttgtgaactgacttgctgtatttgcactttgagctcttgaaataaatgtgatttttgtgtgattatctggtttccagttttaaacattaactgtcaccttttattcttaaacttgaaagtacagaaatcattaaattattaagttgtacaataaaaggattggtttcttttcttttttttttttttaagtgcttcctttgccgaaatgtttcctggctgtttgaacatgaatttttcaggtttaagtattgtgggaaatcatcttgacctaataaagcaatacatactgaagcagttctttgccctgcttagataatgtatgttttctgtacagttgaagaatagagctaaacttttcagggctgataaaatctcaactatctagtttgtaactcatcaagggttgggaattcttagtatgtggtgttaattatttttatttttttaagctgcggagtcattatctggtaacttccttttttttctttttctttttttgaaaccttacacggtaaagatgtccaggtgtaagggattcagatacttaaaactgagaatgttttgtttgtaggtcatgctttataccttgtatgtggttcatatgcccacgtgtgtg

SEQ ID NO: 4290 - DNA, 1221 bp, Homo sapiens
ttttgttttccttcagccaccagaagagatttattcaattggagattcagttttaattcatttccacactgatgacacaatcaacaagaagggatttcatataagatacaaaagcataagatatccagataccacacataccaaaaaataacaccaaaacctctgtcagaacacaaaggaatgtgcataatggagagaagacatattttttttaaaactgaagatattggcacaaatgttttatacaaagagtttgaacaaaaaatccctgtaagaccagaattatctttgtactaaaagagaagtttccagcaaaaccctcatcagcattacaaggatatttgaactccatgcttgatggtattaataaagctggtgaaagggcatcatatacttcaaggaagactctacaagcttttgttcacagcttgaaatagatgcctcacaattcagacagtttaattcaggaactgtgaccctgcagtgttctttttgacaatttgtcaagatttagggacataaaatgatcttgcaggtcgtaaactggaaaacagtattttggttgtcttaggataattgctgactttgtatcttggatacagtgtaaaccagatccatataaggtgaatgtgaaatgggagtcttctgagggtgatttgtactttccatgtgtatgtgtgtgtctggtgtttggaaactgggatatttcagcttcattatttccacttgcaggccagcttaacctctgaaacacaaatgatcttgagaccactttagtgtacttacatttagatgagtttgaaatctcaatggtgtctaattattgcagttaaattctagacatcagttctttaagtctcagaaaacgcccagtgaattggtaaacttagttcttttttttggaagtgctgccttttcacaccaaatccaagaagcctgtgatgtcttatgaaccttatgagaaaactccgaagaggtgtgagcaggattcttctgaatgactgtctggatggttcattactcaagttactgctgctgctattgtctttcctttgttgtcgatctgttattgttgtattattattgttgatgttgtcatggttaatctattttttaaaattgaaatgaagcagaagtaggccttgtgagaactgaaaggtctctttcatttttctcttcctgggattcattttttcaaaacacaatgctggaaaaaaaaga

SEQ ID NO: 4291 - DNA, 1243 bp, Homo sapiens
ccaggcaagaaaattttattagtataagctttattagtgtttaaccctgtccccgttttattggaatagtgaggtggttgcttttttcgcccccacagggctgttcttaatggagaataagctgggcaatttctctaaggtaagatatattgtttcagtaagtaagtttcagactgagaaaatgaatggcttcttcaggttagaggaaataggttagaaagtaatagaattagaacaacttaatggtaaactaaatgttagatgaaggacaagaagttgttaaaattctcagtcttgggaagataggaggagttccttctgagacaatgaactccttgagggaagagacaatcatgtttccaaactaagcaatgattgacacatagaagcattaaataaatatttatccacagggagaatatatcaactaacttacctactatggaaggtcaagtgtgtttctgtaaatagagtaggaactttgggcccatacctggccatggagacagtggatgccctagaagagagggaacagaacaactcccattcttcccaagtccctatgagtaagaaggccattgtcacaggtgcaggtgcagatcttggtggcagtagccaatattcaaatgagaactttgaaggctgaagaggaactgggtcccatgtgaacagcaattgaaagggggagtcagtgagtcctgagaaacgggcaaaagctgctcagaaggtcatggagcaataaaggttgtcttagctcaagctgctctaacaaattacgttagactgggagacttataaaatgcacacaattatttctcatagttccggaggctggaagtctgagcccagggtaccagcatggttgggttctgatgaaagccgtcttcagagttgcagataggcgacttctgattgtattctcacaggatggaaagagagcaagttagttccatggccttttttttataagagtactaatcgtattcacaagggctaaactctcaagtcctaattacctccggcagtccccacctcccaataccatcacactgtgaatgggggttcaatacactaattttagagagacacagaaagattcagttcattgtcaaggcagaagttcctgtccaaggtgagatctggaggtatctccagcctaatgcacacaccttgtgtggaggcagaacaggatccaagagacagaagttgtgcctgggaagggcgatgccaaagggctcttcac

SEQ ID NO: 4292 - DNA, 1203 bp, Homo sapiens
tcgctttattccggtggagcagaaccaaagctacaatatctgcgagacatgcttgtactgtcaatctaaattggcaaagcttcaattatacactttttgtaaaagtgcaatttcattacattcagtgatatattgtaaactgtactgcctactgaagattcttgagtgaccacatctaatgaatatgtaataataatttttaattcaaatatcaactatatgcaaataaactcttgcaaaacagaagtggggaagtaattttctgcaccactgacctgtacttatgatacaaaaattaatcaaggacctcacaaaatttttttaaagtaattttaaaaaaagaaaacattccaaacatttctctattagaatcaacaagttcagtattagaatatttatctacattatatattgtaggccaattaataacaaaggaagagaactgtgaagtacacagagagaacagacatcagactgaagaaatgcatatggatagaggggtgtttatcagaaagaaaaatacagagacacaaaaaaagaaaaatacatgcacgaaaaaaataccaaaacagggctggtccgatggtagcgggttatcagaacctattaacagtagtgtcactaaagttagtatacaacccccaactgctaaatatgagtggcttttaaaagaaaaaaaaacacaagctgctttagcagctttgattcgtgccacgcactactgttcatcaggtcaaaaagtggtaatttctgaaataccaatgaagtgtctggcagtttaaagtagtccttcctgtagtaagattctcaatttactatctattatttacttttagctcaattctaaaagttttgcatgcataaggaggactaatgggttttttaaatacacctaaaaaaaagaagattttagagttaaacaaatatacctcaggttatcaggtgacagatacaggcctgtttgcctgcttgtaagtatccaaagtccttatctggctgtgttaaaaggcaaaggttgactcattgactaatctcttacataagaaaacggatcccttaaatttttaagagtaaatgtccaaaatgctctcatgtccccttagtttattagcatagtattctttccttttctcactttcaaaacagaaaaactctaaattctggcttgaaaaaccatttcctacatttaaaagaacagggtca

SEQ ID NO: 4293 - DNA, 1221 bp, Homo sapiens
tgtggagttgcccacaaattctcactctgagtcaagctattgtaaggcagattcatttagtcaacaaatatttattaaatatctgctatgtgccaggtaccactctaaatgctagagttaacagtagtgaggaaaacagacaaaaatcctctgctcatggagccattctaattggagaatataaatgataaaatacatgatcataaataattggaaaaattgaagcaaggctagtgaagaaagtttgtgtacatgagccccatttctcctccttatctggagcctgctagtcaggtatgaaggtattcctcagaggttactcctggctgggatacatgccttcataatgcagtgaatggtctgtaggccaacataggtttgtaaagattcaaatcaaaactttgcatttgttgtgattttataaagggaaattatcaatatatttttccaatggaatttttaaaaatagtaacattttcaagatttgattaatttataatcccatgaaatctgaagtaggttgagatagagaattacctgctaactccacttcatttgcagccagttaaaatgacataaaagtcagtcatggcggtgtgcagtgactcacgcctgtaatctcagcactgtgggaggccgaggcaggtggaacacctgaggtcaggagtttgagaccagcctggccaacatggtgaaaccccatctctactaaaaatacaaaattagccaggtgtggcggcacatgcctgtaatcccagctactctggaggctgaggcccgaaagtcgcttgaacccaggaggcagaggctgcagtgagccgagattgcatcattgcactccagcctgggcagcaagagcgagacaccatctcaaaaataaaatataagtcagtcagtcatgaccactgagactaaaaaaaaaaaaaaaatagagtcagataaagatcataatatcagttttatttttgataaagctctactggaaaatgtggccttaggtttggcttaaaatcatgcctctcaatattttcctcctgtgactagtccttggaatctgaagaacaaactttcttaacccacaataagagctttatatccatcaagctccagtagcaggaagactgagagtgagacctatcttgtccctagaaagcaggcgtaggcctgagctatttgtgctcaccacaaggcaacagaagggaaacaggatacgcacgcaca

SEQ ID NO: 4294 - DNA, 1168 bp, Homo sapiens
attatgtttatgaaaatagataaaaccatggcataaatacatgaaactatcatataagtaatcttgaaaaaaatggtaaccttaaaaataaaaaatatacgaatatacatccccatgaaggcaaatgaagtctgtgtataataattgttttaaatttttacatttttttcacattcaaatatacctgcctttattttcactcagcaaatatttattgaacacctgctgtatgtcaaggctggttttaggtgctagagatttagagtgagcttacatttttattctaagaccacatgcacacttcttttttggctaataagtaaatatcttcatagacctggcccaaaaaaaaaaaaaaaaacctctgcccttctttctggtaactcattttgttaattgtttttatttttaggcccatgcaaatgcacgtgctgctgtactaaaagaacaactagaacgaaagagaaaggaggcttatgagagagaaaaaaaagtgtgggaagagcatgtaagatttagctcatattcttaatcctggttgtattaacatttttatagctcttcctgggtagtacatcagtattataattttcttgtgcttttttttttctgttttttcattctcattctctctctcaccctttctcattacctctctctttctcagtctctctgtctctctcgcatttaagaataatcaatgtggaagttatttgggagattgatttgaagtcagaactaatttatcttatttatttattattattattttttgagatggagtattgctctgtcacccaggctgaagtgcagtgacacgatctcggctcactgaagtgcagtgacacgatctcggctccacctcctgggttcaagcgattcttctgcctcagcctcccgagtagctgggactacaggcacgtaccatcacgcctggctaatttttgtatttttagtagagacagggtttcaccatgttggccaggcaggtctcaaactcctgaccttgtgatctgcccgcctcagcctcccaaagtgctaggattacaggcatgagccaccacgcccggcccttactttattttaaaatttttaatttactattaccaagtagcttatcaaaatcccagcataatttaatgactacatcatccttctgtcactgatt

SEQ ID NO: 4295 - DNA, 1435 bp, Homo sapiens
tagcactagtatattcctgcagacagacttgtagttacttgtagttattgtatagtctgtatagtctgttatttttttttttaagcagagagtcaaagaaattgttttatgtagatatatataaaatgtgaaggtacaggagggactatggcactgtgtgtgatgtaaaagggtattggtagtgaaagtactgatactgctgtatcgcaacccttgtcattttacgtcattaacttgttaaagcctagtgggataagtgctctaaaaacttagactggttacctttttagacagttattagggttattggtcaatcatcttagattgtttacaactaagtggtttttcacagttgagtaatgataccggatgctttatttttttgacaatatttcaggatattgctgcatatcgtgccaagggcaaaagtgaagcaggaaagaagggccctggcaggccaacaggctcaaagaagaagaacgaaccagaagatgaggaggaggaggaggaagaagaagatgaagatgaggaggaagaggatgaagatgaagaataaatggctatcctttaatgatgcgtgtggaatgtgtgtgtgtgctcaggcaattattttgctaagaatgtgaattcaagtgcagctcaatactagcttcagtataaaaactgtacagatttttgtatagctgataagattctctgtagagaaaatacttttaaaaaatgcaggttgtagctttttgatgggctactcatacagttagattttacagcttctgatgttgaatgttcctaaatatttaatggtttttttaatttcttgtgtatggtagcacagcaaacttgtaggaattagtatcaatagtaaattttgggttttttaggatgttgcatttcgtttttttaaaaaaaattttgtaataaaattatgtatattatttctattgtctttgtcttaatatgctaagttaattttcactttaaaaaagccatttgaagaccagagctatgttgatttttttcggtatttctgcctagtagttcttagacacagttgacctagtaaaatgtttgagaattaaaaccaaacatgctcatatttgcaaaatgttctttaaaagttacatgttgaactcagtgaactttataagaatttatgcagttttacagaacgttaagttttgtacttgacgtttctgtttattagctaaattgttcctcaggtgtgtgtatatatatatacatatatatatatatatatatgtatatatatacacatatatacgtatatatacatatatatgtatatggagtctcactctgttgcccaggctggagtgcagtggcacgatcccagctcactgcaacctccgcctcccgggttcaagcgattcttctgcctcagcctccctggtagctggggctacagccatgtgcc

SEQ ID NO: 4296 - DNA, 1167 bp, Homo sapiens
ctaacgggtctgggagttaacgacctgggcgacccaccgaacctgctaggctggggcgtggagggcgggtctggtaagacactgaccaatcgttagcctccgtggcaagggggcggggactatctgggtttgaataatcgtcagaaccaatcagattagtggggatgtggcccgtggcctagctcgtcaagttgccgtggcgcggagaactctgcaaaacaagaggctgaggattgcgttagagataaaccagttcacgccggagccccgtgagggaagcgtctccgttgggtccggccgctctgcgggactctgaggaaaagctcgcaccaggcaagaataccctccaataccctcgggttcgtggacctgcctttccccattccctcagagcctctactcggtctcggcgcagtggctctcggggtctgacccggcgagcggcatttggggtgcgggccggcgagggctgggtctgtggagggccggcgggcagtcggaggaggcggaaactgcccctgaccgggcccggttctgggagttttcaatgtcggtcacgaggtgcttagcggttaagtgaggctcgcgacgtgggagctgggggacatttctgtcaggaaaggcgttttgagggcgcttgcggagtcaccggactcggtgaagggcgggcggcggcgtctcgggccccgggagccacttgctgggctgagccgcggccgctcgggccgggaggaggaggaggaggagggtgtgcgccggggcgcgggcgggggcgcgggcggccgcccttgggaggacgccctcgggaggaggggggcgcgggcagggcgggagcggatttgggcgggaagcggagccccgccagcgcccgccctggcagctgcgggctccgcgccgaccctccggcttcccctctcccccctcggccccgtcaggtggacgcggatctgtcaacatgggtaaaggagaccccaacaagccgcggggcaaaatgtcctcgtacgccttcttcgtgcagacctgccgggaagagcacaagaagaaacacccggactcttccgtcaatttcgcggaattctccaagaagtgttcggagagatggaaggtgaggcaggagagggacggagctcagggggtgcaggtgtggttttcggctaggagggcctt

SEQ ID NO: 4297 - DNA, 1181 bp, Homo sapiens
gggcaagtgttatataagatacattataataagatgaatataaggcaaacttatttttttgggaggaaaacatgtaggagggtaggggagacaccctatattcagaaacttatagtagttacaaagtagaacttgagtagtagagaagaagctcggggaaaaagagctagggtaagataaatatggtaagtgccaataggagatatgaccaaaatagaatcaagaagcttcaaaaatacagagacttaaccagtatttcatggatttctattttcaggtgaaaaattagacgatttcaagaattggagctgaatctgatgttaagtaatggcaacaggtgacttaaaaagaagcttacggaacctagaacaggtgctccgcttgctaaattatcctgaagaggtggactgtgtagggtaagctataatatcaaacttaattgtattcttcttgctagtgatttgagatgatatttaacatgggggactacctgagaaaaatcagattttacctggttcctatttaaatctgccttgaaatgattaaaatatttgagaaagcagggaattataggagtttatttctaagtatgaactaatgaagaattccaacttaaaagatttaaaactgtttagaagcacagtatttatctgtataagttataatctctgtacagcttttaaactcatagaggtataatagattttattatttgtataatctaccattctctcatattcagttggatgatatttcttacagttaaatatatccagaataagaagagattgttgccatttcttgtcagtcttttcttatcatttatttgtttattcttttatagaggaaagattttatacatttaagtcgagtgttctttttcatatggaatattctagttagtagatttttttgtgtatggcaacctgaagattgcgcttaagctctcccatttaacagaccccactttgaacctttcactttagctcccattttgcaactatgacaacgtttttagaatatggcaacatacattttcctatattcatgcctatataatatggtactgcagtcattctgtatcccttcataattctgtttcttcatgacacttacccttaaccttttatcattgattaattgatggattggttaaatgttcattggttactagaatgtaa

SEQ ID NO: 4298 - DNA, 1215 bp, Homo sapiens
cacagcaactaagcagaaggggctcattttacctgagccagcatgatagggaagccccttctgtgttaaccctataagtaaagtaactttgaaatgaccaatctgcttttgttccttgtttctgctttcttcagcccttttctgcctataaagccaaactataaaccagagcacgccttctgttttatagaatgagatattgcccagttctagaatcactaataacagctaattacatcttaaaaccaaacttgttgtaattttattttttaacaatatcagtaaaggtgcctttattctaagagctatatgaggtggtttgatcatattattcacagaattataaagttagcataagaaaattatgaaattaaaccccaaattgtttgttgaatatggtgactggttattaatcttgaagataggaaataagatgttccttgattagtgttggtcctgaaagaacttattgtcttattaagaagaaaagactcaagaaaagtaatccaaaacagaatatagtcaagtttcaactgtatgtattatagatgttcagagaattgtgttgtgttgatttttgttagcatagaaggcattgtaaaatgtgtgtgactaggagccaattagaactgagtgtgtgtgtgtgtgtgtgtgtgtgtgtgtgtttgagacagtctcgctctgtcgcccaggctggagtgcaatggcgcgatcttgactcactgcaacctccgcctcctggttcaagtgattcttctgcctcagcctcccgagtagctgggactacaggtgcccaccaccacgcccaggtaatttttgtattttcagtagagatggggtttcaccaggttggccaggctggtctcaaactcctgatctcacgtgatccacctgcctcggcctcccaaagagtgtttttacaggctccattccttattcctggagtcatcttagggaaattttctgacattttattgccttagaactctcatctgtaaagtagagagaaagatgcctcacttgcttgctgaggactaatgagatacaattttgagaattcatttttttcatcccaatgattttcaccaaccatgatcatgctaaatttgtctcactcaaaaccaggcataatgtaatgctgttaagaacatattattctaatattcggtccagaattcctctctgtgaaccgtttctgtttagaatctgtgttca

SEQ ID NO: 4299 - DNA, 1221 bp, Homo sapiens
acctttggagatctgtctgcctcagcctcccaaagtgttgggattacagacatgaggcaccgcgcccggcctcctctcataattatattcactatgccaattgtgacttttctatctccttctctctcccaaataaagtagttcttctttttcctttatcatcccctctactctctttccctctcttttctctcttctctctcttcctctccccagctttttcccaatcaggcctgttcctcttttcctcctcaacatctggatcagcccctcccagttatttaatagggacatttttcctctctcaccttcctaagtctccactcaacaccacactcagcaaatcaaatcatttcagggaatcaactctctttagaagaatgggtataaatacttaaacttttttacctgtgacattcttgcatagtgagaaatcatcctatgaaaaagagaaacgatatctaatctgtgtcctctctaaccatcttgaagttcataactcaaacctcttgatttttcttctctcacagagttagtcttggctcaactttaaaacctctaagatgttttgttcagctattcttaattgtcttcactaaaacctaggaactgcatttgtagctgtcttgaaatatatacatcagtcttggttctcaaaggagatcaggctggtaagccagtcaccctttgcttcttccatgagcatgcagccccacctcctctatccactcccatatttcctaggaaaaacagccttggatacgtaccctgcaatttcattctctttctgtagggtctctccctcccactaaatgaaaaaggactatatacagggttgctttttgtttgttaacttttatttcccaaatggctataattcaccataatatgtatcttgcccctcttttgttacttgaaaaaaattacaaagtcatttcttcttcatgaatccctgggtacaggtttccatttatccatatagtcatgctggaagcaagttaagatgagcagtacctaaactgtgttgtgaatgggtactgaagaatatcactgggagtcaggacccatctaccatgatttctcatctctcccaatccacgcctcccagaaaattttgaatctttttcctacatcagaattgccaaattttgatcaagtttggatgcattgtaggcaatatgcaatagctcttacttcctctcaccgacttttgaatttttc

SEQ ID NO: 4300 - DNA, 1099 bp, Homo sapiens
ggcttgtgttcagttaccacacaaactgggtcttctattactccctgagaagcagattaccctcccattctagttctagtgacctggattattgcccaagagaaatgaagtactgaagaaggacagccatcctatatagacttcctgtaccagctgtataaggctaatataatttgtgttgccatttttgttagctgtttttggaaatatggtacactccaataagtaaatgtaaaattccactccaaaaacaaaggcaagaaagctagtgcagcaaacaaggtgatggctcatggtcaggatttgaatactttctgtggtgtaaaatacatctcactctattcttgcatacaaaactggattttcaaaatgcattaaatttactgaataaacaaaatgaaggcataattctattttttcctaggaattatttgatgcctttgctatttcatcttatttagcaggttatgattatgtaatcttatttatatttcattttttttctttgggaatgatggtccatgatttttttttggcaggatcatgcgtggatttacttaaagactctgattaaaatactgaaattctctatccatatatgaacaaaattatgtttccactgtctttttcagtgctctaatgaattggaaaaagtgcatacagagtgtataagaagcaaagccaaatttgacatttaagtgaatttgagattaagtgattgagatggaatattattttttgagattagataattgaagattggagatgattttttttaaatagatcacactgaatattaaaaaggaagattctgaatcttttgttattgaaagttattaataattaagttgacactataaagatttcagtgttaaaattaagttgacattataaagatttcagtgtgaaattccaagtaatgtgaaatatcacattaaacatataaacagattggttaaagataatcctaattttcttcatgatggaaattattttcttatttataaatatactactactattggagttatgtttcctcatctattgtagaagcatatgctttgacaatgttctgatgcaagaacatatttataattga

SEQ ID NO: 4301 - DNA, 1099 bp, Homo sapiens
cagatcctccaaaaaaagctcaagtcctaactttgaccaggtttgacaaagaagggagaggaccaggcgttttgtaaagtgctgcttccaaacgccacccgtcaggacagattctaaaccaccttaacttgctgccggtttcaagtgaaaataaatggtacataagtaatcaagaagtcgcagtcccagacctctgaccaaagaaccgaaaaaggacagcgaacgaccggttcccaattctctgaacccaaaggtcggagaagcaatttagaagaggagggggtgggtcttccacaacaaaccccgcccctccctcactcgtcgctgattggtggcggcgttaggccgcgacggaggggcgggcccgcggctgagtctctccctttccgcgccgccccgtgcgcgctgtgggtgtgtttcgggaagcgggcgcgcgcgcgctcgcgtcggaggaccggaaaggaggcggggctgcggcggcgcgcgctcccggaacgcgcgcaccgcagacggcgcggatcgcagggagccggtccgccgccggaacgggagcctgggtgtgcgtgtggagtccggactcgtgggagacgatcgcgatgaacacggtgctgtcgcgggcgaactcactgttcgccttctcgctgagcgtgatggcggcgctcaccttcggctgcttcatcaccaccgccttcaaagacaggagcgtcccggtgcggctgcacgtctcgcggatcatgctgtgagtgaggccgggccggcggtgcaggacgccgggaccgggctggggcggaagccgaagccgggccgccgcgccggggctgccgtgccggggccgcgggcagggcgtccggatcgccctcctgagcggcagttcgcccccgagggcggtcgtcaggggtggacgtcgcaggcttttccggcgtcccctcggaacttgcacccctccaccgtaaattcccgggcttgctcttaaattttaattttgagcgttcctcaggtcggtgcctccgcttgcttcctgttcctcacttccctccacccacgcctggccaatgagggagcaacacaacagcagagccggcgccgccgcccgcctggg

SEQ ID NO: 4302 - DNA, 1074 bp, Homo sapiens
tttttcttttcctttttaaatttttttattttttctgagacggagatctgctcttacgcccaggctagagtgaagtggcgcgatcttggcttactgcaacctccaccccccaggttcaagcgattctcctgcctcagcctccggagtagctgggattacaggcgcccgccaccacgtccggctaatttttgtattttcagtagagacggggttttgctatgttggccaggctggtctcaaactcctgacctcaagtgatccacctgcctcggcctcccaaagtgttaggataacaggtgtgagccaccgtgcccggctgaagatttttcttaattgcaataaatattcagcattttttctaatgaaaatgaattttgtttaccagtaaaagtatgcattttaaaagactttcagatttatgctttttacgtgaagctgctaaactaaaagtaaatggaagaaaccaagtctagtaggttttttctttttttttgtgggggtgggatgggggaggttagttacacttaaaatatcttctccagagactgtatgctcctatactagactgtaagctctttgagggcagtctgtcagatttatctttgtatcttccccagcgcctagtgtagtgccttgcacataataggcgcccaataaatattgatgaagaatgaaggcgttgtgtttctaatgtgaccaaaccatggggattctttgtcattaataccgtcctcctttgtaagtgctgttttttttttttcattcttgagctcctaatgacattagatcttatcaggggcagttggacagttcagtaaaggtaaatgctgctcttgctctagttgctgtgacctatgttctttctgacttgctaagagagccaagtgatagtggctagtgataagattgatacataaattgctttactttgaaataacactggaaaaccctaccgtagacctgatcaagaaaaaaaaaaaaactcaggatgcatgtttaaagtatagctcaggaagaaatgggttaaaacaaatagctgactctttgaaaggccagggtgttggctgatcctcc

SEQ ID NO: 4303 - DNA, 1100 bp, Homo sapiens
tcatccagaggtttcataccaatgatgcaaagcaaccaagcattcgaaaacacctagatgactgtctaaaactttccaggtagcttgacattatgtagccaaagctttgaaaggcactcagacagttgcaaccatttttaacgttgtgcttttagcatatgaaagcaaattgcctaaaatacagcatattcccatcatgtggatctctgtggctatcagcccattacaatccttttaaggaggacattgatgagtcctctgtggtttcagagatgagaggtcagcagcagagactgtcagaatcacatggcaccaatagtagacaaataaagaatgttcagaatacatgtattaatatgccagttaatatttctgcacagtttgttttctcagcagtattttgctatctagggacaaaaaaaaaatgtgttttgctttacaagcgtgacatgattgatgctttactaggagagacttttcataacaaaacagatgtctcctgacaagaaagttattggtacaagcaaactacatcattgcaataatgttatggttcagacttaagcaaaagatagtaagagagtgtgggggaggatggtggggagaaagagaaagcaagcatgaggcagtgagatacaagggagtgagatatagtttgttagaaatctatatccttaacctaccacatgggcttgatctgtgatgaattgagacagggtagagctctcagaaggctaacatatgcaagctttaaaaagccaatctctgcacgtattcatttgtcaatatcttagcagtaagcacttctggttttctaaaaactcttaactttatgatatcaaaatgtcattatgtgcaaattaaaggtgataatgtccttaatccatcatgacagattcacagaatcataaaatatatagaatattggatcatttggaattttgttctagtatttaatttacttgtaatgtttttcattattatcaattcatataggacataagtctatagaattaagagaacaggttttagatctaacgggccttctgaagaaaggcaaaggagggtaaagctatgtgtctccacaggaaaggaaagtt

SEQ ID NO: 4304 - DNA, 1122 bp, Homo sapiens
acatctccataacacaatttgattgttccccaaagtgcatttcaccatctgacatatgctatcttaatgtattgattggagcttctcactaggatgtaagttacatgagggcagggacttaatttattttgtttatttctacataactggcaatgctaatcatataacacatgatcaatattttctgatgtggtgttaagttggttcctcatttatttacatgcatcctgtacacgtacctatttacaaagttctaagtattttattattcctatagtaataatatgattgacactatttacaagtagtattaataccagcatgcttaatacattttcaaaaaatatttgactaagaataccagtacaagctacacattagtcactatacaacacttctttacactgtaacataatttatggagatatttcatttcttaaactctgatttgtcttcttttaaatattttgcagtgttatgaagcaaaagattggaatgtatttaaaatagtgccagcttatctttaaagagtacttcataaagactataatttcagggatcatatctatagtttgttactagagaactagagaagtttttctgaacgtgtagagcaccaaaaaaaaaaaaaaaaaaaaaaaaaaaaaaaaaaccaagagtatttcatggtaagtactaaatagatggcttcttttcctgtaagttgacaaaagaattgaaggaagaaaggaaggaaggaaagagtaaagaaaaaaagtgaattagaaaagaaaaactatacatacaaacacacaccatcaaaaagagaggcaatgagtacatatgtttgtattggtcttgattcatggttcccaactgagggtaaatttctcctctacccaggaaacagctggcaacatctggtgacatgtttggttgtcattacttggaggaggatctactctgatactggtatctagtgggtagaatccagggatgctactgacatattaaaatgccgaagacagttcctactcataacaaaaactacccagcccaagatatcaatactgccaagatgaagaaaccttggttttgatcctggctagtttgtagaaacaagttcttgctatgttgaccagg

SEQ ID NO: 4305 - DNA, 1241 bp, Homo sapiens
tgacataccaaagaagtaaatttctctagacagtgcacaacactgaagtaaatgcagatactgtatcttaattgagtatatttaaatgcaatgttaattaaacttatacttcagtttttacctatgaacctaaaacaaaagccaccaattatacattgaattttattaaatattgtatctataacttataaaaataatgtaaattcagtgattttcattgagacatgctgacctagaatcactcactgaaaaataggttttgaagggtaactcttattttactataaatacgtttggcttaattacaataatgcttttcaatttatggttccttttctttcaaaataaggataaagtaaacctagttattaatatgcttatatctatattgtagattttttgtatgttcctatgaacataatacatacattgattttatttgccttttaataacatgggcagaatgtaatgtggaaggtaccaccactaattgtgattttaaaaaaattacccttcagtgtaatcctgcaactattattgtggaatatatcaatatgattaaattttggcattgcagaacagaatcttcactgcactgtaggttagaatacaagaaaaattgaaaataaaatgagaaaatttctttcttaaccttttgcaattttagtataattttgctaacctgtgaaaatgtctacacataggcattgtcttgtacatggcaagacagcattgtctctgacacacctgcattatttgagatgtatgcattcatgtcagttcttttcagaaacagtaggtaggtattacacaggaatatggtctatttttatggccttctcccataagatgccttctttgtaacatatcacagtgtacttaaaagaggtcattaaaattaaaaagatccaaggaagcagttacgagtgtagaccttcaatatatgaattaattttggatttcagattccttttagatttgttttagctctctacatgtcatatacttaaagttttcattgaaattaagaatattacccaaattttcatattgctttaggaatatttacaggaaaagaaaaagaacatgtttgttcttcagctatttttttctttacggagcatatcatcaccacaatttcatattcaagctttaaagcagaactcattaatgcatgtttcatatgcgttgccaaaaatacaaaattgttttcttgctttatctagtgctgagatttttag

SEQ ID NO: 4306 - DNA, 1189 bp, Homo sapiens
tctgtgtcagaagcaagctaatttacttaagtagattcctcttagtgaaagtttctgaatatttaaaacatttaaatgtggcattagaaacaaccccatttcaaattcttgccatatgtatgaaatccaagtcctgttagatacctgagatgctgaaatatttcattaatttggggatgggggtgtggggacatgttttcttggtgataggtgtatataaatatgaccaccctctatatatgtaatgttttctatataaagtattgtatatgtaaagaaattatttctaacaattgtcatgtgtattttctgcatgattagagcagcatgtaaaattaaatgatgaataaagacgtagagttccaccattgatcatttcctagtagtcagtgctgaaatttacgtagcatacaaatacttttgatttcttttggatgattttgtgtttcccttgaacaaatttgtgtggaagataaaagctgcttattaattccccttctctctcccgccactcttctctcctgttttgtgtcctcttcctcccacatagaaatatgttctgtggactgtggctcacacggcgtttgcatgggggggacgtgtcgctgtgaagaaggctggacgggcccagcctgtaatcagagagcctgccacccccgctgtgccgagcacgggacctgcaaggatggcaagtgtgaatgcagccagggctggaatggagagcactgcactatcggtaggcttactgcaagtctgtgtctgtccccttcctcccagagaagagcaccgacggtcagctgttttcaacttggaaaaagcctatttctttacgttattttttacttgtctttcttaacacgaaattattttttaaatatggttgtcattttataatggcaattcagttctttttagaacagctgtcacaagtatgagctataaacttttttattcattggtttttgggacggccacaaaaatggactcacataaaacagacttaatgatttgtttatgtgaagttttatcgaatattacttcttgatgttccatattgtcattgcatttcttaatagcagattttccactttagaaaaaaatgctttaaatttttttcaaatatatgcccttgttggcctctgtagtttccagaatcacatagcttagacttgtccatatcttgagtctc

SEQ ID NO: 4307 - DNA, 1155 bp, Homo sapiens
atttctgttagaatagtagcacaggagatgtaggatatggcatgtggagagaaggggagaccaaaagaggtggaaacttatccattgagtagctagaagctctctctgtgatagaaatgtcacttgagggagatagatcatttcctattcctgaatatatgaacactgcagtgaatgcttgaaagaaagagactaaggaccaatgagaatttgtgtaattcatcccttcccttaaaatatttcaggacaaagaaaaaccatattctcttccaagtaatgactgaaaaaactggcgtcccaggaatcttataagtcatagtgccttgagttgtttacagctgtagatttgaatattaacatccttgactcccagaaggaaatcttattttggattgctcatgaccaaactatgtatgtatttaatacttaacttttccaaataagacattctgattagtgctctcaccctcccctccatagatgtggaaaaatcattaccaaaaagaagagtgatccacttgcttggggagaaaaccacttgtgtgtcggctgctgtgtctgatgagtctgtggctggagacagtggggtctatgaagctttcgtgaaacagtaaggattcagcaggggcgcttttagctccagcgaatctccatcgccgtggatgtgggttatatgctgtaaatggactgctaccattagtccgctctttggcttagtaaggactttagccgttaaagaagtggtgtgcctgaaaagttcagtatatcaaaaatgacttagccatggaaattatcgataaacagattggtgtacccagaggcaattgaccctctttagaatttaaaaaccttgaatttagtgggaatattggaagaattcaccagaccctgtttggcacatgaagcttctcacgtgtatttctgaaagtctgaaatgtctcaagggtgtggtatatttctagtaataaggaaagtagtcatcagagaggctttgccctaaagcccagaggcgggctcttcttgaaaagagcctctgaaacagtaagctttcgctgggatcagttccactgggagggcataggagtgctgttaatttggattttcattcagaatcactaagtggcaaactgttaaccataacaatcgataacccca

SEQ ID NO: 4308 - DNA, 1163 bp, Homo sapiens
ttaatagccactaccaaaaggcagctattcagattatttgcaggcacagtggctcatgactgtaatcccaacactttgggagcccgaggagagcgaaacacctgaggtcagaagttcgaggccagcctggccaacatggtgaaaccccatcctactaaaaatagaaaaattagctgggcatggtggcgtgcgcctgtaatccgagttactacagaggctgaggcaggagaattgtgtgaacccaggtggcagaggttgcaatgagccgagatcacgccactgcactccagcctgggtgacagagtgagactctgtctcaaaaaaaaaatacataaataagtaatttaggaaaatgaagttatttaacaaaatagaacaggaaaaacttgtttgaggggattttcttaaagaaataaactcttaactatgactacctgctttacttggtaaatgtctcaatcccaaacttccacttgcactctgtttgatatgcagtgattttttttttaaatcttttgttgccagttaaatcggagtgacagtgacagttcaaccctggctaaaaaatcactgtttgtgagaaactccaccgaacgccgcagtttgagggtcaaaagggtatgtattccctcagccacgtcccactgtccctggaccagtccagaattgtcacttgtgcagcacaaactccagaactacagaatgaatgtcagtgctccatgcgcttggcctactgaatgcagccactgggatacacagagacgcagatgccatggccactatggagatgggggggtgtgagggcatttattcatcattggtgtggaacctgtgatggttaaggctggaaatgcggtttcagtatctctggagaaggggccttctgagcctgcaggggtatcagacgatggtagaacacatttctgatgactctgcataccatgtccaggtcttgagcgattgtgggaaggggtgtaagacctggtaccttttctgaaggacacacattctggtaaaggaggaacacacagtttttgtagcttgcttacacagatatctttagaaggttaaaactcatgtgggtgggcagctcgggtggcattttcctggaggtcatgggtctctgcatgagccttaaggataagtctaagagaataaatgaa

SEQ ID NO: 4309 - DNA, 1147 bp, Homo sapiens
tgtcaactcttgaagaacttttatttcacatcagattttcaacacattaatttgtaaagtaccttgagtgtaatttttatatgcttaaaaaagaaaaaatcatataagaaagatgggataacctggtacacaaatgttgcccagtatgtgcgcattgccagtggacttcattttgtaaaaatggaatagaggcagtaccccacatgtgtactgttgagccggctgttgagaaacaacttggttcagccggtggttttgcttctcctttgtgttcctgtgagtaggctgtgccgatggcagcagcgccacgtggtatctgtgcgctggcgaggagaggagcgctttccatttggaggcagtgtgagcacacgctggagtgcagcgttccaaagtccgcccgaaatggatgctgcgtccacggccatcacctgtgcgggaacacctggtttccttaagacaatttcctttttgtccttttatatttttctaaagaaaactaagatataaactaccaagtgctcttaagaataaaaataagaataagaatacaaaggagcactactcttggctacacgaaagatcttgggattcatgacactgagggcagggagaagaaagaacaccagccacgcagagatacaaataagctcatcaaatgagcagctggtttgtctcactcagcctgaatttgcattaagtgttcaaaagtgagtttctggcttgcactagtgttttgccctaaatctaaggatggtgcctagtggtggccctgtgttctgaggacagagagagctggaggggtggagggaaatgcatcggcactcatttggtgtaaccaagaagagggggaaagatgtcttgatagaatcaaagttgccaaaaacaaagaagagtttatcaagcagatttctaacatttagtagaaactacttcatagctctcatttttagggggttctatctataatttatggtaaatagttgggaggcaaagggaagaatgtgtgtggggggattattaatttgaagtataagctaaattgtttattaaaaagcctattttggatgaacaagtttagagagataaactgactaatgtgtcctccagtttagaatttcaccttacccgacccaggcacttcttaaaa

SEQ ID NO: 4310 - DNA, 1165 bp, Homo sapiens
acaagccactgcacctggcgtggcttttatgtttagatctacagtccacttggaaaggatttgcttattgggtgaggaggagtcaagattcactttttcgtatgtggatatccggttggctcagcactgtttgttgaaatgactgtccttaacctactgctcagcagtgctacctttgccataaatcagtggctatatgtattttgatctgtttctagaccctgttctgcttcattgttctattgatctattcctgtctaatatagttttatatattagataggcacgacactgtctaatatagttttgttataagtctttatatctaggaaaaacaattcctctaagtttgttctttgaaatttcttggtagttattgaccttttgcacttccatttaaattttagagtcagtttgccggtttacacaaacaaatcctgctagaatttttatttggattgccttgaatctatagatcacctaggggagaactgacatttttataatattgagtcttccaatctatgcacatggtaggcccatctgtttacttaggtattctctaatgtttctctataatgttgtataatgtactgaatagaaatcttatccatatttgttagatttattctagatatttgttggttttggtccttcccttttctctggaatttagctccgcacagcttcactgtcttggaagctctctggttgtctcaaactttctagtacctgcatccagcttttccatttgtttcagttgcagaattgctgcagaataattgagtttgctgtttcagaatgtggcattcctccatgctgactgcaatttgttttaatttatatagtgctttaattttattttgtttacagctatatatagaaaataattattttttattaatgctatataaaaacttaatatttgctgactatgaaactaataacagaaaacatgctttcatattgttttatcaatttttgatgtaggagtttatacaagaaatagaaactttcggctatataaatcatcaaaaattggaaagcgtgtggctttggaggttactgaagataacaaattttttcctatacagtcaaaagatgtttctgacgaatatcaatattttctctcttctttggtcagcaatgtcaggtatgtagtagc

SEQ ID NO: 4311 - DNA, 1217 bp, Homo sapiens
gaaccattggttgtttcaagttgttcttaatttccaaattatggatttctattagttttatttctaaaatttgctttatgctcagatgtgttctgtatgaagtgatgattttaaatttgataaaattcactttatagctagcatggaattggttttataaagaactgcttcatatttacctattagatcaaacttcttaattgctttttgtcattcattttttctgtatccttattggaccttttttgtggttatcctttgatctataaattactgagagtatgttttttaaaaaccttgatttatggtagatttgtttatcattgtggtcctgtccatttttgctcacatattttgcagctgtattatttggtgagtacaggttgagaattgttacatcttcctgggggaactttcatcagtatctactttttgccctgcagttcattttgtgtgatttttggcaaccaccgttttgattggtatgtatctatccttatccttttactttttaatttttctccatctttaagtcttaggcatatttcttggaacagcatgcagctggattttgttttctacccagtcttggtattaatactttttttttttttttaaacataaaggattctggttgatctgaaaaatgaagtttggtatcaaaaatgtcatgaccctgtatgtaaagcagaaaacttcaaatctgactgtaagttactaatttttacatttaccacaaagtaaaaattagataactgtaatatgtaatagttttgctatctttctgattcaggtttcccattacctgctgaagtatgtctcctgtttcttttcaaagaggtaagtacagattttagtgtctttctccttaccagggagttcttggtacaatagtatacctgagccatgagtagtgtccaaatagcattgaaacccatttgctaccttgttttcacttatgactgtattataggaatatattgtagtgattttcccatttcagcacatatctgataatacaaaccttttttttttttttttactgctgcttgaggtgtacagtttaatcagtcccagacatttaagaagtttcccatattttgcttttcaaagtaacaaaatacccatctttgtatttctttgaacatctgtatctgtaggatgaatttctagaagtagaattgtgtcaaagggcatattcagttttaattttggta

SEQ ID NO: 4312 - DNA, 1190 bp, Homo sapiens
ttgtatttttagtagagatggggtttcgccatgttggctgggatggtctctaactcctgacctcaggtgatctgtctgcctcagcctcccaaagtgctgggattacaggcgggagccacctcgcccatcctcccttgacttttgatatcacattgccgcataactggttggttttcttatttcagcaaagccaactgtttcccagtcatctctgattatagttaccaatattaaatactgtttgagagttacttgtttactgagataatttcagacctaaaattagacttttctcttagatgcagatatttattttgaataaacccttggagaaaaacatttttccacttttttccttctttgttggttcaggcgctgatggaactgctgctaattgaactgtgtcctgagctgagagttcatttagatcaacttaaagctggccaagtttgagactacacaaataaaccaccagaaaaatgtctgtgtaataatagacatgaaacattttcctcttttccacagagggcttaactgagaaccgtattgatttttattttagttacctccctctagttttatgtgaaattagtagaatcagggaggacgggacttatgctgtggtaggcaacagaaaaaaacttctattgattttaatttaatatgaatactttaaagatcaacataccgattgaaatacaaatgttaatatgtgagaacctaggaagtattttaaatatttatgaaaatattttgttttaaaatgaactatgaatattgtacagttaatttcctcactgaggactgtgaacattcttatattatttcatgtatattgaagaacattgttatgcaatgctttgtgtaaagttattgtgaagattttattgtctttatttttaccaaagatttcccatagtttgagcattcaaagcaataaaatataaaaatgaatcacagtgctctatgatatttaagatacttatatctcaaagaggttgaaactctacaggctgttcaaatatttatcaaatgcctttttagagaaaacactatgtacttaactacttctgcagggaagtaaaagtttgctgccttctccagaaacaaaataaatctgtaaaatatatgatttttagtgagcagaaagagccaaattagtgcttgaagtgaggcattagggaggagag

SEQ ID NO: 4313 - DNA, 1555 bp, Homo sapiens
tcttacctcagtgggttggtagttgcagatacaaatctgatttaagaaattagtcttctataaatcctggtaaattgttatccgtacatgagtgacctacagataccttctctgtggaggcgtaagagaagttaagcccacgtaaagacgtggcaagtgtgaaaatcaatacatattttgtcccagagttagttataagaatgcagaaaggtcatcattatcttactcatatttagataagtaatataccaatgagaaatgttttaagaaatgtatgattctaggtttttgttgcctttctcgtattttattttgccacagtatcgtttcaatatacatgactttcgttcatggttctttaagtattaaaacattcataattggaaatattgtatgagtcattttgtcatccattacaggtattcatcaaagtaatagacacaaatgaccatcgtcctcagttttctacatcaaagtatgaagttgttattcctgaagatacagcgccagaaacagaaattttgcaaatcagtgctgtggatcaggatgagaaaaacaaactaatctacactctgcagagcagtagagatccactgagtctcaagaaatttcgtcttgatcctgcaaccggctctctctatacttctgagaaactggatcatgaagctgttcaccagcacaccctcacggtcatggtaggcgctctacccgctctcctcccaccatttggtcctgaggcctttgtgtgttcgagcgtgatttttaattagttataaggaaagcaccaatgggattgataatgtgtcaattctttttaggtacgagatcaagatgtgcctgtaaaacgcaactttgcaaggattgtggtcaatgtcagcgacacgaatgaccacgccccgtggttcaccgcttcctcctacaaagggcgggtttatgaatcggcagccgttggctcagttgtgttgcaggtgacggctctggacaaggacaaagggaaaaatgctgaagtgctgtactcgatcgagtcaggtacttttggagccttcagtggcattttaaatttgcagttgttaaaagtctgtttctacttttccaaaatcagttctgggtattgaagcatttctatgtatctgcaaaaatggcttaaattgatctctagatacaattttacatgttaggagaaaggaatttttttttttttaacttttagcccatcagagagtttgggggaagttctgggggattcacaatattagcccagttcaaggctctgagaagccacgtagtagaggaaactttatttgaccaattcagtatttctgaaattattttaaccacagtttcttctgtaacattggttaaattaaacacacttaggaagctgcttgcctagtaatttaacgtttcacttttttgtcagagagtattttctcttgagcagagcaggaagctccataacagtgttgactcatctcattgtaattggctgaaacctcagaaagaggtgtcgtgcccctcccaccccttccacatttacctggatttttgccactcg

SEQ ID NO: 4314 - DNA, 1115 bp, Homo sapiens
tcgtagttagattcagtattgttagtataatgccatatacctacttacacctagtatatttcagttaatttagcctatgcaggttttttgtttttgtttttgtttttgagacaaggtctcactctgttgcccaggcttgagtacagcagcatgatctcggctcactgcaaccttgacctaccaggctcaagcgatgcccctgcctcaggcacccaagtagctgggactacaggtgcctgccaccatgcttggctaatttttgtattttttgtaaagacgaggtttcgccatgttgtccaggctgtactcgaactcttgggctcaagtgatccacccacctcagccttccaaagtgttgggattacaggtgtgaaccactgtacctggccgccttttaatacataaagaagatatgataaacacagtaacttcctaaatagagagcagtgttggattttttttaatatccttttttcttttttatcctaaatgggcctggtcacacggagttcttgaactctatacagggatctgtttggccttcctttagttgttataacttaagttccatcgctcctcccaccacaggcaagtgctggtccaccttggtggatgtgttgcctgtttttccactaacagtgattgattgatgagagtcagacctggctgttgaatcacaactctgcatctcatggagatagtaccctctggttttatgtgtggactctggagccagtcagccaggtttggggttctggcttctctgctaccaaagttggataactgaggatgacttccttaacttttcaggctaagttgttagatgtaaagctctaagatgactaactggtaaggtaatccattaattcattggttactttattacggagtaaataacttcagaccagtgacttttgagccttaagcctctgcttctgaatatggaaaatggggagagaccactgggctaattgtgaagattaaacaatatggcatattaaagcttttactaagtctgcatccagtccgtataaggggagaagagtaatcaacactgaaattgcgtatcttctgaaatttgaaacaaacttccagaagcattgccattggtaggt

SEQ ID NO: 4315 - DNA, 1255 bp, Homo sapiens
gaaggctgcgtggcgtcttctacatgtcgtggttgtcgatgccaatgataatccacccgagtttttacaggagagctattttgtggaagtgagtgaagacaaggaggtacatagtgaaatcatccaggttgaagccacagataaagacctggggcccaacggacacgtgacgtactcaattgttacagacacagacacattttcaattgacagcgtgacgggtgttgttaacatcgcacgccctctggatcgagagctgcagcatgagcactccttaaagattgaggccagggaccaagccagagaagagcctcagctgttctccactgtcgttgtgaaagtatcactagaagatgttaatgacaacccacctacatttattccacctaattatcgtgtgaaagtccgagaggatcttccagaaggaaccgtcatcatgtggttagaagcccacgatcctgatttaggtcagtctggtcaggtgagatacagccttctggaccacggagaaggaaacttcgatgtggataaactcagtggagcagttaggatcgtccagcagttggactttgagaagaagcaagtgtataatctcactgtgagggccaaagacaagggaaagccagtttctctgtcttctacttgctatgttgaagttgaggtggttgatgtgaatgagaacctgcacccacccgtgttttccagctttgtggaaaaggggacagtgaaagaagatgcacctgttggttcattggtaatgacggtgtcggctcatgatgaggacgccagaagagatggggagatccgatactccattagagatggctctggcgttggtgttttcaaaataggtgaagagacaggtaaatatgtttttattgctctcatttgatgcccttttccattttttttttttttttaaccatctgccctgtggcagcttcttcaaaattccctgttgctctttgggctcggtatagaagtgcgtgtgaatattttttttggcccggctgctgtattgtagatgtgtttattcgtagtaagccatgaagatggaaacaaaagggcctgagtgatttaagtggcgtaaagtgagtaaaagaccagggatacattgaaattgttatcactgatactgatctccaaactctattttgaactctattatcaaaagcatcattatggttttgttctgactttgagaagtctttccaacttttttcagtcagtgtatttgcaggctcatacttagaac

SEQ ID NO: 4316 - DNA, 2289 bp, Homo sapiens
gctcctgcttctgctccttctcttccaacattttggagacagtgatggcagccaacgacttgaacagactcctctgcagtttacacacctcgagtacaacgtcaccgtgcaggagaactctgcagctaagacttatgtggggcatcctgtcaagatgggtgtttacattacacatccagcgtgggaagtaaggtacaaaattgtttccggagacagtgaaaacctgttcaaagctgaagagtacattctcggagacttttgctttctaagaataaggaccaaaggaggaaatacagctattcttaatagagaagtgaaggatcactacacattgatagtgaaagcacttgaaaaaaatactaatgtggaggcgcgaacaaaggtcagggtgcaggtgctggatacaaatgacttgagaccgttattctcacccacctcatacagcgtttctttacctgaaaacacagctataaggaccagtatcgcaagagtcagcgccacggatgcagacataggaaccaacggggaattttactacagttttaaagatcgaacagatatgtttgctattcacccaaccagtggtgtgatagtgttaactggtagacttgattacctagagaccaagctctatgagatggaaatcctcgctgcggaccgtggcatgaagttgtatgggagcagtggcatcagcagcatggccaagctaacggtgcacatcgaacaggccaatgaatgtgctccggtgataacagcagtgacattgtcaccatcagaactggacagggacccagcatatgcaattgtgacagtggatgactgcgatcagggtgccaatggtgacatagcatctttaagcatcgtggcaggtgaccttctccagcagtttagaacagtgaggtcctttccagggagtaaggagtataaagtcaaagccatcggtggcattgattgggacagtcatcctttcggctacaatctcacactacaggctaaagataaaggaactccgccccagttctcttctgttaaagtcattcacgtgacttctccacagttcaaagccgggccagtcaagtttgaaaaggatgtttacagagcagaaataagtgaatttgctcctcccaacacacctgtggtcatggtaaaggccattcctgcttattcccatttgaggtatgtttttaaaagtacacctggaaaagctaaattcagtttaaattacaacactggtctcatttctattttagaaccagttaaaagacagcaggcagcccattttgaacttgaagtaacaacaagtgacagaaaagcgtccaccaaggtcttggtgaaagtcttaggtgcaaatagcaatccccctgaatttacccagacagcgtacaaagctgcttttgatgagaacgtgcccattggtactactgtcatgagcctgagtgccgtagaccctgatgagggtgagaacgggtacgtgacatacagtatcgcaaatttaaatcatgtgccgtttgcgattgaccatttcactggtgccgtgagtacgtcagaaaacctggactacgaactgatgcctcgggtttatactctgaggattcgtgcatcagactggggcttgccgtaccgccgggaagtcgaagtccttgctacaattactctcaataacttgaatgacaacacacctttgtttgagaaaataaattgtgaagggacaattcccagagatctaggcgtgggagagcaaataaccactgtttctgctattgatgcagatgaacttcagttggtacagtatcagattgaagctggaaatgaactggatttctttagtttaaaccccaactcgggggtattgtcattaaagcgatcgctaatggatggcttaggtgcaaaggtgtctttccacagtctgagaatcacagctacagatggagaaaattttgccacaccattatatatcaacataacagtggctgccagtcacaagctggtaaacttgcagtgtgaagagactggtgttgccaaaatgctggcagagaagctcctgcaggcaaataaattacacaaccagggagaggtggaggatattttcttcgattctcactctgtcaatgctcacataccgcagtttagaagcactcttccgactggtattcaggtaaaggaaaaccagcctgtgggttccagtgtaattttcatgaactccactgaccttgacactggcttcaatggaaaactggtctatgctgtttctggaggaaatgaggatagttgcttcatgattgatatgga

SEQ ID NO: 4317 - DNA, 1199 bp, Homo sapiens
tttcaggcttgttcagactttggaatatttgcattatacttactgtctgagcatccctaatcggaagatctgactccatagcacatttcttttgaatgtcatgctggtgctcagaaagtttcagattttagagaatttcagatttttggattagggatgttcaacctatataaatatttactttgaagtagaaaaactggaagtagatggtttaaacataaagtgtcttggtatagacaagggttctcccactttacatgatgggagcatttttgtaaagcactgagaatcttaaagttcacatgccataaatctacttttatagttaaaatttttcaaaaggaacacaagagatggctttttgtacatttttgtgcttaacttaccactgactcttcttttcaaggtcactctggaatatagacccgtgatcgacaaaactttgaacgaggctgactgtgccaccgtcccgccagccattcgctcctactgatgagacaagatgtggtgatgacagaatcagcttttgtaattatgtataatagctcatgcatgtgtccatgtcataactgtcttcatacgcttctgcactctggggaagaaggagtacattgaagggagattggcacctagtggctgggagcttgccaggaacccagtggccagggagcgtggcacttacctttgtcccttgcttcattcttgtgagatgataaaactgggcacagctcttaaataaaatataaatgaacaaactttcttttatttccaaatccatttgaaatattttactgttgtgactttagtcatatttgttgacctaaaaatcaaatgtaatctttgtattgtgttacatcaaaatccagatattttgtatagtttcttttttctttttcttttcttttttttttttgagacaggatcggtgcagtagtacaatcacagctcactgcagcctcaaactcctgggcagctcaggtgatcttcctgactcagccttctgagtagttggggctacaggtgtgcaccaccatgcccagctcatttattttgtaattgtagggacagggtctcactgtgttgcctaggctggtctcaagtgatcctccctccttggcctcccaaggtgctggaattataggtgtgaacaaaccaccatgcctggccttgtagtttatttctaagttcaaattaatgtt

SEQ ID NO: 4318 - DNA, 1140 bp, Homo sapiens
cctggtgcgggggtccaggtcaccgtcactgttcccccactgagcccccgctcctcctctgcggtgagatgccagagccgtggcggagcgaggaggagtgggctcagagcctccggggagccaccgggagccccagcctgggtttcaatgagggtgctcctggccgccagagccgtggagcctgccgctgaccgcgcgtgtctccccagaggatgacggccgaggcgcaccggcgcgtggtggtggagtacctgcgggcggtcatgcagaagcgcatttccttccggagcccggaggagcgcaaggagggtgccgagaagatggttagggaggcagagcagctgcgcttcctgttccggaagctggcgtccgtgagtgtcgcgcaggtccgggctggagaaggcctgtcgctccgcggccctgttcagcctccaccccgggactcgggccagtagatgggagtgtgtcgtgtgtttgtcaggcggggggagcctgggtccaggtcctgcctgaccttgtggttggacacgaatgtccacagaggtagacgcgccggccccgccggcttcccgaggccgcccacagctccctgacggacgcttcccagtctgtcctgcgctgcgaggtgctggctgcctcccacggtctcgccctcaccccagacccctggccctgtcactgagctttcagagtagatcctgaggagtcaggtgaagagggaggttcccagtcaggaaggggctcagccagaatccagctgctcccagcgccgcgggacagccgagggcggctcctcacattgctgctgccttccagggtttcggggaagacgtggacggatactgcgacaccatcgtggctgtggccgaagtgatcaagctgacagacccttctctgctctacctggaggtctccactctggtcagcaagtatccagacatcaggtaagggatgcacgtcttagaatcctgccttagaatcctggagtggagcggcaggtccctccttctgtctggggcgggtggggctcctggttcgcaagttcagccctgcagcacggcaagggttcaggtgcggcacagcggggcccaggcgcagggagcagagctgcttctgtgctgccttccacctggcctgggc

SEQ ID NO: 4319 - DNA, 1099 bp, Homo sapiens
gcagcctggccaggaggctgcggtccagggcctcgtccggagaaaacacagggttgtcaattcctaggagagagggcagcggctagtcagccttcggagagccccacggcggcaggggagacctcgccggggccgtcacctgctgggtgccttggaaagttagggtcaccgggaaggttagggtcacgtgcctttcaggttgcgggcccttcccccacatccatgaccccacacgccacaggcagcacaggtaacgtctcgcttccctcaagacataccccacctgctccctgcccggcccacgtctccccggacagcagcctccgagttggttgagggggcactcagtgggtgccaagcagggcccttgagaacccacaggagaccccacccccccaggtcccagtgcccctggtccaatgaccgagctccctcctggggcggcaggagccacccctcccttagccacgacgcctgtgccccgtccccacctgcaggggagtcggacgctgtgtccttggtgacactagccaggaactcgatccccccactcatctcctcatcatagttggggggctcctcggtgtctgaaagttccaagtctggggaagacaggttggggtgaggactggggtcactggggggctgtcctcacagcccagtcagcagtgtccatcagctctgtgcacagaggtgcaggcagtcgggacccacagagaggagggctaaaccgcagggctggaggagggaccccacttagagggcagtgtccctggaaccccatcctgggtgggtctgcagctggggccctgaccatgcctcccctgcctgggtggctggagggtccccagaggggaaggtcctgagaggggaggttcccgagccgggagggctggggctgggaggtggtggctcccagtcccagcgttcctgcagggcccccagcgcacctttctccttgatggtgaaattctgcgcagggctctccatgggcagcttcccattggggatgctgctgtttctctgcggagcaaacgtgaagctgctcacaccccgacacagccacacccagccctgactgcccccgctccaggcccca

SEQ ID NO: 4320 - DNA, 1129 bp, Homo sapiens
ttgttattgtatttttctttgaaatttctatttgtttcttctttatatctcctgtttctttgctaagactagtttttcctttgtctcaggtgtttgtaattgctcattgaagtattttttatgacagtcactttaaaatccttgttagacctaagttctgtgttctctcttggtggtatctgttgattgactgtgttttctcattcaaattgccatttttctggttcttggtcattttttatcatattgtggacatgctgggtatgatgtcatgagactctgcttcctgtttaaatccccttacttgagaagactcctcactcgagcctgctgggtgccaccttgttgccgggacagtcatggagctcctgcctcacccacggcctctggcagaccctactggctgggagagtgaagggcaccacctcgttctagccaggccgggacagcagtcaggatccattctcacaccccggtgctggctgctgcgcaaggccaggtggacgaggggtgtgtgtgtgtgtgtgtgtatgtgtgtgtgtgtgtgcgcgcgagtgggggtttgcttgcaggagggctgatgatgtgaagagagtctgtcctgcaaggcccctcctggtgccaagtggacgaggggtgtgtgcgtgtgtgtatgtgttgttgtgtgtgtgggtgggggtttgcttgcaggagggctgatgatgtgaacagtgtgtgtggttgcaggagggctgatgatgtacagagagtctgtcctgccaggcccctcctggtcctttggccatcgagagcaggcttacggtttttggtctttttgtgtttctgggctgccgacttctgtggcacccagagtgggatgtgtagtaaataagcataaacaaaaccccagagtcaagccagggactcagcgctgggttctctctcgagtgccgaggcccctggctggttggcttctgttcctttcagtcccccaatgcttgttccgtatattttcctccagggcagtgggtctaatatgcgggaggagcaggttgaaatgtgtcctctccatgttgcctggaactggaagagctcaaaccaaattttaaacttaatcagaacatattctggttgggtgtggtggctcatg

SEQ ID NO: 4321 - DNA, 1256 bp, Homo sapiens
atggcctgattggcccggacagaaccgtgggatgcgcctgccctgagcctggtgcctgagcattatggaggccacgtctgacaccagctcgggagtctgctccaagtcagatgcggacctagcccaggctacacccagtgctgcctcatctttccccgttcccaggcctcagctttctcatctgtgaagggggggctgatggttctcaccctgtagggcggcgtgtggattaaatgaaattgtgcgtgcacatcactcagcttgctgcacgctgaggcctcggtagatattagctgtgcttagttgcgtcacatgtgggttccataaacgaccgtctcaccgcgtggggcccagagaacttcacagatgagaacgtttcatttttctacttttcctggtaatgacatggagttattgcaaataagtttatacagttggttggtcagtgtgtgttgctggcttatttcactgtgtatttcttgtttaaagtgtgaatgaattcactgtgttttctgttgacagggcattcagtacctgactgcattggagagtctcaatctctactacaactgcatctcctcgttggcagaagtgtttcggctccacgccttaaccgagctcgtggatgtggacttccggctgaaccccgtggtgaaggttgagcctgactaccgcctttttgttgtgcacctgctccccaagctccagcagctgggtaggcatcaggcagggccacgctcatgcttttgtccccgtggggtatgggagtcggggagtcgtagtgggtgtctgtgtgctcaacgtcacatgcttgattccttctggaacggggagttggttttctacgctggtggcttgagttcctgcagacacacagctcgagaggccctgtgtctgcacaggacagggctggaagttgagcaccctgggagggcgcagggctggggccgtgggagcacagccccggaccaggctgctacgtcctgttctggctctccgcgtcatggctgttggacttgggcacgttcctgaacatctcctgtcctgtttcctcgcatagcccccaggtatcatctcaggtgcagctaaacagcaggatgctgcctggttttgccccacttggaagcacacaggacaagcagctcattgtcccccacaccccaccactgggacagggttgggaggggatgtgcagtgacctttggatcatgctcctgaaagaaaaggctttccatgacagtcttgtaggcagaact

SEQ ID NO: 4322 - DNA, 1190 bp, Homo sapiens
gtgtggcgtgtggtgtatggtgtgtgtggtgtcttgtgtgtgtgttgtgttttgtgtgttgtggtttctgtttggtgtgtgttgtgtgttttatgtggtatgcggtgtgtggtcagtgtggtctgtgttgtgtggtgtgtggtgtgtgtggtacgtggtctgtgtggtatatggtgtgtgatgtggattgtgtggtgtggtatatgaacgtgcttacaggccacggtggtatcgaggctgagcgtgggcctgaggggaaggagctgtcctggagtcttctctggctgatgtgacgtccgtgtcccctgctcgctgtcctccatggggtccatgccccttgcttgctgtcctccgcggggtctgtgcccctcgctcactgtctgtcctctgtggggtctgtccccccggctcgctgtcctcggtggggtctatccccactgctcactgtcctctgtggggtctgtgcccctcgctcgctgtctgtcctctgtggggtctgtgccccccggctcactgtcctctgtggggtctgtccccactgctcactgtcctctgtggtgtctgtaaccctcgctcgctgtcctctgtggggtctgtccccgctgctcactgtcctctgtggggtctgtccccccggctcactgtcctccgtggggtctgtccccccggctggctgtcctctgtggggtctgtgccccccagctcactgtcctcggtggggtctgtccccgctgctcactgtcctctgtgcggtctgtccccccggcttgctgtcctccatggggtctgtcttgccggctcgctgtcctctgtggggtctgtgaccccagcttgctgtcctctgtggggtctgtccccgctgctcactgtcctctgtggggtctgtgccccctggctcgctgtcctctatggggtctgtgccccctggctcgctgtcctctgtggggtctgtctccccggctctctgtcctctgtggggtctgtgccccctgactcgctgtcctctgtggggtctgtgccccctggctcgctgtcctctgtgggatctgtctccctggctcgctgtcctccatggtgtctctccccccggctcgctgtcctctgtggggtctgtccccgctgctcactgttctccatggggtctgtctccccggctctctgttctctgtagggtctgtgtcccccggctc

SEQ ID NO: 4323 - DNA, 1187 bp, Homo sapiens
ccgtgtgttgggaggttgtggtctgcgtggcttgtgtgttgggaggttgtggttcacgtggcttgcatgttgggaagttgctgtggtctgcgtggcttatgtgttgggaggttgtggtttgtgtggcttgtgtgttgggaggttgcagtctgcgtggctcgtgtgttgggaagttgctgtggtctctggcttatgtgttgggaagttgctgtggtttgcgtggctcgtgtgttgggaggttgcagtttgcgtggcttgcgtgttgggaagttgctgtggtctgtgtggcttatgtgttgggaggttgtgggtttgtgtggctcaagtgttgggaggttgtggtctgcgtggctcacgtgtggggcggttgcttggctcgcctgttgggagtttgtggtttgcatggcttgtgtgttggaaagttgctgtggtctgtgtggcttatctgttgggaggttgtggtttttgtggcttgcgtgttggggggttgtggtctgtgtggctcacgtgttgggaggttgtggtctgcgtggctcacgtgttgggcagttgtctgcttggctcacgtgttgggaagttgtggtctgcgtggctcatgtgttgggaagttgtttatgtggcttgtgtgctggaggttgtggcctgcgtggctcacgtgttgggcggttgtctgcttggctcatgtgttgggaagttgtggtctgcgtggcttgtgtgttgggaagttgtttatgtggcttgtgtgctggaggttgtggtctacgtggcttgcactgtagttcttttggacagccttgttctgcagtctgtgtttcagccctggaattgccacattctccaagaagccctggtttcttgactagagagccttgtgtagaagccaggacctgggttctgggtgaagccctctgcagatagagctgggagatgcctgttgtgtgtgtctgcaccacatacatggacactgtgcagagggattctgttggcacctgtgtttacatgggttgaaaactgtttttacacggaaacttccagttccctcgtgccccgtgggttccgcccacttcttccctttcagttttgtatctgcgccgtgaggacttgtctcctaatcttcgtatcaactccgtgtcccattgagctgaccttccgcctctcccccagggccctggccatcctgtgggctc

SEQ ID NO: 4324 - DNA, 1200 bp, Homo sapiens
ttcttatttttctccactaagcttttagtcatgtgcattttaaatcattctcttaatgactcctcacctgcattggtgatgtatcagacttagcacacttgctcctggatgcaagcacgttataattctttaacctcattttcctatcctggcttttgcatcatttttctgtatcctaattgtatgcatatttaattctacaatatatcattatttttattgttttcagtgggtttgcccacaagtttaccttttctattgattttcaaattttctcctattttcttgtgtttgaaaacaagatatttttggataatttgcctttggcctgaaaaagttcctttacatttattttagtgaagattagtggtgataaattccctcaaacttttcatctgaatacatcttcagttcatgtttattttcataaaaatattttaactggatataagattctaggtgagctgttatttttaaccccagaatttaaaaatacatcattcagttgtctttcagcttccattattttctgttgagaagtaaaacatcagcctatttactgtcacaatttttctcttcctttttatttttgactgtaagatgcccaggcgtggttttctttgcattcattttgcttcatgtttgcagagcttcatagatatgtggtctgatgtctttcattgattttgggaatgtcttaaccagtgtttctttaaatattcttctccctcattctctctcttcttcttctgggactccagtccatacatgtcatgcatttgcatcatgtctcatacgttgtcacgcccttttttctacttttttccttttagttttgattgcattattctttatgtgttctacctacctagcttctggttcactgatctttattctgatgttcaatcagttgctaaccccatcttttaagtactttcagttaatacagttcttagttctagtatttccatttgattttcaaaaaacaaaagacttcagttatcctgtagtattgttcatattgtcatgtgattttaactaaagttaatttaaaatcatatttggtaagtccaacatctgctcctattcagttctgtttatatttcctttttgtctcttggtgattggccttgtggtctttggcatagccagaagtttgtattttggatgctatgcatgaaaatagaagttgtggaggat

SEQ ID NO: 4325 - DNA, 1287 bp, Homo sapiens
tcctttctaagttaaaatgaacaaactcagaatcaaaggctgtcctgtgaattaaatacatttcagctttcagacaaaagtgctgcctttctgtattttccgcctctggccatgactcctcccacctggcatggagaccccagggcccaggtgcgccctcacctggccaagtgccctccctgccacattgctgttcctctcacctggcagctgttccccctgcgacagatcctactgacgtccaggagagtcgcaggccaccacagcgaagtgtccctctggctctcaccttcttcttttgtgttgtccagagcctcgcccatcgtccttgtcctcccaggtggtatccactgaggagggccagtcctgggtcacccagggcaccccttgtgatgcctggctggggccagcgaggggactcactccttcccttctccaaagtccacctcctggttccgtgcgaggcatcctgggtgccacagaacggtggcagagaaccctgtggagattgggcgcactaagagccaagacctccgacctaccctctctccccagcccccaaaataacacaaatgagattggctattattaattccctgtgagcaatgctggctcctgcctctgtacgtgtctgaaaacaccaacagcagcactttcccagacaggtgtgtctctgcacccccgacgtggctctccctggcgactctgcggagcgccacactttgcttttggcgggacccgcacggcttcatcaccgagtgtccctgaagggctagggccatgggatcactggtgacggtgccgtgaaggtctggagagtggattgtgagggatccggagtccctggggatgtgcgtgggtgaggagtggtgccatggtggcagtgcacttgtgtggctgtttttccaagtggtagtgactgcagggaggatggcttcaggcctgggaacaggctgcccctgcacactcaccctcaccatctggtctgcgagactagctttaatttctacagcgctccctgaggctggcggaaaatggttctgaagacaagagtcactgttaactggaatgttgttgtgaatggagcacaggcttccatgaagtagtgctgaggaagggtgcgctggggctaactccagaggcagcattgtagcgaacactcgtgacagaccagccagtgcgtggaggaggccgtggccctggcctgcacggggggctcttgcccacatctgcaggaggcagcaggcacggctctgagtggcccgtctagggcaggtcccagcttac

SEQ ID NO: 4326 - DNA, 1190 bp, Homo sapiens
gaaggggtctctgtccacggacaagctgggcggccccccgtgtcctgcatctgtgcccaccctgacctgcccggggtctgggagtggacaggaccgcagctccacacgcctttctctgttgggggagagcagcagtcgctgcttagtgattccggctgtcagcacatatggccccacacgcagacccgtgtactgcaggttcctgctgaggccaaggccccagggcaggcaaatcccctgcccctgcctccgccgtcactgcagtctcagaaaaccaacacctgcacctggtctgcagacacacgtgtgtgataccagcctggtgggacccacgaagaccccatgaggccgtgacctcacagagctgagcatcccgctaccaggtgacccccgtgctgtcctccagtgcgaagtgaccacaaagacacctgcccttggggtctcacagtggccatggggcccaggccagtataactcaggtggatacacccagacgtcctcagcagcctacagttacccacggagccaaagccgctgcagccaggcggccagcttccacgcacggaggctgcacaggtctgtgtcggggggtggggggtgggggggttggcaactcccctccagctcgcttccctccctccctgcacactcactctcccctcccacttggtcttaggacagaaatctgtgcatgctgcggggaagggcactgaggggctccacggtttcaggctgtgagacaaagcagccatcgtaagcagctgtgggcactcatccggctcagaagccgctgaccctgtcagagggcactgcccttggggagggtccccatgtctcctgcctgcacgctgctcggttagaaaagctaagttcaaaggtctcggccctcgtcccttcctgcacatgagcatgcatctggcaggctgccgttcctctaaccaggcacccgcacgcccaggctccgatgagctctggctttgacgccactcctgtgctcctgcagggcctctgccacctccacgcaggctgggggctgagcctgcgacgcagtacctgaggcatgctctctggaggaccctcgtgggctgcaggagggtcccagaaaagactcggcgaagtcggctatacttctcagaaagcctggtgtctgtggccacggcccccacgtacctctcgctcctgctcgttct

SEQ ID NO: 4327 - DNA, 1441 bp, Homo sapiens
cagcggttcctgttctgatcactcgagtctccgtgatgccaccgttcccagaaggcagcccgtgcagcctccgggtccccccttcagccatggcagcccgtgcagcctccgggtcgtcccttcggccaagcttccctttccttgagagcagcacgctggcctggccatgcagaacaaaacacaactcagaaatccctcctcagccctcggcagtaaaacttctgaggattcgactttttagttaatttgctcactgtggcagctcactggaaaataaatcgaggatgccaagtcctcctcttagaaaaatagcccctgcagtggggtttgctgatgtgctcatttgtgtcattgcaggctttatcctgtggataaacgcagagtgaacgagtttggggagtcctacgaggagaaggccacgcgggcgccccacacggactgaaggccgcccgggctgccgccagccaagtgcaacttgaattgtcaatgagtatttttggaagcatttggaggaattcctagacattgcgttttctgtgttgccaaaatcccttcggacatttctcagacatctcccaagttcccatcacgtcagatttggagctggtagcgcttacgatgcccccacgtgtgaacatctgtcttggtcacagagctgggtgctgccggtcaccttgagctgtggtggctcccggcacacgagtgtccggggttcggccatgtcctcacgcgggcaggggtgggagccctcacaggcaagggggctgttggatttccatttcaggtggttttctaagtgctccttatgtgaatttcaaacacgtatggaattcattccgcatggactctgggatcaaaggctctttcctcttttgtttgagagttggttgttttaaagcttaatgtatgtttctattttaaaataaatttttctggctgtggcatttttcttgacctggtataatgaaagtatttcggatatttgagtttaacccttttccagaaagtaatacatgatatggatttatttatgcattaaaagagcaaatttaaagagccctttgcaagcctttgagtcatgagtgttcttagatacgtagcatcttagttgtttaagactaaactattgtacagagccatgacccatcaggtcaagcttatcttgccctaggttgaggcagagagagagaaatggaatagaaagatgggtggagaactgctggactcggtgtgtagtgaagtttaatgtttgttgaagttagtttttgtggggtttgttgttctcagctcacagcagcctccacctcccatgttcacacaatcttcttgcctcagcctcctgagtagctgcgactacaagtgtgcaccaccacatccagcttttttgtattaatatttttagtagagatgtggttttgccatgttgtccaggctggtctcg

SEQ ID NO: 4328 - DNA, 1202 bp, Homo sapiens
taggtatgtccgtgagactccaacacacatgggtatatccctgagatcccgacacacctgggtgtgaccccaagaccccaacacacctggatatatccttgagaccccagcatacttaggtgtgtccctgagacaccaacacacctgggtatgtccctgagaccccggcacacctgggtatatccctcaaaccccaacacacctgggtatgtccctgagaccccaacacacctgggtgtgtcctcacaactccatcacaagtctccttgcatttggttttcttgttctgctcagctggggtctccaggcccagcccagtgacagggggatggggtccacgccccactcctcctgcatagaaagtcaaatcgagatcggagaaataaagttgaggggcccaagtcacaaagctgggggatggtgggggttgggggtgaggcctcagttctcttgttctgccaactactcctattcctgggtaagatgatcactaaaggactctgggttttaacttgaaaacaaaggagaaaaaagttatatccttcaggtcctcttccattgtaaaaagtacatataaaaatagggctgagcacacgtgacccctcctgggactcagcgaagttcctggcagtgactggaactcagtgaacgtctctggaagtaactgatggggtagaccaggagaaaatacttagtctctagtggagacaaagagacaaaagggggctacaattttttgttttatttatgcttttctcttttccttttcttagggctaagcttgaagcagaagaaaccacagtaaaaacactggtcaatgtatggtaattttaaagtcatctacttcctatacatgtgattgttggccagggcatttatgatttatgttatattttattttcctatggtcttaagttgttggttatactctagaactttgcatacatgcagttgttggctgggacatttatgatttatcttgtattttacaattgtcttaagttgttggttatcctctagaacttcctgtacatgtagggttggccgggccactcatgatttatgttgtattttattttgctatgatcttaagttgttggttttcctctagaacttcttgtacatgtaattgttggccagggaatttatgatttacattgtgttttattttattatgatcataagttgttggttttcctcta

SEQ ID NO: 4329 - DNA, 1177 bp, Homo sapiens
aggtcatgatttaacgcttaacagatggtgacccaacaattctgtacctagcaaagtcttattcatgcatgagaggtgttcctagtttactccctccttacagtttttagcaagggaaaggcatcctagtaattttagtgcaaaaatggtataggcatatcacttatgaacatagatgaaaaaaaaaaacctaagtaggatattggggaattgaatcctcagtgtgtttaaataatgttaacatagtgttcaattacttttatccccaggaatgtaaggctgctttatcattagaaaatctattgtagttcactgaaattaataaataaagggagaaaaatacatattcaaactaaatacagaaatttatttgatgaagattgatacctatacatgaaaatcttttagcagactgtgtgtagaagtttcataacatgattaaaggatatcaaccaataacctggaacagagcaaatttaattaactaattccaacttttaagacaaagacacctgttattacccttactattcaatattgtgctgaagccttagtcagttcaggaaggagggcaaatgaaatgtaggcatgagtaaaggtaggataaaattatcagtgaatgttacaactattcacataacacacccaagagaatctgcagataaattattcactgctggatttactttgcatatattttatttagatcttttgtgtgtatgtttataagtgacattgttgtaaaatgagctggtcttactgtaatcaacaaacaaaaattagtaatatttttgcatacccttaagaaccaattaggaaatgtaatatagcaaaaacagcaacataaagatagtactcatgctagtggtaaaaacaaattaagctagggtgtaaaagctaaccaggatgtagaaaacatccttcaggaatgcgtagaggaaaaatagaaaaaattatcactgtgtgtgttttgatttcattatatgctgccaaaatgctcttcaaatactaccacccatagtatgaattgtattttccttacatccttaccaatatgtttattttagtctagcctagtggatgaaaagtaaatttttgttattttagttttgcatttcctgatatgaaaaaggtggaatacgttttttaaaaaatgtctattgactattccaaattc

SEQ ID NO: 4330 - DNA, 1225 bp, Homo sapiens
ttcctggaagttgagctgttggagttacacttgattaggattgtgataccatctgtctctattgtgctcaagtcctgaaataaccaggtgttaggtacaaggggaagcgctcatctttggggagtatcagtaatgtcactgagtagtttatcagttttctgtgttctttttttatttccattttttgaatcctatcaaatatatatgagtgcctcattaaaatatttctacagtcagtgacaatacaggtgctggctacaaacgaggtcacatgtttaccctgtatagccaggtgagcctgctgtgtttcctgccactcacctgcacagaagtgacccatctgtccaagtgacagaggtgccattgccccaagggagttcgacaatatacagtccttggttctgtcaagactcaggtgacgttaggtggcaggtgtaccacttcttaaactttttaaatgtatcacaaacctaagaagttacaaaggaaaagatcgatacatttggctgtatagctgttagaaaaaaataaataacataaggctaaaaacaccataaactcaaaaggcaaaaaagctaagaaagttcttttttttttttttttttttaaaaatagagacagggactcactctggcccaggttggagtgcagtggcacaatcatagctcactgtaatcttaaattcctgggctcaagggatcctcccacctcagcctcctgagtagctgggactataggtgtgcactaccatgcccagctaatgttttttattttcatttgtaaagatcaggtttcactatattgcccaggctagtctcaatctcctggcctcaagtggtcctccctccttggcctcccaaaatgctgagattataagtgtgagccactgagcccagttgtaatacttattatacatatcacaaggaacttcatgactactatgcagagctctttcacaaataagaaaacccagcagaagaataggcaggtgttaatttttacattatataaattttacattatataaattttacattatattcaagcaataacttgaatgtccattaataatggcttagataaatcgtgctttatccatttgctggataactgtgctatgactaacatgaatgaaggaatgaagatctgtatgtattgatacagaaagacggacaaatacataattacaaaacacgttgattcagtcaacattagctgagggtcg

SEQ ID NO: 4331 - DNA, 1151 bp, Homo sapiens
ggttttgtgggtatgggttttctgtggttttcttttttaagcagttgcatattacatctcattcgatttagttatgggaatgtttaatgttctacatgaagccactttcacttgtaggaatccagacgctctgcagtgtcccatcgtcttatgcggatggcggggaaaggcctccattcgaacttttgtgcccaagaatgaacggcttcattatctcaggatgatggggctggaggtattgggagaaaagaagaaggaaggggttatcctcacaaatgagagtgcagccagcaccggacagccagacaatgacgtgactgagggacagagagcaggagagcccaacagcccagatgcagaagaggccaacagtccagacgtgacagcaggctgtgacccggcgggggtccatccaccccggtgagcaggcccaaggcagcgggggcccacacccctcacacgcaaaactggcttcttctggtcactggtgtctgaaaccaaatccagagcagcctgtggcctgtaaagcatatatttctaatgactgcagactggtgggatcataggagccttctgaatgaccaggactgctttctttggagctgatgaaaatgtactcttttagcgtgttagaaatcacttgttttattttgtttctttggccaagctgggtctagtgtttcttttgctgggaatagactttcaaaagttgtacttctatcaagaaacaaaactgcccttgcagaaatttcaggtcttttgttaagcctgtattggtcttaaggtgcagtattttttaaattattatttatagaaagaatctataaattcttggggaagtgtgttataagctttaataattacattgagctgcacctcagtggtgtgtcattaacatgcagtggggttaatatctgaggcctcagatgactttgtgccttttggaataaagggtaaaataaactctcccagagtaagagctgtatcgtgaattgtcatactaattattgagggggacttatgtgcttttattgaatggagtgctttacaatttttatttttaaatggggttgggatccttggaatatttcaataaaattgataaaatatatacatgtgtgattcctgtttttgctcttaggaagcagaaa

SEQ ID NO: 4332 - DNA, 1197 bp, Homo sapiens
aggagccagctctgccctgggagagatacaaagcgcctgcctgggtgaggcagtgcacgggtgggcttgcttcacctctttggccccagcttcaaaaccagccagtcctccctggctttggctttaattcacatttacaagcttgaaaaccagttaatcccattagctcagcttctaaagctgaaaatcgtcccctaaatgggtcacctgttgtcatcaatagctttattagctatggaataatatagttttgttctctaactgtaggatccttcttttgctcttaaaatagctcagtaagttgggtctcataaatacatacagcaagcatataccagatactaaaatacaaaaacattgctgatcttgcttttcagtactaaaagcagaaaatcgggaatttactaaattgagaagtcagtcattacctttcgatgggtttggactcttgcaaggcagtgattgtaaacgagagtgatcttttgttgtttttcaatgaactttattctctaatttttagtaaagcacactaggaaataatgcttcagaattctgttttcgagtagtttcctgactaaaataaaaattcactaaaaaaaacctctgctgtcaccatttccttttttcttaagataactaggaaatgaatcattaagagtttgctccgtggcaatggatcgggaagctgaccctgctctctgtggggctggagccttgctaatgtcccaggatttcacttcacagagacaagcatcagaggcttgcttcatttatagatcctacttcttttctacaccacagccaactcaaaatggtgacagaatctaagacgaggctagaagtcaccacggagcagttggaagctctgcttccggttctgggggcagtgttcctggcgttgtgtcctttggccccacctcagtttgtccgtttagctcctcagctgagaatgagatgtgtatcatataggagtttcctgggccactcacagccccaagctggagagtgccagcctaatgtgtcaggagtagggggtgaggccagagggctgtgtgccaactcctccctaagaagcctcctgggaaagccctcccaggcacttcccaggtctcactggccgcctgaggctgcaggggaggatggtcaggccgcctcttggctggcactgcttcccggcgtgccgccagcctttctcat

SEQ ID NO: 4333 - DNA, 1245 bp, Homo sapiens
acttacattatttctcctacaatattatttctagagatactttgaaattacatagctgtttttaaaatttgcttttcctgagtaaccattttataaagttgacaattattttagagagctttgttaaaatgttctttctagttattacagactttgcttctagctcagtgtgcctcattcgcaggttttacccaggtggaagttgataaatcatgaggtgccttaaatatactcactttgggaggtctcagtgcctgaggatgggcagagagacttggttgagctgacatgtttgggactctgaccatgtgcctggtcttaaacgggtggtcatgacctcctgttacagtagaggccgtgcagtccttagcaggggcagacgcacctccgggtggtcgtgacctcctgttgcagtagaggctgttgcaatccttagcaggggcaaatccacccctgcaatctggtcccatcttgttccattttcaagggccttgctcttcaggttcccccttcccccttgtcatctggtctgagggagcatgtccaccccaagcgcaacacgaacagcagcagccaggctttccctccctcctgccatctcctgccgctctgccttccttgccagcctcactctgctctcctgctccggaggcccccactgtcctcatggcctgtgtagcaagcacataaacactccagtgaacgcgctggtctcttcctgagttcctttgtgcctgtggactcgtcatggtaggggtgcacccctgctgagtcgtaacccagggagagctccacagtctcgattttcacaagcccctcaggaaattaattcttagcgtcccccaaccaaagtttgagacttaatgactgagagccttcagatgggcaagaggatcgaggaaactttcctttctgtcttgtgtgatttgctatgtgaaatctctttgaaagtatggtaattactcagtaaatctttttcttttggaatttacagaaatattcattgctgccttacttgattttagtattgaaacagttccttctgcagagggacctgaatgaagtttttacaggtggaattagctcatacagcctaattttaatggccattagctttctacaggtatgtatgctttcttgagactgtttctgttgagacatgtgtaagagtagactcttccaaccagttgcctagtgggttccagcagcctttgctctccttttactgtattgtttcaatttggt

SEQ ID NO: 4334 - DNA, 1218 bp, Homo sapiens
ccccctccccttggcttttctcctcattattcttgtaaccaggacaagccacataactttcgggtctccatgcaaaatgaaaattggagcctcttattcaaaaattatgaagaatttcaagttagcaaagactaaatgtggcttgggccctttgaacaggagccctaagtgactgcacaggtcacactgcaggaacccagcccgcccttgatccaggagacccttggctgtgcctacgcacctagactcctgctcttcccccactgcacgtttttgctgagcaagtcttggcaagagatgaagacagaagtgcagttcatcagcgggcacagggcccttccttcccttccagccaaaatgagggggcccagaatcggcagaacagctcctcaaagagaagatccccatgtcctgagacacattctcaagcaggacaaatatgttcatgtccgcattactgggtctatgtctcattgaactttgaaacacactttagacatgaacaagcacttctcaaaaggagacctggatgtgagggcgatctggctgcgacatctgtcaccccattgattgccagggttggttcggctgatctggctggctaggcgggtgtccccttcctccctcactgctccatgtgcgtccctcctgaagctgtgtgctcggtcgaagaggacgaccatacccgatagaggaggactggtcttcagtcaagggtatacgagtagctgcgctcccctgctagaacctccaaagaagctctcaaaagaagacctacaaacagccaacaaatgtgagaaagagctcaacatcacaaatcatcagagaaatgcaaatcaaaaccacaatgagataccatctctcacctgtcagcatggctattattaagaagtcaaaaaacaacagatgctggcaaggctgcggagaaaggaaacgcttatactctgttggtgggaatgcaaattagttcaaccattgtggaaagcagtgtggagatttctcaaagagctaagaacagaactatcattcaacccagcaatcccattgctgggtatatacccaaagaaaataaatcgttcttccaaaaagacacaggcacttctgtgttcatcgcagcactactcccagtagcaaagacatggaatcaacccaggtgtccatcagcaatggactggataaagaaaatgtggtacatacacagcatggcattatacacag

SEQ ID NO: 4335 - DNA, 1155 bp, Homo sapiens
gccactggaagcagccctgagaaacattgcccattatctctccataccagcccccaaaaagattttcactgccccaacacttcaatactattttatgttatttttcttattgatataagaagacaggaatgtcaggcctctgagcccaagctaagccatgatatcccttgtgacctgtacgaatacatccagatggcctgaagcaagtgaagaatcacaaaagaagtgaaaatagccggttcctgccttcactgatgacattccaccattgtgatttgttcctgccccaccttaactgagcaattaaccttgtgaaattccttctcctggctcagaagctcccccactgaccaccttgtgacccctgtccctgcccaccagagaacaaccccctttgaccgtaattttccactacccacccaaatcctataaaacggccccatccctatctcccttcactgactctctttttggactcagcccgcctgcacccaggtgattaaaaagctttattgctgacacaaagcctgtttggtggtctcttcacatggacacgcatgacaataccatgctggttgtgggctctgcagatttgaagatgcatgtgtctccagtcctggaagagaaaggactggtcctgatgccaaggagttgcagctgcagcatgggtgctctagtgacattttctccaccataggtttctatgtttaaaaaggcctccccggccgggcgcagtggctcacgcctgtaatcccagcactttgggaggccaaggcgggcagatcacaaggtcaggagattgagaccatcctggctaacatggtgaaaactcgtctctactgaaaatacaaaaaaaaattagccagatgtggtggcgggcgcctgtagtcccagctactcgggaggctgaggcaggagaatggcttgaacccgggaggcggagcttgcagtgagcggagattgcaccactgcactccaacctgggcaacagagtgagactccgtctcaaaaaaaaaaaaaaaaaaaaaaggcctcccctgcctggctcttcaggtgacggaatcacacccttacttagggggtggggcactcagtggagaaatggcctcagaaaacccagccatctgcaccattaacagcaatctttcacagcaa

SEQ ID NO: 4336 - DNA, 1277 bp, Homo sapiens
cctgcacctacggggtgcgtacatgtgactttgggcaagtgacttgatgttgtagtttttttcctaattttgtcttgacgtccttctcaggagagagtggctgtaaactctagccctgccctgacggggatcctggggatgtggtcgtgggtgtttcccatgtgcctttcatgggatccttctttgacctcacagacggcctgattcctgagtgtccaacctgtggccaggtgtccctctcgcaggaagcttgtttatcctggcacatgaccttgtggctctcatctgacctgtgtccagtttattcctactgagacagccactctcccggagagccctgaccgggaaagaagttaggatggggtagaggaggcaactcatcagaacccaagaaatgacagaagcagtttattgcttacagatccagagaacagagggcagcacgcttcacagggccagcaaaaagggggagccattcaggacacatgggctcaaccagaaggtggagaacgagagagagagggagctatgagccaaagccttcactggggcccagggtgtcatctatgcaggtttcccctggaggttctaactggggggtttagagcaagcaggcatgagccccggggactcacgctgtgactgagaggggtcggtgtgggtaggatatcggcatggtccatgtgggtgtgggggtcagtgggacaagtcaagcaggtggtatccagctgtccatgggaaggtggtcccaggaggcggttttgtaaggcagatgtctggatcgaccaccttggggaacagtgagaagttgtataactggaaactgtgttactaatccctgcttctagtatgagaaagtccaacttacattcaaatagatgctcaggaaacataaaattcaaagaattcccaaacttgagcttcctgagcctcagtttttgcatctgtcaaatgggtatggggagaccctttgcctaatgttgagagaatccaagcctgagcagggctggtctactgtggacacttagttgtggaccccaacaggccaaagcccttgcctgctgagggctgctcccaggaggcctcacacattcatccggcctcccaggaaacccctgagatgtgctgggcttttgccgtggaacggtgtcggtgagcatgtggccagtagccagagtcttcaacataggtgggaggtctgaaattcgtgcgagaatgaaccaagggtgtggctgtatccttcatggtgagcttggggcctgggcagccttccctct

SEQ ID NO: 4337 - DNA, 1214 bp, Homo sapiens
caagaatcttaataatagggaatctcaatttgattctgcagagagagagcctgataaattaataccctatctaaagaatgcagcaggcgcacaaattacccactcccaaccctggaggataatgattaaaacaatatagaactctttcaaggccctgtagttggaaagagtccagtttaaatcctttaaagaggatctattgcagggcaagcctggtgctggcagccacggtaatcccactttcaatgtggtgtgctgaattcctggcagttaaaatgcttgtttttggatcttaacgtgctgccggggtccattgcaagaaagtccatgcctcttgtctttttggtaccttacgggctcttcttccctgagtttccctggagctgaagtgtgcacttgaagaaaattagtgttcaaagtagcgtgggctgcctggatactgctggtgggaatcatggaatgggagcgtggttctattttgtttgtgttggaactttgaggaagcttattaagcagggcagttggggcattagtattgcaccgctaggactcaaattctgggccagtaataagactgatcagagtgaaagtttttgccaaggatgttttcattaaccaagaatgaaggtgaaagtgggaagtttaaagatgttcaggtcctgtgtagttacgaacataaatgtgatgttgaccactgcattaatgcccatgacccactagcagcttccaggaaaccagagccctttgggtcgtggtagggggaaggtctgtgttcatagctgaaactgaaaggcaacagcaatagagacagcttaatttgactgaacatgagcaaccttacctgcttccagcacagacaggattgtcccattgatagttattctgtgggtgggggtgcatggcttttctacttgatgaagagattttgagaggtgacagcatgctggcagtcctcacagccctcgcttgctctcggcgcctcctctgcctgggctcccactttggcggcacttgaggagcccttcagcccaccactgcactgtgggagcccctttctggcctggccaaggccagaactggctccctcagcttgcagggaggtgtggagggagaggcgcgagcgggaactggggctgcgtgcagcgcttgcgggccagctggagttccgggtgggcatgggcttggtgggcctgcactcggagcagccggccggc

SEQ ID NO: 4338 - DNA, 1099 bp, Homo sapiens
cctgcctcagcctcccgagtagctgggactacaggtgcccaccaccacacctggctaatttttttgtatttttagtagagacggggtttcaccatgttagccaggatggtctcgatctcctgacctcatgatctgcctgcctcagcctcccaaagtgctaggattacaggcgtgagccaccgcgcccagcaagctttttttaaaaaaataataaaaaatagagagagggtctcactatattgcccaggttgttcttgaactcctggcctcaagcaattctcctgtcacagcttcccaaagtgttgggattacaggcttgagccacattgcttggccaaacaaagttttaaattaccgtttttttcatgaggctaacttttaaggtcaatatttcataagcctttataaaatatttttgcagcctttaaggttttaactatgattcctgtgcctattaatatttaatatgttttatctcaaataagtagaggactgtgctggcaagttattaaatatttgaagcataatttttcattctgggatcccctatattgccttcccttacaaaggatttttgtgttttagttgtgtgtgtgtgtgtgtgtgtgtgtgtgtgtgtgtgtttaagcatcttgagcttctcgatataaatgctgtaacttagtgttttactttgtttttatttgatgagtataaatgattaaagttattacattttcacttttggagctgtatattcatcataaaaaagtcaattctgttattttgtagtcattaattttctgtagtacgtaaaagctgtacagcttgtcaagattcataggaaactaagactaactagttgagtatcttcatgaaattcagttgataggaaatatgtgggcttttactttgaggccaatagaagcttgttttgtacattttaattttcatttgatagttacattctctatttcttttatcttttgcaaaaaatctctattattcctggttttaatgacttgctcttgtataccagatatcctatcgaagtcaatgatctgtgggcatgtgccattaaaagttgctatttgtggccaggtgctgtggctcacccctg

SEQ ID NO: 4339 - DNA, 1257 bp, Homo sapiens
gtgtatgttcagtgtttttccatcagttttggtcattattctttttgatgctcatattatcctctctttggcctgttttcacaatggtttctgtgttgatttggcatggccctattagaccttaatagctttgttgttctctagttacagagaatgtcctaggcagtgtatttttagcctagttctggaatctttcatttctccaagaagccctagttccttttagtggggaattgtagtaggagtgttcattgttttgatgtcggagttttcatggaattttttccccctttttagcattttgcccttaccatattggtcatttctcccttgttggtttgggatttgaagaacacgtgagtataatacttttacaaagttactttcattcattactcccaaatgtgattattaataaaatagtattctaaagagttacatcatttcttcattggcattatgcaagggaatagttaggcaataccgtctcattcttttttaaaaaaaataacagtggctcaagagatagtggtcatgttgccaactaatgaaaatgtgctctgaaatccagtcagctgggtgggcctgaggcataccgtgggaaagtttcccacaggctgattttctgtccatctcaagaacctgtatgttctcttctttccctttccccaggtgccccctgctgaatttagaaaagtaacaatatatcaatcaatttaaaaagggtagaatattttggaatgacgggttgtagtgttttctagagtgctttagttttgacattttatcagtattttccagaggtaaataaattttggaaggattattacttctctgttggggccctagaacaatttagtcttttatggaaaagctgactatctgggatcatatgctcagtttgtatatttgagatctgagagatcacgttctgaagtcttctcatatttagtacacctctgattctcactagttgaatgcaagaacttgaaaggttcaggtaagtgttttgaaaaattttgactttccaaacttttgccacttgctatctgaaactcaggaatcaaaaaataccgacaggcactgttactttcaaaattctttctataagttgagaatgggacagatttgcagagcaagggaaacttgaacagttacttctagtggtaggaaatgaggtggctaggatattacccagctggtgggtgacttgggcagtgtgttcctgctttcagtggttagcctttagcaaatctg

SEQ ID NO: 4340 - DNA, 1178 bp, Homo sapiens
tagttttctgtcttgatgaatgagccaattggaagatagttactctaaattatttgtaatgtttctacatattaaaagtattgacatcacaaataagagaagaaattccccacttttgtcctattatttgcataacagtttcatttggtgataaaaacaatgaaaacattaattccctcaaaagcttttttagacctaaaagaataagtaattggcatgacaaatcagagtgtatgtcccagtagagctcgcctccattgaacttaccttgttttggttgtgatttcatcaaattgtgtactctttagacattgtgatttttgtcttttgtttttttgatgaagacattgatatatcgaatgtgatatctttttcctaatgtgaaaatactaacataacaacatgaagatgacaattctctttacctagccacatgtctcatttatcagcttttctattttcagtatttgctggccgttggttaatgtcgttttggacggggactgccaaaatccatgagctctacacagctgcttgtggtctctatgtttgctggctaaccataagggctgtgacggtgatggtggcatggatgcctcagggacgcagagtgatcttccagaaggttaaagagtggtctctcatggtatgtgtgtgtaatacaagactgatcttgtatgttaggaatagtgaatatttttccagtcatcttaaatttttttttttggcacatttatttccttactatattgtttcaagagagttgattttttgaattagaagaaatactctttcaagatagtggctttctggttcattcttgttcagagtcctacgttcagatatatgaggtttaaaagaaaaacaggttgggcacaatggcgtatgcctgtaatcccagtactatgggaagctaaggcaggaggattgcttgatcccaggagtttgagaccagcctgggcaacaaagcaagaccccatctgtattttaaaaagtatatgtatataatatatttttactggatcatttagtagcatgtttttctttatacacgtgcatgcacacacctacacatgcttatattacttacttaagggccttactggacactttgtaacattattgctctcagtaacacatatgactcccacaaatgtaggataaaaaaaatactgtaa

SEQ ID NO: 4341 - DNA, 1224 bp, Homo sapiens
gtaattcttggacttgctttttttatattcactatagaattctttcatactaaatttttaaataccttttgatttgttaaaatttgatttatgcaagcttttcagaaacgcttcctgcttcagtgttttctcatcatactcagataaaatgaatgcaatattgtataataacacaatattacatattacgtatctctttcataagatgtatgaagttacttcaagtaatgtggtcttgaatgaataccactgaatgtcatctggtattgtatagtgcaagtagagtataaattattctagattagtgtcttatttcatcacttagcagagctaactgcagagcgttagtgggtaaatacatttcttcagaaactcgtgggcactatgcttatgttgatataccagaatttgccttgactttagaagaagtaaccagtttgactatttttgggttggcagattcagttgtgtggagattgctgtattaacttggaggaatttgtcttgtatctttgttctaattgctttttgtaatgtttcaggtttacgcaaatggcatccggaacattgaccttcactatattgttcgtaaactggcagctcccgtgatctctgtgctgttgctttccctgtgtgtaccttatgtcatagcttctggtgttgttcctttactaggtacgtaatgctggttgtggagccttgaaggagcacttttattaacattggacattctctttacccctagtaaaaaggatgtctcactccatatgctttatttgtaaatgtgaatccagctaagacaatgatttcaaaataccacttttcttagatttgactattctgggtaagattagaggatcataaagctctttgatacagttcttttctctaccagaagataaaacttgaaatttacatgctgtacaaaataggcaggatcagatttccttcaggttgtcttcttctgactagaagtgctgtgatcatataaaattaagtaacagtgttgttgtatttaagttttaaagaaatattctttggcataaaagatccaaagaggagatgctaatgggcaacacgtttatactgaaatacactgtcttgttgattgtgtagtgaagactcctcatagctccttaaacccaacatattttcaaaattataagcagagacttttccttcccaaatctttttcttctccagaattccgtctctcagcagcaa

SEQ ID NO: 4342 - DNA, 1226 bp, Homo sapiens
gttgaaaataaagtacaacttttcctgaaattagtctgttctgcagaggggccctggtgaacttaagcatgcctcaaataacacttgttctgaaggatttcttccgcatgtgcctttcctgtggtgtgttcttacttcctggtgtttgcaattgcaggctagccaaggcgaaagaactaggcattcatcacacttggcttcgtccggaaaacttctggtggaggttgggtttttgaatgttgctacgttgtaccattttgtttttccctatgatactctccgatattcttgtacctggaaagtcactctgcccctcacaaaccctctaatgccctatttttaccaagaaggtgtttcttaatgagcaagacctgctgtgaacttatgccagccagtggttaggggctcagaactgtatccatttttttcttttttcccttatttaattatttatttatttattttattttattttattttattttattttattttattttattttattttattttttcctgtaatgcaaggaaactcataagattgttcctggccaggcacggtgactcacgcctctaatcccagcactttgggaagctgaggtgggtggcttacctgaggtcaaaagttcggaccagcctgaccaacatggtgaaaccccgtctctactaaaaataggaaaaattagctgggtgtggcggcagacgcctgtaatcccagctactcgagaggctgaggcaggaaaatcgcttggacccaggaggcagaggttgtagggagcagagatcgcaccattgcactccagcctgggcaacagagcaagactccatctgaaaaaaaaaaaaaaaaagattgtttgttcccttgcagtgttaggagctgcgcagcaacagacagcaggtgtgggtcagaagtaacatggaaacggagggcgtcttcaaccacaaggataggaagcggtagggcgtgggtgaggtcctgaccatgtccacgtccaggaaaccaggcagcttgaccagaatctctgtctaggagacagaggccatcatcaaaaagtcgggcaacaagggatgaggatttagacgtggagtccaacaaaagacataggaactgcaggagcaggaggcctctgtcccctgggaagcagagacccaggcttgcctctgctcagccccacagtcctcccccttctcctgccctgtgtgtgaagaggggtgctgccccca

SEQ ID NO: 4343 - DNA, 1209 bp, Homo sapiens
atgacataccctgatgcttcgtttaagtatttgagaattttctagtatatttcagagccttgaattcaccccatttctctttttactgtctgtgttcttgagtggctgatgtcttgtacacacctctgtgtaaccacagccattcattcttaccatgatgagaactggtcatgggtagtgtttatgcacccccttctctaggaccgaggaaaactggtttaaatttgatagcacggatttgggggattgctctatgatcagagaaaaagttcactcggtgtcttcttctcttcctccactcaccaaggaggtactgagcactcagcaacaggcgtgagggctccaggaatggcccagctggatgccctccctgccctgatgtagcttatcctctaataggaaaggaagacagagggacaaagaaaataattgccaatggccctcaagtctgtaaaagggacaaaccaagggtgaggtagagaagagcagagggcaggcctgaggtcccagcagatgactcctgggagatacatgcccccgccagggtcctcctggctctgcagctgtgcagaccctgaggtcagaagggagatgtacttccctttggtagggcctcctgccctacgccatcagggacagggaactctcagaccgtgcacacctgcgggcctcacagcacacaggcagaacattgcgtcctcccccatccgactctccgttcaggcttttgttggctgtccccagcagcctccatttgcctaaacctggggtgggtctgtccgtgggcacaggtgccaggctgggggcctctgcccaccagcacctaggagggctctggagccaaacagctggagaaggaggccgcctctgcatgaggctgggctgcgggccctcgcacctcccaccacccgcctgcccctccagactccgccttttgaggcccctcaccctgaggccatgtcaggcacagaccctctgggctcaccactacacttgagcctcccatcccctgaactgtgcgcccatcccctggacggcagccatcatctgaactgtgcacccatgccctgaactgtgcacccatacgctgaactgcacccatacgctgagccgcacccatcccttggactgcagccatcatctgaactacacccatcccctgcactgcacccatcccctgagaaccacccatcccctgcactgcaccta

SEQ ID NO: 4344 - DNA, 1162 bp, Homo sapiens
ctgacttccttcattgagcggcgcaaacaccagaatgatgttcgacctatccgtagcattaaaaactttctgcagagcaggcttctgcctagagtttgacctatccagaagttctttctcattctctttcacctgccaatcagctgttaatctgaattttcaagagaaaacaagcaaacataactgatcagctgccggtatgttcatcgtgtgaaattgcattccaagtgagctgtgctcagcagtgcttggacacagagctgcaagctgcgctggggtggaggaccgtcacttacactctgcccaaggcagaggtcgcattgctgtatcacagtattttattcaggtttctgcaaaaaaataaaaagataacttttttaaacaaacatgaatagaattttgcaaatttaacgttttcaagatttattcaaggaaacaaaatgcctatgttcaaccactggtgttaatgaacaaagatactgtgcgtctctggggaagacgcacctaggtggcggccactcccatggccttgtctaggactcagagaccactcggctctgagcttccaggcgcctcgtctgtgtgcatctcacgcccgacgtggcttctgaaacgtgcattcaacctcaaacttttgcataaaatagaatgaatcgttttgctctgatgaaatgtaggccttacttgtatataagactgttcctgccttcggtctgtcattttcccacctgcctcccctacccaccccccacccaccacctggggcttcctctgggggtccgagggtcttcccatcacatgaagacatcaggttgggtcctgccccactgcccctccccctgttcctgccccaagccgtcaatcagattgtggagcagtacacagtcagatgaaaatactgtaaatgcactcattgggggttttttggttttacttcatatcatgtgcaatgttgtggctttaacattttatgcaactatttatgaagacctctgttgtacctgtaataaatatatagaaaaagcacatacttcgtatggtgagctttatggttttgtgtgtgtgttggggttggcgggtgggtgggtagggtcgtagccctgtgccatcggttcaaagagacttttcgtgaaatttgttggttttgaggactgtaaaagtg

SEQ ID NO: 4345 - DNA, 1161 bp, Homo sapiens
tgggcctatttccagctccaaatacagcggtgatgcccaagtctgtttttccagccctaacttgttcccaagcttcagaccagtcactgggtgtatccagtcacctcccaacatctccccaggggccgagaagggctgtggccttcagcccatccctgtacactctttccttaccccttccacattttctcctgtctcccccatctagaggagtcacaggagcacccacccggaaacccactccatgtcccactcctctcagtcaagtccccaagcgccatcagcgctgcctcctagcatctcactcccactctctccttttcctcttcagtcccagcagctcggctcagggggctcctgctcaccttgggcttggatgctacagaagcctccctccagaaccatctccctccacgaggctcgagtgtttccctagactatgatggaaatgacatctcctagaattctgcatcacacaacccacacacccattctcagcagcctgggatatggttctagaaaccctggcctgatgagcgccctgctttgcccggcaggtccttcctcactgtaggcactgggctgcttcaggaccagcctgacacttaacacgggtgggcaccagcttacgcctgagctacatgtagaaaataagaacccagccagagaggacgacactcacaccaaagagaaggcggccacaccaaacggggactcctgatggcacccggcctccttctgcaggagtctgaactccctgactctgccatccctcaacacgaggagggcaaaaaagtaccaagagtagatatttgaaaagaatttgtagagatggtttctttgcagagagcgacactgagtcccactccttctggggcagggggttgtaatactcaaagcttgaaatggggtcctgagtcctggggactcagtgggctggtgtctgactcacccatcaaatctaatagaagggcattggggctggctggcaaatcccgagtttgacagggcagggggtccaaaagtctttcccttggcccagaccctggcctcatagatcaacaagcttgcctggggtcatcttaaggcctgccccacaaggccacctaggggtgtggacagggctcagtagaaagaagctggagctatcactggcttcct

SEQ ID NO: 4346 - DNA, 1179 bp, Homo sapiens
cttgaggggtgtttttttgtttgtttttttgttgttgttttgtttttcaaattttactaagttaatgggtttcacacaatggtacaaaaaatctctcggtttggtgcacacatgcagtgcttctctgtgccgtcattatttgaatagttatatgttccagtaaatcattgccaagggattcctgaaaacatattgcataaatttttttaaagtaataaccttaaaaaagatgccttgaaagatttttgtagttgcttaaaagaattttcatggtgggtataacaaaatgatccatgttcctccagtgaatcccaaacatctgcacatgaattacatgagagcgacattgggtcatcatccaatttttggttctgtttgcataaaagtcaagatctttgctcagaggtctgtctcaggttcaagagcgtgcccctgtgcttctgtcagtcggttcccgcttctcccctctgacctgttcccgttctcccttctctcaggttgtttttgtagccattttgcttcacagtcacctggaatgccgggagcccctgctcatcccgatcctctccttgtacatgggcgcacttgtgcgctgcaccaccctgtgcctgggctactacaagaacattcacgacatcatccctgacagaagtggcccggagctgggggtacgtctaccaacccaacagcagtctgtctgagactcagagtagaataaaactgtattccacctctatgtaaaatgagaaatcagtgacatcaaaacatgaagttggccaggatgtcatacccagaggccaagtgctagatgtctgcagggaaagacagttggaggattaatgaactctaacagatggatgtgatctgagatgtcactgtccagcctccttatcccataggaggagacagaggcacagagaatctgtggccaaggaatagatacgacattcatggtttttcttgctcttataagttattctgcagtcagcaaaggttttaggacccacgatacctttgagtttatatttcattgtgtttgattttacagcagggatccaggctttgtttatgctttcttcaatggccaatcccagtcccttattcaggtgcctcctggggaccaagcacaacgttaggtaccatagggcaacacagaatattttaagatatggtcgctac

SEQ ID NO: 4347 - DNA, 1216 bp, Homo sapiens
cttgttgaaatagatctctgggtctcaccaccaggttttctgatttgggagggccacagtggggcctgagaatctgcatttctagcaagtgtccaggtgatgcttatgaccataccaccattccagggaccactgagataaattaagttgtccagggccccgcagtcaataaaacataaaggctggattcaaacccaaggaatcaacctttaaatgcatttgcattacctcttgtgataactagacgggtctgatgtacctcacaagaggaatgcctgttgccgtataagccgttttctatttttctgcatataaatgtgagtgtctttgtgggtgtatgtgcttatttgtgaatgagtagacacatgtacattataaccagacactccactgagtccaatgtgtgtcaacagggaatatctattagcaaattctttaatcattcccatacttaatttaacaagtataatcattagtttgtttcaataacaaatctctgagctcatcacagtcattataacctgtcatttggaaataatgggtttatgtttcaaagcatgtgtaatctcacacatatttcctagaagaaaatcagactctgtaatttgacctaatgacaagtgtaattaatgctgtagatttgtagactcttagttatcaaatccaacctctcatcagtttcataaattttgagatctgtgaatgtggtgctggtagccattacttggaggcttcccaggttaatctgactcaactgtgggcagctctgttgctctagtggcttgaaagctctttagctcagttaacccagacctgccctcctgtgagtttcatctgccctaaacctgtgccctccagcaagccgtattgatgtctcacgtgagaccatctcaaatgtacaaagatgccactccaaggattctagccttcaatgacccagcctctcttcagtgactcctcaaagacccaccctctttctgcctccagttccacctgccctgagcacactttgacctggcattgtctcccctttcaaatacagtgtcccgaagtgaatgaaatgccccagaaaatattcaagaacgagaatcctagcacttgatctggaaatggatgctgagattaaacgtaaaccattttagccgggcacagtggctcatgcctgtaatcccagcactttgggaggctgaggcgggcggatcacttgaggtcagga

SEQ ID NO: 4348 - DNA, 1213 bp, Homo sapiens
aactgcactcatccagtccgtgtttgttatggcttgagctgagcttttgctcgccctccaccactgctgttttgccaccctcgcagacccgctgctgacttccatccctccggatccggcagggtgtcctctgtgctcctgatccagccaggtgcccattgccgctccgaatcgggctaaaggcttgccattgttcctgcatggctaagtgcctgggttcatcctaatcgagctgaacactagtcactggcttccacggttctcttccgtgacccatgacttctaatagagctataacactcaccgcatggcgcaagatcccattcctttgaatcctgaggccaagaaccccaggtcagagaacacgaggcttgccaccatcttggatgtggcccgctgccattttggaagtggcccaccaccatcttgggagctctgggagcaaggaccccccggtaacaaaacgaccccagggtctctttcccccatataaacccctcattttgtaagcacagggctgcttcctctttctgtaatggagcagctggcaggttgaataaaggcttgcctgaacttgggtgtctgtgtctctgtctctctctctctctctctctctctctctccctctctctctctcgtcctttctcttggctgatcttacagttatttttgtaaataattttgagtttagttcctggacacaataaagcaacttgaaaactgttccatctttttgtgtttcgcttttaagctttttaaagcaaggctccagccacatttggtctaggattttcttcccctactaaataaaacaagattcttcttgtactctactcaatgcctcatgaaagatgaagtttaccaccctgatttttcagaacaggcactgttcagaactgatcctatataggctctgtttattgtttattttaatcctttgtattgtgaaaggaaaataaatcttggggcctccaaatcgctaagctaaagggaaaagttaagctgggaactgcttagggccaaactgccttccattctcttccaagttacccctttactcactgagttaaatgcatatctgattgcctcctttggaaaggctaatcagaaactgaaagaatgcaactgttcacctctcacctatctgtgacctggaagccccctcccctcttctgagtcttcctgcctttgcttcaagttgtcccgcctttct

SEQ ID NO: 4349 - DNA, 1176 bp, Homo sapiens
gcgcccctcccttcaccagtgcaaaggcagtggcagagcccaaggtagcctttggttctcttgctgcaaatggccctaccgccttggttgataaaaaagtttcaaatcccaaaactaatggggacagtcagcagccctcctcctctggccttgcttccagtaaagcttgtgtcagaaatgcctatcacaagcagttggccgccttgaactgctccgtgcgggattggatagtgaagcacgtgaatacaaaccccctctgtgatctgacacctatctttaaagactatgagaaatatttagcaaacattgaacagcaacacggcaacagtggcaggaattctgaaagtgaatctaacaaagctgcggctgaaacacggtctccttcccttgttggctcaacaaaattacagcaagagtcagcgtttttgtttcatggcaacaaaactgaagatacacctgacaagaaggtggagctgacatctgaaaagaaaacggacccatcatcactaggagcgacaagtgcctcatttaatttcggcaagaaagttgatagctctgttttgggctcattaagctctgtccccctgactggattttcattctcccctggaaactccagtttatttggcaaagatattaccagagtaaaccagtctcttcaccatttcgcactaaaccattggagggccaagcggaaggtgacagtggtgaatgcaaaggtggagatgaagaagagaatcatgagctacccaaagtagtagttactgaagtaaaagaagaagatgctttttactccaaaaagtgtaaactattttacaagaaagataatgaatttaaagagaaagtcataggtactctgcatttaaaacctacagcaaatcagaagacacagcttttggtgcgggcagacaccaatttaggcaacatattgctgaatgctctgattccacccaatatgccacgtacgccaacagggaaaaataacgtttttattgtctgtgttccaaatccaccaattgacgagaagaatgccaccatgccagtcaccatgttgattcgggtaaacaccagcgaggatgcagacgagttgcacaaaattttactggagaaaaaggatgcctgaacacgcgaagtcggctgcggaattattgccaagttgctgcttcttccaccatc

SEQ ID NO: 4350 - DNA, 1198 bp, Homo sapiens
acttaaactgtgattactgggtgtgatgattagtagtatatgtcaggttgacttggctaagggatgccaagatagctgaaaaaacattatttttgtatgtgtctatgacggtttcaaatgttagactgaataaagatgtgagtgggcatcattcaacctgttgagagcctgaatagaacaaaatagtagaaaaagggtgaattcactctctctgtttgtcctcagatgtcagagcttctggttcttggggctttgaacttggactggatcataccatcagctttctgtttctctagcctgcagttggcagattgttgaacttcttggccttaactatgagccaagggctataatctctgtttctgtttcaatatcaatatcccattgattgtgtttccatagggaactctgactaatacactgggtttattttttcatggaaatgttaataacatacttgtacagactgagcagaagatgtagcatgctggagtctggtttactcaaagcagatactaagaagaaaattccgaaaattccaatagcaatataagaaaatggccgggcgcggtggctcacgcctgtaatcccagctctttgggaggctgaggcgggtggatcacgaggtcagcagatcaagaccatcctggctaacacggtgaaaccccgtctctactaaaaatacaaaaaaattagccgggcgcggtggcgggtgcctgtagtcccagctactcgggaggctgaggcaggagaatggcgtgaacccgggaggcggagcttgcagtgagccgagatcgtgccactgcactccagcctgggcgacagagtgagaccctgtcccaaaaataaataaataaataaataaaataaaaaagaatataagaaaatacttttggacattgattagaagcataatagaaaaatagagacaggagacatgaaaagttaacattgttttaaaaattatttaaaaatggaatattttaggaactagtattaaaattatactttatacttcattttgttattaaaatactgtatgtggttaaatgtataaacacatttaaatataacaaagttcctaaattctatgtgtaattccataccattatgagtggactataagtagtgtttattttgtcttccttcttatttctgtaaatcacagtgtctgtgtgaaaaaatcagctacttactc

SEQ ID NO: 4351 - DNA, 1177 bp, Homo sapiens
ctctttcttgtatgaatggtggtatcttacacttttctctactgagattttgttcacttaacaatgtgtctggaccaggtgtgatggctcagaccttaaattccagtgctttggaaggtcaaggcaggaggattgcaaacttagccaggtgtggtggtgcacacctgttgtcctagccactaaggaggctgatgtggaaggatcacttgagcccaggagtttggggctgcagtgagctatgattgtactactgtactccagcatgggcgacagagtgaaaccctgtctctaaaaaacaaaaccaaaccacaacaacaacaaaaccatgtgtctgggagatcactctgtagtaatatatagagcttattgatatgtttggctttctgtctgtcaaacagttttatgttagtggttactatgaaatccattatattggctttgttttttcctcttcatatcctttgtattcgggaaggcttgtatttttattctaatgattacctttatactgacaactttatagtataattacatttctcccttacttctcttcctctctctgtgtgtgtgtgtctgtgtgtgtgtgtgtgtgtgtgtgtgtgtgtatcttgttgtcttttagtaaaaatagcttctctctgcttcttcccataatcctctctctcacctggcacctaatttgaagtgatatccttttgttgcaagttaataaggcagacagcaacctcatcctactctttatgtatttcttattctccccttgttttctgatggttgtactaatcaatgttagaatgtttaattatttcttatattgactcacttgtgattatctaccaataaaaatatatttgcaagtaatcatcagatcatgtcattatcaatctcccacctccccttttttgtttgtctgaagctcattttctaaaacattcctcaagaagggcttatagaaacagtggtccttgagtttctgcatgttcctcacagtttgcctgtggcctttgttttaacggtcagtttggctggatataaaatctgtggatcccattttctttctttaatattttaaatacattctcattgttttctggcataaaacattgctgtcaaaagtataacaatatggtcaggtacaggtactcacaactgtaatcccagcactttgggaggccaa

SEQ ID NO: 4352 - DNA, 1175 bp, Homo sapiens
gttttttgagtttttttgctagggtgagataggagtataagtcagtataggatgttcttttaagtattcaaacatgatggtagtcatttatattatttgatggcatttgttgggaggtattttggtgatctttgaagttacacagtttcttggttgaccattgtgtagcaaaataacaagctcttcttgacacttagagagagattacagtttgaatagatgaggagatcctgcctttccaaatttgtgtgtctgagaagggctctggtggtatggatggaagcccaaaagaaaataaagtatatacaaagagaagaggtcagagaaggaattccaagaagtgattttacttaaaatgaaatggagaaaggactgtacgtgcataaatcatctagcagagtgctttttcctatgatagcaaggaagaaagtttgcacatttgctttctgcctatctcttgagaattcccaacagctctggttgttttctctcctgtttactctctgagtagttcatttccacccatgcatattctgatccccaccagatcaatattaatagctgtgacatgtacctctgtattaatactccactctcacattttagattgccttttgaaatgaacctcctcgatgtttcctcagatactttaccctcaacctgtgtgaaactagactcgtcatcttccctgcatattgaatttgaggtactaaggggacaccctcctgaattaagtgacctagttggtcacttacgccagaaacccagaaatgatcctcaattctttcttcactcttcctcccacatcagaatggtcactgtatatttcagtaatatctcctgtgtttaaaatttttctcttcctttccagtcttcccttcatttggctcctggactattgcattagacttcagtctggtcttctttgttcccttacaagccattcccacactgtttccacagtgtctcatctgaaatgtaaatgatgataatctgtaacttaaagtacttgaatgatttctcgttgccatatatccataagccctgaccttaacatggtttgtaagggctacataatagagttcatattttcctctctagatcatctggcatctctctctctccacgcacttctatctgaactgtgaaattactacttctttcctcagctccct

SEQ ID NO: 4353 - DNA, 1332 bp, Homo sapiens
ttacatagacttcagttgagatgtatacttagcaaaattatttttaaattgaaacagcacagtaaatacttaatataaaatgtcccttggattttgcttcccatgtaaatctattgtattattacacttgttataattttaactataaaggtccaattgtttcacagagccagtttgggatgggctgcattccatttatgctgtatatagtttgaattatatataaattaccccttcttctggccacccctgctcccatcttagtattttgcaagatctaatcagttgtacacctggtgcccctcgcttgcttcaatcatggttatttgatggcaaaatcgacctcttgtcgctgaaggagagagaaaagatgtgtgtctgattggtcctgggattttttgagctgtgccatttatggtactctttgcctatgcatccccttgttagattttttttaaattttatcttactgtttttataatttctattgggaagaggcttgtgaccagtaccaatcttgagtttctttttctgtccacaagtaaattaatatctgctctgaaatgtcatttatctactcacacattcttggggaaaaaaatcaaatgtcagtcctagcagatgttgcatgtaaattggtagcaagtaatgattacaacccagaggattaagaattttgtaacagaaagctctatgttttaattttttatatacaattaggataattagcattgtcagactataaacctttgctttttaaagtttatttttactatttctttatcactttattgtatcatcaccattggtttcataatgtaaatactatatgttgaacaaattaaatgtcaaaattttttattaccatagtccatgttaatagtggggctttcaggtgtttagagattttttttgttgttgttaacattcattgcaaaagtactagatggtgtataactctagagttgaattttaagggattccctaatatgtatactatctttttatctgaagtaataaataaacaatgatcttgaaagtgcctgaatcagagcaagcatgtcatttgtgtttttgtattctcatttagttttctttcaaatgaaatgttacttactgtagcattgtaatattttaatgcagggcttgggtttcttaaagggccagatagtagatattttaggctttgtgagccgccagctgtgtcagttgcaactactgaactttactgaatgaaaactgttatagataatacaaataaataggttagactgtgttccaataaaactttatttgcaaaaacggggctggtcaaggccccagttttaatgc

SEQ ID NO: 4354 - DNA, 1240 bp, Homo sapiens
ttttggtagaaacaggatctcactatgttgtccagtctggtctcaaactcctgggctcaagccatcgtcttggctcagcctcccaaagtgctcggattaaccttgtggttttatcctaaacagcaataaatgaatggtattctaattctctgtgaagctaacttggctaggttgtctttgcctgagcttcttaacttgtccacataaataaatcactataatctggggttaactgagtattccttggagtttgcagggttctgaaagaacctaataaacacacagcttggtgaaatgtgagttatgtttctaaacttatgacctctaaagttatttgttgtttgtatgtaagaataagtggtggaaagataagcccccgaaaattctcgattagtaatttatgttaattgtattttttcagtatattattatagaaagacaggaaaggtaaaaggcaccaaatatgactttggctgataatatttctgttttttactctgaattcaaggtaaattagctattttgttttatttcttcttctttttttaatagggttacacatcattttggaatgactgtatatcatctggattacgtggctgtatgttaattgaattagcattgagaggaaggttacaactagaggcttgtggaatgagacgtaaaagtctattaacaagaaaggtaagaggagtgctgagtaacattctttttaaagaggttgtactgcttaaaatgtatgtttttactagtagccttcaaaaattaaagtggaagttgatattaaagttgtctttcttcaattgtatttccatatcttttttgcattcttggtttcctggttctttcacctacaatgagtaatgtaattgattgttaaggtaaccggccactggatcttacaaattcagaaagattctagacttcatttgcagcttttatttatttatttatttttaattttattttattattattattttttattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcaccgcccttaatccattcaaccc

SEQ ID NO: 4355 - DNA, 1129 bp, Homo sapiens
tgtttaaagctttgtgtatagttttaagatttttttccccctctttctctaagttaataagtgtagggagtgaaaggtgaggaagcagctgtttggtttagtgactttgcagtcatgcaaaggcacagaagggaaaccaaacagatttccttaacctttcagtccctagacaaactttttagctctttactttttcttttatttctaatgtaggcagactttttttttttaagtttactgttttaaatgaacacaggtcaaggttcacaggggatcaagaaatattattcttgtataatctgtttactttgacctaaataccagcttttaaatactaaccctggcataaaatactgctgtaaatggcagctcattgaatccaattttaagtgtgattgtttttgtttttatctgagcttccattgaacggtggtattttaactttttttcatcaagggatatattcagtatttctaagattaattcaattggtttttatgttgctctcaaggctagagctaatggtctgcagtcctgtgtgattatcatacgcattcttcgagacctctgtcagcgagttccaacttggtctgattttccaagctgggtaagtagtacgtaactgtatggtgtaaaaacatgtaggaaataattctgcagcttttatcctctcagtttacatgtaattatcagccttatttgcatttactaaatatagtttttcttttctgatgaaaaatcctgggggagtcttagaatgtttaattttctcagatgtgactaattaaagaattttcattgatgtttctctttgtgtgtttttttctttttgctgttttcacagtgttttttttttaatattacagcatttattagttggcttttacatataatatacaaatgtataaagaagactttgaagaactgttaatctccttatgcagggacattttttaaaataatgtatgtggttgggaactgtaaaaattcagaaatacatattattcaaaaataatacaaaaaaaataggagattcagtaacgcagaaagctacaaaataaccaaaagccttcttatttaaaggcagattatcttaacaatctgctgtgatttcttctaggagaaaaaa

SEQ ID NO: 4356 - DNA, 1314 bp, Homo sapiens
tatgaaaatcctcaacgcttaaatagattttcacctttgaatttttaaactttgttttaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttctccaagctattgtatgtttggattgcagaagaatttgtaagatgaatacttttttttaatgtgcattattaaaaatattgagtgaagctaattgtcaactttattaaggattactttgtctgcccaccacctagtgtaaaataaaatcaagtaatacaatcttaactgttgtggccttttttgatcataagagttggtactgtttaaggccaaaagtaacagtttttatagatcttttagtttcaactcagcttttacaataaaaaggatttgtattgcattgagtttataaacttttggtttgtgaacttcatatttgatcttttctcttccaatcaaatgtctaggcttgtttgacttccacccccaatggtttttcactctttttatttacttcattttcctttaataacttaatctcttcatgttcagtttttacttcactctttattcttttctttgattatggtatgcttatttggaaagtcagtgaaactgtcaaaatgttatctcaataagatacttatatgagaactacaatcaccgaatctactgtattcaatattagcagatctaatttgataaacaacatggcttgtgtgaaaactgagcaggtgtttgtttacccatagtgttctgtgtagttattgcttagtctgcagaaaataatgacttagatgagatgtctgacttgctttcacttattaaacatgttcaccatgggatgatgtctgtaacatcagatattgttcaactagactaggatttaataaaaattgtgaaagcttactggcctaacattttattttataatattgggtatgaattatatgtagccagagatgtcattaagctttactgttatagtaggtaatatggttagtttgtagggaaaagagcatatgagcacatgcttgtgtattttggcctttgccccagtagaacagaccaatggcattctagacttgatgatactaagttttagcagacactagtaagtggtttgtatttaaccatactgatgaagcagacagattgaggcacagattttagtggctttgtggcaataaatagggcatggtgtgcctta

SEQ ID NO: 4357 - DNA, 1238 bp, Homo sapiens
tctcccaggctgggatgcagtggctcaatcttggctcactgaaacctccacctcccaggttcaggtaaccttcctgcctcagactctgaaatagctaggactacaggcatgcaccaccacacccggctaattttttgtatgttttgtaaagatgaggtttcaccatgttgcccaggctggtctcaaactgcagaactcaagcgatctgcctgtctcagcctccaaaagtgctgggattataggcgagagctaccacacccagccttgattattttgaggtcttctaattgttaagttgtaagaatttcttgtgtattctagatacaattcctttattgaatacagtctccaatttaagattttggcttaagatttttttgggcggtttctctttccagccagcgccgagcgatgggcatctctcgggacaactggcaccagcgccgcaaaaccgggggcaagagaaagccctaccacaagaagcggaagtatgagttggagcgcccagctgccaacaccaagattggcccccgccgcatccacacagtccgtgtgcagggaagtaacaagaaataccgtgccctgaggttggacgtgggggaatttctcctggggctcagagtgttgtactcgtaaaacaaggatcatcgatgttgtctacaatgcatctaataatgagctggttcgtaccaagaccctggtgaagaattgcatcgtgctcatcgacagcacaccgtgccgacagtggtaagatgtcccactacgtgctgcccctgggccgcaagaagggagccaagctgactcctgaggaagaagagattttaaacaaaaaacgatttaaacaaattcagaagaaatatgatgaaaggaaaaagaatgccaaaatcagcagtctcctggaagagcagttccagcagggcaagcttcttgcatgcatcgcttcaaggccgggacagtgtggccgagcagatggctatgtgctagagggcaaagggttggagttctatcttaggaaaatcaaggcccggaaaggcaaataaatccttgttttgtcttcacccatgtaataaaggtgtttattgttttgttcccccccccccaaaaaaaagatttttttgagttgatgattggtttatcaagatataaacctatcataagtcaaggagcatctagccttataatggcttgacttatgattttttcatgttacagtgggtttgccaaggtattaaatgcac

SEQ ID NO: 4358 - DNA, 1168 bp, Homo sapiens
atctggtgtacattttaagcaggaagaggaacagagaagttatttagtaggccttttttttttcctttggagtctacatagcttagctttgtagaaagagaaaggtgggtgtattaagagaaaactcggtgtggtgacttgtgccagttgtcccagctactctagaggctgatgttggaggattgcttcaggccaggaggccagcctgcgcaacatagcaagaccctgtcgctaaaaaattaaaaaaaaaaaaacttatttgttggagaaattaagattattcaaaccattggaaattgatagtgcttatttatcagagttgccatatctgcttaaacaggaggcattcaatgtcaaatgataatgttctgcattttcaggatcttccagttaggttcttaggtacatttttggaatttgttgtttttatcattatatttcagaaaaatagagatacatcaatataaaaaaacaatatataataaaaatagtgtttattttcctgttttcaaattagattcgtgtgtacttatatatgtgtggacttttttttttttttttttttttaagtcaaggcctggccgacaacaccgttattgctaaagtaaataatgttgtgtgggacctggaccgccctctggaagaagattgtaccttggagcttctcaagtttgaggatgaggaagctcaggcagtaagttgctgattagtattcattgaattttaggatgcagattcacatttgaagtcttttccagctcagtcctgctgcgattgggtggctaacatttattgttgtctcactgtcatatttgaaatcttcattttgtccttcatttagggaacataataaaagtgcttgccttagaaaataaaggggtgaagctgaataagtcttttcattactagacacttcaatagggaaaatgttttgggaattgtattaaacattgattaagcaagtaaaaattgttttctaaactgtgaacactattttattttaattttttttttttttaatgatggagtcttgctttgtcactcagactgtagtgcagtggtgcgctcttgcctcagtacaacctccacctcccaggttcaagctattctcctgcctcagcctcccaagtagctgggattataggagcgcactaccacacttggctaa

SEQ ID NO: 4359 - DNA, 1168 bp, Homo sapiens
ggatgaattataggaagcagatttgcaacaaggggtgaatctaactaatgaaaaggttaatggagtttgttgatgtacacacaggtgatgtttactgtgtttcttaacttgaggcaagtacatttgcaggggattaaatttaacctatgacttaacttacatgttcggcaagggatactgtgcatggatatctataactaatcaaataattaagaatttcattgttatttgtgacatagataaactaggacatacctatgttgccaagagttctgccttttcacatataatgttacactctgtaaaccacaagtttgataacagtatttttgtaattattagtagctcatttcttacattatacagcattatatcataaaaagactattgagctcatttaacaaatacaacatggtcatactattacttatgtatgacaaataatgtaactaagcttatggaaatttgcatttgtttaatatctctgcataaagacaaagatacaaatattatgttgaattaaatctctctctctctctctccctctctctctctctctatatacgtatatatatttgagggctctctgatttctgtttatgagaattaagttaacctggtgagaagtaccagctagcatgaggatcaattgattttatgttaaatccattttatcagttggagaaattcaagattaatgttggagaaacagtataaagctctagtttttcaggctgtagaatataaaatcatcagacaaaacctaaaaaggcaagatattagatgtaagaaatgtcttgaaatgaatgtgaagtgaattgaaaagagccgtgaataaagcaaaaaccactaggaattcaattttgttggctatttctgacattcacaagtagacgtaccagaagaaataaaatctaagaagagtttatcttctacacaagttatttccagcatctggcagttcatagcacaaagtaaacttctgcatatgtttgtcagaataaactaaatcgtcttgttaatatactattgacactgattttcttaagaatgtagtaaaaaagtaaatcattcattaaaaaaaggaaaaaatagagaatggttaagaccatgaagttgtaactgaggaagatatttagattttataagataaggaacgattttagtt

SEQ ID NO: 4360 - DNA, 1234 bp, Homo sapiens
tgagccgagatggtgccactgcactccggcctgaatgacagataagactttctaaaaaaaaaaaggtatttggggcctgggccaccatcatataaagaagttgttggccaggaatggtggctcacgcctgtaatccctgcactttgtgaggccgaggcaggaggattgcttgaggacaggagtttgagactagcctgggcaacatagcaagacccccagctctaccaaaatttagccaagtgtggtggcatacacctgtggtcccagctactagggagtctgaggtgggaggatcacttgacatcaggagatcttggctacagtgagccatgcttgtgctactccattccagcctgggctcagaaaaaaaaaagaaaagaaattgttcctcgaagtcagtggttctgatgaactgggcttgatattgccccccaggggacatttggcaatgtctagagacatgtttgattgtcacatttggacctctagtggatagaggccagcgatgctgcctaacgtcctgtactgcataggacaaccatccacagcaattatccagcttataaggtcaatgatgctaaggttgagaaagtgcatctacggccataccaccctgaacacgcccgatctcgtctgatctcggaagctaagcagggtcgggcctggttagtacttggatgggagaaagtgctttaaacatgtcctaaagtatgggagttatctacaggtgttatattatgtcaaatagcttgggaaatccaggattaagagtttactaggtgtggtggggtgtctggtagtggtcaggtcctctgctctgaccctctccccaggtccccccatccagacatttgaaattagcataccctctaattcagatggacagaaatgtattgagagcctactgtgcagcagcagagttgtcaatactagagatacagcagggaatcaacaggggtgtctgtcctcaccaagcttatattctcatgggggaaaaataattaactatataagtgtgtgtctgtatagagaaagaggtaaaagggagtgatagaagctgctaagtgctatgaaggataaagaaataaagcagggagtgggggtaaaagaattagggagaaattggaatttgaaacgagaaagtcaggaaaggcctcattgagaattttacaactctctcccttctgtataagaactttgaaaatcagaaaactccaggtaatttccattcagg

SEQ ID NO: 4361 - DNA, 1217 bp, Homo sapiens
gatgattggaaaaagattgaattggattttaaatgtttaagactttcagaactggtgttttgaagggtacgatatgcccacacatcgggcactaaaatctggtagttttaatgaattgccattttgatttcgagtataatcaagttttgctactgtggtgcttaatcacatggaactgaatttttatttacctccccattttagtatcaccatcatcatcattatcatcattatcatcccctttcttctccttcttccctaaaccttgcaactcatcacttgaatgttggcacaaggttaaagatatggactttgaaactattattttctcaagttaggaaaaccccaatttttatctccagtttcatgggatcactggtcctaatctgtgtcataataaggcaatatagttcggcctcaacagaaatagatggtatggtaaacagaataataaacccctaagaatgtctatgctcttatctctggaaccagtaaaaatgatgaaattattcaggcaggcccagtgtaatcagataagccctgtaaaacaaatttcaagtgtgagaagaatttgacaagccattgctgcttctaaaatattcaggaccacagacacacacacacacacacacacacacacacacacacacactcacacacacacacacacacgcagagagagaagtgagtgaggagatagatatgttaatttgtttgactatggtgattatttcactgtatatgtacagtatatcaaaacatcactgttgtgcactttaaatatatacaatttaaaaacatatacagagccacatgcaaagactggggagaggcctctagagctaaggttaaatgccagctgtcagtttgcaggggaacagggatctcagtcctataaccataaagaactgagttttggcttggctaggtggatcatgcctgaaatctcagtgctttgggaggccaaggtgagaggatcacttgcagccaggtatttgagtccagcctgggcaacatagcaagaccctgtctctacaaaaaaaatttttttttaaaattagccaggcgtggtggtgtgcacctatagtcctagctatctggaagctgaggtgggaggatcagttgagcccaggagctcaaggttatgttgagccatgatcatgccactgccctccggcctgggcgacagtgtgagaccctgccagtagcctgaatga

SEQ ID NO: 4362 - DNA, 1210 bp, Homo sapiens
ttagggatctattcagagtttctatttcttgttgagtctgttctggtaatttgtcttttgaagaatttcctttttttttaatataagttgtgtaatttgttggcttaaagttaatattcccttttaattctttctttttttatttttttgaaaaggagtctcactctgtcacccaggctggagtgcagtggtgtgatctcggctcactgcagcctctgcctcctaggctcaagtgatcttcccacctaaccctcctgagaaactaagaccacaggtgcatgccaccatgcctggctaatttttgtattttctatagagacgaggtttttccttgttgcccaggttgctctcgaactcctggactcaaatgatctgcccaccttggcctggaaagtgctgggattataggcatgagccatcacaccgggccttcccttttaatttctaaagtattggtagtgatttcctctccttcatttctgattttggtaatttgtgtctgttctctcttactttcctgatcattctatttaagacattgtcaattttgttgattattttttaagaactaatttttgaattcattcgtatgtctctggttttttttttttttgtttatttttacttttatctttatttttttcttcttcctgtttttgattttgtttacactttttctagtttcttaaggtatggaagcataaatactgattcgaggctgttctttctaatatgggcatttaaagctataaatattcctataaaactgctttagctgtatcccatgaagtttaatatgttgtgatttcattttcatgcagttttaagtatttaatttctctcatgatttcttctttgacccattgattttctcagatttctttcggttatgggttttaattttattcttttgttgtcagggaacaccctttatatgatttgttgtaaatttaatgagatttatttcatggtccagcatgtgatcaattttggagaatgttcttgtatgcttaaaaggcattgagtattctgtggtctttgggtggagtgttctgtaaacttaagttaggtcattttggctgatagtgttgctgaagttttttacatcattgttaattttctctctagttatatttatcattcagttctgtcggtttgtgcttcatatatgtggcaacttcgttgttaggtatgaatacatgtataaacg

SEQ ID NO: 4363 - DNA, 1194 bp, Homo sapiens
tatgttcttcaggttttttgtttgtttgtttgtttgttttttagtttgttttttgtgggatgtggaaatactgaaaagttgttaggtcagtttgaaatcgtgatgcaaagcatcttcccttttggcttagtacttcagcatttgtctttcagacttctctgtgactgtattttttaactaaaaaatgaccaaaatgtaagaacataaaatcgtactacaagtatcaacatccgttctgccctgtcttcacatctggtgccagcatctcgttgtgtgagatgatgttcagctcttgtccatctggatgtgctgggcaatcacagccctatttcctggcacatttccttcagccttttgatggatgagcaactctagaatttttggaaagcttagttcacgttccaggtttttttgtttttgtttttttgtttgtttttaggggctaggaccacaattgtcttttcaatttaataggacttgtctccaactgaagaggaagagccagagcatccttttggggtgggcggtgtggacagcgtgtctgagagcactggcagcatcctcagcaagctggactggaatgccatcgaagacatggtggccagcgtggaggaccagggcctgtctgtccactgggccctggacctgtaagacctggatatcattgggtttccatgcacaggccagcacctcagtaatgtggttctgaaagattaacaggtttaagggacagaagcaatgaaagaagcaatgtgaattttccatttgctttcatattattacctggattagccattaccagaggaaaaataaacatttctcagtaactttgcctttatggggaaagggttgactattgatgtattatatgtttttgtatttgatgcatcattaggcataatttttaaaatgataagtacctttcaagccaagtttgcataacctactttcaataaaaaccctctatcttgcctcctcctttattaccctctgagttttgagaaacaaccatatacagatgaatctaataggaaaaaaaaaaatcttttcattgagaagaaaatcagtctcacctgagaactcaattatgaaccctattttaaaacacctatgcagggtttagcctaggagtgaaaagaaaaaccaactaccttttaccaaccctgaatctctaaataagcaaagtttcatgga

SEQ ID NO: 4364 - DNA, 1099 bp, Homo sapiens
actccactaggcggccaggcacagtgacttacacctgtaatcccagcactttgggaggccaaggtgggcgaatcacgaggccaagagtttgagaccaacctggccaacatggtgaaaccccatctctactaaaaatacaaaaaaaaatagccaggcgtggtggcgggcgcctgtaatcccagctactcgggaggctgagggaggcgaatcacttgaacccgggaggcagaggtttcagtgagtcaaaatcgcaccattgcactccagcccaggcaacagggcgagactctgtctcaaaaaacaaaaaaacctcaaataggctaagcagatccattcccataatagtggattctaaaaccgtccttaaataggcaaataactgactttttcaaaactttttttaggtgttgggttcacccttgaaagaactgtcctctaacaactggttttgtcagttaaagcccttgagaattgacatagctatatacctggttgagcaggtgataaaacttgtaactaatgttgtgtcctgaaaacctacacagggaggtactgttttcccttagtgtctacctggctgcttggccttgtgactactgattccattagagcagtggttctcaaagtatgtgctccaaaccagaagcatcagcatcagcatcagcatcacctaggaatttgttagaaatgcaaattctcgagccccaacccagacctactgaatcaaaaacgtgggggatgaggccctgctttctatgttttaacaagctctccaggagattttggtgcatgtcaaatttgaaagccactgcagtaaaggatactgctaccttccatagtttatggactgagctacctatctggctcctcctctgtgaataaccacacacacaaattttgcccaaggcacacaatatataaagcaaaactgttagtaatgtactttttaattattccttaacaaaatagaataaccaaaccaaatgcttcaaagtaatagcaacaagagagaagaagagtgggaatgaccagagctaacaaaacactctattcctttctctcttttttttttttttggagacagaatctcaccctgtag

SEQ ID NO: 4365 - DNA, 1180 bp, Homo sapiens
gcatatgttaaactatccttgcatcactgggataaatcccacttggtcttgatgaatgatctttttagtgtgttgttgaattcatttgctggtattttctggagggtttttgcatcaacattcatcagtgatattggcccatcattttcttcttttcatgtgtctttgtttagttttggtatcagggtaatattagcattgtagaatgagtttggaagtattctcttctctattatttggaattgtttgagtaggattggtattagtagctctttaaatgtttggtagaattcagcagtgaagccagcaggtcccagacttttctttgctgggaaactttattatggcttcatcctattatttgttattgttctgttcagatttgggatttcttcttggtacagtcttggtaagggttatgtatttaggaatttatccatttcttctagattttccaatttattatataattgctcataatagctgctaatgatcctttgaatttctgtagtattggttgtaatagctccttttttatttctaattttattaatttgggtcttctgtctttttttgttaatttttttgttaattagtctggctaaaggttggtcagttttgtttatctgtttaaaaatcaacttttcatttcattgatcttttgtattcttcatttcagttttatttatttctgctctgatctttattatttcttttctactagttttgggtttggtttgctcttgcttttcttgttctttaaggtgtaccattaggtcatttatttgaagttttcttttttgatgtaagtgcttatagctataaacgttcctcttggtactgctgttgctgtatcccataggatttggcatgttatatttctggtaccatttttttttttcaagaaatttttcagtttccttcttaatcccttcattgactcactgatcattcagtagcatgttatgttgtttcatttcgatttccatgcatttgtatcatttccaaattccccttgttgttgatttctaggtttattccattgtggtcagagaagatgtatgatattatttcaatttttgaatgttttaagacttgttttgtgacttaacttatggtctattcatgagctaacaaaaagcatatctgttctgcagccattggacaaaatgttctgtag

SEQ ID NO: 4366 - DNA, 1211 bp, Homo sapiens
ttctttatcaccttggctctaagagcaattaaattaataggaatgggccaaaaaaggaagagaggagacagtaagaaacctatgtaatcctcagattatctaattctcatcttatttgagccaaatgacttaaagtaccgaagtcccaaaatgaagaaaattagatctgcgtgtatttacataactaatttttgtctgtatctttttgaatgtatggtatttaaccagcactttttaaagttctttatagcctggctagctgatggttttatacttatctgaaatgtttcagtgatatctaatcttttccctaccatattttaactaatttagatccagggaggttccaagacagttggaggctttcagatggctttgtggcagctgaggcaaaaactattcttcctcatcgtgccagatccaggtagaatttaaaataaaaagggtttcaatttattagaattcgggtttttatgttagactgtgtaatctatgaaactttatttaaattgtttctgtgctgttttttccaggccagacctcatggataattatttggcactgatactctctgcatttattcgtaatggacttttagaggtaagacttataaaccttattttattccattttgtttattttctctaacagattctttcatgccaggtgtggtgactcacgcctgtaatcccaacactttgagaagccaaggcaggcggatcacttcaggccaggagttcgagaccagcctgaccaacatggtgaaactgtgtctcaactaaaaatacaaaaattagccatgcatgatggcatacccctgtagtcccagctactcaggaggctgacacacgagaattgcttgaacccggaaggcagaggttatactgagctgagatcttgccgttgcattccagcctgggcaacagagcaagcctcttgtcttaaaaaaaaaaaaaaaattttgaaaaataaatctgatgcataaatgttttcatatgtattattttgcaacagtggtgttatctttttattttcaaagggtctagttgaagtgataacaaacagtgatgatcatatctcagttagagctaccatccttttaggagagcttttacatatggtaagtttagcaacttctgattatatgtttcatacctttaatgtttgaatttataaaacaagttattttaatagtgttgctttgtattatc

SEQ ID NO: 4367 - DNA, 1172 bp, Homo sapiens
acatagaaattggaatgtgatttatagtacaatctcatgagtatgaaaaggctatattaaaaaaaattttattgaaagtccacagtcatattcacaaaccaatactgtcattgctaatctgaactattatttttatactatatattgtagtacaataatatagaactgttgggttctgttacttctgacactcaggaagatactattggtgtattaattttatctttgttagagatgaaagtagcccactttatgttaaagatcttactactgttggagcttataagtaatgatctacattttttatgaagatggtttttaaaacttttgttttattggaatgcatatctcttttcagggttggagaaattagcacttgccttgaaaagaatattctttccttaagttatatcatcagaaaattagctctggttagagaggttagtttcagagtgctccaaaaaatatgttaattattttattttgtttaataaagaacattctcaaaacgtaaataggtatctagagaagtgagtactcaacatttggtatattgttttgagtaatggatgtttgttttttgtgtaatttgtgaataaatagtttttttctgcattttgaagattttcctattattttatgttgttagcttttgaaaaattagattgatctacttagtgtctttcttatatgaacttaatatatttaaagtaccttgcatggtgcctcacacatgaagtaatgccagctatttcagtaaatgctagctatttctatgaagaacttgagttagtttggagatatttaacctcaatttcctctgattttaaaaaaggagaactttttttgtaatcctttccttatctgaaagtaagaagtctctgattccagtattataggagagatagtgggatttttcttgacagggtctatagctcaagtcccaaagaggcaagactcaggatggaatgcatgtggccactaggccctgttataagaacctagtgtttcctctgtactggcatggtaggccaagttagtctctttcttacccagatataagacataaaatagtttagacataagacagaggagaaaaagaaacagtaagttatggagaaggaaggcagctcatttctgcaggcccctcaaaatgcttattttagctcata

SEQ ID NO: 4368 - DNA, 1149 bp, Homo sapiens
gtttgctgtgcttggggggctggcaagattccggataaggggaactggtgggctggaaagaggcatgcggtggccctcaagagccagaagaatgactgctaactggtgcctgggggacctatcccgccgtaattgtggtgctagagccgcattgtgtcctttgcctcggtccaacctttggagacctttcacggctctagccttggttgggagccgagggaaggagtttgggaatgtttggctctgtgtaacaatgaaataattcattggtgatgctctctggccggagtctgtaaagataaggtgcatttcagaacattgcaactcttgcggagggttttaggtaacgtgaaatgcgggtagtggtctctgacttggcattcgtggaaagaggcttctcccgcagtttcgatctttacgattgcctttaaattttatcagtaattggtttcccggagaactcgagtaaatctagaagttgccaggtttcagaactatttattcctttaatgtgcagacgaagggaacgtcatcgtttggaaagcgtcgcaataagacgcacacgttgtgccgccgctgtggctctaaggcctaccaccttcagaagtcgacctgtggcaaatgtggctaccctgccaagcgcaagagaaagtgtaagtaacatttttcaggccaactgtgttagcttttgtttgtattgcacttaagtgggggcataggtttgaactttatttggtgcctatcttaaaactcgtacatctgtatgccgatgaggtggcataaaactcgtgtgttaacaacacctacaaggtgtgtgggagaacaccgtttgaaatcttttctgaacttatgttttagataactggagtgccaaggctaaaagacgaaataccaccggaactggtcgaatgaggcacctaaaaattgtataccgcagattcaggtacagtttgtatgttcgatcataattggtccagtgggcttgaatgaaaccctcgtgtttacttgtaaaaagataacagtaccctgatggttactggggatgagatgttggaagctttttatttattgttgtttttgaggcagggtttcactatgttgcccaggcttgagtgtagtggcacgatcacggctcagtgcagcctcagt

SEQ ID NO: 4369 - DNA, 1182 bp, Homo sapiens
gattttatcctagaccctgaggatatagctttttaaaaccccctcctgtttcagagcttatattctagtggaggaagttagacaagcattttaagtaataaatgtatagagagtgtcaagtgatgagtaccatgaagaagaataaatgagggtaaggggctagtgtgatagggagaggggtgggatgccatcatatttaggggtggttgggaactgtctactgctttagcatttgtgtcttcaaatttctctcctttggttatataccttgcgtattccgcacattgataaagtttctttcttacagaagttctgatattgaattaaggaatgggtcactacttaagactttatcatttcagctacacataaaaggtttctctcccctatggattttgctaatggttgagtgatacctaaaggccttgttgcattttttacacttggggtttctcttcggtttgaattctctcatggttaccaaaactctgttaaaggacttttcacagtcgttaaatgtgtatggctctttcccaatatgaatttttttgatgttaactaggcttttagacttagttaaagacctgtgtgctctgctgcatttatagggttttgggctgctgagaataattgatgctgattaaggtgcaaatcatgactaaagacttttctttcttcttttgcatatagtagagtgaggtgagggtcgtggctaaaaccccacaataactttacattcctagctttacagtcttgctgtgaattctctggtgttcattaaagtgtgagctgtgttaaaaggcattcttagattcattttaaccacatttttaaaaactcacagttggttaacatgatggtttcagattgcttgcctcttttctctttctaccttacagggctccttttctagcttaaataagggtactccatctgccacagaatccaggattctatagttttttagtttcacttccctatgttctttttttttttttaatttttaacaatgagatgataccatgttacagcggtattacattaagatacatttaatatagccacaattaaagtatgtattatgtatttatgctggtgttctttcatgttatttcttctagtgaaaatttccaagtaaactgttattgagcatatacatttttaaaaaaataaaaccataca

SEQ ID NO: 4370 - DNA, 1122 bp, Homo sapiens
gcaaatacaagacgtaacaagtaaaatactgttacgtggtgggtctctgtggcaggcttcctctcccccccatatggataattgtatactaaattcaccataaggtgaaaaatggatattgagttcccttcatgaaaagttatataaaatatatatttagcataaacttctccagagttgtcctttattaagtttctttacagaaactttaattggtgccatgattcttgtgggggaaagaatcataagagccatcaacttttttcctttcattttagcatattccaagccctgccaagaaagtaccaagactccctgccacagcagcagaacctgaagcagctgtcattagtaatggggaacattaagatactctgtgaggtgcaagacttcagggtggggtgggcatggggtgggggtatgggaacagttggaggaatgggatatctggggataattttaaaggattacatgttatgtaaatttttatgtgactgacatggagcctggatgactatcgtgtacttgggaaagtctctttgctctatttgctgacatgcttcctgttgtggtctggccaatgccaaatgtactcgaatgatgttaagggctctgtaaaacttcatacctctttggccatttgtatgcatgatgtttggtttttaaacatggtataatgaattgtgtacttctgtcagaagaaagcagaggtactaatctccaattaaaaaattttttaacatgtaagaattttgtactttgaacaacaagattacagaaagtacctgtggtttttggaaaacatttctagcttggggaatgtgacaacattccccagtgtggtaaaattggggtaaaatgtggtaaaatgtgatacgcacaaaccctttgaaaatagcaaaacaaacatgccctttttctaaaattgataaatcctaaagaggaagaaaagagctgggacaataaaacactggctctggaatctggaatgttaagtccaggccagcagtgacaaaagttattgtaatgacctctgaacagagaaacactgccattgaagaggcttctggtatagaaaacatggtacattcaggagctgtgaatatagctctaggtgtgctc

SEQ ID NO: 4371 - DNA, 1181 bp, Homo sapiens
aatagagacggggttttgccatgttggttaggctggtctcgaactcctgacctcaggtgatccacccacctcggcctcccaaagtgctgggattacaggtgtgagccactgcacctggcctatttacatcttatttcttagcaacgtttagagtttcttttatctccatgcatttcctgtgtatgcctacatttttgtgtaattggaaatggactttttctttccaattatatacttctttatagtttttaaaagtggctttatataggtgatactgatagctatatatttatcttgtaaaagaccaatttaagttgttcattagagccaataatttgtcagctgattctcatgaggtgtatataaccaatctgatttgcgttcttctgaaactgcttatcaaatagatggccattagcccctaaatggcaaaatccactggacagttttctgtattgtactcagtaaggtctgacatattttgcatgtttgaccgctccttcatttttaaaatagtttttttattgccttcagtgaaacatgctcttggttttcctcctatctcatttgctgttctgtcatatttctgtttgctgttcttcctctcacttttcttcaaatattggtgtacttttttttcttttctagactccatttttgtttaaccacactctccctagatgattttatcaaattccatggatttaaatatatttgtaagcacattcaaaattagtttgatttcaaccttgtgttttgtatctgaatgataagcatcagcattataactaaacagactgtgtggttaagattatggacagtttttccctctagttatctaattttcataattacccccagaacgtgagaacattatttttatgatcagaaagtattttaagaaactagttgagtggactctaatatggaaccatcaacatgtatcaaattccacttaattataagcaaattcattatgaaattatatttaaaaaggcatttcatgattacatttgttatttaagaaaatgttatttaaagaaatttacataagtttcattatacatgtattttagcttactcattctggaaatggaaaacttagatactaggcaagaaggctttagattttttttatgagatattttaatagaccagtacttaggtcttaatatttgtgt

SEQ ID NO: 4372 - DNA, 1197 bp, Homo sapiens
atgctttactttcttttggatagaatacctacacaaattatttggaattatttggaatttttctacatagtaggtttatctcttctaccccatttatttgttgatttattcaattatttacttatgtcagtagagactcatggatatttattttatactttgttttttgtttgttttgttgttgtttgttgttgttgttgtttttggagatgcagttttgccatattgctcctagtctccagggatcctcccgggccccagggatccttctgcctcagcctaccaagtagctaggattacaggtgtgtgccatcaagcctggttcatactttggattataattcaatactctgttattttgttgcttaaattgttccatttttggcataggatgttcttttaattagctcctacgtccctttgacatagcctcatcgttgtggggttttaggtgattttttttcttttggcacttcctaactctggcactgtaagaggctccacactcatcttgggtatttcttgccgcagacaggatcagccttttgttgaagaagccctggtcattggaaaatggaatcagaaaccaagatctgcgtgccctgtgtgccactggggtattattgcttctagacctcagctgatagagcgaactctgtgtgtgcacgtgtgcatgtgtgtgtgtgtgtgctggcccatgtatatacatataaaaacatttttatatgtaatcctctgtatattaaactaaatatgagttcatactgaggtcttcagctctaattcattcccataaggatcattctagcgtttttacccttgcttatctgtaatctctcagtaaaacagtgagaaatctggctcacgctatccaccatccatttactcaattgtttaattttagtatacatatataatggtttcaaaattaatccatacccctgtgggagacaattcttacgtacagtttcctttacctttagtcttacagacttccctttcttcaagagttacttagttctgcactttataccccaatacttttctgggaagttgttgtatgcaatgtaatatgtttagattatttataatatatttagattgcatttcatgctaggcttccccgactttctagttaattttttttaatttgcatacattgagatttattcgttgtgctataaagttctttgggtt

SEQ ID NO: 4373 - DNA, 1176 bp, Homo sapiens
ttcctggttctgaaatttatctatgtttcctttttaccagattgccccagaccatgtagttccagctccagaagagtgctatgtgtatagtccattgggctctgcttataaacttcaaagttacactgaaggatacggtaaaaacaccagtttagtaaccatgtgagtgaaactgctttttggagcatgacttaaactgtatatggatgaaaattactggttttttaaatttttgtctcaattaaaatgtttgaagagtgaaactccatttttttactgctattactctgtgttttcagttttatgatttggaataccatgatgggaacatctatactaagcattccttggggcataaaacaggtaatactaatttttcagcacactttttgcctaaatgtttttctctttatattgtaagttttataacagaggttttaataaatctacataaaattcattaaagaaaatagatggttatatttagtttttcatgagttgtcaagtttttatcatgattgtttagggtaaaataattgcatatgaatttatgcttacatgatgatatatgctgttttatacttttatttttaaacaggctggatttactactggaatgtgtgtcatcatactgatgggccttttaacactttattgctgctacagagtagtgaaatcacggactatgatgtgtaagaatttgacacagtgacaatagattatgggtattaataagcatttccctttgaggcagatcactagtgtgtatatgctacatgtgtgtcagctgtctactttgtacctaaagatttacttctgtaattcatcgctttcagctaaattgatttgctaataatatttagtggctgcttttgaaattcagagaagctgggagttatttgcagagtgcattcactttggtgctagtttcttcataagaatcatttaaaaactcatatttataaaataatgtctttgccaaaactaaattgagaattctgtgcttcctgtcagttaatggtgacttgttttgacctattcataccaaaagatctaaatgttagaatctgctaaaagtagaaattataactagaaaaatatgaaaatgtaagcaactccctagtaatgaatatttgaagttgtgtgaacaccttacctctactcgtatctacaaat

SEQ ID NO: 4374 - DNA, 1176 bp, Homo sapiens
atagtaatatcaaagtagatttcagagaatgttaccagtggtaaagaagggcatttcctaatgataaaagggtcaatttatcaaaaggatctaccaaataacatagtttcaaaacacaacagggtaaaaactgcaaggagaagtaaatccacagttatattcagggatttcaatatccctttttgaacaatgatagaagtagtagtcagaaaatcagtaaggatatggaagatttgaacactatcaaccaaattcacgtaatgaccatttatgtaacactctaccagcagcagcagtgctttttaagtgcacacagaatattgatttcaagatttataaggctaaagtcatcacgacagtgtggtggtagcatataaataagcaaattgatcagtggaacaaatagagtaggagtcatcctaccttctgttttcataaagtactgttagaacacagccacccctgtttgtttatgtattttctatggttgcttttgtgtcgtaacagtagattggtagctccaatagagaccttatggctcacaaacctagaatatttacctcctacctcatacatgaaaagcttgcccaccctggaattgagagtagccaaatagacccacacctgtgaacaactgatttttaagaaagacgcaaaggcaattcacttgagaaaggataattttttcagcaaatagttttgaaacaattatccgtatatacaaaatgaactcaaatttcagcttgacaccacacataaatattaacttgaaataactgagacctaaatgaccctaaaactataaaacttgtaggaaaaaacctttttgactttatttttattttttatatttttttttttttgagaaggagtctcattttgtcacccaggctggagtgcagtggtgctatctctgctcacttgcagcctcctctgcctcccgggttcaagcagttctcttgcctcagcttcctgtgtagctgggattacagatgtgcaccaccacacccggctaatttttaaaatattttagtagagacagggtttcaccatatacccaggctggtctcgaacttctgaactcaggtgatctacccacttcggcctcccaaagtgatgggattacaagtgtgagctactgcgtcgggccctttatgattttagattaagcaaaga

SEQ ID NO: 4375 - DNA, 1312 bp, Homo sapiens
catttaggctgggggcagtggctcagacatgtaatctcaacactttgggaggctgaagtgggatgatcgcttgagcccaggagtctgagaccagcctgggccacatagtgagaccctgtttctaccaaaaaaatttaacaattagctgggtgtgatggtgcatgctagtagccccagctacttgggaggctgaggtgggaggatcacttgatcatcccagaagttcaaggttgcagtgagctatgattgtgccactgtattccagagtatgtgacagactgagaccctgtctggaaaaaaaaagatcaccagacatttaaacaaattatatgtatatagttttgcagcctgtgccttaaggtatcagacaggcgttagttactaacattaaaatgcatctcagcctcatttggtccatccagtgataccatcagttgtgtcagatgaatactggcattatttttctaggctcagaggccttgttgattgtaggatgtactgttgatttctttttttttttttgagacggagtctcgctctgtcgcccaggctggagtgcagtggcgcaatcttggcttactgcaggctccgcctcccggattcacgccattctcctgcctcagcttcctgaatagctgggactataggtgcccgccaccaagcctggctaattttttttgtatttttttttttttagtagagacggggtttcaccgtgttagccaggatggtctcgatctcctgacctcgtgatctgccctcctcggcctcccaaagtgctgggattacaggcgtgagccaccgcgcccagcctactgttgacttctaaacagtgcaggtggtggaggaacgcttgtatatgaagtttgcactttagtatcaggctacatcctgattctgatatgtgagggagtgcatcataggatcaaggaaatgatggtatgtgaggaaatggaggtgagagggattaggtgatttgtccaagatattggttagcaattagtggatcttttgccctaaatctggttctcttcctgatataaatcctttgacttacagaacagttcatttataagtgtgactagactctactgtgtcccttaaaatgtaaataggttcaacaaaatacccaagaagaggaagagaaaaatccttatacccgggataaggtgatggatcacacttctaagctgatttagctaccacagatccttacagactttgagacttactaattcaattttgaaaaaattgtttttatgttttaaaggacttaagtgctttattaataggctctcaaagagagttcatt

SEQ ID NO: 4376 - DNA, 1204 bp, Homo sapiens
gggaggccgagccaggtggatcagtttaggtcaggagttcaagaccagcctggccaacatggtgaaaccccgtctctactaaaaatacaaaaaattagccaggcgtggtggtgggcgcctgtcatcccagctacttgggaggctgaggcaggagaatcgcttgaaccctggaggtggaggttgcggtgagccgagatcaagccattgcactccagcctgggcaacaagagtgagactccgtctcaaaaaaaacaacaataaaataaaaataaataaaactacaaaaattaaccaggtgtggtggtgggcacctgtaatcccagctacttgggaggctgaggcaggagaatcgcttgaacccaggcagcagaggttgcagtgagccgagatcacaccattgcactccaacctgggcaacagagcaagcctccatctcaaagaaaaataaatgataataataataggaaaggtgtccaacagtttatgaagctgttcattgataacttctttaaaaccccacacaaaaaaataggatggtccgagtgcagtgatgttttcaactaattgatgacaactggttagagatttctttgttccttctccactcccactgcttcacttgaccagccttaaaaaaaagaaaatgaaagaagaaaaccacaaaaaaaagagaaacaacctaaatgtctataataaattgacaaagtaaattatattacatccatagagtggaatatgaagccattaacaatggtatttattaaaagatggtcacatgaaaaaatgctcacagcatactattaagaaaaatgggctgggcgcggtggctcacgcctgtaatcccagcactttgggaggccaaggcaggcagatcacaaggtcaggagtttaagaccagcctaaccaacatggtgaaaccccatctctactaaaaatacaaaaattagccgggtgtggtggtgtgcacctgtaataccagctgctcaggaggctgtggcaggagaatagcttaaacccgggagacagaggttgcagtgagccaagattgagccactgcattccagcctgggcaacagagtgagactcagtctcaaaaaaaaaaaaaaaaaagaaagaaaaaaagaaaaatgagaggtagattacaaaactgtatgtataatatcctatttttgtcaaataaaaaagtataatcaaaggaaaaatt

SEQ ID NO: 4377 - DNA, 1152 bp, Homo sapiens
ttgcaaagaatatgtgtgtagttcttaatgtgctacctagaatcactgttgtaaacctcctgggtgcttagaattattacaaatcatttattataatacaaatttttctatcttgctagctctatcagcaacatcctcagatacagaaggcatacttcttttgctgccatgtggcttcttgttttttgtttttattaaaagtaatcacaaaaactgcaattacttttgcaccaacctaataattagacaattaaaatttcaaaggaagggggtaaaattaaagaactatgttgcgacctctcttagttctctgtgtgtaggacttttcaggtgcccaatgtcctcttgactgaccactcctcatgaagatactggtaaactttgtgctagtggattgataaccgctctccgagttcatgctcttctgaggtctagaaagaaatgggtgtctctgtcccaacctggttagttattctgtctctaaaaacacaattaagtcaatgttaagactaagttcattaagctgctcgtgtttttatgccttgacagtttgttaatggtggttgcataagttttacagaactagtttcgtcttgttgcccaggctggagggcaatggtgtgacctcagctcaccgcaacctccgcctcctgggttcaagcgattctcctgcctcagcctcccaagtagctgggattacaggcatgcgccaccatgcctggcttattttgtatttttagtagagacagggtttctccatgttggtctggctggtctcgaactcctgacctcaggtgatctgcccgccttgacctcccaaagtgcagggattacaggcatgagccaccgcggccagcctgtagtcagctctttaaggcaacaatttattggctcaggtgactggcacaagccagttttcttttgttcatttcatccattgtggcaaggattagcaacagtactaaatgagagcttgtcaacaccttctgtaaaaacaccaccaggagcaggagagctgcttctcccatgtggctcaaacacttaattccagcttctctacaccctgcatgatggtatcatccactattgtgtaaatctgtatattttctaaataaatacactgttcaaacttatgctaaaacaaagaacatt

SEQ ID NO: 4378 - DNA, 1199 bp, Homo sapiens
aaattaaataaaaaataggcttataaaaatgtaatgctctctcttattaaaatggcattgataagccccctgggttacaatattgttgaggtccttgtgaggacatgatagcatcagttgaactgattaggagcacgtcggattgccaggcatttttctttagaaataatctagaagctgaaatagatgtctgatcatagatttgcctttcttctttttgcttacttgaaagaaaatgaaagtaagtgtctaatttctaggagacattaaatatagttctcatatatctggcaaagattgatttgagtataggaaaccaaatggaaatgcattgtcctcattattcaccttacacttaccgttttttatataaaaaggaaaaaaacaccaaatcataccaaatggattcttgagcaaagtgaaattagttaattgcttgtcttgacagcatttggataacaagcagtagaaaaggtatggtaaggaacttacttggaacaagctacaagcctttctggtccttgggagaaaagatgctcatgtaatttaaaacaatataaaaagcagcaaaattttgttcttgttatctggaaaagaaaggttactttttttttttgctatttactcacttatttgagctactgttgactattgaatatttgctgaaaaggcaaaagttcaacaaccctaatgtatgaatacatatgtacctatataacgagacctctgtgtgccataaaattagaaaggtgggtgaggggtacagtcattgtcctagctacatatgtcaatgtaacatttatttcttctcagtgctgacagtagagtaaaattatgggatgtgagaagagcatcaggatgtttgattactcttgatcaacataatgggaaaaagtcacaagctgttgaatcaggtaaggaagaacgcattaataaatatgacaatgatagtatttttttacattgaaaatttttaattgaagccacataataaacgcatattgacaaattgcaaactttatgatttttcaaaaggcattcatcgtatatcactttcttaatttacataaactaaattatgattctctttctttaagatacaaataaaaatggcagtttcatttgcccccaaattttcaaaagtagaaatttttgtgaattaacttgctttacttgttttgtttttgctccattgaggc

SEQ ID NO: 4379 - DNA, 1167 bp, Homo sapiens
aataggagtggtgagagagggcatccctgtcttgtgccagttttcaaagggaatgtttccagtttttgtccattcagtatgatattggctgtgggtgtgtcatagatagctcttattattttgagatacgtcccatcaatacctaatttattgagagtttttagcatgaaggttgttgaatgttgtcaaaggccttttctgcatctattgagataatgtggtttttgttgttggttctgtttatatgctggattacgtgtattgttttttgtatgttgaaccagccttgcatcccagggatgaagcccacttgatcatggtggataagctttttgatgtgctgctggattcggtttgccagtattttattgaggttttttgcatcgatgttcatcagggatgttggtgtaaaattctctttttttgttgtgtctctgccaggctttgttatcaggatgatgctggcctcatcaaatgagttagggaggattccctcattttctattgattggaatagtttcagaggaaatggtaccagctcctccttgtacctctggtagaattcggctgtgaattcgtctggtcctggactgtttttggttggtaagctgttaattattgcctcaatttcagagcctgttattggtctattcagagattcagcttcttcatcgtttagtcttggaaggatgtatgtgtcaaggaatttatccatttcttgtagattttctagtttattttcgtagaggtgtttatagtattctatgatggtagtttgtatttctgtgggattggtggtgatatcccctttatcattttttgttgtgtctgttttattcttctttgttttcttctttgttagtcttgctagtggtctatcaattttgttgatcttttcagaaaaccaactcctggattcattgattttttgaaggcttttttgtgtctctatctccttcagttctgctctgatcttagttatttcttaccttctgctagcttttgaatgtgtttgctcttgcttctctagttcttttaattgtgatgttagggtgtcaattttagatctttcttgctttctcttgtgggcatctagtgctataaatttccgtctacacactgctttaaatgtgtcctggagattctggtatgttgtgtctttgttct

SEQ ID NO: 4380 - DNA, 1214 bp, Homo sapiens
agttaactggttgtgtgaggaaactttttcaaaatttgattaaccacatagtcttttctcctgtttttttcctctgtgttctccacccgcctcccccagccccagttttcataagactgctgtgaagatgtttgatataaaggcttgggctgagtatgttgtggaatgggctgcaaaggacccctatggcttccttacaaccgttattttggcccttactccactgttcctagcaagtgctgtactgtcttggaaattggccaagatgattgaggccagggagaaggagcaaaagaagaagcaaaaacgccaagaaaacattgcaaaagctaaacgactaaaaaaggattgaaggactgaacaggctttgcaaccagaggaaaatcatttggaaaattacacagctttggaagaatccactaaagtttcttctttggatttcttgacagtatgatttagtaaatgaaatttgaccaaatggaagaatcatgttagttctgacctcaatactatagtaacttttaggcgtgggtgtagaagtttataggtttctattgacagttattgtaaattagcatttactgtggtacaaattctttataactgacttagtcatttgccgcttagcagtttatatactgaaatgaaaacatcttgtggggaaaagtgactttagattatgaactcaattcaaatgaactctatttaaaatggggtcctattttggacaaaggaaattaagaatgtaaaagtcagaacagtcttgaggtaaaaagtgtgctttggcttaaaagggatacagtatattaattacatcttttattattattgtttatttcttagaatcatttctggctttctcaaaacaaaataatattaatgagtacttctatttgctgcatttttcttattacagcctttgagacagctggtaattataagtcattttccattttttaaaacataattttataaagaattctcttatctcgactatgtagaataccacctactggacagaacaatttttgtactcacaaacactgccattttcttagagatggcttgagaggagtaacactatggtttaaagcttgcagtaaaaatgccaaacactgtagtaccttggaacccagtttattcttgtgctaagcagaactgtaaaatagttaaaatgtcttatcaagtaattcgccgattacaaagacaccatt

SEQ ID NO: 4381 - DNA, 1099 bp, Homo sapiens
ccgcggcgcagcccttgtgccccgccgcccgagttttgtttgcgctgtgtggtcaggtcgtggtgccccgggcgagccgcggtcggcagttgcggatttgccgctcgcagccaaaggggcgagcgggctgcaggagcgcgaggcagagggctcggcggccgctcccgcgtccccgcggcgcggcagcccggcacgacccagcactttgttctcattttcaggtttttttgtgcccctttcagttttctgtcaccctccgaaaaggagaaaccaaacaaaagagtctctttcttttcagggcttgtaaagtagaatatatttgacaaaggcgagagaaggacttgtgatttagagctgcacagccttcctttctctgacagatcctgagagttttctcaaataccttagtttaaaagtgtctcctgttccccctcccctaaaatgttctttttcccctgtccagatctttttcagccatagcgatgggaatgtttgagccagactgaaaagaacaatgctgtagtgaaacttcccatttttttctcctgattgcaaatggcatattttctgaccccctcccatgttagtgtacttgaaattgtagcatggtgaacccggcaccgaatgaatggggatagatttggacgcatctctatctctttgattgttaacttaatcctttttctctttctgtagtcagttccttttatccttcttttctttggaagtggggtgggggtctggatagggtccccaagaaagaattaagatttgttttaatcctgtctggttaatttgaattctaatgccatctgcaaacgtggttttctgcatggtcatttatttccaaaggcagcccccagtgttgccttttctatgttgggcactctttccttctgtctagagggggtttagcttttgaggctattcatctatccttttttccttaaaacaaatctaattaacattcttcctagttatacctttttttttgtttgtttgtctgtttcctgccggttagcgatggatggaagcacatctatggcttctcagtataacaaactagagtctgcgaatttttatggcttggctggcaatg

SEQ ID NO: 4382 - DNA, 1226 bp, Homo sapiens
tgaacaatgagaacacatggacacggggaggggaacatcacacaccggggcctgttggggagcgtggggggttaggggagggatagcattaggagaaacacctaatgtagatgacgggttgatgggtgcagcacaccaccatggcatgtgtatacctatgtgcatgttctgcacatgtattccagaacttacagtaaaaataaataaatagttaaaacttagcattacagttaaatacatgaatttgcacttttgggggaaattattgttgtagacattaaatttcctggtctatgatgtatagggtacatgtcttattcctaaaatgttgagttgtatatagagtgaatttatgttttatctatctactagttatctttgcttgcagtcttatgagtaagtcaggaagatttctgtatcacatgagcagatttctaatttttattgctcagttaattttttttcttacattatagaattttagagttaaggaaatggaggcccgaagagcttaagttatttgctggaaaatgcatagtttttccagacagtgcctagaactgaaatcttctgaattctaatccatcctctcaactggtatgtagactttgggccatttttttttttctccagtgcatttccctcttgcccagtactatcaagaagtaagttaattctaatactagcttaccccaaaaaaataaaaataaaaaccccaacttaatgtatccattcatttttctgttgcttataacagaataccagaaattgagtaatttataaagaaaaggaagttatttcttatagttcttgagactgagaagtccaaggttgagaggctgcatcttgtgggagccttcttgctggtggggactctgtgggcacagggcgttgcgtggtaagggagctgagcatgctaacacgctagcttaggtatctcttcctcttcttataaagacaccagttccctcccatgataacccattaatccattaatacattaatccaagaatggattaatacattcaccagggcagagccctcatggtccattcacctcttaaaaggccccacctttcaatactgccacaatggggtttaaatttcaacatgagttttggagggaacaagtattcaaattttcttaaaacttgagaaaacataattgatgtatttatacatttgctattagatttttctccacttgaaccaaaatctgtatctat

SEQ ID NO: 4383 - DNA, 1197 bp, Homo sapiens
ttcagttcatatatataaagttacctagttgcactgtttttcttctttatcatctgaaggcatacatcatggtatccagcagagaagtgatgaccactgggtgtggtttaggtgatcctccagatgtgtgagcaattgtagctggccataagaagatttcctggctgcccataagctgccattttgtgaggcccttcagctaactatttctccactgcagcagtagatcagttcagaagaaaactgtacattcccagcaagaatgccaacagaaacaaatggttgctatttaaaataaatagtggttaaacgttcttttttcatatttgcatcagaaagggatacatacttcatgctgagaaaacactgccatcccagtgtttagatatgacacagcatatactataaaattattatttttctttcactaacgtataatggtttttttattttggaaaaagggaagctggtctcaatataaagattatctttacatcattaaagtcatgctttagtgaagcaaaacaaaaataatactaatttaagaactgccacacaacttctttgcccctgccccaacatataaacctgatttctctctgagacctagtaccttctcttcaaatcattcacttttaggattttcctacaagtgagggatattgggtctgtgaacgtaaagtgattattttaaagacatggtcagccatttccaacgtttgattcatctgtaggtctgcttctattgactttgttctcttgattatgggccacattttccagcttctttgtgtgttttaaacttttgtattatgtgtacttttaccttacacacaagcacataagccatgtaaagtccctgttttggtgaggttgcaatttttgagcctcaaattctgacaggaagccccagtgaagtagaactcattagcaaaaagccattgtctgaaatggcaagcagcacagtacaaataccagctaccaagaggattggttctttattatagcaagttcatgttcctttcaggcatttcactgaataacaattcataatgaccttattcttaaaggtttctcacaggcacattactttacaggattttctagcctagctcatgtcctatgatggttaacaatgtaaacactggttgtaaaagtcaaaataaggcaggacctctgggcagcctcctcgtcagt

SEQ ID NO: 4384 - DNA, 1156 bp, Homo sapiens
ggcaaactcaagagtaaaaagtgtcaaaaaaagaattgagaattttattctgtactttttaaaatttaagagccagggagttgcatcatgaaagcctttgtataataatggaaattttatatgggtaagcattttcaaacacatattagtagatacgttttttaaatttctattttcacattgatcagtgttactttgcttaatacttaggtagcccttatgtccactaaagtaaatgcttatgttgtagaagcatcgaacatcaaccaatgtcatggcacagcaccaaagattgcaaatacctcactatggtgcgcttagaaattttcaaattgataacctatagatacggctgcaggtgaattcatgatagtgaaatcagctaagtatacttaacctcacaggctagaaaggtttactgattcttgtttcacctggcacccaatgtggataccctcagtaagactcagggagccttataactcctcttaacatatgcttacccatgcttaaattctagggaagctgtatccacagccctctgcattgcagccatgagagctctcacgctttcaacccttccataacctaatttagtcatttgggcctctcaaaaggaaatgcttttgtttaaataggtcagtcagttactgggagaaaaaatacagagccagtaggtttttagggatttgttttgcctttgctgctagttttttgaaaatattcttcgattatcaagattttaaaaatcggtttttaatataaagcttttttaaaaacgaggctggcacaagtgcagtggtgtttctttactcccactgcttgacttgactagccttgaaaaaataacagtaaaataaaatattaaaaaataattagaaaatgctacaaaggcaatgaccttattccattgagtaagatagttaaaaatgatagtaattgtagtgaaatagttaattacttgtaagttttattactgttaattgtagagattataaattggctcattaggtttctgaatggtgacacaataatgactgagaagagcaaaagtcagtcctcgttaactaatgtagtatgcaaattaaaatattttaatgatcagtaattttccccccagaaatgatgttggcatttctaagtaaatttcccataa

SEQ ID NO: 4385 - DNA, 1157 bp, Homo sapiens
ctaattttattgaccttctcaaaaaaccaattttcattgcttttcccttatttttatttttttattttgtactgatttaacttctttgttgttattattatttcctcaacttactgtgggttttatttgctctttttcatatttcttatgatagaagctgaggttattaatttgagagctttcttttcttttaaaataggcttttaggccgggcgcagtggctcacgcctgtaatcccagcactttgggaggctgaggcgggcagatcacgaggtcaggagatcgagaccatcctggccaacatggtgaaaccccatctctactaaaaatacaaaaattagttgggtatggtggcatgcacctgtagtcccagctactcgggaggctgaagcaggagaatcacttgaacccgggaggcagaggttgcagtgagccgagatagtgccactgcactccagcctaacgacagagcgagattccgtctcaaaaaaaaaaaaaatagatttttagtgctctgaattctcatctgattactgcttttgcttcatcccagaaatcttgatgttgcatgtcaattgtttgggggatgaaaaaaaaaaaaagacaaattttgatgttaatgtttttatttctattcagttataataatttcctattttcatattggttgcttctttgacccattgattatttagatgtatgtttttggtatccaaatagttgcaaagatttctacatacctttctatttttcaatttaatgccattgttagaccatatttaatataatcaatatgattgcattgaaagctatgttattgatttatatttttctgggggagggagggttgggagcagaggatcttgctccgttgcccaggctgggtgcagtgttgatatcatagctcactgcagccttgaactcctggcctcaaacaaccctttcaccttagcctcctaaagtggtagaattacaggaatgagtcaccaggcttggccttgatttatctttcttttcatcctgtttttctgttcctgttttcttcttttcccactttcttggattgtgtgtgttgttgttgttgtctttgttgttgttgaggcagggtcttgccttgttacccaggctggcatgcagtggtatgatctcagcttact

SEQ ID NO: 4386 - DNA, 1202 bp, Homo sapiens
ggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcacccttttagccgggatggtctcgatctcctgacctcgtgatccgcccgcctcggcctcccaaagtgctgggattacaggcgtgagccaccgcgcccggcccttccatgtaaattttacaatttgcttgtcaagtcccataaagagaaacaaaaactttcaggattttggttaagattcagtagctcaacttgggggagaattaacgtctttacaatgtgggtctttcagtccatgaatatgaagtatctttccatttatttaggtctgccttagaacttctctgttaataagttattgattaagcagtataaaatgcagaagttccatatgaataaagatattgaggaggggtattctgatttgcgtttgatgtggggtagacatcctcatcattctttattgcactgtctacctccttaaaattgcccagttttgaatcttatgccaccagactctaatcctcttccattctttgcaggaatcatctagcaagattgttttactcaccctcattccttgaagatttttagctcctggctcattgccctttgcagtactactatcataattcttagtgattttaatatccttatagatgatccaataacttggcctctctttttcttgaccttctttcccctagtgattatgttctctcttgtcttagctacttattcctatggccattctttcactttgtccctgtctgtacctgtggtgctacaccatagaagaaaacatacaaccatgctctggttttactttaaactcatgatactaatctcaggtgagcctgtaatgctactactgaataatcctgtaactttatcctctcccatttttttatatatctgttttatacatctcttttcctgtgctcttaaactcgcagtactttcttcccatcctttcatagctgataaccgtagttaccattttacggagaaaagagaaacaatccacatagaatttctacaagttcctagcaacacgtctacttacctacctgcatctacactcttgatattctgatgaccctcccattaaaat

SEQ ID NO: 4387 - DNA, 1099 bp, Homo sapiens
tgcataccttaattactcattgtaggagaaagagcacaataaagaaccagattcaagtgtgagcaaagaagtagatgacaaggatgcaccaaggactgaggaaaacaaaatacagcacaatgggaattgtcagctgaatgaagaaaacctctctaccaaaacagaagcagtataggaccgacaagtgtacctctgcactcaatgctggaatcaaatccaaagcttttaattctctcaacaagatgtaaacaggaaagaaatctagttgagcatgaagataggatctaacagcttttccagttgttagatgactttgtggccatcttgttattgagtaagaaaataaagcatggacatcatgaaaataacagatgttacccaaactcatcttctaaaatctgtgcatttccatggtggctgacacacttgtcatgtggtctgttagtgtttgccaagaaccattgcaaataaattgaacatcaaagatccaagtttgtactatccctaaagactggagataagcattggaggctcttttaaaaaatgctagttactgaattttgtattgttttacttttttttttatttcaatatatacagtttgatgatgtgcttgaaattggtgcaaatatatacacacccttgtaagtgcaaagtatgtaagaagttttaacatttacttcacaggacttgtgattgtgttaaattctcactattgtgttttcttttgctcactgtttaggacaatttttctttaaaatagttttgcagattaaaattgcttaaataagtggattaaaaaactgacaatgcatgctactgttctctttcaaaaggaagagcaaccgtgttgaatactaataatgatgaattagtattcagtgtttagaatcattgggactacccacaaagtgagcatttctttttaaattttcttgacatttccaagcttattatgaataatattgcagtgtgtcttgtcagctgtaggtggcaaaggtgcccttataaaaaaggaaactggcttttcaaaatgggctatgggagcacaagctgaagctttagtgccttctacaatgtggtatactgttttctagaa

SEQ ID NO: 4388 - DNA, 1226 bp, Homo sapiens
gttctagagtaactggtttgtttttttcttcttttccatttatttatttagagacagagtttcaccattgttgcttaggctacagtccagtggtgcaatcttggctcaccgcaacctccacctcctgggttcaagcgattctcctgccccagcctcctgagttgctgggattacaggcatatgccaccacgcctggctaattttgtatttttagtagagacagggtttctccatgtttgtcaggctggtcttgaactcctgacctcaggtgatccgcctgccttggcctcccatagtgctgggattgcaggtgtgagccactgcacccagccatggtttgttttttcttaggaacattgtttttcatgcatctcatcctgtttcttcttcacgttgtccatgaccacacagccacaaggcctcgctatagtgcctagaatttcgtatcatggatttttgttgttgttttgattctttaaaaaaattaaattcagtcttgtgctcatcttttttaaattttagaagattcctttttcctgctgatttcttccctcgtagaaaaaaatgcccccctttttggggactgctgtaggtgctttttgggacacattagggagcaaataatcataataggcactcagtgaatgttgaagccaatttcatgtggtcttctcagcaatgagcaatggaagttgtttacactttgttgcagctacctgaaccttggggctgtgtgagaacgttgggctgggcccaaggtagggcttgagtggtggaatcagctgtatctaccccagttactctgtgcggcccaaccaggcccaatattctgaagcccagtgtgagccctctgcttccttctcttaggacagtgctcttcagggctccctggtggtcccgccccatcagtgctccagatgtggccagatgtgcagaaaacccaatcctgcctctgggatgcaggtcctgccatcctagtattgtctttgaaaagctttgggccttccttcacaagtgagagaggtctacagcttctcattgttgtacatcaggtacatcattcttgttagcctaggttataccacacacctaaagagcaccaaatctttctggcttaaaacagcattatgttgcctatcacaggtccacaggggactcaggctccctgaacagccgccatttccaaccttgctggtaaccgtgccagagtgaaagagctctgggaa

SEQ ID NO: 4389 - DNA, 1197 bp, Homo sapiens
atggagtcctggtgaggtcagggctatatgtctccccagcagctggctcaggagcacttttattggctggatgccctcactggaattaccagtgcaaacggtcattcatacgtcaatgtcatcccaccctcccatggtgacacagaccttctcctactgaaaccacatgctgctttagtccaaaataagctctgaaaaagtaataaacattattttatttcattttatttcattttattttattttattttattttattttattttattttatttttattttgagacagagtctcgctctgttgccaggctggagtgcagtggcatgatctcagctcactgcaacctccacctcctgggttcaagtgattctcctgcctcagcctcccgagtagctgggattacaggtacacgccaccacactcagctaatttttgtatttttagtagacatgggatttcatcatgttggccaggatggtctcgatctcttgacctcgtgatccgcccacctcagcctcccaaagtgctgggataacccttacctgtttctcctttgcagggcagatagaacatgataattggagatgcatgaaacgtgattaatctctctgtataatcaggacttgcaacacacttaattttttttttaatagtgaaaattttattggagatcattgaagtgaagactgataaacacttgccctgggtgggttacaaccaacttttctttttttttctaagttttttaaattatattttaagttcttggatacatgtgtaaaacgtgcaggtttgttacataggtatacatgtgccatggtggtttcctgcacccatcaccccgtcatctacattaggtatttctcctaatgctatccctcccctagcaccccaactccccaacaggccccagtgtgtgatgttcccctcccagcgtccatgcaacacacttaatttctattgcatagtactataggggttacagaaagcataattttaagataatggatttatattctatgggcttctttctaaaaccttataattcaaatatgaatataagacaaatcccctccctgagctcaggtcattttaagagataacacctactatggaccacatgttcttcgaggcacaagagatacaaagatggataatgcatgagcctgcccttcttcagattctatgaaaccaga

SEQ ID NO: 4390 - DNA, 1547 bp, Homo sapiens
caggccagtctgggcgcagtggctcatgcctgtaatcccagcgggcgggtggatcacaaggttaggagatcgagaccatcctggccaacgcagtaaaaccctgtctctactaaaaatacaaaaaattagccgggcatggtggcgggcgcctgtagtcccagctactggaggcggaggttgcagtgagctgagatcacgccattgcactccagcctgggtgacagagcgagactcaaaaaaaaaagaaagaaataaactgactttttcaactaaaatctttcttgggggatatggtgtcattaagattttgctatgggagaatgtctttctacctctccttcatcatagctctgtgtctccttttcaaacattttattcaccctattgaaattcccattgcagaataattgtgtgcccaagaagatgctgcagctggttggtgtcactgccatgtttattgcaagcaaatatgaagaaatgtaccctccagaaattggtgactttgcttttgtgactgacaacacttatactaagcaccaaatcagacagatggaaatgaagattctaagagctttaaactttggtctgggtcggcctctacctttgcacttccttcggagagcatctaagattggagaggtacaggtttcttgagaaacctctccgtatgggtacattagggggaacactgctgctgaccaagcacgttgaattcaactgacctgtattatacctaactacatggggaagggataaagttgttctttatttctagtcaggctgcatgttaatattaggactttccatgggcatttgagagtttgtagacaaacatttgtagttaaagatacatatgggcatgcaggttagtgccaaaggaaaattttctgaaagaaactcagtaacatgggttttgtttcaggttgatgtcgagcaacatactttggccaaatacctgatggaactaactatgttggactatgacatggtgcactttcctccttctcaaattgcagcaggagctttttgcttagcactgaaaattctggataatggtgaatgggtaagctgtgtcccacagaactcctaagcttttaaattttaaagagtgactaaatacagaacttttgttattaaaaggcaattcaagtggttcataaatatgggatctactgaaggaatagttaaaaaagatgtcttagaatgtttccacatctttttgtttttgagacaaggtctcgctctgtcactcaggctggagtgcagtggtgcagtcttggcccactgcaacatcagcctccagagtagctgggattacaggtgtctgtctagtttttaaatttttttcatgtcagatgggtaatatgcccacattgtaacaaggtttgagggtggcacgtttcacatgttcacatgaacaccaaatcatcacacttatgaactacaaaagagtcgcccaccagcctgggcaacatagcaaatcctcatctttacaaaaaatatataaaatatatatatatatatatatatatatatatatacaggca

SEQ ID NO: 4391 - DNA, 1189 bp, Homo sapiens
tcaactgatctgcccacctcggcctcccaaagtgctgagattacaggcttgagccaccacacccagcctgcaacttgttattctgagtcaacattatttccgaaatcctctatatcgtatgatacatgtagatccagttgattcatgctcgttgattattagattccattatatgactacactgaaattttctatccaaactctcgttgataaacatttaggctgctttttaatgttttcctttaatacattccttctctggatagtcatctgtgagtcatcttgtatgcaggtttgagtttctctagagaatgtatctataattgaaacaaattatgaattgatgcttcagagtatcacaaccatcagctttaccagatatggtcaaattgctctccagaatgattggaccagtttactgtcccaccacattctcaacatcatttgcattgtcagactttaaaacgtttgtcaattacgtagattgaaaatggtatgtacttattgtttcaattaacatttctctgattactggtaaagttcatcatcttttcttacacttactggcttcttagattttctcctgttttctgttggattacgtactttttttgtcctattgatttattggacttattcatactttttgttttttttaatagagacaaggtttcactttgttgtccagtctggtatcaaactcctggccttaagcaatcctccagcatcggcctcccaaagagctgggattacaggtgtgaaccacagcaaccagccagaattcttttatattctggatattgatcctttgtcagaaatacacattgcatatatcatttcccagtctttggcaaggcttttagtttatttatggtatctttgaggtactgaaagttaaattttaatatgattgaatttgttaatttttttgaaatctttaaaggcttcctttttatgtgctttcctgtttctggattacaaagaattctgtacttgtaaaatttttaaaatattgattttaatacttagatctttattccatcaacaagtttttcctttgttgtatgatatgaggatccagtattttttttttttttcaatagagacagggtctttctatattggccaggctggtcttgaactcctggcctcaagccatcctcctgcctcagtctcccaaagtgcttgg

SEQ ID NO: 4392 - DNA, 1334 bp, Homo sapiens
aggcgtttccatacatcctctgacatctaggcagaggtttccaagcttcgatttttgttttctgtggacccacagggtcaacatcacatggaagtggccaaggctgggggcttgcatcatctgaagtaacatcctgagttgtaccatggccccttttagccattgctggagtgtctgggatgcagtcctgaggatgcacacagcagggggaccctggacttggcccaggaaacagtttttttccttctaggcctccaggcctgtgatggaagggactgccatggaggtttctgacatgccctggagacattttcccccttgtctgagtgaataacatttggctcctcgttacttatgtaaatttctgcagccagcttgaatttctcctcagaaaatgagtttttcttttctatcacatcatgaagctgcaaattttccaagcttttattttctgctttccttttaaacataagtttcaatttcaaaccatatctctgtgaatacataaaactgaatgcttttaatagcacccaagtcacctcttgaacactttgctgcttagaaatttcttccagtgcggtaacgtgaccgatcccggagaagccggcgggagccccggggagagttctcttttctttgtgaagggcagggcgccctggaatgggttcgccccgagagaggggcccgtgccttggaaagcgtcgcggttctggcggcatccggtgagctctcgctggcccttgaaaatccgggggagagggtgtaaatctcaacacattcaaaagctagcagaaggcaagaaataactaaaatcagagcagaactgaaggaaatagagacacaaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacacaaataaactagaaaatctagaagaaatggatacattcctcgacacatacatcctcccaagactaaaccaggaagaagttgaatctctgaatagaccaataacaggagctgaaattggggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattagatgaggccagcatcatcctg

SEQ ID NO: 4393 - DNA, 1099 bp, Homo sapiens
gtcatggtgatgcaagtcactaaatttctcagtttttgctgattgctaagggaaataacagtatttccacaatagggttcaaattcctgcaaaattacctaccccagttcatctctgctgaacatttggaaaccatgcactagccaacccaactgacttctgctaggtagaggcatttgtcttagagagagagagagcgcgggagagagtgagagagagtgagagcacaaagataacgcaggagagagagagagaaagaatgagaaagaaaaggaatgcaagagaaggagatgtaatgacagagagttctggtgagatacccagagagaaaaagagagagcagggtggggtaaggaggagaaaataaaccaacaattaggtctgcattttctcaggcagtaggcattctttagtctacataggcaaagttttccatttttgtcagtctgagtcatcaaaaagagtcttaattttctaaaacaagttggctagaagaaagtaaaaagaacaacacttgttatgagggcatgtgatattttcacatcttaattaagctccttcagtttgaaggctgcacactgacataatgtagtgagtgtagactggccatgcaagtggtttgggccccattcagaactctcagactctaaacacacaagtagattgatctaaggcatgctcccagcatttgtccacccacttagtccactctgagtcgattaacctgcatgcagcaacacccaagtccaccccaattaactgaagcaaataccaaagcagttgggagtacatatggtagacaatttgccttaggaagtgacttgaatgtacaaagatacttgatgcacttattttttaatgtgagacagcaagtttataaaacatccatataggattatagatacttaaaggaacacgtgggtgagcgtgtgtgggggtactagaagctgatctgattggtccaacagtttgatgctgagtcatgcgtgttgaatcccacttcagtgcacctgtggcctctcagtcaaacaagttgtgcctttcacagcttctttactactgcaagttcaagactgaaatggcttctatgatcagaact

SEQ ID NO: 4394 - DNA, 1210 bp, Homo sapiens
tatgcaataactatctctgtttctaaagtatttttattaccccaaaaggaaagctcatattcattaagcagttattcttcattacctgcttctccggctgctggcaacctagtctactttttgtttctatgaatttccctattctggatattttatgtaaatggaatcatacaatatagacctttgtgtctggcttctttcacttagcatgttttcaaggttcattcacattttaacatgtatcagtactttatttctttttacagtggaataatattcctttgtatgtatatactacattttatttattcactcatctgttgatggatgcttgggttgtttctatctttgggctattgtgtatagtgctgctacgaacatgcatgtacatgtacttgagaacctatttttagttcttttgggtatctacctaggaatagaatttttgggtcctacagtaattctgtctttagctgttttaggaactgccaaactattttccatagtggccagctgcaccattttacttttgctccagcagtgtacaagtctttccacattctcaaccaatacttttccatttttctagtcatagctctcctaattggtatggagtaatatctcactgtggttttcatttgcattttcctaatgactaatgatgttgagtaccttttcaggtgcctattttggccagttgtttatcttctttggagaaatatctcttaaagtactttgccatttattaattgggttgtctttttgttgttaagagttccttatatattctgcatactagatttttatcaaagaaattgcaaatatttcactctgtaagttgtctttttgctttttttgataatatttaatgcaaaaagtttttaattttgatgaattccagtttctctattttttcttttgttgttaatgcttttggtgtcatatctaaaaatccattgctaaattcagtgtcatgaaaatttaccccatgttttcttctgaggcttttatggctttaagttttatggtcattgattcatttgagttcatgttactactatgcacaatagtggataatattcacaaattctgaaagtgcctagcctcaaaggtcttatggtctaatgttctttaattcactgtgttactgatgaaggaaatccctaagaaataatcaaggggaaatgcttcgttttactagacattgcaa

SEQ ID NO: 4395 - DNA, 1120 bp, Homo sapiens
ggagagaaatctccatacgtaagtggaatggaatttagaaggaaggtgggtttcctctgagtgttggcaactcagctgaaaggaaaggagaggatatagaaacgagttatgagattgtttcttcctaaactgtatttcattataaacctatctttaagtgccatttggttcaaactacaatactctgtgtctttaaatttgaaaggttagaagtaataatactagggagagaagaattggttttatctcctaatgagtactttcaccttccataaggtttttgaacatgtttaggagctgactttatctttggaattatttaagcacttaggtatcatctgacttattttaaaacagagattggtgaaattgacttatgtaggcatttttatttcttgctgtgtattagtagaatacgaaaggtctttcattttagtttatgttaagtagatacttaagtattctaattgtgagggaccactgcagttttcagtatagaaacagcttttatttagttgctttactacagatgaaggagcttcaaacataactgcagtgtattttcaaatgacatgatgtctaggatttgataaaaaagcaattaggaatgtgaaggtggttgtgggtagaagtatggatgaaacaagattgaccatgtattaatgactgctgaagctagttaatggatacatttagttcattatatttttctatttttatatatgtatgtgaaattttctattttaaaaagtctgtaatattaactagataaaacagctatgagcttgaaataagttagctaaaaatgagttcgtttttgtccctcctgccttcacacccacctccaccccactttttgatatgtattagtgaaggtggtggaaagtatgattgacagattcttcccaaagaggggagaaattattttgggggcacagcattaagactaaagtattggccaggtgcggtggctcatgcctgtaatcccagcactttgggaggccaaggtgggcggatcacgaggtcaggagatcgaaaccatcctggctaacatggtgaaaccccgtctctactaaaaatacaaaaaattatccgggtgtggtggtgggcacctgtagtc

SEQ ID NO: 4396 - DNA, 1228 bp, Homo sapiens
cagtcgtccctcagtatctgcaggggattgtttccaggactccccttggatacagaaatccagcgatgctcaagtcccttatataaaatgatgtggtatttgcatatggcctatgcacctcctcccaatatactttaaatcattttaattgtttttctaaatacttttgattcaagattggttgaatccatagatacagagggccaactgtatatatattactttccggcaggatctcagaatgtgcccagtaaagtccattcacaacattgaccaggatgggagcatgaaatgaatctcttcaatttgagggaaaaatatgaacacataatactcaatctgtcctttaaagataatgtttcttgtagaaacgcttcctctgagtaaacctgacctgattggctggcaaactaacaacaatgaatggcttccaaaagagagggttggggtggggggaggggaacctgctactgtagaaactagtagagcaagctcataaatgatcaggatcctgttgagcgcagtttcaagcattcatcataatcttcagtatacccagaaagtttagcatgtgtactttattcttcctagtgcctatcttcagttgccacagcactgcagtctggattccttccgtactgtgaacctgtgtatcagcgttgtgtaaacctagtacagaagactcttgcacaagccatggtaatttttttaaaatgtcttcctcttcttgacatggtggacatttttctaaagataggtataatgtatacagactttttaagtagttaattaaaaccaaacttacaaaaaacattgtgtctaatttcagctaaacaatgctcaaccagatcaatatgaagctccagataaagattttatgatagtggctcttgatttactgagtggcctggctgaaggacttggaggcaacattgaacagctggtagcccgaagtaacatcctgacactaatgtatcagtgcatgcaggtgagacttgaaaggtgaaaatgaattgaagcctgtttctctgtgtcacattggggttaatttcttcttatttcttgtaggataaaatgccagaagttcgacagagttcttttgccctgttaggtgacctcacaaaagcttgctttcagcatgttaagccttgtataggtatgaatattttctactgctatgaatatggttttttaaagttaacatttacatcagctttgtttttttatt

SEQ ID NO: 4397 - DNA, 1208 bp, Homo sapiens
cctagatatatgcacacagggtgcaagttaaaagctacagagtgaaagttggtttggatcctcttcatttcatttgtttagcttttctgttatttttctctacttacatgtattcctgtgaataaatccttgttaagttaaccctttacttttccttccatgtgtattttcttatatactgtgaatgtgaaaacctaactggtacacttgatcttgtgttcatatgaaagtgcaagtctttattaatttggattgcctgaacagtgtatcccatgatgatgaaggaaaatggagagatttttctttttaactctgctggtcagagatgaagccacgcctttccatttttcaatgctgcatatttaatctgcaacaaaaatgttaagccataacagcctttttatattttagtttgtcacctttgcattgcagaataaatactgaataaccatttttataagcagttgctcctctttgcatggttctattctctaaaagtgttgaatgatacagccattgcactgaagtttgagctgtgtgcgtgtgaatttatactgtttcaaaaatttcaaatgcatggtagcatgtagaaaggtttttgttactatgtgtgtgtgtgtgttttgttttgttttgttctgttttttaacgttctttcacctttcctctactttggctttgcaaatttcagtctgtagagcctgaaattaaattattttatagtgcctgatatttttaatattataagttggattcaaagggtatacagcattttgttttctagtaccattgcttcactgggagctcaaaatttgcctccctgttagtctttaataactgagtagagtagcttttttattcttagattatagtgatattctgtagtgcttcaaatacttagaattctaatatgagagatagtttaatattctggaatagagagtattttaaattgaaatgaccaaattcgatttaaaacaaacacataacaatcttcagtaaagttatttgaacctgtggttgacaattctgtattgactaaaggcaatattgtcacctgtctcattaaaaattagtttccagttaggcagatgaataacactattaaaaatgcacccagttttgtagtcacttgactttttttttttatttaaatgaaatttaatttgaaaatagaaaataaaattaggtaaatatgactggcaacc

SEQ ID NO: 4398 - DNA, 1194 bp, Homo sapiens
tcactctaacttcgtgttcacactccatgtgtgaatggagttcaggctgggagacaggcagaggcctaggagaactaaaacagtgtttgtggtggagcggcaggacccgccagagccacagatatatggtgatccaggaggctcaaagagaagccaagtcagctttgttgtgatttgatttttttttttctaaactcttgtacaaaactgaaaaaaaaaatgctatttatatacaggtaaagtattagggacatgtatggggacagtaaacaataagcacatgatggaaattacttgtgatgagaatgtaaggggaatgggacaggagctgactttattcaaaataaaataattactttaaaaaatgtggtcaggcgcggtggctcacacctgtaatcccagcactttgggaggctgaggtgggtggatcacgaggtcaggagatcgagaccatcctggctaacacggtgaaaccccatctctactaaaaatacaacaaattagccaggcgtggtggcgggcgcctgtagtcccagctactctggaggctgaggcaggagaatggcgtgaacctgggaggcagagcttgcagtgagccgagatcgagccactgcactccagtctgggcaacagagcgaaactccgtctcaaaaaagaaaaaaaaaatgtaagtcacaggagcagtttactcttggtagatactataacattcatgcccaacagtgaattggtatgggtttcatatcattaatgcaaatgtctatgatctaaattagttaaaactatccagaggattaaagtactgctgggttaaataccgttgtcttcttttttgtgaaccccagtgggctcaccatagtacctagtatgccgtgaccactcaaaaaatatatgatgactagcgattacacataaataaatgattctgagtcttttcatgtaaaccaaaacaagtttaatgtaatgatttagatgcaattaaaggattttttttttttttgtctagagatgaggtctcactgtgtcacccaggctggagtgcagtggtggtatgatcatagctcactgcagcctggaactgctgggtgcaagcgatcacctcactgcctcagcctctcgaatagctgggatcacaggtgtgaatcatcaggcccggctcatgatttcttttttattaaaatattgagcaggagt

SEQ ID NO: 4399 - DNA, 1183 bp, Homo sapiens
agaaggtggttcatagaacagccacagcagatgacaaaaaacttcagttctccttaaagaagttaggggtaaacaatatctctggtattgaagaggcaagtatcaaattttgttactttaaaaaacaagatttggctgggaaaagttaacgttaatgcattaaatgggttgttttttttttttttaacttagggacttcaaagtccctaagatgtgtttctaccataaattaataaatatcagggagctcattaagtctgaatgctattagaatacatattccattccaggcaaaatttcacctgtgcttcacagtgaaatactagttagccagacttagtttaataaaacatttgtttttaaagagactggtcagcattgctaatttaaatttttcttttcttaataggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatgtgagtttcctagtaatggttttaccagggaattactcatttagcagctgatttctgatctcagggctcagaatggatatgagtatttttaagtttggaaatgcaagctttaaaaataacagatttgtaactgattttaagcaactgtccttgctcaagtttgcagtaattgatgtagcgtgccatgattgttacacttgattttgtggaatgttttctacttacttgatttggatcagatactttattaactagaaatgatgaaaatgttaatttggtgctttgccaataactacttgtaagtttggaattgaaaaaaaaattagtgtaaattatgaaattacttcagtttcatctatatagttcgtattaccagtaatcttttaaaaatggcttgccagtattctggcatttttaattacagtgtgatagggattttattcggggcagaaaatagtgtagctgaatatacatctgaggatgtggcagtgttatgctgttttctgtgcttaaaattttgaagaataggaatgcaggaggaagtcagaggcttatatatggctctttagtta

SEQ ID NO: 4400 - DNA, 1142 bp, Homo sapiens
gcagtggcccctattgagaagttttccggtagagttggaaatcagttgtgaatacattctttgctagttggagtgcttgtttactaagcatgtgccgtcgtaggtattagtgctagtctcagataggtgcttcccctgaggtgcaggggaagaccaaagtttgcaactcgaactgctttcgtccatgtttctcacattgctgtattttagaaaataggggttaagactgataacaaccttttacattgtgactgtgtttgcattgtctaatgacagataaatccttaacatttctctccaccttagtactttagactaattgtgtttgtccgtccatgccatgaatgagtgggctgtagttgggcctaaataaatgagctgttggaagaaaagaatcacagtactttccagcagtcagtccctggttcctagatgtgttctaagcaatgcaaatgtctaattgtcccccagtgggcatagtcagtgtcgtttatattgtagcagttacagctctgtagtttatgatgcaaatctgccaagagagatgtatgtgtcactgcatggcttctgaaagcaggatgaattttctgcagctgtttcaaagttggggtctgttcttgaatcctctattaattactgtgtgtgagccagagggagctgtggtaagggttgggcccccagcctgtagggaactttctggactcccactctttgaatcgatataggcatttggtctcactacttgaccattctcaccctgtgaaacgtcccacactttgaagcaaatacaattcacagcacagtacacacaaaaaccttggcataagacagagaaggttcttcttattttgtgggctggttgctgtagaaacacataacaaagggcagccctccacttctggtataattgtgtagccccttttctttgggcttgacacctgtcttgaataagagtgattagagctgcataatgtccctctcttggctattgaccatgtggttcacgtacaaaactctgtataagttgaaggaaaatgttcatgttcatatgtacttgtttgctatgactacattttgaggttttgtaaaactgttatttttttttttttcacaatgtgaaactgaaggtcaataaattatta

SEQ ID NO: 4401 - DNA, 1196 bp, Homo sapiens
tcccctctgggaggtgaggagcgtctctgcccggccgccccgtctgagaggtggggagaccctccgcctggcagccgccccatatgagaagtgaggagcccctccgcccggcagccaccccgtctgggaagtgaggagcgtctctgcccggcagccaccccatccgggagggaggtgggggtcagcccccgccaggccagccgccccgtccgggagggaggtggggggggtcagacccccgcccggccagccgccccgtccgggagggaggtgggggggtcagccccccgcccggctagccgccccctccgggaggtgaggggcgcctctgcccggccgcccctactgggaagtgaggagcccctctgcccagccaccaccctgtctgggaggtgtacccaacagctcattgagaacgggccatgatgacaatggcagttttgtggaatagaaaggggggaaaggccgagaaaggattgagaaatcggatggttgccatgtctgtgtagaaagaggtagacacgggagacttttcattttgttctgtactaagaaaaattcttctgccttgtgatcctgttgatctgtgaccctacccccaaccctgtgctctctgaaacatgtgctgtgtccactcagggttaaatggattaagggtggtgcaagatgtgctttgttaaacagatgcttgaaggcagcatgctcgttaagagtcatcaccactccctaatctcaagcacccagggacacaaacactgcggagggccgcagggtcctctgcctaggaaaaccagagacctttgttcacttgtttatctgctgaccttccctccactattgtcctatgaccctgccaaatccccctctgtgagaaacacccaagaatgatcaataaaaaaaaaaaaaaaaaaaaaaaaaaggaaaatgtgtgactgtagcttttcttaaataaggaatagggcctacatctggaggagtggaaagctggacaaagggttaagatctatatagagcgatgggctgggtatcagaaaagggggaaagaaattgctacagcaaagaaggaggatctagctgggggagagaacctggaagaagtgagagctggttccaagagaaggaacagcctgcagaggggtgtgaatgcacaactagtaggatagcactagccagtagcacttttggtgatgatggga

SEQ ID NO: 4402 - DNA, 1176 bp, Homo sapiens
tacatgtggctcctgttatatttctatatagaggacagccccggtagagacaatattgtcagttcccatataaggctgctgctatggcctgaatgtgtgcccccaaattcatatgttgaaacttcatcaccattgtgatagcattaagaggtggatcctttaggagatgattaagtcatgagggcagagctctcatgaatgggattagtgaccttataaaagggctggagggaactaggtagggccttattgaccttccttccatcacttccaccaacggaggatgcagctacaagatgccatcttggaaacagataaccagctggtatgggacaccaaacccaccagtactttgatcttggacattcagtctccagaactgcgagaaacaaatttctgttctttataagttactcagtctcaggtactctgttataggggcacaagagactaagacagctgtgtgcccagggatgcacaaaaaattctctcacatcctcagtcaaggtacaccattatttcatttacatgacaactcacttctttccccctgcaaaatcccctaggaactgtagcagacatggtaagaattgacacattggggctgtatttggggagacaagataacatacagaacaataatatggaagttgcctatgtatatgagacacaaaaacactgagcttcctccatctgctattctgttatacatgacacagaagtgatatggacagtaagtgctaggggcgttcagaagaaaaattaccactatttgggtgaccaagaaatctgcagagaaaagataagctctgggttcatctatgaagaccaggtagactttaaaaggagtaaaatgataattgagggagaaaggaataagaaaactattccagagagaggggattagcaaaagtatggctgcgagaaagaagggccatgtttgagagaagaggacctcctctccacccagtcccttgagctcagctccatccagaacagagggtatgtgaaatatgtgccttatccctcagaggacacatatttgcttctccctgagcaggctgacattaatctgaggcacacagacaccccactgagtgaagttctgaggcagagaagtcaaagtctctggtgacactccctgcccagcccccacctacacaaacagctctgtgg

SEQ ID NO: 4403 - DNA, 1147 bp, Homo sapiens
ctcatatttctcgtctgtttttctgtcggtctttttgtctttttattgtgtttgaagagctctttgtgtgttacggttgtggctgaagtgtctgaagaggtttctccccctccacattgcaggggcagctgaaatgcactcgagttttttgttttttgtttatactttaagttctagggtacatgtgcacaacgtgcaggtttgttacatatgtatacatgtgccatgttggtgtgctgcacccgttaactcgtcatttacattaggtatatctcctaatgctatccctcccacgccaccccacgacaggcccctgtgtgtgatgttccccaccctgtgtccacgtgttctcattgctcaattcccacctatgaatgagaacatgcggtgtttggttttctgtccttgtgatagtttgctcagctaaccaggctgttacggcctgtggccatagactgctggtcactcagcagatactgagactgaggattgtattgagctagaatatagccgcatgatgtggaggactgagaaggtgaggcagttttgccccgtgctgccttccaccggttaagacctccaaaatcgaagggctgcccaggcagaggatgtccccttgccacccttggaggggcagcgctgtgctggccgacatttgtgatgcagcctgtccctggctcaggtgaggcttccactaggtcaaaaggattaagacatcgaagtcagtgcttctcatccttgtgcccactttaactcctaacagatggcattcacctgtgcgacactccctctgggcattccagtttttaaggaaacccagagaggtaaaaagcatgacagtaatcagtcacctctggcactatcaggggcacatcagtaaggatgactctcagactttggcacaagtaagagaatctgcgggtttatgtgcagtttccaagctttggctcaagaaagcatatcagaatgcaaagcaatactcttgatgttataggaaacgtttacatcccttttaatttataaagtaaattagtcgtaaagattcattataatagtctctgcacttttgtgtttgtccagtaataaaaaaggacctcaggaaagatcagattcaatatagaaggaaatagaaattttaaaaaagaaa

SEQ ID NO: 4404 - DNA, 1758 bp, Homo sapiens
ccttccccttacttggggcattttctccctttgaagctttttctgaatttctgtgacatgtcatagtctatactgcattatttagtacctgattacataatctctcattggtacctttattgtttcaattatgatttgcttttcagaatcttcttgagggtagggaccataaacgtagtgctgacacttaacacctatggattgagtatatctacttttatagagagctgaagccagtgtttatcttgggaaatttagaattcagacattttttccatagccattatacagtataagtaatggttaagtaaaaccaatacttgaaaaatcagatgatgaaaaaatctggaagaactatgagaattcatgtactttacaaaaatagctattctgtagttgaacaatattaacaaaattctgattaaaatattagatattatttgtatgtgacttaccaatactgaaaaatgaaatgaagttctacacccagatccaaaggagtctttaaggcacatatctcacacgcacatgtgttaatgtggtattagacacttctctgcttttcggggtccctataatcagttttaattttctttacagatgtttctatactttgaagatcatggactagtgacgtgctccgctgatcatctcattattttgtggaaaaatggagagcgagaatctggattgcgcagtttaagattatttcaaaaattagaggagaatggtgacttataccttgctgtctagtttaaggaattaaaaatacacatgcatgaaccttgaacatcaaatatcgggtactactctgaaaaccattaatatattgatcacttaaattggtaattttttttgtcagtccataaaattctacatgtttaaattttttgtggacctaccaaccaggaacatgttgcttctcaggtcctagtatatcctccaaagaatataccacaagtttttccatttgactttgagctgctgttgaagtggtgagtgctgtgttttgagcttattttgaacctagatccttgtgaaaggtacaaatagaggtaatagttaagttatggcatttattagaagttttattatttggcttcctttagaattattgtgaagtttaaaaatagcctttctcctgcaaattttcctagtctttagtaactgttagtgttctatatagcacaaacttgaatctctcagccaaaaaagggaacatatatactgtttaagtatggcaagttttctttggtaccaatttgtttagataattttaaaaatgttttttagttctagctactaaaacctgtatgaactcaaatggataggcatcttgtgagggtgtgtttttcccagtgtgaattggcttgaagagccatgggctaaatgggtactagaacaacaactgcccctcatgtacgccaaggatgagctctagatcatttgagaggcacagtgtttccggagtcagggactgcagctgagcgcaactgccccatctgaccactgactcaaatacgaactgcttgagacagacttcttttatgtagttctttgcagtgtccattgagacactataaccagccttgtaacaatatgttttctccttttggtgctaaaaaatgaaaatattagaaagtagtctacacattaaagattgaaattcttaaactactgatgaagaaagggcaacgtgacagatgttagcagactgacccttcttacagaaaacctacagatttatttgttcattat

SEQ ID NO: 4405 - DNA, 1123 bp, Homo sapiens
gagataatagacaaagacatttaataagatgaaatacagatatagccaaacagttttaccttctcagttggtgattacaaacagcaagtggttggtgatagaatgaaatgaaaaatatctagatggtgtccttttaataacatggagcccgtcatacacaggcaatacatctttaactgtcatcgcacttatttgttctcatttgtggtgttactgcttttcgaggttgattggtctccccgtagtccctccctgtgttacagctccattcaaaaaggctttgtatttttcattgctggtgtctctttagggagaggagagtaggggatatttaaaatgttttaaatctttaaaggcagaaatgtaaaatatatgaggaatcaagtccgcacgctttgaattacgcattactacaaaatcaagtaaacaatttttgaagagaggactcttccttcttaatgtttttggaacaataatagattatgtgtatattaggtaaatgggaaaaactttatctgttgactgataaaaacaaattattatgggtgcatttttgtatatatgaagataatttgtgtgacctggaatcagaatgcttgggttcagatttctgctcaaccagaaatttggtgtgtggccctgaggaagttcttcaacttctctgggcctcgcttgcctcatctataaagtgacctgcctcataggattaaatgaaataattccagtgaagcacttagaacccactgccagaacacagtaagtgcttaacaaatgatagctgctatcatcattatagtgatcaaaaatttctcatgccttttgaaaaaattttgtcacagtgtgatcttagttcaaggccaagcacagaggttctgatgtcagccattaagtttagtatgtaaatatctgacccacgctgactttataatcaatgtttctgacatcccaaagctagctatttattacttatgaattagtactctttccataactattttttgcatgtatgttgaagcatagcctgtgcaggagttaaatgatgaataaatctggggtagtggtttttgccttccgagggccaaaacaaaccaattttgatcatgctgtgttccaattaaatata

SEQ ID NO: 4406 - DNA, 1170 bp, Homo sapiens
ttcccagcctccagaactgtgagaaataaatttttattattaattatattattaataggcttcccagtttatggtattttctaacagtagcccaaatggactaagacattttgcagtttgaacgcatggagtggcttgtatgctctgctaagtagtatggaccttgtcctgcagaggaaagggaaaccacttttaatagtagtataatttaccagatttgcagtttagaatattcattttttaagtccattgactttttgagcagctgttaataagaggaatcatttttgcttccatgtacgaaatagggacttttcctatatctgaattgctattctctgtgagtggacttacctgtttagtaaattggaaaaagattcttgctcatttgcagctaggcttcttgggaagctttatgctctgtgtcctatctatttttctctaattttcacttttcctctgactcttacttttgcctttgtgattttttttctccacctcccctctctttgtttttgtccccttccccaaaactctttctgcctagatatctctctgacatccttcatcccttcgtgccccgcccccgtactacagtccagtgtgtttgtcattgtctcctttctcttccatccctgtttgtttctctctttttgtatttgctgtgtatctctctatatgtgtctccctctctgtctgcctttcctgcttccccatagaccacacttattttctagtaaactaatgtttgcctttcagaatccttaggtcgattcctcaaattcatttctatatgctttgggattatcttcatccctaatcgtgatatgagttatcttattatagcttttgctgattcatctacaagatttgtaaccagataattgcaaataatggagcatatttccattatttagattttgtctttacattttaagtcatctttaaaaggaatcagttaatcctttccaagtgtctgtagatttcttcatacattgagatgctttctaaaaactgagtaaagaaagacctatgtttgctgttgagtttcatgtttcttgataaaatagagggagttttagcctgaaactccatggtgttcactaaatccctgtggtatggcaaaagtcaatatgatacctagactcttaggatttttttctgtctggt

SEQ ID NO: 4407 - DNA, 1151 bp, Homo sapiens
gcacttgctagctctgtgactttgggcaagttatataaacctctgagccttactttccttatctttgagagggagataattgtacctaggatagatatgagaattaaacgagtaatataatgtagatgtagggccttacacatttaaattctagctggaaagttatagcagattgaggtgaagaacaaaagctgtcgcaggcagttttcctttcatattctgtatttcctaattaattttaatactagccagaatgacaagggtacttttagaaaagaaaggctgggctgggcgtggtggctcacgcctgtaatcccagcactttgggaggccggggtgggcggatcacctgaggtcaggagttcaagaccagcctgaacaatatgatgaaaccccgttctctactaaaaatagaaaaattagctgggcgtggtggcatgcgcctgtaatcccagctactctggaggttgagacaggacaatcgcttgaacccaggaggcggaggttgcggtgagctgagatcatgccattgcactccagcctgggcaacaagagcaaaacgccgtctcaaaaaaaaaaaaagaaaaaagaaaaacaaaggctgaggaacttctccagatgaaagaagaccaaggagacatgaaaacttaaatatgatgcatgatcccagatcagaaaaaatactataaatataggatgttattgagaatttctaaatatggattatttattagataataaataatgcactgatgttatgtttcctgaattttataattgtagtgttagcaattgaaaaacatagatgaaggcggccgggtgtggtggctcacgccagtaatcctagcactttgggaggccgaggtgggtggatcacttgacgtcaggagttcatgactagtctggccagcatggcaaaaccctgtctctactaaaaatacaaaaattagctgggcgtggtggtgtgcacctgtggtcccaacttttcgggaggctgaggcaggaaaatcatttgaacccaggaggcagaggctgcagtgagccgagattgtgccactgcactccagcctgggagacagaacaagactctgtctaaaaaaaaaagaaagaaagaataaaacataaatgaagcctatatgaggcttcagtga

SEQ ID NO: 4408 - DNA, 1108 bp, Homo sapiens
ggcagataaaacgtgttgcaaatttcattcacccctttgccctccccctctcctcatccacttcttctcctgtaccccttccattatctacttctttcaccaaaatcacatcttcttgcatttttgtgcatcttttcttctgaagtatagtaattctttgaatatcttttattctgaccaattagttaaataaaccaaacatttttaaattattcgaaactgtttctaaattgtgttatatttccgtttctaaattgtatgtttcagagagttttcttgtgagtagcccagcttcaaaaaactttttctcctagcttgccatgaataaaaaataaaaatttccatgttttatgtttttaagtctttgactcaaatttcagttgaaatttggttcatcagtaagcatacatcaaaggcagttttaacctcaagatgatattgtgtactttaacaaaagtgtaactattttttatcccccacccctttttttaaaggaatccgcaggcggggatcttcagtctcctttaacaccggaaagtatcaacgggacagatgatgaaagaacacctgatgtgacacagaactcagagccaagggctgaaccaactcagaatgcattgccattttcacataggtacagattcaattcagcaattatgattaagtaaatgtgtaaatatggaaatgtttggtttcaggaacccttgtagttacaagctttgagtgaaaactccaggttgactttgactttttttttttttttttttactgcttctgttaacctcagaaatgaaatacacaaactttttattaatttatagtttatagttgcatagatggactgcagtgaacatttcctttatgtagaaaaaggagcactaggctaattacagtacaaattgtttttcagtgaaataaaatcttgtaagttgcttctacctgtcttttaacatagcctctaaaaggcctcctttattaacctggtttctatttttgtgtatgttcttgaaggttataagttggaatttttttttaagtaggctttccactctgaaattaagctttatcatagtctttgagatgatctcaccacgtgatttcacagaag

SEQ ID NO: 4409 - DNA, 1218 bp, Homo sapiens
taagatttggggggttcctcacactctgccaaatcctatattacagactttacacttatcatcacatgtaattttcccaataaccctaagaagtacccattcaatagttgaggtaaaatgaggtcatagagggtaagtaactcatccagtcacaccagtcctcattgtccagatttccaaattgaaacccaggcctgagtccaaagcccaggctcttttatgggttacatattgttcaggatggtccgcagttaaagaaagtcaccaaaatgtctctctccgacctcaaacttctcccgacctaaatacctaattggtgacttgccatttccattaaatttataataggcatctctaatgtaacgaagccaagaaacttgggttttcctcaccaaatgtcctcttcctaacaatttcctacttcacctcagtaatgcgatcatcatctacccagtggctcaggccagaaaccgagcctgtctcattcccacatcccacttctaatccttgctcaaatccagttctacctctgaaatatacccaaagccaatgatgtcccactgtactcactcctacagccatagcctaaattaaggtaccacgctgtctcctcctgggactacagcaacagcagattgccaggattcgagctccatcaggaaaggatttttgttcactgccgaagcctagaacactgcttgcccctaagaggcaaatatccacttaggttttcctcaccaactgcttcatgaccaactcgaactgctttcctcacctccactctagcccgttacagtccagtcttcacgacatcccaattatcttctaagtgcaaatcaaaccacagctcgcccctgctcagaatcctcccacagcctctcactgcaaccagaattaaatccaaagtccaaaggcagctgacaggttctggccatttctggtcctgctcttctctctgacctcatctaagacaccccagccaccctagactcccttgcctctcctcactgagcagtctcaactccacaggcatcttctcagactccctcggcaaccctcctcaaggctgcttaccacacggccttctgacagtaccagtaccatattcattgtttcattgtttacatgtttatgaatgatctcccctgcccagataggccattgagagcagagatgcttgtctgacttatgactatatagcaggctcctggcaaaagg

SEQ ID NO: 4410 - DNA, 1155 bp, Homo sapiens
cagtggcacaatcttggctcactgcaacctctgcgtctcaggctcaagtgattctcctgcctcagcctcccaagtagctggaactacaggcacacgccatcatgcctggctaacttttgtatttttagtagaagtggagtttcaccatattggccagctggtctcaaactcctgacttcaagtgatccgcccacctcggcctcccaaagtgctgggattataggcgtgagccatcatgctcggcttaattcagagctttgggaggcccagagaggcagatcccttgagcccaggagttcaagaccagcctgggcaacatgctgaaaactcgcctctactaaaaataccaaaaaaaaaaaacaaattagctgggtgtggtggtgcatgcctgagtcccagctaccggggaggctaaggtgggaggatcacttgagaccaggaggtcaaggctacagtgagccatgatcacaccactgcactatagcctgggcaacagagtgagaccccaggtgtgtgtgtctgtatgtgtgtgtgtgtatgtgtgtataaaactacagaaaaatatgtgctgccaattctcttacactgatttcctcctatctcttttggctcctgttttgttgatgtattctggatttttttctaagttcattatgattgaattattctttctcattttaacattagcttttcttcaaaactttattacagttatagtctatttggtatctatacttacacgtatttttgtgtttatgtttaactggaagtgatgcttatttctagcttttccatatcaaaactttcctgcgagttctttattgtgatgcatcaacttaactggattatgtcttcagtattttttagaaaggattcatggttgctatatttcctgaattcccacatatgtgagcctggctttctttggtttgtatgtgtgaatggaagcttggctttttagggtctcgtttcattcaagccttgtgaactttgcatcattgctttttggcacctaatgttgctaaggagaaatgtaaggtcagtctgatttatttttcttggggattacatttccttatggtggatagatattctctatccttgaagttcaacactataaccagaatttgttttattaatgagtaagttctatta

SEQ ID NO: 4411 - DNA, 1177 bp, Homo sapiens
gaacaaacactggtgtgtgcctggtggatgtttgggatctcttagctgagatacgcagaggctgacagtgtcgacagctagaagtgaatgggtgctgataaataataaaagggtgagactgacataaaagtgtgtcgggcgtagtggctcacgcctgtaatcccagcactttggaaagttgaggcgggtggatcacaaggtcaggagttcgagaccagcctcgtcaatatggtgaaaccccgtttccactaaaaatacaaaaaaattagcttggtgtggtggcgcatgcctgtaatcccagctacttgggaggctgaggcaggagaattgcttgaacctgggaggtgtaggttgcagtgagccaagattgcaccactgaactccagcatggagacagagcgagactctgtctctgaaaaaaaaaaaaaaaaagtatataggccatcgattatcctctgacatggtgattgtataaaattatctgtggctaggcacagtggctcatgcccgtaatcccagcactttgggaggcggaggtggaaggatcacttgaggcaaggggtaggtcaaggctatagtgagctacgatcgcaccactgccccccagcctgggtgacagaacaagaccccatctcttaaaaaaaaaaaaaagaaacacacacagaaacaacaaaaaaaacataaaacaccatttgcaaggctgaagcagcagacaactcattagtcatttaaaaacatctcatagctgctagcatttcacattgagaccaaattttatcttcttattcctggtatccccatcagtcctaccagctggggacatgcccaggagcctcgtggcactctgtggtgcctgagcagtgggcagcatctcacccacttgtcaaggtgggatatctggggtcttgaggcttcaagaacagcgggggtttcctggcccttcaccgcgggcagctctgactgtacttcctgcaggcaggtggcctggggaggctggccggggcgtctgctgtcaccatctcagcctgggaggtgcagtggttgtcagcaggggcacagcactcctccctgcaccagcctttagcaagtacaaatcctttgagcaacacaaaatagactcagggtcaaaagtaactttcctaaggaaagattgagaaacagggaaagcattggcagt

SEQ ID NO: 4412 - DNA, 1138 bp, Homo sapiens
aactttggtgttatgctttaaaaatgtttctcccactatctctatgtcacttgacattccagccaaattgaagttgaacaaattggggagtgaatgaatgaattctaatccaactaacttttcttgtacatgtactatgattcaggtactatgccaggtgttttcactgaatccttgcaataaccccacgtatcattatctaaattttacagatgaaaaaatcaaatgacttgcctaacgcaacttatgtagcgagtaagtggcaatctgggagtcaaaagaaagttgtgtgactccaaagctagtgcggtttccaatataccacatttctttatctatataaacaatccttcttggactgactatatgatttaccagtcctcacaatgtttttacttgatcctggagaaaaataattttgtgtaaaacagctcaatgcctttcactgaagtattgagaattatgaacttgaagtcagatggccaccatcctctatcacttgcagaattattccttctgatcaaagagctcttgcgttttttgtttgtttgttgtggctttttttttttttttaagatctcactgtgtcacctaagctggactgcagtggcacagtcatggatcactgcagcctcaacctctcaggctcaagtgatattcccacctcaacctctcgagtagctgggagtacaggcatgcaccaccacactcaaataattttttaaaaaatttttataaagatagggttttgcaagattttgcccaggttagtcctgaactcctggcctcaagtgatcctcccacctcagactcccaaggtgttaggattgcaggcatgagccactgtgcctaccctcaaagagctcttctaaaggcagacttgagcaataatgctggcttttagggagatgattaggtgagctgaaggggcaaatatggatacaaataatgagattatgtaagcaaataagggaagtgaatgcctgagcaggtagaaagtatacctgcttttcactgttctatatacacaggtcctgtgaagtcatagactgggtgagtgaagatgatcagctgtatcacatcacctgtcctatactgaatgatgacaaacccaaagacttggtagtactcgtatcac

SEQ ID NO: 4413 - DNA, 1116 bp, Homo sapiens
ggaaagaccaagatcataaatattaatggtgaaaacactgtagtaataaattttcatatgccaaaaaatgtttgtatcttactgtcccctgttctcaccacgaagatcatgttcattaccaccaccacccccccttattttttttatcctaaaccagcaaacgcaggacctgtaccaattttaggagacaataagacagggttgtttcaggattctctagagttaataacatttgtaacctggcacagtttccctcatcctgtggaataagaaaatgggatagatctggaataaatgtgcagtattgtagtattactttaagaactttaagggaacttcaaaaactcactgaaattctagtgagatactttcttttttattcttggtattttccatatcgggtgcaacacttcagttaccaaatttcattgcacatagattatcttaggtacccttggaaatgcacattcttgtatccatcttacaggggcccaagatgataaatagtaaactcaaaattgctccccactctgtttattatttaaaggtgtcaggatctgtgttgtaatgtgtctacattaatgtgtttaggagaatacaggcattggatcatttagttgatggaagtatatgccaggcaagggagataaggtatacgacaagactgatgttttcagtatcttctcatgaggttgtcagagaccttcatgtcttcaaagactagtcagcaaatgaagtggtttagtgtagagacaagattggttgtgttttgataatttaagctaggtattgagtacatgtggattttgctgtccacaaatacttgtttcagagttttcatggatacagtggcatggttgaaatgaagctgtgagccttctgctttaaatctgatgtaagaaactcctgttaacaaatagtaagtatgggttaattagccctttgatcaaagcctagctttacattgtttaggatctttggaaaacaattggtttggttgcccactttccgtaggatcaagagcagaacctttcacatggcacagaagaacccaggttgcgcttcatacctgcatattccagccttagcctgccatttctctccttggcactttgt

SEQ ID NO: 4414 - DNA, 1099 bp, Homo sapiens
acagcggcgcggggtccttggctgggcggggcttgctcgcggtggcttgtggctccttcctgcggtgcttctctctttcgctcaggcccgtggcgccgacaggatgggtgagctgttgtggccggtttaagggcgctgcaagcgggacttggggtcttggggacgggcgggcggatgcgaatagagtagggcgggggatgccatggagaggctccatgggggagggccggggaagcgccgctccaggaggcacgtggtccggcgcggaaggggcccatgaggcgtggaggccgccgaggtcggggtaccgagggacgcagggaggccagcgcttcctcccgggcattcgagcggggcctcgtccttcgggagaacacattctccggagccctcttcgaacgtttattagtcggttcagggcaacttgaaggccaaatgtttggcccacaggccaataaatagtacgagagccaatcggcttaagggtttattccaggtgaggcgagtgtcttagaagatgggaaacacgtagatggcgtgtttttacggaagaactaaaatatttaatttttaggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtgtaagtccattgctcccgtcaagttttagtttattataggaattcgagacatgaacttacgaattcttgttttgaaagtaattgcaggtttttgtgtagtagtattcatttgggcattgtggggtaaaattgcaaagcgtttgttctatttaaaagttggtaaaattagtttttgggaattaggtagttaaggttttaatttaacgttggcctggaaggaattggagaagatactagcaatgatgaagtaaaggacacaaacacctttactgtgggagttgttataagtaaatggcacgtgtcagctattgaactttatcgacttgataaaactaaggtgaagagaagtgacttgcatcagaatt

SEQ ID NO: 4415 - DNA, 1177 bp, Homo sapiens
ctccatttatgaaaaaaagtataagcattttaattatgattgacttgaatttatagattaattttgggaagaattgaaatctttataatattgagtcttccaactaattgatgtgatatgcttctcatttatttgcttttctttaatttttctccataatatttgatagtgtttaatatagagatcttagatatcttcttagatttactactgagtattagtttttgatgctattgtaaattatgtttttaaaatatctatttctgattcttgctaatattagacaattgatattgtttattaataattttctattggctggtcatggtggctcatgcttgtaatcccagcactttgggaggctgaggcagttggaccacttgagcccaggagtttgacatcagcctgggcattatggcaaaaccccatctctactaaaaatacaaaaattggccaggtgtggtggtgcgtgcctgtagtccgagctgcctgggaggttgaagtggaaggatcacttaagcctgggagttggaggtttcagtgagccgatcacaccactgcactccagcctgggcaaacaagtgaaatcctgtctgaaaaaaaaattgtctattggtgttttatcctgcatacttgataaactcatttattaggttcagtggatttttggtgagatcatagtattttctacatggatggtcatgtggtctgtgaataatgacagttttacttcctttccaaactggatgctgttatttatcttgccttactgcacttgctagaacttccagtacaaggttgaatagaagtagtgaaagtggatttcattcttgttgctaggattaggagggaaagcattcagtctttcaccagtaattatgtgagttataggtttttcatggataccctttattaggttgataaatcttaaattccaactgtgccaataatttttttttctttttaatcaagaatatgtttagatttttcaaatgctttctgtgtatccatttacatactttatggttttgggtgtttctttttttagttttctaatgtggtgaattatattgatcaatataaaatatgaaacaaaatttgcatttctaggataatccccatttgggcatgatgtattctttcttatataatgtttgatttgctttgctaatatttt

SEQ ID NO: 4416 - DNA, 1132 bp, Homo sapiens
tcgcatgagggatttaacctactgaaggtgaaaatagatgttagttgtccatcagtttttatgataatactccatctccttgtagacactgtcttctcttcattccacctttttcagtaaagtcctgttgaatttattcttcagtattcacccatttgttgaaattacgttatttgttgcttggctgtgcatgaagtctttctatccaagtagacagtttcattgtatctttcccttctgtacccgccaactgtaaacttagaattaaagcatatggtagactctagtaaacacttattcctattgatgactttattggaattctaatataatgcataatgtccatctaagatatttaagtgtttatctcattaaagaataattacatagtagtagaatactttccctatgctatcacgaaaattcttcttcaaaagcaagtaggttgcatgtggaaatgtctgcttctcattccttgggagcaggaatatgttcataacatgctacattaacaaaggagttctcagggctgccaaccttctagtaaaggttgagtggtagtatatttctccaacataaaagaccaaaaagagcatgcctatttttacattttaaaatatgtactaatacagtcaactgtttgaaagctttttttaaaacctttatttctacttatatacgtgttaagcaccattttatgttgatttataactaagaattattttgtatagaaaattttataggcctagtctctttctgttaaaattacatgtttttatgagactcgtaatcttttattatactgagaatatataccatgcttaggtggagatatctagacagattggataaagcaagttcttgatgacttcactgtttaaaataacttcagtttttgctacttcaaataatatagaactaagcagcagaaaaaaagattactacatggtctttatcctggtttcatagacctgatagcattatcagcaaatatacttattggtatttagccataataactaagcaacgtaattacattttttaaatcaactaacagggttcgtgtgtgtgtgtgtgtgcatgtgtaagtaaaattggggtattacagaaatatatctaggtagagaaatat

SEQ ID NO: 4417 - DNA, 1185 bp, Homo sapiens
cccacagatatatactgcttgcccttagagtatttggaatatttgataattgtcaccatttaagaatagagatttcttttctttttctttttctttttttttttttttgagatggagtcttgctctgttacccagggtggtgtgcagtagtgtgatcttggctcactgcaacctccgcctcccggattcaggtgattctcctgcctctgcctccccagtagccggggttacaggtacacaccaccatgcctggctaatttttgtatttttagtagagacggggtttcactctgttggccaggctggtctcgaactcctaacctcaggtgatccgcctgccttggcctcccaaagtgctgggattacaggcgtgagccacctcgcggccaataggaagatttcatatttaagaagtctcaacttctagcatctctagaaaacccacaggacttggctatacctggtggccattcctgcttgagactagattgccagagctgagtagcggttgacccttttaggtgggtactgaggtctccatttgcagtctccaccaggtctgctttgcctttgctattgcagtatttgcctggcatctggcctggatcttatgctgaacctaatattcagacttctcaagtctgaaactttaaggaaaagaaaataaggaatgtaaatagtacctttcttttttaaaaaaatcattttactgtctctacaaaaataaaatcattcttattaagtcaaataattggtgaaggttaatgttagaacatgtagcattcattaactttgtcactgattgcattatacatatgggtgagccattgtttcttaataaaaatgggggtgagacttgctaagattagttacggacaatgattgatgaccagaactcatattttttactgtatttgtataagtagcagagaaatatagtaggtgcttcaagggttgcaagagtaaaatgccccttttctcaatgggagaaaagggagtattagatctagtaggaaattaagtaaaccaattactgtgattcaggctaggttaagataaatatcacgagtgaagtatgagcaaaggtcatgagggttaaaagaaaaagaaatttgtgtaattaggatcagtaaattctttgaggaaaaatagcaggtatgtttttcctgctacttaatttatttt

SEQ ID NO: 4418 - DNA, 1178 bp, Homo sapiens
ccggcctcttgcaggaccgagaggccaaagaggacgcggcgcgccggccactgcttgccgtggccacccacgtgcacttcgaccactccggcggcctctaccagttcgaccgcgtggcagtgcaccacgccgaggccgaggcgctggctcgcggggacaactttgagaccgtgacctggctttccgatagcgaggtggtgcggacgcccagccccggctggagggccagacagttccgggtacaggcggtgcagcccaccctcatcctgcaggatggtaatgggcccccgcgggcgcgcgctctcgttaagggagggtattgggaagagactgtccgagtgccgcatgttgcagacttgcgtggccataaaggggattattttggcacctcgcagagccacttctgtttcacccttccctgagtaaaaacccacttgaccagagtcaaggccatcacagccttccctgccagagaccagctctggcatcgtgtagagattctgagtactcctttgaaagccggcaccaccccctccctagccactttcctgcatcggctgtagcagtaacactacaaagacttgtgactgactagggatttctcattctttccctaagcacctgcccgacatttccaggagctttcgtagtgagcagacttttaaggaatgacccctcacggagagtgcatgtcatgatctgtgcttttgagaattgcagacttcatcagcttggtccccaccgggtatgggcagttcccacctgtagccttagagagtcatcagaccagtgattccaatccgctaatgcgattggaaacctttcagataggtttctgttcttgatgttgcctcacgattgcaaaagcttaatagtaatcataaacgtagaatatgtctgagtcttactttatgacagatatttggtccggttgaaagcaaagcctgagaaagatcaataaggaagtaattttcggtagaggtaaattatgtggactaatgcataggtagccatggtcctctttggctctgtgaaagacaagtatggaattcagagagaaattcatggaatgaaaataaatagggcctcagcccattctccctacgtagggacttaaataattgagctaattcgccacatcagcaatatttggtatattagttttctattttcttttt

SEQ ID NO: 4419 - DNA, 1276 bp, Homo sapiens
tacatatcaataaatagggtttgatggaatttgaaatggcacgtcattgttaagttgctgccctcatgagcagcattttaaatatgtgaatgatgaatctctacagtcatattcctattttttaaaaaatcaatttcttcatgatttaatttttttcccagatcaggtttcattgttgctgaaattgaaccaatgggcgtcttccaattttccactagctcaagaaatatcatagtgtcagaagatacacagatgatcagattacatgtacaaagactatttgggttccacagcgatcttattaaagtttcttatcagaccactgcaggaagcgccaagccactggaagattttgagcctgttcagaatggggaactgttttttcaaaaattccaaactgaggttgattttgaaataaccattattaatgatcagctttctgagatagaagaatttttttacattaaccttacttcagtagaaattaggggattacaaaagtttgatgttaattggagcccacgcctgaatctagatttcagtgttgcagtgattacaatattggataatgatgacctggcaggaatggatatttccttccccgagacaactgtggctgtagcagttgacacaactctcattcctgtagaaactgaatccaccacatacctcagcacaagcaagacgactaccattctgcagccaaccaacgtggttgccattgttactgaggcaactggtgtatctgccatccctgagaaacttgtcacccttcatggcacacctgctgtgtctgaaaagcctgatgtggccactgtaactgccaatgtttccattcatggaacattcagccttgggccatccattgtttatattgaagaggagatgaagaatggcacattcaacactgcagaagttcttatccgaagaactggtgggtttactggcaatgtcagcataacagttaaaactttcggtgaaagatgtgctcagatggaaccaaatgcattgccctttcgtggtatctatgggatttccaacctaacatgggcagttgaagaagaagactttgaagaacaaactcttacccttatattcctagatggagaaagagaacgtaaagtatcagttcaaattttggatgatgatgagcctgaggggcaggaattcttctacgtgtttctcacaaaccctcaagggggagcacagattgtggaggagaaggatgatactggatttgcagcttttgccatggttattattacaggtatatctt

SEQ ID NO: 4420 - DNA, 1192 bp, Homo sapiens
accttgggcgcttcccacctgccccgtccccctagagactcagaggacccacctgggccaaggactccaaagccgcggggacaccgggaagtgcagcgggccaggcaggctgggtgggagggaggagggccgagacaggagcagcccacccagcagaaatacaatccgagctacaaagcatgggaaaaagagactcttttaggatcagatctgtgagcacgttggcgaggaaaaacaaaacaaacaaaaaaaagaaccttgtgtctgtctggtgaaaaaaagaaaaacaaattggaagagaggaccatgagaattttaataaaacagaaggaaactaatggaccttccaggatttattgtggacggatgtggatatattctgtacaggaacaacacatatggaagtggactgaagcctatgtagaaacacacacacactgaacattgttattcattttgtaaaatactagtctttattttcattttttgtaaaatttaaacatcgtatgcgcataaagaaaaaggaaacaagaattaggggaaaataacattttccaaataattataaaaaattgtcctgtgtctatgtatctatatctgttttgtatttttttctggttccaaaccagatttcctgtgattctatactaataatttttgatataaccctttgcttcttataatgagtgcgatatatgttgtcgaggctgttcttcaagaattaaaattgaagtgaaaatttaaacaaaaataaaagaatttagcaaaacccatgtgtctggttgcttgatagatgttatccgtggaagagaactccttggttaatttccacctcaactattattagaattgaaggttttggtgtgtaaaaggggagacttttaaagtctactacaaagttggttagattcatttccaaaaaccaagctgctaccttggttttgtaaatgcggagggccaggctctacatgggctggggtccgcggggaggcagggcgccttggtcgctgacttcagccgttgagacctggtgggctgcgggcggtcccgtgctcagttgggccagggagtggtgtaggcagggtcgcgcgcccggtaagtctccaggcaccaagcaccgggggcgcagccggcttcagtgtctggcggcggcaaccggggctttaccgcatgtgggaacttgctgagctgg

SEQ ID NO: 4421 - DNA, 1654 bp, Homo sapiens
aacactgcaattctgactcccagggccagattcctaactaacaacatgcaaatacattcattttcctcatggagcatatgttccagctacccatttatttaacaaatatgtatcaagtgtctgctatgtgccaggcacagtcctaggccctgagttacagagaaaaagagtttgacacggtcattgctatcatggcttacaccttccagagcctctaatagaggttttgtaaaaagggagaaagtatgcacgtattaatgcaagtactagacataattaaagtaattaataacattgacaagaattactaaactattgaaatataatacagtttctttaaaaatacatactgtatattcagaaagggtaatgttatttttacatcttaaaaagaattcattttcatctctggttcaaaatatatatctttaaaaaaaaaactttttgcctggtgtgattccgtcctgcgcggctgttctctgcagcagcgttgttttatctccgtccgccttctctcctacctaagtgcgtgccgccacccgatggaagattcgatggacatggacatgagccccctgaggccccagaactatcttttcggttgtgaactaaaggccgacaaagatgatcactttaaggtggataatgatgaaaatgagcgccagttatccttaagaacggccagtttagggctggtgcaaaggatgaactgcacattgttgaagcagaggccatgaattacgaaggcagtccaattaaagtaacactggcaactttgaaaatgtctgtacagccaacagtttcccttgggggctttgaaataacaccaccagtggtcttaaggttgaagtgtggttcagggccagtgcatattagtggacagcacttagtagctgtggaggaagatgcagagtcagaagatgaagaggaggaggatgtgaaactctgaagtatatctggaaagcggtctgcccctggaggtggtagcaaggttccacagaaaaaagtaaaacttgctgctgatgaagatgatgacgatgatgatgaagaggatgatgatgaagatgatgatgatgatgattttgatgatgaggaagctgaagaaaaagcgccagtgaagaaatctatacgagatactccagccaaaaatgcacaaaagtcaaatcagaatggaaaagactcaaaaccatcaacaccaagatcaaaaggacaagaatccttcaaaaaacaggaaaaaactcctaaaacaccaaaaggacctagttctgtagaagacattaaagcaaaaatgcaagcaagtatagaaaaaggtggttctcttcccaaagtggaagccaaattcatcaattatgtgaagaattgcttccggatgactaaccaagaggctattcaagatctctggcagtggaggaagtctctttaagaaaatagtttaaacaatttgttaaaaattttccgtcttatttcatttctgttaacagttgatatctggctgtcctttttataatgcagagtgagaactttctctaccgtgtttgataaatgttgtccaggttctattgccaagaatgtgttgtccaaaatgcctgtttagtttttaaagatcaactccaccctttgcttggttttaagtatgtatggaatgttatgatag

SEQ ID NO: 4422 - DNA, 1148 bp, Homo sapiens
ggaagtgttcatttaaacagcccttaaaagttagttgaatagaagtttcttcaagcaacagtattcacttgcagggaacagaagtttcaggtatttagcataagttcctaggtagaagagccatctggagatcctcgttcaaatattttcaaacaatatagaaggcctgtgacttatacttattataatgatgtcactttctcatttacagatgggtgtcaacctctcccagtatctggcagctgtaataacccacagttgattaacacatcctgtcttaagaacatttaaatggtttttattgagctggtcaagaaccaccccccaccatataggccaatcacattagtgctataccatttcagcttcataaacctgagcttacattgaagaaatgtgatcaaatgaagattaccctgaatttctagaggcaaaaatttagaaacatttgagggcataaaacaactaagattggaaaagaatcaaaatctcaaatgtctttagtccccaaatttatatcgcacagtctttattttctttgtatcatagggaataaaggctgagatttgaaaagccgtcttgttacttttacagtgaaacctctctgtccatacttatccttccttcccctaccaacaccatcaggtttcagcgtattacgccagatgctaagtagtgatgattgcatactttatttgaagtttgggttattttaaacttagatgcatttagttttgaaatcacaggtataacttgctttatctgacatatacatttcatttgaaattcagaaaatccaatcattccccatggatttataggatgatttttgaaatttgtgattttgatttttttttttttttgcttttcaatagtcttctgaaagcagacctcacattcttttagctctgtgtttttctcttcataatccaacatttagtgggttaatatggtgtcagtgtgtaagaggtctgaaatctaagatctaagaaaaacctacttgatctcttagctattagtgagtcaaatcatgatgtgatcttgagtacatgaataagacaatggagtgttagcaggttggaaggaaaatttagatttgaatgtagaggattaagatggcagatgggggcaggactagtatgcagctc

SEQ ID NO: 4423 - DNA, 1161 bp, Homo sapiens
gggtgagtaggtaaagcagaatctgggagtaatgtgatgtatacataagcacatggctacagttgattataaaattttgtggatattcagtggagatagcttcaacttggcggtgatagaaaagtaccagtattggaaaaaaactgaaacatgtttctgaaggtgaatttcgaccttttgtacttctctgtgagcttactgaccatagggatggtatctgaggggagtatttatctctgtgttccagcacatggcctggttgatcagttcattcattggttggttggttgattaatgagcaaaaaagcgtagatattcacaatattctggcttagacaatttcagagacattaaatattctgggactaatagtgggaagaattataatggaatgtggtctttaatcgcactatactgcttagagaattttaacaccaagacctctgaggatcccttcagtctaatcagtccacatctgcccctggctacccgatcatcatcctccttgcccagcatcatcttgttgccttttctatgccaaaatccctcacatctactcaaaatatatactctaaagctctctgaatgttatgcttgcaacaggacaaccatgcatttaatacatttatttgtccactcaacatttatctatggagcacttcctatgtatctggctagacggtgctggatgctaagaagcagatctactaatatgatagagaatttcaagttcaaatgggtaaagacttaaggtatgtactgagatgccctttctgcccagtcttttccagtgcattgtatgggagtttctggaaatagcattccagtattgttctctgactctagtgcagtgagcctaataacttagttgcatcttctcggagatccaagaggaaggtattggttctacatgtctcccacatgtcctccatatcataggaatttgcagttgagacattttcagttacaagaatattattatgaaaatttaaattgacttcaagtaactcttatgtatcaattcactatgaagcagagctaaactgaaacagcagctaaatgactgtccttttggaattagggttaacacctctgccttaatgaaacttttataacttacataatattctggcaggaaagatgctgggtaagtgtaaagta

SEQ ID NO: 4424 - DNA, 1129 bp, Homo sapiens
agggacagcttcgaagacatttccatctggtatacttcactagttagcaatgcccaggaatgcaatacttgctatttaatcattggtagctatgaaagacactctgggtatctttgttgtccttggacatttggggagtgcctgcccattggcaatgatcagagtttagtcacctctggggaagcataaagtgcttactcacaaaggggctgaggaggcagtgacttcttagagcaaattcttgttttccctctaggagatacagttgtattttaaaatgcaaacagaatcacttaagaaacagaacacttggaaatctctttagaagaagtgaaattgaaactgtgactttgcactcctcatgaaggttgctctcacagcattttgcttggactgtatggtgggtgtttgttgttgtgatctttttaatggaattcattctcagtatttaaaaatctggaggtctcacaaaacaattcggacttaaaacttctctctgaaaagtcaggtcgggcaatacagagcttgcaccttttagtggaagctgctggggctgacagctgttgccccctttgtatagggcaagtagtggctttggtttgccacaggtcccaacgacaggcccatgcctgagacaccggcttcaccccataaccatttgagttggtaacccttgaacagcagtttaatatggaggcaaattccaacacaatccttgatacaaaactacagatgaaatgagaatctttttttctggttgagcctatgtttgtgaccctctgcttttaactgtttgtgaggggaagtagtgttgtaactcagacaccacattcacttcaagtgttataagacacgggttgtaacagtaggaaatctttcgctcttccccagggtgcccattctccttatcccgcaaagcaaagtcctctactcctgggtctagttccggccccctctagtgtatggtagcttaaataaacaaatcaaggaaaaactatgtcctttaaacgtgaatcatcctttccccaggaagttttatggtgaaaccagagtatcttcaaagaggcggggccaaggccagagctggacaccacgactgccacgtaagaggaatcccaagcatactgcg

SEQ ID NO: 4425 - DNA, 1209 bp, Homo sapiens
acaaagcatttggtaactgcatctccagaaaagttgtgaattagcttctcagtttgataatggagaaggcaaaatgactgcagaggcaattcacacatagactactattgatatatggcagtaattatgtgattgtgtatatacatatagatatctaaatatatatatatatacgtgtgtgtgtgtgtgtgcgcgtatctcaaagtgtagataaactttacccccaagcgaggcatgagagttattagtgttgatcatttgatagaatctagagcatcatctcatcctggtaacatattagaatcccttgggtagcctttaaaacatgccagtgcctgaactccacctgagaccaacaaaagccaagtatctgaaggtggggcctaggcactcatattctatatggccctaatgattctaatatacgagctgaaaccactggcctagtgaaaacacagaaaggctaacaacatcgaccattttttgagcatatactatgtgccaggcacagtgctaggcatttcacgtgcacgatctcatttatcctcccaagaaagatatcaggcatattcataactttgacataaaccaattatacctaaattccctttcctgaacattgctagcagctaacaaaaaaaaataaaatgactttgctctaataaaactgaccaaaagtaggcaccagagaaaagaagagccgcaagatacatacaaatcatcccaaaattggttattctgtcccagacaaactagttgggaaacaagttacctaaaataattaatcaggctttgcctgtgccagtagagataatttgcttatttgttacttacacagtagttttcagaaccctgtggacattattaattcatcaaagtaataggtttttaaaataaactaagatgttggctcccggtaaaatttgtacctaaatttaaaagtgcttaacatccaccaggaaatttgtgtattgctgtttattattaaactggtatgtattaataaaacctttttttcttagaatgaccttttatggaaaaactaaattttaacaatcagaaactagataaagttgaataatgtatccagcttaacatttggatatttggctcaagctcaacattcattcattcaattcaacttattaagtacctacagtgtaccagacactgttttaaatgctggaatcccaaagtaaccccaataga

SEQ ID NO: 4426 - DNA, 1099 bp, Homo sapiens
gcctttaatgatgctactcaaaaagtaaactaagtttttaatggtaagtgtagactgtaatattaagcgctaaataatggttcactcacctttggattgaaagactttatgtcaaggatttttcagaatcctttcaaaaggatattataactggcttaaatctgaaataattcaattaattccacttcaggtgttgcactacatatttagcctttgatttagagtttgcagccttgataaagcctaagaagcccaatctaaaagagtcaggtttgctgctgcttcaagactcagctgaatactacgttctccatgaagcatttctttctttccccagctggaattaatcattccctctctgatctttcatagcactttaattatctcttttttgtagttcttaatactcattggtataaaacccccagcactttttatgtatcccaaaatgtatgcagtcttggcattttccccccttcttttcttccttcctcttcactctctctcttcctttttccccctttctctcatctgctgtgtttgcttcacactacctgtaggattacattcagattcatcatttgataatcaaggccttccttataaattcagcaatatttcttttcttgtttaaaatttattttttccacccatctgcacactgatctttcttttttctttttcttttcttttttttttttttttgagacagagtctcgcactgtcgcctggggtggagtacaagtggcacaatttcggttcaccacaacctctgcctcccgggttcaagcaattctcctgcctcagcctcctgagcagctgggattacaggtgccctccaccacgcccggctaattttttgtatttttggtagagatgaggtttcattatttggcctgctggtctctaactcctgaccttgtgatccgcccgcctcagcctcccaaagtgctgggatcttttttaaaaatttttttagtgacagggtctcactctgccacccaggctggagtacatggtgcaatcatagctcaccgtaacattaaagttctgggctcaagtgattctctcccaagtcattgggactacagacaggcac

SEQ ID NO: 4427 - DNA, 1197 bp, Homo sapiens
agtctttcagtaaatgttactgaaaccattggaaatccttaagttaaaataacctgacttaaatccataactcataccatatacaaacattaactcaaagtgtgttataaacttgaagataaaacttacaattgtaagacttctagaagaaaacataggacatttttaggacccagggataggcaaatatttcttagatatgatgccaaaagcattatctacaaaataaaatattgataaatgtagtttctttaaaattaaaaaacgttcctttactaacaccattaagagaatgtattaataaaggcaggatgtgaaggcgatctggctgtgacatctgtcaccccattgatcatcagggttgatttggctgacgtagctggctaggtgtgtgtccccttcctccctcactgctccatgtgcgttcttcctgaagctgcatgcttggcagaagaggacaaccatccttgatagaggaagatgcgtcttctgtcaagggtatacgagtagctgtgctcccctgctagaatctccaaacaagctctcaaggtctatttgtaggaggacgtgggtaataaggcttccaagactccagacacatcccaatgaggcactggatgaggcagcagtctacctttgtgtgtgtgtatacacacacacacacacacacacacacacacacacacacacacgaaaggcattgagaaaaatacttttaataatatatatgaaaaggatgaaaagggatttatatccagaataaagagctttcaaaactgaataatattacacaactaagtgagcaaaatattttaatagattttgcatcaaagaagatatgtggatggaaaataagcacaagaataaatgttgaatatcattggttacacaaattaaaacaacagtgatgtataactgtgcacctgtaagaattgctaaatttagaaagaagagacatgatgagtgttgacagtgatgcagaggatctagaacttttacataccactggtgcaatgtaaagtactacctaactttggaaagaatttggcacttccttaaaaagttaaacataaaccttatataggatccagccattatgctctttagtatttacccaagggaatgacagcacatgtcccaaactgctatgaacatacatgaatgttcatagcagaatgttcatacatgtaatagcct

SEQ ID NO: 4428 - DNA, 1195 bp, Homo sapiens
ttccgtttaaaaccttcccataaagaaaaagtggtgaattctaccaagcatataagaactaataccaattctaaacaaattctttcagaaaatcagaagtgattccaactcattctatggtgccagaattactcatcatttatctggacctcatcatagtatccaccccaaattaccttttatccttgtgattatgataaataaatgtgtgttaattgatggtaactattagtatagttgagacagataattctttttgattgaatgactataacaaaacaatgactgaataacacattagtgtcaacatagagaaagaactgtaataaatgccgagaacatgtattaggataagctatcaagaatgtgagggccatctggctgcaacatctttcaccccattgatcatcagggttgatttggctgatgtggctggctaggggggtgtccccttccctcctcaccgctccatgtgcgttgctctggaagctgtgtcctgggtctaagaggacaaccatctctagcagaagagggcgggtcttccctcaagaatataggagtagctgtgcttccctgctaggacctccaaacaagctctcaaggacaggctatcaaacaatcccatgtggtaaaaacaataaataatggctctcctggaacgttttccttcaaattatgaattcatggatccatcttcctcccgttttctgattctctcatttcagagttattttctccctgcaagtaaattggggacagggtgaagatcttcatgctagatgtttctgcccagcactgaaatatatcatatggtatttttgcccatatgccactgaccaaaacttagtcccttgccctaccaagatattagaggggttggttatgtagttgtcctgtatgccaggaggaaaataaaataacttggtcaacacatagcaatgtatctgccataaatattataaatactttgtataagagcatcaggaccaaacaggctaaaaccatgattcatatctaacaagctgatataggttaaaaaaatttttacaaatcaacttaaatcaaaactgtaagataagagagatttatctaaacatcagcaaattaaaacataggtcaaaaataaataaatgtgaaggacattaattaaagtattgaatccaggttaatatttttctctctatctgtgccattc

SEQ ID NO: 4429 - DNA, 1196 bp, Homo sapiens
agtactgattggtggatttacaaaccttgagctagacacagggtgctgattgatgcatttacaaaccttgagctagacacagagtgctgattggtgtattcacaatcccttagctagacataaagattctccaggtccccaccagattagctagatacagagtgctgattggtgcatccacaaaccctgagctagacacagagtgctgatggagcagggggcagcgctagtctaggaggcttggggaggttcggtagcgcaggagcccacagccttgggggaggctcaggcatggcgggctgcaggtcccgagccctgccccgcagggaggtagctaaggcccagcgagaaatcgagtgcagtgccagtgggccagcactgctgggggaccaggcgcaccctccgcagctgctggcccgggtgctaagcccctcactgccctggcgggcgaggccggccggccactccgagtgtgggcccgccaagcccacgcccacccggaactctagctggcctgcaagcgccctgctcagccctggttcccgccctcgcctctccctccacacctccctgcaagctgagggagccggctccgacctccgccattgcaggaaggggctcccacagtgcagcggcgggctgaagggctcctcaagcgcggccagagtgggcgccaaggccacggaggtgcccagagcaagcgagggctgccggcatgctgtcacctctcactggttggcacagccaattttagctgtgctgtcagacgcccagtagtgcacctcacctcagagcctcagacttacagcctcaaggcattccattctgtgtgcaggccagcttgggcagtggagccaaccacctccacttaggtgaggagaagcctcccttttcactctcctcagggctccaccccacctgaggttgtctctgcactctgtcattacaaaactagtccttagtgtcccagttttactttcaaaaatactatatccaatttaatttaaaaaatctctttctccgccccccgcttgtttcctctaatgctcaaaaggctaggccattgaaagttcaagagggtagaaatttctctttttcttctcatcaaaagagaaatagtccttgaaagaaccttattaaacttatatcctttctgaatatggtaatcccttggtattgattattttaattttata

SEQ ID NO: 4430 - DNA, 1215 bp, Homo sapiens
atatagctccttccaaagccctgcatctttcctggcctcctttcccacttttgtgtctctcatccctcatttctgtgttataaatagtgtcatagataaacaaagctggacactcctaaagtggtagggacagattttaatcaacaatggattttacagaagtaactgggcattttaaagggagaattagggagtaggaaaaagtagtatgtgggggctcagtagagtcagggaagtaaaacattacaaaaggttagttggcgtaaacccgatggggccagctgtgtttgctagctggaaattactgaagctatgattccatcccgtcacagagactggaaggcaaaggctctattctcaggtattggctagagcaaacagtagatttttttggcagccttgagtcttgtcttctcaagcaagcactttaagcggagctagagtcatcttagggatatggcattgagctgttagaaactgttagtgtttgttcaagtctttgtaagccaaggtgaaggcctagtcaagaagagggcttggaggagcctggctatggtttagtcaaggagataatatttatcagtcattatagatacaaaacaaatcagaactctgtcccaccacttgctggctgcaagaccttaggcaagatacttaaactataactttagttttctcatctgtaaaattgggataataatagttcctatctgataggattgcagttaagtaaattaatatgtgtaaaacacagtaaatgctcagtaaatttagttattaacatttctgccctgaactgcattacaatggattagttaagaaatgttagcaagtagctaatgcaaggccctatatgataaatacattagaatacttgaaataaagaattacagaggatcaacctgggaataaagagagtaattgcaacaatattttagtcaggactgcaatcataattttctagagcacattatggaaacaggttagaatctacatttctctcttgctttatttagaaaatatttatggaggcagcaggatttgaagaatgtagttcaagaggtagggagagagacttggaaacaaaagtttagaattcctgtaaagctaccattctagaaatacggctgtaaacagatgaagtattcagaacctcaacttttataattttgtctttaaaagaaactagtaattattaaaggtacaatttgctaa

SEQ ID NO: 4431 - DNA, 1129 bp, Homo sapiens
taaatctactttagcttatactaacagattcaatttgaaattatgtttaggtaaaatcagaattaaatgtatcttgatcacagggattaagtacagtatcttactgtgtaacttgtgtcacttgtgtatctggtaggagtttatcttctacatggagtttcattactgcctctccattgataaatgagcatctatagatgtagtttcacgggaaaaaatattaaatttatttgctgtcagaatagttttactgttacaatctatgtacccaggtattcacttctgagaagtggatactgagttttcaaatgctgataacttttagttggtagtatttattggataggggaccaaactgatttttttatgtgttgaattggcacaaatttgtgaaatagccactcagaactatcagtttgaatagaaatatatgataacatttgcctaaatagatcttctatatttccaaaatttgaaaacttgtataagttttacctaaaagtgtaaataatcaaatcatccttttaatattattctgaattctaaactggaatgtcaccaagtaactttgagtaatgaaaatccacatcaagaagaatataactatttgtccttaatttctttaagaatgtaaaaagcttttaaataaagttaaaaagacttccagtaataaaagtttatttacattctcctttagtagctatgcttataaagagagtcataatactaagaacatgcctcttcatctgaagtatgccataagcagtttggtgcttctaataagaatatacttttaaacatcatgtgcgtattctaagttcttcttggattattttgactatttgctgaaatgatattagggtaattaaacatatctcctactggttggcattattgatgcaatagtcaaataatacagcagcaaatatgaccaacacacttttaggaataccagtcgtcctcaacctggtgctttgcttctgttaaggtttgagtatcatcaatttaaaaggttatactcttaagaggaaaatatctgtgtaagtcatgaaggatttactaaactttaacctaatcatgttttctttggactttttcaattcttgtagggacttgtatattaaacatt

SEQ ID NO: 4432 - DNA, 1166 bp, Homo sapiens
atctctatgctttactgttatttcacctttattttaccctggataataaatgggatcttccaaaatgattctaaaacatttgtataatttttaaaaatcactaataactgattctctaactacaacaatccattttctctaatcctcactgggaacctgaatagcccgatatgatttggctgtgtcctcacccaaatctcaaattgtagcccccctaattcccacgtatcatgagagggacctgttgggaggtaattgaaacatgatggggggtcttttctgtgctgttctcgcggcagtacgtgagtctcatgagatctggtggtttcataagggggatcccctgcacatgctctctctcttgcctgctgccatgtaagacgtgtcttgcttcccctgcaccttccaccatgattgtgaggcctccccaggcatgtggaactgtgagtcaattaaacctctttcctttcccctgtcctctttctggtccagcccgcaggaccagcaccacgctcttctattattttttcaagtcccttgagggcaagcatgtggtcgtggaactcaagaatgacctgagcatctgtggaaccctccattctgtggatcggtatctcaacatcaaactaactaatatcagtgtcatagactctgagaaatatcctcacatgttatcagtgaagaactgcttcattcagggctcagtggtccgatacatgcagttgccagcagacgaggtccacaaacagttgctacaggatgcagcaaggaaggaacccttgcagcagaaacagtgatggctcctcctcctcttccccttcctctttcattggtgacccccaagtcccaacctgaacccctaatgcccaatacttgaagaggttttgtttgtttgtttactaatgatcgttttgtggggttttttaagggatgagtggatgagaggaataatagagaacagctatcctctgttgagaaggtgagaaaaagtaggatggaaaacttcaaagccttccagtccccagcacctgcctttgttgctacttccctggagatggtggaagagtttcctaggtctttcaggggcagcatgtgattcatttggagatggaaggaatctgtcccacatcaggaataaaatttatgatgcaggggaaaaaaaaaaa

SEQ ID NO: 4433 - DNA, 1212 bp, Homo sapiens
atagctccagagtgtatcaagaagctgtcacataatgggcattcagttaatgtggcatgaaagaaggaatgaatatatgctccctccaactactacttaaaaaaaaaagtcacacgtttgcttctctatctacatcttaaccatttttaatttatctaaaagtcaattttaaaagaaagtattatttgacgccaagaactggtatttcaagttttactacaaaagaaaccgatacagcagttttaaaaagtgctgaacagcaaaatcaaaatggaacgacactactgtgataactgcaaaggggctagcacatgttgctttaataaaaaagccatattactatgtgctagaaacaaggggcttatcaaatcatacatatacaaaaaaatcaagatgtatgttaactgtcaaacacaaaaacaacttttttctataactagattgagtctgaaattatttctgaagacaccaattccatactttcaaattaccacctacagagacatttagaacaaaacagtctttaaaaaaaatcaacattaagaagataactttaaaagcaaacatagtgctcgcttcagcagcacatatactaaaattggaacgatacagggaagattagcatggcccctgcgcaaggatgacacgcaaattcattaagcattccatatttttagaataaaatacctaggaatccaacttacaagggacgtgatggacctcttcaaggagaactacaaaccactgctcaatgaaataaaagaggatacaaacaaatggaagaatattccatgttcatgggtaggaagaatcaatatcatgaaaatggccatactgcccaaggtaatttatagattcaatgccatccccatcaagctaccaatgactttcttcacagaattggaaaaaactacttcaaagttcatatggaaccaaaaaagagcccacatcgccaagtcaatcctaagccaaaagaacaaagctggaggcatcacgctacctgacttcaaactatactacaaggctacagtaaccaaaacagcatggtgctggtaccaaaacagagatatagatcaatggaacagaacagagccctcagaaataaggccgtatatctacaactatctgatctttgacaaacctgacaaaaacaacaatggggaaaggattccctatttaataaatggtgctgggaaaactggctagccatat

SEQ ID NO: 4434 - DNA, 1225 bp, Homo sapiens
tctcatcacaaaggaaacaaagcactatcagttctagaagaagcatggcagtttgaggaaacagtaattgtgaacgaccaaaaaaaaaaaaaaaaaccggcaaaacttcatactttcaatcctgagtaggcacaagggaccaaaatgttggtgcataatgagttgtaaaatgattttttaaataatgagattcaagagacaggaatcaataacttctatttcctctgacgctaacaaaaagggaaaggaattagaaatagacagaaaaaacaaaaactacatatcaggaagtcatggtccagaagttaaggaaactgaaatatagcatgattctcaccagctggaatataagagactccacttgctctaatgctcagaatatttccttcaagtggcacaggtgtaattatcaagattatccctccttcttatgaagccaaactacctgacatatactgcatggtatttaatatcataaaattgaaaacactatgtactggttttcttttttttaacattttttatttctttaactgacaaataggatgtgagggcgatctggctgcgaaatctgtcaccccattgatcgccagggttgattcggctgatctggctggctaggcgggtgtccccttcctccctcaccactctatgtgagcccctcctgaagctgcatgctcagtcgtagaggatgaccatccctgatggaggacgggtcttcggtcaagggtatacaaggagctgcactcccctgctggaacctccaaacgagctctaactgacaaataaaaattgtatatatttatcaagtatatcattttgaaaaatgcatacattgtagaatgctaaatcaagctaattaacatatgcattacatcacttatttattcttttttgtggtgagaacacttaaaatctactctttgcaattttcaaaactacatgctttattattaattataatcagtatgttgtacaatagatctcttgaacttattcctcctacctaaaattccgtatccttgtttactggttttcaatttttgtaaccaacctatagtcagagtacataacacattcagtcacagaatgaaatgtagatgatataaggtatgttgatgtaaaaaaactgatggctgagggagggtgagaaatgagaaggaagagaaattgagtgggagaaggctgagaagtaccaaattccttgactgacagagtggggagt

SEQ ID NO: 4435 - DNA, 1198 bp, Homo sapiens
atttataagagcactttacaagttttactattttttttttttttagtttttgttctttaatctcatttttaagatagaaaaatttttagttttttgttaccaaatctgtcagccttttacttcattgtatttttcagttatggctagaaagaccttttgtaccacagattatatatttattttttctactaactttgtatcttttttatgtttcaaaatttacatttatctggaatcagtgttgacatattgttttaatgcatctagtaaccatttgtcttgctcatctattattaaggatgtatgtatattatagaattgttttgcccatctcatgatcattttccttccctcacctttcttccaagaaatgaaattcagtgggattttggttggcactgcataagacttacgaatgaattttgggagagttgtgcttttgcattattttagttttcttatttagaaagatatgtctctccattcatttttatgttctactaagtgacattttttcattttctgcgtatattatacattctgctcattttgtataaaattaattttctgttttgattggtctcctgaagattgttaatcttcctaacagccgtgtgtgtgtgtgtgtgtgtgtgtgtgtgtgtgtctgtgtctgtgtgtctgcatgcatacgtatgcatcccatgacatgctattacatacctttgtcttattgcctaccctgttatattgaacttaccagtttgtttctgtgcctctccctcctaaactgtaggtactttgttgactgggattatgtattcatattcataagtttataactacacataccatacagcatctttctctcctttctttgcttgctttttaacttagccataagccatgtggttactttgaatgtgtattctcaccactaccatgttatcagaattcttgtttcaagatatctgtattatcacctgttgttaatttcctttatttagatttatacatgccttacacaaaaaaaggatttatgacagctcattgacctgggtttgttaaatcgttcactgtactacccagtgtgatgatgtgccagggtccttggtcaggataccatgagagtcttgtaagggaaaggagagaagtgaattgttattgagattctttttttgtgcttggtctgagctaggtggttttctaaacattttat

SEQ ID NO: 4436 - DNA, 1200 bp, Homo sapiens
tggtctattcagagattcaacttcttcctggtttagtcttgggagagtgtatgtgtcgaggaatttatccatttcttctagattttctagtttatttgcatagaggtgtttgtagtattctctgatgttagtttgtatttctgtgggatcggtggtgatatcccctttatcattttttattgtgtctatttgatgcttatcttttctttaagaatgttgaatattggccccaactctcttctggcttgtagggtttctgctgagagatctgccgttagtctgatgggcttcccttcgtaggtaacctgatctttctctctggctgcccttaacaatttttccttcatttcatccttggagaatcagacaattatgtgtcttggggttgctcttctcgaggagtatcttagtggtgttctctgtatttcctgaatttgcatgttggcctctcttactaggttggggaagttcttccggataatatcctgaagtgtgttttccaacttggttccattctccccatcactttcaggtacactaatcagttgtaggtttggtctttccacatggtcccacatctcttgggggttttgttcattccttttcattcttttttctctgattttgtctttatgctttgtttcattaagttgatcttcaatctctgatatcttttcttccacttgatcgattcagctattgatacttgtgtatgcttcacaaagttctcatgctgtgtttttcagctccatcaggtcatttatattcttttctaaactggatattctagttagcagttcctgtaaccttttatcaaaattcttagtttccttgtattgggttagaacatgctcctttagctcagaggagtttgttactacccaccttttgaagcctacttctgtcaactcatcaaactctttcttcatacggttttgtgcccttgttggaaaggagttgcgatcatttggaggagaaaaggcattctggtttttagaattttcagcatttttgcactggttttccctcatctttgtgaatttatctacctttgatctttgatgctgatgccttttggatagtgtttttgagtgggtgtccttttagttgatattgatgttattgctttttgtttctagttttccttctaacagtcaggcccctcttctgcacgtctgctggagtttgctggaggtccac

SEQ ID NO: 4437 - DNA, 1187 bp, Homo sapiens
acgtgcctgtaatcccggctgctcaggaggctgaggcaggagaattgcttgaacccgggaggcggaggttgcagtgagctgagatcgcaccacttcactccagcctaggcaatggagtgaaattccatctcaaaaaaaaaaatgttcctgagatactgatatgtagcagtgtacttaccaaaacaaaattctttcaatggaaatttcagtagagtttttgctaatataattttactagcatttgaaatacttataaaccagcaatcatgttttcttgaattttaaaagcacaaggtactaaagaaaaaattccagcaaaatagaaaaattagagctgtactttgaaaggaaattatcaaattacttataatgtcagtctgcttctggctccaaagttcctttggagaaaagtaatttaagaaactcttttgtattaagcatttatgtaaattttgctttccatcctgttttgtgaaagagtttgtactcaatacaaaaggaagtttaaaattacttaattgttatatcttcatgtaaatatattcatatttcaggaaaatgagctgtgtttgtcttagaacttcccctgtgccctgtcactttttttctgccttatcggcaagggtgctagagatctgcattgggaagcccaagttaaggatagctgtggtattggtcagaagagatcatattttaacattcttatgtgaaagagtttcattcctcttttactttttggtatttgttttaaaattgatttgaaattaaatatgagaaactgttggcaagataattcctatttttctttctcattttctcttaatcagaaaaagaataaaccaaaggaaccacccaaagtacccaaatcagcaccatttttcattccaacaattcctggccttgtacccagatatgctgcacctgaacaaaataatgatccccagcaggtaaaaaacaaattagaagattctaagtatatcggtgtatgtttgtatgtgttttctgcacttctttaccaagacctagttttacagatatagggtaaattaatgatagcttttaattacaaactatacatttttgggtgatacttgaattatttgaataatgtgtatttgtttttgtttaagtctaaagtggtaaatcttggagttttggctcaaaaatcagatttctgcttgaaactt

SEQ ID NO: 4438 - DNA, 1200 bp, Homo sapiens
gtctggtgagtcgactgcggcggcctgtgtccgaagtgtccggggccgtgaacaagggcagcggcctggcctcaggcctgcgttcccacgtttggaaacggggagcttcgtcgatttgtgtttacatcatcgactatgccagggagttctccagataagcctggttttattttcgtcagtgaaaaggccttaccgtataactgactttatgcttgccctgcccccgtataaaataacttaaaagcagcgtgcctggttacagctgtttccacgtgcggtgctcgtcgggagtgatcacctaccctacaggtgagttttcacgttcgtgcaagaccagtcgccatttaaaacgcatcgcatttcacttttcattattaagtcggattttaaatcgtgagaaaatttctctgaaatgtattgtccgtttttaggctgtaatcggcattactgtcagccagtcagcaaccttatgccataaagcctacctcacgcagtgtcagcctttgtgttgcccattcactttggaaactagtgaatgtggtgtcaaaaaaggcgtaaattaaacgctttgcagccttttcctgcccttaaatttgatacctttggtgtaggagctgcataagtaacagttgctgcttttacgtttccacgcgtgatcttgaccctgctagccttaagtgtatggtttctcttagccagttctaatttttgttcaggtggaagatggatgcctgaagtgtagactgctgctagctgaataccatctgggagcataaaggtgacctgaaggtagggtgatatgtcttaaagcactttgtaatgggaatttttatcaccttttaaattggggttccttctctagtgagttttaatgtcagtggtacattcgtagtgttgctctgtctgtagctattaaggtgagttaataaatgggatagcctccacagcttatttttgggaaggttttgctgatacttcctgagaagcccagggaaataaatacgcatagtactggcattctgcatctctttaagatttgtttttatgtgtagtaattgagttttttaaaagcttgtgaaatcgcaggcatattaccaagttcttgattaaaatgtaatacaaaaatatttgctgtcgaattgagtactttattttttctcttaggatgtccttggtgaggattttgaaaatttgatcttc

SEQ ID NO: 4439 - DNA, 1200 bp, Homo sapiens; identical to SEQ ID NO: 4438

SEQ ID NO: 4440 - DNA, 1275 bp, Homo sapiens
gaccataatgctataatgaaaatcttggacctttgatagcagcacatgtattgtaaatgtcccaggatcagagacctgttgaatttgagtgggtgtctcctcaagccttacctttctcaggtgttttaaagaaatgcagggaggcaatgtttctgaagacattttctgtttataagagagtagaaagaaacacgagtttgcactgtaaatgcagttataaccttttatacagatttaccttttcagtgttcagtacaagtttaagttgctttctttgagggcatttattctgtgtgactgtgggttttattttgtattctggttaagaaaataatgtattgagttactgtcaagtagccaagttaatgggaatgctccatctacctgttacagtgattgcaataatagtatattggagtttttcaaagaaacttaaagtaatgcccaattattaaatgaacacaagagctgagatgtcacattcgtcagcattacaggtgatctattttggtggcattttgtacttctctctgcttctaaccactgaggctctctaatcttcctctggagttttagtgaaaggatttattgagcagcttctggaatataatgtgcatgtccaaaatgaactcagcgcttcaaaaggacaaagtctgtagcctggaggggcttgagtggatgggagctgatgctgtgattttgagctgtggttacatgcagtcagtaaacctgtgagactgctggaggaaatgtagcagacagcatggaggctgggacccagcagctactttgggtcatgtctttactgtcctgcctccaaccctttagtctcgtagacttttgttcttgtggaaatttcttctgtattccagttgtgtaaatatgtatggaaaactgatattactaggttttacgttgcatctccagtattgatctttggaaactgatgttacattaggttccaattcgcaatagtagcagagactgacatgcttttattgacctgctaagcccctggatgatggagcgagaagggaaggggtatgcagtttacccaagtccaaataaagcatttcactaggttacacgttatgtatatgtgttacataacagtaacatacataactcactcctaggaatgtattttgcttcaggatttttaaattcaaataaggatggcagtgcccattttaaggaggatttcagctataactgaggacaatcaccagggcgttaagggggctttagtgttttggctgcatctgacctcattga

SEQ ID NO: 4441 - DNA, 1149 bp, Homo sapiens
atggtgcacaatttaaaacttactgtttatttctagaatttcccatttaatattttcagaccatggttgaccttgaggaaccgaaaccacagaaagcaaaactgcagttaagggggagctacagtacttctgtaccaatgactgcatttattatcgcccttaagtctcacaggtctgaggaaagaatagttatccccatttacatgagaaaaatgaggctcaaagaagtgaggagtctcactgctgataaatggtagaattgggatttagcccagatccactaacgggctctcttctctccactgcatttcctccttgactccttcctgctggcgttgctaccgtcacagggtggtaagcaggaatcagcctgccggcagaggaggaggaaggaagccttgggttacgaagtccacatcatctgaaagcaggctgtctggtgatagaattttgcaaactcactcttttatcagcccccaggtgtttttttttttttctggaatccaagttcattccattatcctgtatctcagaattttccaaatactgtgttgggaaaaaaacaactgtggactctaaagaattatatcccttgtccaagggtcatctatattctgtgcatcatatttttctgttcttaataaatgcaagcttctcttgacccccatttgtttcagacccaggactcgcagacatatgccaacttgctagtctaataagctgcttctcatagcataagtgcaggatcgtctccaggagagccatatacctgggaaagaaggaacagtactgatgtcatgtgacagtgaattgtcactccctacatagttaagaactctgaagcatgattcacaaatggccacagctacacccttctccacctcccacttgctgaggagccaagacaagacacagctgtggcacccagccaggccagccctcccaagaccctggctgctttttattcatccattcagctgataaatgtgatttggcactcacagcgtgccagaaccaaggcagggtgctagaggcagctctgtggtagacaggcagtctgtcctctaggaatttacattcttaggaggagactggtgggcaaatgggtgatcgcagagcagtgagagaatgtccccagtgcgaggctga

SEQ ID NO: 4442 - DNA, 1192 bp, Homo sapiens
ggatactcagaggcatagcagacttgggcccagagcacagggataggcaaaacttttctgttaagggctacttagtaaatattttaagctttgcaggtcctatggtctctgacattactactcaactgtcccatggtaagataaaagtcacagacaatatgtaaacaaaatggacatagctgtgttccagtgcaacttttttttttgagacagtcttgctctgcctccaggctagagagcagtggcgtgatcttggctcactgcaacttccgcctcccaagttaagcgattctcctgccgcagcctcccaagtagctgggactacaggcatgtgccaccacacctggctaatttttgtatttttagtagagatggggtttcaccatgtggccaggctggtctcaaactcctaacctcaggtgatctgcccacttcgacttcccaaagtgctgggattacaggcctgagccaccatgcctggcccagtgcaactttatttacagacactgaaatgtgaatttcatataatttttacatcataagatattcttcttttgatttttttaaccatttaaaagtgggaaaattctttttaccttgtaggctctacaaaaacatatggcaggtgaatttggcccatgggctgtggtttgcagccccctagagtatcacagggaagtaagggggagtgtttacttttataatagctgagatggatgagaatagctctcattgagtgtaagtccttaatattttaaccttttcattaatcccacaagacctctggaagatagttggccagcatcctaactaacctttgagaggaagaaaagattttaagttcagtgagctagttttcaagctgggagctaataattaccaggccagactttaggtgtttgacccgtgactaaggccctctgctcattgtatcactggggagggaggcagatgccgttttcgtatttatatagagaaaccaagtctcctggaagattgtgtaatgctttgtatgtaaacgtcaatgcaagttttggcagggacaaactgcattaaaaaagcattgcagcagcgaagtgtgctggctttaggaagcagtttttagtggatatttacctcacaaagtcttacaactgaaaaatcatatctttcggaatcacttaatttttgtttctaaagagcaaagtgcctc

SEQ ID NO: 4443 - DNA, 1192 bp, Homo sapiens
gtattttaattgaaaaattaatcaggcttttaaaaattacttttttattgtattagttggcttttaaattcagattctttatatttgcttgatttttcctggaagttccaagttttatgaatttgtagctgatagtaggttttacttgtgtaccccatctgcactttgatgttgtgtagatcgttttgtgagttatttgaaccgtgtaactcagagaatagtatttcctcatacataaagtgacctcacttttaatcagctcctttatagtatgttgaaaatcactgcgtgtaatgagaggtattgagagtttcttgcacacatgagtgtaaaaggttgagaactagattatacaaagtagtaagtcacagtgcatggcaactttctacaggttggattataagacttatgtggaataggagaattatattgggaaaaaattattttctctaacttgaagactccagagacacttttcttagtcatgaccagtaatatttttcatatattttggaagaaataagctcctcactataccaccagttagtgatttatttatttatgtattttagagacagggcctccttctgtcacccagtttggagtgcagtggtgtaatcatagcttactgcagcatcaaactcctgggctcaagtgttcctcctgcctcagcctcccaagtagctagaacctcagccccatgccaccacactcagctaattttaaattttactaatttcatttaatttttgtggagatgggggtcttgctgtgttgtttaggctggtcctgaactcctggcctcaagcgatccttctgccttggcctctcagtaaattatatagaagagcacttctgtataatttactcagtttcttcatcacatatttccaactgttgccctaaataggtttaaaaatgtgatcatgttattagaaaatcctttccattgaatttcagggatgctgaatttcagggagctaaattgttgacccttgcctgtagttgttattggttcagaagtaaattttattgatgctacaagtaaaaaattagatctgacttagtaaactcaaaagttttacaaaactgtattttactatgtagatgtatttctttaaaataggtatggatggatatttttatgaataaataatattgcattatagatggaatgaaactttgcatttaa

SEQ ID NO: 4444 - DNA, 1184 bp, Homo sapiens
ttataggaggaataagaactcctaagtgttggatgcaagaagtgtagatgagaagttaatgtgaagaagatatagagccgcagaaacaaagattgaagaccaacttagactttaccaattttaaccagaggtacccttgcttaaccttttcgttttaactaatggggacaaattgagactgtgcatggagaattttgttcttacgtgtatttgaaggtagtttttggccataagttataaaggttttaagaaaagagttcctttggaaataaaaattgagtttttactgcatttggggtcctgctatctaaaaatatgagaaagaattacgaataaacatgattcttgcccttcaggagcctgattttattgttgtctgaattgattgctgactgtcataactatttcccagaggaagttttcttaaggttatatatatatatatatatatatacacacacacacacacacacacacacacacacacacatacacgtatatacatgttcttagaatgttttataaaatcaatttttattttatttatttttaattttttttagagacagagtcttacagtgtttcccaggctgcagtgtagtggcgcagtcgtaactcactgcagcctcaaactcttgagtttaaacagtcatgctacctcagcctcttgagtagctgggactacagacatgtgccaccatgcctggcttattttatttttttagagacagggtctcactctgttgcccaggttggagtgcaatagtgtgaactcagctcactgtagcttcaacttccttggctcaagtagatcctcccaccgcagtgtcccaagtagctgggacgacaggcatgtcccaccatgcctggctaatttttaaaattttttgtagagtggggtctcactgtattacccagactggtcgtgaactcctgggctcaagcaatcctcccacattggcctcccagagtgctgggattatttatagatgtgagctgccatgcctggccttattttattttttaattgatgcctaatagatgtacatgctttcaaagtaaatgtgataatttaatacattcatataatttgtgaagattaaatcactgtacttggcatatccagcaccttaaatatttgtgtttatgctagaactatttgaattcgtctagctgttttgaaa

SEQ ID NO: 4445 - DNA, 1205 bp, Homo sapiens
taacatatgcattatgattctggagtctttgcagtgctattcctaattcatcaacctgaactgcttgcttgatgtttttttttttttttactaattccatggaattacatccacaaaacaaatgttgaccaaacaaaggtgaaaagcagctttgaagacagaaatatatcaacataaaataatgctttaagtgttactcattttttaaaaaggatccgaaatacatcagcacagtggaatttgccataagcattttttcttttcctttcaaaaaaatgctatttttgcaaaacatatatgtgctcattggagtgatacagttatttgaagaaggaaaaacttaaaaaagcccatatttccaatcttaaactgtgagtctcatagaagtttacacatttatattgaaaatatggaacatacatttctgataatcatataagcatatttataattcttataaacatcattttttacatttcttcaggcctgtctacaagtcattttgcttgggcatttcactcagtagcagaagaagaactgctgaacatgttgccagccatgcagaaagatgatcccacttggtctgaactaagagctatgggtgtggggtggtgggtccggaatacccgcatcttacgcaaatgcatagaaaaagtaagtgttttattttggtgtataagtgaattaatattttttggacgtttctttaaatggcatttcatatcttctctgccattactccctcttgtttttgaagcagcaaaaggcttttgaatagtctttacatttcatttataacgtgtttcaaaatatctaaagttttaaaatgtatattctaattcccaagtttttaattgacaaacttgttagtagtatatgtctgatttttacaaaataatatatatgtttagaaaaatttaaaaatagtacagaagaacttgtaatgaaaggcaatagtcctattattctctgtatccattgaagccaccactgtaagtcacttttgttattattttatatatacatgcacatattattcatatacatatttttaaaattttattaaacattcaatggatatgtgccagcctttcatatgaaagaaattacttgttcaaaactgtttctgtgaaattttgatcaatattttttgattataggtagctaaagcagccttttatagaaagaatgatcctttagatgct

SEQ ID NO: 4446 - DNA, 1157 bp, Homo sapiens
aggtcatgggtgaattttattatgtgatgtatatattttctaaatattctaagttttccacagttagcgtgcataaaaaacgcttagtagtcataaaaaaccaaccaaccaaccaaccttatttccttcccacttgggcttttggagttggctttggtttaacctttggattgctatagctgctggtcagaattaaaccatgtgtctacttttctctcaccagacagtggtgcactccatagagctccaagcaactgatgggcatgaccgtccactcaccaactgctcgatcatcaacagtggcaagatagacgtgaaaacgccttttgtggttgagatcgctgattggtgacacaactggcagaaaacaaggatatgctttggcaggggtgtgtgtgtgtgtgtgtgtgtgtgtgtgttgtgttgtctttcaattatttgcttttttttttttactttctttttgtattctatcccagatcacaggaaagttataaaaatcaaaccgtcaccctttagtttgcttgaactttagtaaaccacctgcttagggactttgaacttaaatatatccccttcctcaagtggtgctattttaaaactaaaaaaaactttgaattggctatttttttaatgcaatattttttttctgaattcattatgatccccatattgggtaatgctgaacatttatctgaaacagatgaggatattattattttgtatccaaacagaaattcagataaagggaaatttgactagtgtaatctgagatatgtcatagggatttctttctgacaaaagggtgctttgctgttctttatattaaatacttttagatcaactctttttgcaagactttttaaaaatgtaaagttctttaagaaatatacaaaaatacacacactctagcattaacagtgaacagattagaaagattttataaatcaaactacaaacataattagataactcagaaattatgcccatccacatctcatatacttaaggtgattatttacttattgttattcaatgtaacatttttagaaagttatctttagcccagttgcaataggaatattttttgttacttacataaggggattaagactcaggctataaggcctgggtatggtggctcatgcctataatcc

SEQ ID NO: 4447 - DNA, 1194 bp, Homo sapiens
taaggatagacatgggtagtactaagagtctcctgtattgaaagcagtgtcttacatgtacaataagtataaaataatattataccaggtgtaaatatatgcaagacataggcctttccatcacagagcttgcaatttagtaataaggaagaaacaactataaatataaaatttactgcctaatagtaagagccttgacacaggccatatagagtactcaggaggagaaagtacgtctatttaataggagttggaaaggtgtcataggagaggaggtatttgtgatagacctctggagatagatacttaagattttaatagaggaattggttgtgatttaggaaagtagtgggggaaatgtaaatataatgaacagaatgatcatagcaaagaggcatgaagtgggaaagcataggctgttcttataaaacagaggagggcccgttttctaagtcatttctggtaataagggctggaacttaagtagtagcagtaggaatgcaacaagaagattcttgtcaaagatgatgccaagggctcaagcttcagtgtctggtccagttttggaaatacagttactaaaaagctgtttggagggtgggaaggagataggatttgcaaatttggatgttttaatttttacagaatgaaattcggctaccagttagaaatatggatctgttgttgggagaatgattgggcttaaaaatagacataaaggagtcctttgcagaggtagtgtttaaagttgtgccagctagaacttggaattcttatgtttaggaaagagaaaagaaagctaatgaaggaaataacagctagagaaaatgtgaagatcactatgatgatactgttagagcaattagcatgtctggaaggcttactttgtgctaggtgtaacactgagcccttcagaatttatcatttaatcctgacaaagatccctacatagcaggtaatattcccattttattaggtaggtgcaaaagtgaaagcggcaaaaaccgcagttacttttgcaccaacctaatgaagaaactgagacttaaagaagttaagttgcatgtgatcacataggtactaagtgatagacccagcattgaaagcttttgatgaatccagcctcaggctctttcccttttatgatatggtcttagtccattgaagtcaaggaatgaaataatttctaggaga

SEQ ID NO: 4448 - DNA, 1220 bp, Homo sapiens
gtctaattgaggtaattttaagttgggaggtttatattagtgaatgtatgttgatttatgaaacagtataattttgttcctttaatttttaagaagtaattgaatccctgatatctttgtttcgtatctttgttattaaggtatataaataaagggtagtggttaatttaaaagtatactgtggtttgatttcaatgggcatcaatagatagcagtaattcttgcctaagcttttgttatgttatctaatttcccagacatatattttaaaattcttagttgactaatttccttttcttaatattctagctctctatcaatatcagctcacatcattgaaaagataattttgaagacatgttttgctgaaaagacactaagaaaaattttacgaatgggatgaacatgctccagttaattgactacctactgcaatttgaatgttaacattacccatctggtacagttacctagtgatgtacctattttcacaataccctgtttcagtgtgcttgtcttgattaaagaattcaaagtggagtaccgcaaacttgatatggaaaataaaaagaaagacaaggacaaatcagatgatagaatggcacgacctagtggtcgatcgggacacaacactcgaggaactgggtcttcatcgtctggagttttaatggttggacctaactttagagttggaaaaaaaattggatgtggcaattttggagaattacgattaggtaagactattttgtttattccattatgttagaaacattttaaaaattggaagatactttttaatgaaaatgatttagttatttaattgtttagttgtttaatggttgtggtaattttaaagaataaagatgttggaaatttcttttgtagttgtattttcatgtgtaaggaattccctagtataggagtgtctactttagccatccagagattgactatccagattatgagaaaacaaacaattaaattaaaatagcccagtaggctgaaatagctgccagtaaagcctttgcaatgttctttaggaatgatatttaggccactttttcagattcaaaaatgtttagtaattgataacttttggggcataggtatggcttaaagtcaagttaatatactgaaactgcatacaattaatgaaatttacatcattgtaatttaattttttccttttacccttccttctgccccaagtatgtttgggg

SEQ ID NO: 4449 - DNA, 1200 bp, Homo sapiens
ttttataagtctgttttcacactgctctaaagaactactctgagactgggtgatttacaaagaacagaggtttaattttctcacagttccacatggctggggaggcttcaggaaacttacaatcatgatggaaggcgaaggtgtggaggcaagtccttctgaacataaccagatcagacatggcaacctgctgaatttaagcatattagtcagtggaggaaaagaaattaacctggactccctcagtaacagcaagtgaacagggaagagcccagcattgaatccctgccccacagtagggtgcaggaaatgtggcatattgaagacccactccccggtgatgctcatggggggcccaagtccttctgattgaggcccagctcatggacggtgtgaggctggtagtggtccccagtgtgccaggcccaggtcttcccagagttgggctgcttgggaatgcagacgaaagagggtggtaaactccatctatggctaaatactggcatgagaccaatagtcaacaagtaccataagtgaaagttgaaaagaacttagaagagagacttcaagagggtatgacccgctctggggatggtatcaagtagggagtttgactggggcagtcaaggcatgtcttacatagtggcaggaggagtaggggactgccaaaatctttaaagccatcagatcttgtgagaactcattatcctgagaacagcatggaggaagcaccctgtgatccaatcacctcccaccaggtccctccctctcatgtgatgattacaatttgagatggggtttgggtggggacacaaagccaaaacatatcatttcaccctggcccctcccaaatctcatgtccttctcacattttaaaacacaatcatgccttcccaacagtcctacaagtctaaactaattccagcattaactcaaaagtccgattccaaagtatcatttgggacaaagcaagtcctttctgtgagcctgtaaaatcaaaaacaagttagttacttcctagatacatggcaatacaggcattggataaatacacccgttccaaataggagaaattagccaaaacaaagaggttacaggccccatgcaagtccaaagcccagtgggggagtcattaaatcttaaaacttcaaaatgatctcctttgactccatgtctcacatccagggcacagtgatgcaa

SEQ ID NO: 4450 - DNA, 1387 bp, Homo sapiens
cctattcagacatatctgatgctgctgacgatggtggttctgacagcaggtcggagggtatgagatcaaaggccagttccccatcagatattatttctagtaaggacagtgttgtaaaagggcattcttcaactacagcacaatcatctcaactgaaagagtcccattctccctattaccacagctatgatccttattattctccaagttacatgcaccctgggcaggtcggtgcccctgcagctggaaatagtgggagcacgcagggaatgaagatcaagaaggagtctgaggaagatgctgaaaagaaagacaaggcagagcagttagattctaagaaagtggaccacaattctgcatccttacagcctcagcaccagtcggtgatcacacaaagacatcctgccctggctcagtcactttattatggccagtatgcatatgggctctatatggaccagaagtctctgatggccaccagccctgcctatagacagcagtatgagaagtactatgaggaccagaggctggcagagcagaaaatggcccagactgggagaggagactgtgaaaggaaaagtgagctccccttgaaagagctgggcaaggaggaaactaaacagaaaaatatgccatcggccacaatctcaaaagctccctctactccggagcctaacaaaaaccattctaaactagggccatcagtgcctaataaaactgaggagacaggtaaatcgcagcttctctccaatcaccagcagcagcttcaggccgacagcttcaaagctaagcagatggaaaaccaccagcttattaaggaggctgtagaaatgaagtctgtcatggactctatgaagcagacaggtgtagacccaacctcgagatttaaacaagtaagattgtggagcgtggccccaacagggagagagcagtctgagacttgtattatacatgtctgggcttgatctggttagacttctgacacaggaaagaaacccatattagttttttcctctgctcttgaaaaatatcttaagattctcaggagttactatgtagctctaaaatgtacattatcagtattttcttgtcatggtgtatagtaaaaggaactgtggatgggtgctttgcagatttgtgtttcatgccactaacttgctctgtgactctgatgaggtccattaatttctttttttaaattttttaaattttttgagacggaatctctctctgtcacccaggctggagtgcagtggtgcaatcttggctctctgcaacctccgcctccgttcaagcgattctcctgcgtcagcctcctgagtagctgggactacaggcacgtgccaccatgcccggctaattttttgtatttttagtagagatgggg

SEQ ID NO: 4451 - DNA, 1137 bp, Homo sapiens
taatattaaaattaagtagaactgaatggcaccagaaaatgtaatcggccgcaccaggagactttatcaagacagaaagcattgttctcctaaccagtacctttttggaaagcttatcaaatttagtattactttcacatatcttggagtcaatccattatctagcacacaaatggaacagaatttaaaatggctttctgctcaccggtttgggaaagtgtgcactaattcatatatactaattcatatgctgagatgtactaaataaagtattaatagcataatactttggctaaatgtcaaagtcttttgtggctgaaaatttctcaatcaaaagctgtgtataaaaccaaaccatttggtttttgtgctttttccctgaacccaagaaatttgatttccgaaatgtcaacatgtgctttctcacttgaagcattcacattgtagcctgtcgtttaccactttgaacagcaaggttttgtggggtggggcaggttttgtgcatgctgtgtggtaggccaggtctgggtccccactgcagtgagcaacagacctggacgctctggtgtgtaccttctacggccacaccactcgcctttccctcctgtctcccctgagaggcctgtttgggtaagaagagataatgggctgcctgttttctctttcaaagaaaaccggaaagcctttggaccaataattctgccacccctttagagtgctgaatttcttcaaaggaagcctgaatggaatgctgtactcttcaccctgaggctatccagtctgttgctggctgctcacaaatagagctactagtttccactgaaaaagatctttagttattttaagcaaaggacatcagaaggaaataataggtttctacctcattcttccatcaggcattttcctgccctatatactaatccccacagatatttgccatgaaaaaatttatttattgttccaggtggcaacccccaagtgttagcattgtccagccaaacattctgtttgcattggtattagatttactggttcagggactgtggcgagtacaaatcagatttttgtccagaagtgtgtgtgtctgtgtgtgtgtgtgtgtctgtgtgtctgtaactcttgagagaattacaaggc

SEQ ID NO: 4452 - DNA, 1197 bp, Homo sapiens
agggacgtttatatttgaatttccctgaaccgccgagtgtgggcggtggcgcagatccgtcccggaaacctccgggctccttcccgcctttctcaggcccggcccctccaaggggtccccgcggggcggcgggagggccctgggcccagagccgcgcgggtgggcagtcccaggcgtccttccttacagccctgagcctggtccgggaaccgcccagccgggagggccgagctgacggttgcccaagggccagattttaaatttacaggcccggcccccgaaccgccgaagcgcgctgcctgctccccattggcccatggtagtcacgtggaggcgccggggcgtgccggccatgttggggagtgcggcgccgcggcccgcgccacctccgccccccgcggcttgcctccagcccgcccctcccggccctcctccccccgcccgccgctccgtgcagcctgagaggaaacaaagtgctgcgagcaggagacggcggcggcgcgaaccctgctgggcctccagtcaccctcgtcttgcattttcccgcgtgcgtgtgtgagtgggtgtgtgtgttttcttacaaagggtatttcgcgatcgatcgattgattcgtagttcccccccgcgcgcctttgccctttgtgctgtaatcgagctcccgccatcccaggtgcttctccgttcctctaaacgccagcgtctggacgtgagcgcaggtcgccggtttgtgccttcggtccccgcttcgccccctgccgtcccctccttatcacggtcccgctcgcggcctcgccgccccgctgtctccgccgcccgccatggcgactgcgacccccgtgccgccgcggatgggcagccgcgctggcggccccaccacgccgctgagccccacgcgcctgtcgcggctccaggagaaggaggagctgcgcgagctcaatgaccggctggcggtgtacatcgacaaggtgcgcagcctggagacggagaacagcgcgctgcagctgcaggtgacggagcgcgaggaggtgcgcggccgtgagctcaccggcctcaaggcgctctacgagaccgagctggccgacgcgcgacgcgcgctcgacgacacggcccgcgagcgcgccaagctgcagatcgagctgggcaagtgcaaggcggaacacgaccagctgctcctcaagtgagtgctagctggcggc

SEQ ID NO: 4453 - DNA, 1199 bp, Homo sapiens
tccatttacttatctgttcagccccagtatatgttaaagcagtttcaaaattttgaacctgtactgctgtgaaaagtaaatttaccagcaagagtacagtttttatgtatttggtagctcctttttatctctagccttctagatttagtttttgcacattagatgccctttctctcctgctctgttgcaggtacttgtgattctgagggcctaagctatccatcagtctttttgagttgtcactttctgaggctactgagatgaattctgtcatggagaaacacagaagaataattacccagcgagccacaaggtttctaagatgaactttctggtgtaggatgtgtgatttttaatttttttatgccaaatatacagcttctatattcacagtaatactttacaaatcaccctatattgtgtgtcctttgtgtgctaactgaacatgagatagcccagcaatcctaaagggacactaggtagtgccttccacatagtaaccagagtccctttgccttggtttctgaatattcctcagcagtctgctaaaacgtacttttacccactcttaggtttattttgtcagtcagtgtttatatctttttttttttttttttgagacagagtctcgctctgttgcccaggttggagtgcaatggcgtgatcttggctcactgcaacctctgcctccggggttcaagcgattgtcctgcctcagcctcccaagtagctgggattacaggcgcccaccactacaacctgctaattttttttgtatttttagtagagacggggtttcgccatgttagtcaggctggtctcaaactcctgacctcaggtgatccacctgccccggcctcccaaagtgttgggattacaggcgtaagccaccacacccacccagtgttcttatctttttaagttctttatttaatttatacttttggaagtaaaggctttgtaagggagccagacttgacttttaccaaaaccacatcttaacatttttttggctaagtacagaaaaattatatgtatatttacagaacttacatttgtggaatatgtcttttattcttttatcagccaaaactatcctgaggtctgtgttttgtatttgaggaattttgggttttaatttcttaaaatctcttgaattctagtgagttagagattccatagggttgtactgttttcca

SEQ ID NO: 4454 - DNA, 1196 bp, Homo sapiens
caaatactgacatttcattagatgattattttcctagaatccccaaagagcagtggcagtccatggcttggttgaagctagaaattttcctgcccctggtgacctggtaagcctcctgctcggaaccgtgtgagtgggtgaggaagatgagagatggtcagatggaagagagaaatacatgaactgctctggcctctctggttctgttcttggcccagagtttttgaaaagcagcggagcatgactgacttcacatgctcagctttctcagccttttgtttattttgttgtccttagatttccctgttgtaaaaggggcaagaaaagtaactcatcatctctaacacaccatggcagcttagccaggtagtcttagtggtggtgtttaggcataagatatgctgatcatcagtctcaggccacagtttccttcactaatcgtccagcttgagtgttctgttctcttcctgcccatttccttgaacctcctgctctagccttggcggagggagagtgctatttgcttttgttctccctctgtcttaggaaaagccatctttaatatagttcttcaccactgttggggttgttttgtgattttttttttcttccgaagaactcctggttgttattggattttgtattttaatacaaattattgaattttataagcttgtacacaatatttaattagtgtgaaaggaaacaaagaatgcaggaaaaataatttaatatcaacctcagttgacaaggtgctcagattattcaattcgggatcctccttttgttaggtttttgagacaaccctagacctaaactgtgtcacagacttctgaatgtttaggcagtgctagtaatttcctcgtaatgattctgttattactttcctattctttattcctctttcttctgaagattaatgaagttgaaaattgaggtggataaatacaaaaaggtagtgtgatagtataagtatctaagtgcagatgaaagtgtgttatatacatccattcaaaattatgcaagttagtaattactcagggttaactaaattactttaatatgctgttgaatctactctgttccttggctagaaaaaattataaacaggactttgtagtttgggaagccaaattgataatattctatgttctaaaagttgggctatacataaattattaagaaatatggatttt

SEQ ID NO: 4455 - DNA, 1176 bp, Homo sapiens
ttttgcactgttcacagctcattggtacaatcataacagaagattgtattttgctttggttttagtcttgttcctaagggaaaaatcagtgttgtgtgttttcccagggagatgctgtaccaggacacttttcccaaaggaatgcagctttgattcacccatttttaattttttttattgctttagttttatttcctttctatccttgctaatgttaataaaatgcatgccataaagaaataaactcctgaggacatgaaaggacagacctcatggctatttactctgctgacggctcctgctctttagctcctgctctttagtacccgcgcattcacgagtttgaagctggccctccgcgacagctttctgttcacaatagagctgcatactaaacggggttggtgccacccctcccttgcagtgtgacaaatctctgctaagaggataatgctaagttctttcaccatctgtctagttttgttttcttccctcccccactgctaccaggaatgtctaaaaacatagtattctacagctgcgtggtttacgtgactattactgtccaaaggggaaacattcagtgtttgctcttgaacatttccttttttttgtttccttccaatacgaacatgatagtatacattcaaacacatgaacttgaacttgagtttgtcacctaggagactatttggtatcagactttacctggatgacacttaataaacttttattgttttcttattgggaatctacaaattctcatcagagaccacaggtgggatgtcatgagtagagaaaactggggcttctggtaaacatcctggagggtccttgacctcttggggaggatggggactccgctcagcttccagctgctgaatcttcctttccttttcctccaaaacttctttcagctgagtaattctctcagtctgaagggaaacctgggttgacagttccattatcaggctaatttttctatcaccttcttccacaggtgggagacctccacagaacccttccagcaagctgtcttctaaagcaaacaagaaaaggaaagtctgagcagttttgattagatttcccagaagtcaaagcaaggaaaaatgaaaaagcttcatttctcacgttcttaaaagagagcacagatgttgcatcatctggttagatacc

SEQ ID NO: 4456 - DNA, 1193 bp, Homo sapiens
ccaggcgactgctaaaacttctattagtggaggcaataagaattagataaataattccttaaattatactccccttttgtcattgccaccatgagaactatgttatgttttggaatgtgggaaaatgatactacttttctgctttatgccaaatcattttgagactcaatttttattcatattttttcttcattgtttccataaaggatttgtgtgaaatgactaagcaaacatgtttttattacattattattacaggtttgaaaatctcacataatagtttatccaaatgcagtgattattgagccttgtttttgtcattttaattgtggttcttgatattagcttataaggataacaaaacaaccagaagtctggtgaggttttcaacttgagaattatgaaaaaagttcatgtgatggtggttgctatagataagaaggcatggaaactatgtataataatgaataatacagtgaaagccttttggatattgctgttatcctagtttctgaaaactctaaagcccctaagtgaagttagaaatgtggaaaaagtctacggccataccaccatgaacgcgcccaatctcgtctgatcctggaagctaagcagggtcgggcctggttagtacttggatgggagaaatgtggtaaaaatacttctaaaatctctgcatactatgagtaatagtagtatacacctcatggagatattgtgaggattaagtaaggtaatatatgtaaagttcttagaacagcgtctactacacactgtcatggaactctgaaaaatcggtaatgaattaaccaccaaaagagtcacttaaagtttctttatgtggtatgcctaaaacaaaaagctttttcctctgaattctccttgccattttcaaaatatctgcaagtagtgttcagagtgtgtcccttccaagctgtcagtttaggacgtcatctggcactcctaggctgcatgacacgatcttttttgtccctttcctggtacctgtttctgttcctatctgttgcctacaggaccatctgtccttagctgactcctgaagatgccactcaactattgaacagtcctctctaaatttgtcctaggtctttaactattaatgggatctatagctatcactttggaatgtgcaacagagatgggttaaaatccaattttaaaaaattgcttgc

SEQ ID NO: 4457 - DNA, 1200 bp, Homo sapiens
agaatcacttgaatgtgggaggcagaggctgcagtgagccaagatcatgccaccacactccagcctgggcaacagagtgagactccatctcaaaaacaaaaacaaaggccaggcgtggtggctcaacgcctgtaatcccagcactttgggaggccgaggcgggcggatcacgaggtcaggagatcgagaccatcctggctaacacagtgaaaccccatctctactaaaaatacaaaaaattagccaggcatggtggtgggcacctatggtcccagctattctggaggctgaggcaggagaatggcatgaacccgggaggcggagcttgcagtgagtcaagatcgagccactgccctgcagcctgggcaacagagcaagactccgtctcccaaaaaaaaaaaaaaaaaaaaaaaaaaagctatattgtttgatcttttccatttggttgtttatatcaactagagttggtttgtatatggtatgagatgggagggtcaagatttatttttttacatgtgactatccagttgatccagcaacacttattgaaaagaccactcttccccctactactctacaggatcacctttgtcataaaatctaagaactatatatgtgtgcatctgtttctggactttataatctcttcaatctgtttttctgtcctgcatcatataccttcatgtcttgatttttacagccttataatagatcttcctacctggtagtataagtccaaagggcttttaaagttacttttaattaatggggacttatcagaaattattagatcttgggctgggcactgtggttcacacctgtaatcccagcactttgggaggctgaggtgggcaaatcacctgagctcaggagtttgagactagccagggcaacatagtaaaaccctgtctctaccagaaatacgaaaaattcaccaggcatggtaatgtgcacccatggccccagctactagggaggctgaggtgggaggatcacttgagcctgagaggcggatattgcaatgacccgagatcgcaccactgcacctcagcctgggtgacagagccagaccctgtctcacaaaaaaaaaaaaaagaaaagaaaaaaaaagaaattattagatctgagttatggttttttcgttttgttttgtttagtttagatggagtcttgctctgtctcctacgctggagtgcagtg

SEQ ID NO: 4458 - DNA, 1177 bp, Homo sapiens
agatggaatctcgttctgtcacccaggctggagtgcggtggcacgatctcagctcattgcaacctccgcctcccacattcaactgattcttctgcctcagcctccctgagtagctggaattacaggcatgtgccaccatgcccagctaatttttgtatttttagtagagacggggtttcaccatgttggccaggctggtctcgagctcctgacctcaggtgatctgcccacctgggcctcccaaagtgctgggattacaggtgtgagccactgcacccagccaatttttttaatttttaacttttgtgggtacataggtatatatatttatggggtacatgagatgttttgatacaggcatgcaacatgaaataatcagagggagaatggggcatccattccctcaaacgtttatcttttatattacaagcaatccaattacacacttttatttaaaaatgtatattactgactgtagttaccctattgtgctgtcaaatagtaagtcttactcattctaactatgtttttgtacctctggtaaccacccttctactctctatgtccatgaattcaattgttttgatttttagatcacacacgtgagaacgtgtgatgtttgtctttctgtgcctgacttatttcacttaacgtaatgatctccagttccaaccatgttgttgcaaatgacacgcaggatcacattcttttttatagctgaatagtattccattgtgtatatgtgccactcaattttttttttttttttttttttgaggcagggtctctgtcacccaggatggaatgcagtggcgtggtcttggctcactgcaacctccacctcctgggctcaagtgatcctcccacctcagtcccccgagtagctgggaccacaggcatgtgccactacgcccagctaatttttgtatttttagtagagacaaggtttttgtcatgttgcccaggctagtctcaaactcctgagctcaagctgtctgcctgcctcagcctcccgaagtgctgggattacaggcatgagccaccgcgcctggcctgtgctacgttttctttatccattcatctgttgatggacacttaggttgcttccaaatcttagcttttatgagcagtgctgtaacaaacatgggagtgcagatatctttcctttgttttgggt

SEQ ID NO: 4459 - DNA, 1169 bp, Homo sapiens
ctaaaatctctcataactcaagtatggaatactttttttaaagaaattcttatcatgggtgttgtaataatgaagacgaatttgactttatgcagtgttctgcagcatgcctcccccacatctcatagcaccaggttgtgtctgacctgacataccctgcagctctcagctggctgcagtaacattttgtgggagaaagaggagctggagttacagaaatgattgtctcttggttctcagtttttagcccttgagaggacatacttttccagcctcatgggtatggcactcttaattaaaatttcagtgactgtttactggatgaggcagatttttcacatttttgcaaattaaatatattttatatatattaagtttaattttttcagtttttttaatgtaaaagcaagtgaaattttaataaacttctgtaattaccaaaaaaaaaaaaaaaaaaaaagccaaagccattaacgtgcactacccagatcaacttggagccaaaaggggtttacttctgaatggctgtccgtatgtgtccacataggatttagttggtttgtggcctcctttatagaaatgtgttgtctttccctagctgtctctgctgtctgtcttcctgcatatcccccttcattttaaaatcatgaatcagttgtaagtggtaaatggtagtagttcatctttcccatcaacatgattgtctctttattttaggaataatagcatttcaaaaattcctgtggtaaagaaacattaatctgaaacttaagccttagaaattaatcgcaggtatgatagaatgaggcttggtggttccatagctttcttggtcctttgaaatgggaaataacctgaaccaaaaatcctagtttgaaagttacacttcagtgatttggcctataaacagtggtcctatgattatacattttttccttcactgatttgcataattttgttttcatggccacagcaaaacaatgtgaaatatatttttgctatacccactttttttatcaaattcagatgtctactctcaccattttatattcatttccccagaaaaatgtgctgttttcataatgtctttatttagcaggtctttcaaaccaaatggaagccttacctgtctttgtccttaatagtgtaaatatcttgcacagagtgtt

SEQ ID NO: 4460 - DNA, 1174 bp, Homo sapiens
ttgtatgtactatttatatgtcttatttggtttttactaagcttcttcatagtaaaatctaccttacaattctagacctacatagttactttacagaaataattctagttacctgatatttttgtcatatttttccttatgattttaccagcttggcttcctttcaacagtttttttgtttttgtttttgtttttatttttatcaccagcttgtgctgataaaggtaatctttctcctgcattctgtcttgcaataactgatgtgtatatgttttatatataagtagatttttttccatgcattaaaaaatatgttgctagatttcaatttttcagatattatcaagatgttagaatttttaaatagtgaaatattatgtaaacaaggctaattgtgattgaccatgtcagggtttttgcatctctccctccagttggcagtatcatatctgatcacagcagcaagatcagtggccagagctgccccggaataggtggggcttacttgcaaaagaaaatccttcagattaccaggagcacagccaaaagaacagacagtactgagaaggccactgaggagaatagagacaggacaagttgtgagaacacaaccagaaaaagaatgacatccccgtttagaagacttagggaaagaatgctttcaagggagagactagtcaacagccaaaaagaggacacagatcacaatcaagctacagaaagctgtgagaaagtgaaggatgttggaagcaacatcaaagatgagaaagggagtgccatcttcaattcaaatagccaaggcaacagtaacactttaaactgcttctatacgcgattcaagtctaaaaggaggaagacactctgatgaagttccttatttaattttagtgttaagtttgttttcagttattaatgtatacatggcttaaattaaaccatttgtcaaagcttaggcagacaacttagtaaaatactatttataaacacttgaaaatgcctcatttgtacataagttattttactgatgtattgagttagtaaattttatactcttgttttctgtagttgactttatttcctactgttagctggatctgtgagtgaaatatgtagaggaggcttttttatcttctactttttacgtatctttgattgggggagaagggactagtct

SEQ ID NO: 4461 - DNA, 1177 bp, Homo sapiens
cccaaagtgctgggattacaggtgtgagccactgcacccatgcccggctactttttgtatttttagtagagacggggtttctccttgttggtcaggctggtctcgaactcccgacctcaagtgatctgcccgcctcgacctcccaaagtgctgggattacaggcgtgagcaactgcgcccagccattgccagattaatttttacaaacatattttactgtgtgtatcatgatacagaatacagataaagaatattaccagcactccagaaatttcccctttttccttctcagtctcccaaaggaaaccactcttctggttctgtcattgcagatttttttctttgtgcctttgaacttaatttgagtggagtgtttttgtttgtttgtttgtttgtttgttttgtttttaaagacaaggtcttgctgtgttgcccaggttggcctccagcccctgggctcaagcaattttcccaagtagctgggagtacaggtgtataccaccatgcccagctcattgtaagtattctttctggcagccaagaggactatgaagctaccttggttctttgcattttgcctttgtattggacttttaacctcctctcttggggctttccttgctagtcatctgattatctatcctttatatcctgacactaaaatctcttctgtttctgtgcattgcataggatgggaacagtatggtaacggtgtcactggcctttgaattttgcatttggacaagcctacttcaaatctggactccagttctgagaatttgaccataggcaagttatctaacttctctaggattgaatatctttttgggattcttgtgtggaccaaatgagataatatatgtgaaataattagcaaagtatcttgataataaacagtaaatgatagcctacatattagctgactattttctctgtctggaaaaccatcctctggcctggtacattctgattcttcactgaaagctctagtgctcatttgcagaattgtgcatccttccttcctcacttttccactcctctgtgttcctagatactttgcgccttcttccaccgtagtaattactgtgctgtgttatgattacttgcatatttctctctgattgtaagctccttgaagacagtgagtgtacccttatctcccagtgttcattacaca

SEQ ID NO: 4462 - DNA, 1099 bp, Homo sapiens
gtgtgtctgcaatctgtttggcccatgaccttttacctagtcccagttattacctgagtctcccatggatgacttgctgccaaggagtgtttgtggatatattttctttggcttaattttcttattctgtgcattaacaaaattatccagttgtctgattttggaattctatgagtcaatctttttggcagaattcagaatattaaaaagttcatacatttgcgggccattgtacctttttttttttttttttttttttgacggagtttcactcttgttacccaggctggagtgcaatggtgcgatctcagctcactgcaacctccgcctcccagttcaagtgattctcctgcctcagcccccaagtagctgggattacaagtgtgcgccaccacacccagctaattttttatttttagtagagatgagatttcaccatgtgttggtcaggctggtcttgaactcctgaactcaagtgatccacctgcctcgacctcccaaagtactgggattacaggcgtgagccactgtgcccagccttgtacttttttttttttttattgtagctctgtatagcacttggataatgtctgggtgtctccttaaccatcaaactgttctttatttaaaatgtttaattaccgtttagaaattctagtcctcaataagtgggtggctcatgctattgttgttcctaaagctaagctttgctgggaaggaaatgacctatagtttcttaaagaatcattaatccttataggattcctgagttactgttttgttcctccccactgcttcccattcctgagttttgtaattcctaatccttctataatttctattaccttcaccatagtcattctttccttacgcaaagcccaaggaatgagctgctgctactttaaagtgtggtcattatgatgaatgtgaaaagagttttggcttgttctaaataatttttacaagttatggtacagacagttgttacatatcaaaaaaaacctgtttattgaaacaggaaataaaaaagggatcttttacattatagaattaaaactaattttttcttgtatataaactaattggtttgattttaaat

SEQ ID NO: 4463 - DNA, 1202 bp, Homo sapiens
tatgagaagcctaggctgatgaaaaggagccagggaggccggaaataaaggagaacttgaatcacgaagtgcttcgctagaggaaaaaaaaaaaactgtccgaagtgtctactgggtttggccactaggaggacccagaacactttaccagacaattccagagaattagttgggggagactcactgcgtcaaaaatttaagaatggaaggtgaggacagtaaatctagcataagcagcttgccttaagcttcttgaaatcaaagaagcaggcaagatgacagctgtgagcccactgggtacaaaagcagtttgggtcattactttagtgaggctccgttggctgcaaatttcaagagaaagagatggacttttcagagaagagtaagagaagggaggaccaagctggggtgtggggagggggctgatcctccatgttataaacgcactttcagaaagacactgaaaagtgccttaaaaacaaaaaactttgagcttgccaaatacccatggcctttcctaccacttatcttctcacaacccccaaatgctttacaaaaaaaaaaagttggcagaaggggtatagctcagtggtagagcatttgactgcagatcaaaaaaaaaaagtttcccccgagtttagaataaagaatcttcacaaaagttaaacctcttcaaagtagcgtcagccttagatattacgtccaagacatcatttgacgcacccagacccccgctcagagcacatccttgactcaccagcctctctctgactctgtccttgcggagggaccgcctcacaggacagagccccactggccccaggagccttgcgagctggtcctgcggggctgctctgccagaccaggtcggaaaggaggggccagccagagccctaagccagggcagccacagacacagcctgtagccccactgctgtccgctgaccccgccattctcaccacctgacctctaggaacacgcccacaggtcaaaggcctttccagaaacctctgaccctgccagaccccgcccccaggtcctcagaggccacgccccttcctgtggcctcgcacggcctcgccctttcccgaggcctgcgcgggggaaggggtggtgtcctttatctggggggtgtcctttatctgggtactgagctccgagtgccatttcagtgcccactgagcaagagaggctgctcgat

SEQ ID NO: 4464 - DNA, 1201 bp, Homo sapiens
acactcaatgtccgtgcagctcagtgtcttcattctgtgacatggggatgacagtaccgtacctcacagggttggggtgagcattgtgtggagtgacttatgtccagaagcacacctttgcaccagtggccttggcacccccaaggcatgctccacaaacagcttgcacattcctttctcacagcgtgtgctgctgaaacattgaggtttgtggaccggacttctctgtagcccttgtatttagttttcacttcctctttcttgacctcctcccaccccccacccaactgcaaggtagggaggctactgaggggccagcctgtggattccagagggcacagggctatctgggatggaggggacagggttctgaagacagaaggtgggaaggtcacactgtaagggcagacataccccatttcttctacctaaacaactgggtgtaataccactgtttccctgagaaacactttcaggattaaaaagtatataagtaaagaaaataaagcatataagtgatctggtaaagatgaaaacatggctgatctgaaggtagtgaattatctcaattgacttcacagtcagttacagatcgaactccttgttctactcttttcccccttctcactactgcccttgactagtctttttttgttgttgttttttgttttttttttgagatggagtctcgctttgtcacccaggctggagtgcagtggcgcgatctcagctcactgcaagctctgcctcccgggttcacgccattctcttgcctcagcctcctgagtagctgggactacaggcgcctgccaccacgcctggctaattttttgtatttttaatagagatgggatttcaccgtgttagccaggatggtttcaatctcccaacctcatgatccaccggcctcggcctcccaaagtgctgggattacaggtgtgagccaccgcgcccagcgactagtctttaaaaaaatgaataatataaatttttttaaaagatgaaaacatatatataccctgtaacccaagagtcccactcctcagactcttctcaaaccacactcttacccatgtgcaccagaatacccacacagcaccagaaaatgtccaaatgaccatcaaaagtggagagtacaaataaattgtgcagtgttcctggagtgaaatgaactacagcgacttgcaataactgtaatatt

SEQ ID NO: 4465 - DNA, 1096 bp, Homo sapiens
gcagcagtcactgcgcctcccctctgagcgctggcggccgggcaggcgctctgtaacttgccgtacacacctttctcattgaatattcctgaccgcccttaagctggtcatattatcctccccatcttacacggggaaaactgagctacagaactgaaatgactggcccaaggtcactcgggtgattccagcatgttcctctgaggtcacctttatttagttcttaccagtggtgaaatgctttgtgttaaacgtgcagcagatagtgatgatagttgcatggccttggatatgctaagaactactgaagtgtatgctttaaagaagacaagaggactgagacctttttttttcttctatatgtcttatatgtgtgctctctgtttactctcttaatttttaaagagtttgtagtgttttatcttatctacacatgggggactgaagagttcgagagatccaagaggaagaatccagctgcctatgaaaatgacaaatgagcaacgcatccggatgacggttccctgtctctgaaagacctttctctggaagaggagtctgcattgtagtgtctcaaagacacaataaacttcctatggtctgcactgttgtgatattacatttttgtgagtagaatcctgtgtgaccactaatattcaagttcatgaagcgcccctcctcagcatgagtcttgaagttttgcctggtctcgggttttggtgaaagagcagggctccccctttgttccattatctacaagaaagtagctgcaggtactcctgcatctaaccatttgtgggtgacatgggctatggcgagtgctggttcttggccctctgctcccatagcaacaataaagtctactaactatattgtaattagtatgtgtcagggacgcttttattttttattttttgagatggagtcttgctctctcacccaggctggagtgcagtggtgtgatctcggctcactgccatctgtgcctcctgggttcaaacgattctcctgtctcagcctccgagtagctgggattacaggtgcaggacaccacacctggctaattttttgtatttttagtagagacaggtttcac

SEQ ID NO: 4466 - DNA, 1374 bp, Homo sapiens
actaattgtaccaggggaacagtgagaggaaaaaggaaagtggggttccagaagtagatttgggtaggctctctgggcggtgggataattatagttgttttataagcccactgtagtatgcctgttggtcagatagtgctaagtaacaaggattgaagggccatgtagtttggaccctgctgataatacctggaacaggttctgaatttggtgttaatctttcttgtcatttctttcctccattcctcctcctttcctctccctcatttttctccctgcaggtattaaactgacactgtcagctcttctggatggcaagaacgtcaatgctggtggccacaagcttggtctaggactggaatttcaagcataaatgaatactgtacaattgtttaattttaaactattttgcagcatagctaccttcagaatttagtgtatcttttaatgttgtatgtctgggatgcaagtattgctaaatatgttagccctccaggttaaagttgattcagctttaagatgttacccttccagaggtacagaagaaacctatttccaaaaaaggtcctttcagtggtagactcggggagaacttggtggcccctttgagatgccaggtttcttttttatctagaaatggctgcaagtggaagcggataatatgtaggcactttgtaaattcatattgagtaaatgaatgaaattgtgatttcctgagaatcgaaccttggttccctaaccctaattgatgagaggctcgctgcttgatggtgtgtacaaactcacctgaatgggacttttttagacagatcttcatgacctgttcccaccccagttcatcatcatctcttttacaccaaaaggtctgcagggtgtggtaactgtttcttttgtgccattttggggtggagaaggtggatgtgatgaagccaataattcaggacttattccttcttgtgttgtgtttttttttggcccttgcaccagagtatgaaatagcttccaggagctccagctataagcttggaagtgtctgtgtgattgtaatcacatggtgacaacactcagaatctaaattggacttctgttgtattctcaccactcaatttgttttttagcagtttaatgggtacattttagagtcttccattttgttggaattagatcctccccttcaaatgctgtaattaacaacacttaaaaaacttgaataaaatattgaaacctcatccttcttctgttgtctttattaataaaatataaataaacagggcatttgtttagatttattttgtcttcatgctctgtgtattatatattattcgttttcactcactgtacaacagattaccatatgtttagcagcttaaaaca

SEQ ID NO: 4467 - DNA, 1163 bp, Homo sapiens
gaggctgggtcagtgccaactgtatctccccagcagtggctgcagcaggttgtgccaagggctctaacttgccttctgaggcatatgtgcagccccacctttcttgccatttctggctgtgttctcttctcattttcttctctttccataacattttttatttttacttttattttttgagccagagtctcactctgtcacccagactggagtgcagtggtgagatctcagctcactgcaacctctgcctcctgggttcagacgattctcctgcctcacccccccaggttgctgggattacaggcacctgccaccatgcccagctaatttttatgtttttagtagagacagggtttcatcatgttagccaggctggtctcaaactcctgacctcaaatgatctgcccgccttggcctcccaaagtgctgggattataggcatgaaccactgcacccggacttccatgccatttttctggtagaatcgtttataaaagtaataacatcagtagcagtaaaaataaatcactcagaatctcagtgctctacttgctgcttcttttttttttttttccttatagagacaggatctcgctctgttgcccaagctatatcctgggctcaagcagtcctgctgcctcggcctcccaaaatgctaggattacaggcgtgagtcaccacgtaccccctctcccctggctttttctttttttgtttgagacaatgtcttgctctgttgcccaggctggagtgcagtggcgcgatctcggcttactgcaacctctgcctcccaggttcaagcgattctcctgcctcagcctcttgagtagctgggattacaggcgtatggcaccagcccggtcaatttttgtatttttagtagaaacagggtttcaccatgttggccaggctggtctcaaacccctgacctcaagtgatctgcccatctcggcctcccaaagtgctgggattacaggtgtgagccactgtgcctggctaggtgcctgttccatacttatcagacttcctgtaatttagtacctgttttgtgaaatttggtgaacttctgacttcccttaataccagtattggttcagtccatttctgtcatccctgtcttctgggagacttgggtggatctgtctgggctgcagctcacctcc

SEQ ID NO: 4468 - DNA, 1217 bp, Homo sapiens
ccctagagagaagtatatactagggtactttagagcaacttaatgaggggaggaaatgaaagaatagatcagaatgattttgttgacatgactacagactgaaataatgtgaatgaattaactgaatttgctctgtcaactttagtaaattgcccattgcctttgctttgttcataatttcagcagggcagaataaaaaccatgggaggcaaagaaaggaaatccggaaatatagtcttaacctggtgttgttctaattttccatctgttcttctgactcaactcactggctatcgatgaatcagtaggtagtatttataagtcttaggaaagactactcaagttaaggtacttccctatatccatctcttttaggtacgcaaagagaaccagtggtgtgaagagaagtgaaatgttgtgcctgacactgtaacactgtaaggattgttccaaatactagttgcactgctctgtttataattgttaatattagacaaacagtagacaaatgcagcagcaagtcaattgtattagcagaatattgtcctcattgcatgtgtagtttgagcacagatcccaaaccttacggccaagtttcttctagtatgatggaaagtttcttttttctttgctctgaataaaactgaactgtgggttctctataagtggcattttgggctttccctcttttttgtaaagcaatgtctgcctagtttattgtccagttaactttagtgaccttttaaaagttggcattgtaaataaaacaacttgcaaaaaagttttctggaatagaattaacaaaatattatctttattcatgagttggaaactggaaaaaggcttcttgaagtaaatgttctgagtggagctactaggatgtcttccagcctcctgcagtcaaggagtaccactgtattgattagcctgtatgtagcagggctcccttcattgcatctgaggacttgttttctttttctttatttttaatcctcttagttttaaatatattgcctagagactcagttactacccagtttgtggttttttgggagaaatgtaactggacagttagcttttcaattaaaaagacacttaacccatgtgggatgtcatctttttataattagtgttcccatgtggagaaaattattcacactacttgcatgtaaagaataatttaacttttaacattaaaatatgtggtaaaacccaga

SEQ ID NO: 4469 - DNA, 1122 bp, Homo sapiens
tggaaatgggaagagcaacagtaactccaaagtgtcagaaaatagttaacattcaaaaaacttgttttcacatggaccaaaagatgtgccatataaaaatacaaagcctcttgtcatcaacagccgtgaccactttagaatgaaccagttcattgcatgctgaagcgacattgttggtcaagaaaccagtttctggcatagcgctatttgtagttacttttgctttctctgagagactgcagataataagatgtaaacattaacacctcgtgaatacaatttaacttccatttagctatagctttactcagcatgactgtagataaggatagcagcaaacaatcattggagcttaatgaacatttttaaaaataattaccaaggcctcccttctacttgtgagttttgaaattgttctttttattttcagggataccgtttaatttaattatatgatttgtctgcactcagtttattccctactcaaatctcagccccatgttgttctttgttattgtcagaacctggtgagttgttttgaacagaactgttttttccccttcctgtaagacgatgtgactgcacaagagcactgcagtgtttttcataataaacttgtgaactaagaactgagaaggtcaaattttaattgtatcaatgggcaagactggtgctgtttattaaaaaagttaaatcaattgagtaaattttagaatttgtagacttgtaggtaaaataaaaatcaagggcactacataacctctctggtaactccttgacattcttcagattaacttcaggatttatttgtatttcacatattacaatttgtcacattgttggtgtgcactttgtgggttcttcctgcatattaacttgtttgtaagaaaggaaatctgtgctgcttcagtaagacttaattgtaaaaccatataacttgagatttaagtctttgggttttgttttaataaaacagcatgttttcaggtagagcttaaactaaatgatgtgtttacttagtgcagtttctggttatgaatattatattgctatgtgtatattatatggactctttaaaatgattgacagattggcaaattcttaaatctttgtacattgttg

SEQ ID NO: 4470 - DNA, 1209 bp, Homo sapiens
ttgggattacaggcgtgagccacggcacctggccgaaaccagcttttctttaatgcagaatcggtatttatttattttgatgcagaggctgctgagttctagctgcaacagcatattttaaaacataaacatgtaaggtgtttgccagtatggaataaatacataaggcttttacatttcttttctcagaagaagaaagtcaaacaaaatcaaagcagcaggacagtgataaactgaactccctcagcgttccttccgtttcaaagcgagtagtgctgggtgattcagtcagtacaggaacaactgaccagcagggtggtgtggccgaggtaaaggggacccaactgggagacaaattggactcgttcattaaaccacctgagtgcagtagtgatgtcaaccttgagctccggcagcggaacagaggggacctgacagcggactcggtccagaggggttcccgccatggcctagagcagtacctttccagattcgaagaagcaatgaagctaaggaaacagctgattagtgaaaaacccagtcaagaggatggaaatacaacagaagaatttgactcttttcgaatatttagattggtgggatgtgctcttcttgctcttggagtcagagcttttgtttgcaaatacttggtaagaaaagatctgtaaattattaactaacttaatggaaaatgcaaaatgttaataattatgagtgcttttgatcatagaagtcattgccagtattaatatctaccagatccatgtggctgtttgaagatatattattaactttgctattcatctcatagaatgaagtgttctggttaaatacagagcctaataattactgttggccctccatatcagttggttctgcaccctatgtggattcaaccaattgtggattgaaaatatttggatttagccgggcgtggtggtgcacgcctgtaatcccagttacttgggaggctgaggcaggagaatcgcttgaacccgggaggtggaggttgcagtgagccaggataacggcactgcactccagcctgggtgacagagtgagaccccgtctcaaaaatatatgtatgtgtatatatttgggggaaaaataacaatacaacaataacaaatagtaaataatacaaataaaaacagtataacaactatttacattgcattaggcataaaaaatctagaaatgatttaaagt

SEQ ID NO: 4471 - DNA, 2297 bp, Homo sapiens
ctcggccttattttattttttatttaagaaaatgttttttagagacagggtctcgctgtgttacccaggctggagtgcagtggcatgatcatacctcatacgcctgggctgaagcaatcgttctgcttcaaccttcttagtagttaggactacaggcatgtaccaccacatctggctaattgtttatagagatggaatctcacgtgttacccaggctggtctcgaactcctggactcaagtgatcttcctgtcttggcctcccaaagtgctgggattacacacatgaaccactgtacctagcctagtagtagtttaaaaatacataatcatgccggacgtggtggctcatgcctgtaatcccaacattttgggaggccgaggcagacggatcacctgaggtcaggagttagagatcagcctggccaacatggcaaaatgccatctctactaaaaatacaagaattagctgggtgtgatggcggacgcctctaatccaagctacttgggaggctgaggcaggggaatagcttgaactgggagcaattagcctagatcacaccactgtactctagcctgggtgacagaataagactcagtctgaaaaaaatatatgtgtgtgtgtgtgtgtgtgtgtgtgtgtgtgtgtgtgtgtatatgtatatatgtgcatgtatatgtgtatatgtatatgtgtgtatgtatatatgtatgtgtatgtgtatatgtgtgtatatgtgtgtgcgtatatgtgtatatattatatatttttatatatattattgttatatataattggctgggtgtgctgactcacgcctgtcatctcagcacttttgcaggggctgaggtgggtggattacctgaggtaaggagttcgagaccagcctgccaacatgatgaaaccctgtttctactaaagatgcaaaaattagccggactagtggcgggtgcctgtaatcccagctcctggggaggctgaggcaggagaattgcttgaatccaggaggcagaggttacagtgagctgaaatcatgccattgcactccagcctgggtgacaagagcaaaactttatctcaataaataaataaataaataaataaataaataaataaagtatgtataattatataaaattatttataatacagtaaattatgaatggatgtattataaaatataattatattatgcttaaaaatttatacaaattaatgagaaaaacaggctattgtttgtcttttcatttaataactcagttggctcagtgccctggctcacacctgcaatcccagaactttggtaggctgaggctggtggatcactggagccaagtagttcaagaccagcctgggcaacatagcatgactctttctactaaaaaacaaaaaaaattaactgggtttggtgacatgtgcttgtagtcctagcaactcaggaggactgatgggacgaatccttgagcccagaaatttgaggttacagtgagctatgatcacaccactcaagcctgggtgactgagaccatgtcactaaaaaaagaaaaaaaactaaagatgaaattgtgtcagttactgtgtgcttcagcagtcatataacttgtgtttcagctttgcaaaatattctatatttgttctttattttagaagtctgggccaacggtcacaaaagttgtcactgttgtgacaaccaaaaaagcagttgtggattctgataagaagaaaggtgagctgatggagaatgaccaggatgccatggaggtgatttttcttaattttgactttgtttatgatactatcctggaagcatttattagaaagcattcatggagatgtgcgtttcatttgtgtgagctaggagaaattcccagaattgagagacattcttgctattcttagtagtataatagtatctagttaaatatctgtttagtggaacattctgatgtcttcattcctaactgtatgatctttctgcccctcatcagctcacttcaggcatacaatatggagagaaaaaaatggagtaacagaatgaattaattttctttccattaacacgtaaagatttatatagtaaaaacagtagcaaagccttattagagctgtctctgatgattactgttttagctttatattggcattttaaccttctaaaggcaaagaaaaaaaaactaagttgaaaaattcttcaggagctgcttgatacgtttctaattcaaggtgtcatacgtcatttgaggtgattttaaaattatgaggtttaagtgtgctggagcactataaaaatcttgtggg

SEQ ID NO: 4472 - DNA, 1186 bp, Homo sapiens
ttgaaaaagaattcttttcgtaattcatttattaatttaaatgcagtgtttgcttagtatggtataattgatatatcaaatttcaatttatgtataactttatcagaacacatctctactaccaagtgatgtgaagtgagatattcactgattccacagctccgatgtagttttcctttcatccagaatggttctggtcatttgtctccactgtcaatttacactcaggaaataacgtctaatttttataataatctaagcaagtctcctcagtaaaaaagcaactttgttgaagcaaatcttaagaataatctagaaatataatgataatggccgggcgcggtggctcacgcctgtaatcccagcactttgggaggccgaagcgggcggatcacaaggtcaagagtttgagaccagcctggccaacatagtgaaaccccgtctctactaaatacaaaaattagctgggcatggtggcgggagcctgtatcccagctactcgagaggctgagtaccttggaaacagaaggtagaggttgcagtgagctgagatggcgccactgcactccagcctgggcaaaaacagcgaaactctgtctcaaaaaaaagaaaagaaaagaaaaagaaatataatgatattgaataagagctagggtttggtaatttaagtgatctaaatcttttagaattttcagaggtaattagattttttaaaggatcatttagtttttgaaactccgaactcaactaaacactaacaggatgaaaacaggtgttgctactgtggaatgagcctagtgtcatctgtttctagttctgtaattggagggaccccactgcctggctggctccttggaggctctgtttggctcagcagctccaggcctcccaccaggcaaagggaaggagaacaggaaggacttacatgcctagtcagcctgtataatttatatagcctgttctgtgaccctctctttttactagtggagaatcccttaaaagcagccacagttgttttaggaccaatgaaaggaaatgccctttttttcatagctgcttataaacatatgtaacctattacaagaagttacataagtcagaatttaaactggtccaaattgtcgggctctgataaaagtaggaaaattgattttccagttaaatctaggtgagagtgtcattttcc

SEQ ID NO: 4473 - DNA, 1171 bp, Homo sapiens
agtagcctcctcagattcattggaccagatctgttccgatgtatgggacggcggatagcaggtttgtaattactgtggcccctcagaaggatatttggcctcatgggaggacatagcccatgaaggctgttgctatagttgtaagtaggaggatgatgccaatgtttcaggtttctaggtaaagaaatgagccgtaatataggcctcggccgatgtgtaggaagaggcagatgaagaatattgaggcgccattggcgtgaaggtagcggatgattcagccataatttacgtctcgggtgatatgggcgatcgatgagaaggcggttgaagcgtctggtgagtagtgtatggctaggaatagtcctgtggtgatttggaggattaggcaggcaccaagaagtgagccgaagtttcatcatgcggagatattggatggggtggggaggtcgataaatgagcggttaattaattttatcaaggggttaattttgcgtattggggtcattagtgttcttgtagttgaaatacaatgatggtttttcatatcattggtcgtggttgtagcccgtgcaagaataatgatgtatgctttatttctgttgagtgtgggtttagtaatggggtttgtggggttttcttctaagccttctcctatttatgggggtttagtattgattgttagtggtgtgattgggtgtgttattattctgaattacgggggaggttacatgggtttaatggtttttttaatttatttggggggaatgatggttgtttttggatatactacagcggtggctattgaggagtatcctgaggcatgggggtcaggggttgaggtcttggtaagtgttttagtggggttggtgatggaagtaggattagtgttatgggtgaaagagtatgatggggtggtggttgtggtaaattttaatagtgtgggaagttgaataatttatgaaggagaagggtcagggctgattcgggaggatcctattggtgcgggggctttgtatgattatgggcgttgattagtagtagttactggttgaacattgtttgttggtgtgtatattgtactagagattgctcgggggaatagattatgtgattaggagtagggttaggatgagtgggaagaagaaagagaggaaataaagtttgattatgc

SEQ ID NO: 4474 - DNA, 1227 bp, Homo sapiens
atcttcttcgaaaccacacttatccccaccctggctatcatcacccgatgaggcaaccaaccagaacgcctgaacgcaggtacatacttcctattctacaccctagtaggctccctccccctactcatcgcactaatctacacccacaacaccctaggctcactgaatattctattactcactcttactgcccaagaactatcaaactcctgagccaataacttaatatggctagcgtacacaatagcttttatagtaaaaatacctctttacggtctccacctatggctccctaaagcccatgtcgaagcccccatcgctgggtcaatagtacttgctgcagtactcttaaaattaggcggctatggtataatacgcctcacactcattctcaaccccctgacaaaacatatagcctaccccttccttgtactatccctgtgaggcataattataacaagctccatctgcctgcgacaaacagacctaaaatcgctcattgcatactcttcaatcagccacatagccctcgtagtaacagccatcctcatccaaaccccctgaagcttcaccggcgcagtcattctcatagtcgcccacggacttacatcctcattactattctgcctagcaaactcaaactacgaacgtacccacagtcgcatcataattctctctcaaggacttcaaaccctactcccactaatagccttttgatgacttctagcaagcctcactaatctcgccttaccccccactattaacctactaggagaactctctgtgctagtaaccacattctcctgatcaaatatcactctcctacttacaggactcaacatactaatcacagccctatactccctctacatatttaccacaacacaatgaggctcgctcagccaccacattaacaacataaaaccctcattcacacgagaaaacactctcatgttcatacacctatcccctatcctcctcctatccctcaaccccgatatcattaccgggttttcctcctgtaaatatagtttaaccaaaacatcagattgtgaatctgacaacagaggctcacgaccccttatttaccgagaaagcgcataagaactgctaactcatatccccatgtctaacaacatggctttctcaacttttaaaggataacagccatccgttggtcttaggccccaaaaattttggtgcaactccaaataaaagtaataacca

SEQ ID NO: 4475 - DNA, 1186 bp, Homo sapiens
atacaccgttctctctctttccccctcctctgcctcgcctcctgtatctgtcccctgtgtccccctcagctcccacccctatccttttttaagtttccaacataaaggggaaagtaacagtaatttgaacttggctttcacgcaaaatggaccaattttttttaagtgttggtaatttgtcctgaaaatggatatcgggagttgggctggaaagactttgaagaatggggttttatgagtggaaaatgcggcctgagcatgcgggaatgcaagccgccccccctccatgcctgggacagtgcagcacgtgtaataatcgcagctaatagcaccattattgctattatcacattatattattattcctcatcaaaatcagacaatgcttattaacccatttaattgaaccaagggtttaacatcccaatgacttcacagaaagtgcttggcaaactctctaaggcatcgtagccacaaagtggctggccacttcaccacctgccaggctgtggcggggcccagcaagggtttccccaaaccgttccctcctgtggcctatctgggaactttccaggacacactgggatggatgcgcatcaccacccagactccagcctctttgtgcacacacatgcccacacaggcgcacacacacacacgcacacctctctcccgctgggtaaatgcaactcaataaaggatacccttacacaaaagaccccaccccaggcacggtgtggccaaggatccttcctccatccccaagctggcattcctattgtcaccaaggccggaatgagtacaggcacacacaattcatggtgaacccctggcttctcccaagcttggcattatctccaccaaggcctctcaactctcccacagtccagagcccacagtggggcaactgaagcccacccagccccccaggctcacagagactcacccagcccctccaggcagggatatccactgagcccaggctggtggaggggcctggaggagggcacgatcccctcggggagtccagaagcccaaatcctagcccgtgagctgggctcttcccagggcatgatgtcacctcacagaaccccagtaaccctctgtcaagcgggcattggccccacctgcctacctcttgggatttcctgtcagggtttgaaaagaccctggatatgaccattaa

SEQ ID NO: 4476 - DNA, 1197 bp, Homo sapiens
attggtagttttgtttgtattttatttccaaatttgctttggcttttatgtgttcaagggtgataaatacaaggagtggattgcactaatttttgtttctatatacatatccattcatttacccgggatatattgcctgagctcctgctccgtgacaggcatgttctaggcagggaggatgcagcagtgagtaaagatgaagaaagctctgccctcgtagagtctaccacctagaggcggaaatagcccccaaaacaaaaagaaccctgaacaaaccaaaaccccacaaacaaattagtagatatacaacaaaatattcggtggagatgaaggaaaagttagctgggtaagaagatggagcaaaagaggcattccccttaggcgaggtggtctgggtgggcctgtctgaagaggtgacatttactcagagacctgtgtgaggcaagggagtggagcacaccagttggggaagcgggttttagcttaggaagcaggaagtgcaaagacccctgagacgggcatgtgatcagtgcatgttgtatgtttcaattatgctgagaatgaagattttatattcgtcagcacatgggggtttgggagcctgcagcaagaggtggggtagctagcctagtgtgggggcctaggaggaccccagatccagacagaggagaagcctggggggcagaaggcttccctcaggcttgtgagctgacaggtcggcatagcaccttggctgagggagggcagagggaggagccggggggcacccctccccccacctgcagcctgttccccccacaacatgggcgcatagagcggtggttctcaaccttgagcagaatcacctagagggcttgttaaaacacagactgctgagctccaccccaggatttctgattcaggagacctggggtggggcatgagaatgcagttcaccaaggttcccagatgatgctgatgttgctggtccagggaccacaccttgagagcactgatcgagagcaaacgcagaccgtgccaggatttgccaagaatgactgtggagagaaagtgaggcacaaagccttcactaaaggtgcccccaggggtttgactaggtctgcagtgtcccttgctgaacaccactgcgtgtatgtgtgacaggtgttgcccatgcatctcagtccatggtcactactgtcaggggcctgactacat

SEQ ID NO: 4477 - DNA, 1177 bp, Homo sapiens
gacgccaactaggctgagcaatgacagaaccagctgcaccatgtaccccaccttcagtttaaaagaaaaaaaaaatccccttcactcctactgggaggtgggacccctttcattttcagttttgctcatctagggaaaataaggctttggtttccagtttaattgtttttgaccttctaaaatgtttttatgttagcactgatagttggcattactgttgttaagcactgtgttccagaccgtgtctgacttagtgtaacctaggagattttatagttttattttaatgaaaccctgattgacgcacagcagtggggagaacagcgtcttttacctgtcaccgaagccaggaagccccgtttgtaagcgtgtgttgtggtgctttattgtacatcctccagtggcgttctttttactctaatgttcttttggtttcccccctcagaagaatcatgaatttgcaacagacctaatttttggttactttttgtcttattgatggatttgaaaatgaaagatttaataaggcaaagcagaatctgttgtccttaattatatttgcaatttggaatttgtgtgagttgatttagtaaaatgttaaaccgttgttgtgactggtgtgttccagttattgtgcccgtgagtcacaggtcttaagtcggcttctgcagtcccaggatgtgggggcagggcagtccatccccctcaacccccaccctgctcccacaactccttggatgctccacagtgttcactgcaacctgggtgggtgtgggccatctgctggccccagtggtttgtagagagaatttttataaagtctcaccttttggttctgtgtgacccttgggccagggtgttatccccattccccgttccacagatgaaggagggagtgtatccaaagccgtgcaggtggcatgtggcaggctccagaccctgagcccagctctctcctaccattgtccccttctgacagtctgtgacttagggctgggcctggccacttgctgatgaagctgctggagcctcattccctctgccgaggctgctgggtctgtcatccctgcaggacaggatccctggcagaagggtgcgtggagctttccaaggagaagccgccacagccaaggctcctgggatgtgctggcagctttcacgtgccttctcaccgcca

SEQ ID NO: 4478 - DNA, 1202 bp, Homo sapiens
tgttgtgaggattaaaagactttaaagtgcttaagtgtgtggccatagttagctctcaagaaatgttacttattattgttgttatcacaatactttgtgtataactgtctactaagctcttatcacctctgtttataaacacttttgtatatctgccttactagacttgtgttccttaaggacaggtgcatatcttgttcactttttctggccttgtatatggaagtttacagtaaatgttggttaaatgagtgattgcacacagatttgccttcacaatggaagtgggcaatagatagagtaaggaatgcttaaggctgggtttgtaggtgatcacagacccaaagctgatgtgaccttgatgttacctggtttatcctcttctgtgcctgaatcccttctgctgcctcctggagcccaggaagtgcttttatgtttccaagacagggcaggagaccatctggaaggtaaacatatcccaggtaccacatttatgtcattttgtttttgttgtaaactctaggtgacatgtctgagagtaaagccaaaaagatagaaatcaaggacgtggatgggcagacgctgagtaagctgattgactacatctatactgctgaaatcgaggtgactgaagagaatgtccaggtaaactcaggctcactaatagctcagtgtattgcacactcaggacccaccattttacagcgttattttatttaaccctcacaacaattcagttggttactgaagaggaaactaaagctccagagaggtcaggtgacctgccctgggccacatggccaggaggtggtcgagctggtcctcaaactcatgccttcctggcttgggcacccatgcttttagccactaggccatgatatccctgaatgagcctgggccccgggagtagaagatctttaactcatgtcttcaaaatcttgtgaaggaaaagctgggagcttaggtgactcctattctccccaggtcatcgtctcatctcagaattcaaacaggtgaataacttttgggtactaacagtaagtgcaaagtaatttggcataaaatgagtagaggggaggtagtagaagtctataattggaaccagctctctttgctcttttcatcatgtatttatttaataacttttttttcctgtaaaatacaaagtgtttacaaacttggataattagaagatattctac

SEQ ID NO: 4479 - DNA, 1104 bp, Homo sapiens
ggaggcggcggctacaatgcctacggaggcggcggcggcggttcgtcctacggtgggagcgactacggtaacggcttcggcggcttcggcagctacagccagcatcagtcctcctatgggcccatgaagagcggcggcggcggcggcggtggaggcagtagctggggcggtcgcagtaatagtggaccttacagaggcggctatggcggtgggggtggctatggaggcagctccttctaaaagaaaatttaaaatgcctgggagtggctataggggtagctctttccaacagcccaagtggggtcaactcctaagccccaccccctcacacacaccgccttccctgttttgcccttgggggagccacttctaaggctgcttacccttgggggtgttcctctatttgcctgccacctctcttgtctctccctctgaagatggactcggccccacatacacatttttgtgttacagtcattgatggactctatttttttattattacttggaccttggtcgtttttatactagcaaaatgtcttgttttaatttgtgttttttggggggagggagggagtgaacttgctgattctgtagcaaaacctgggtgggggttggggtggggggtagtttactttgttgtaaggacttgataacctggctacagcgttttctatgaaatctacttggatcccatgcctgaaatttggaagcatatgtacaaaaatcatttttacgttttatttttaataaatcattgtgtttgaccgtacatgtctaacattttttttctaggatccattccgtaccgttttttaagggatatttgtttaagactttacgtgttaattctttattcttgatgtgtacttagagaaacttaagaggtcctgtggtttttttcccctctcctgttgccctgctagttgcgtgttgaattatatcccttacaggcaaaacttttgaagtggtggatgtggctttttaaactcttaagtttctgtgcatccatctcttgtactaagcgaattgtttatcatcttgacatggttggtcatttctatgacaatttacttcaaactgtgtactgtgtagttctatata

SEQ ID NO: 4480 - DNA, 1124 bp, Homo sapiens
tcatacacctgacatcatttggcttttaaattaaatttctaagaaagaactgttcagttcttgctgtttctggttttcccctacttgaaaactaacatttgtaaataaaacatcttttgaaaagttcagaattatattaaataacatctttagaattaaattgagttttaaagagcttgacaatgtcctttcttgctttgccactgggttcagaaatttaaatttatatggaaatagaactctgggctgggcacagtggctcatgcctgtaatccctgcacactgagaggctgagatgggaggatcacttgagcctagcagttcaagaccagcctggccaacatagtgagacctcgtctctaccaacaacaaaaaaaagaaaattagtcaggcgtagtggcaagcgcctgtagtcccagctactcgggaggctaaggtgggaggattgcttgagcctagaaggtcgaggctgcagtgagccaccatcatgacactgaattccagagcctgggcagcagagcgagaccttatctcaaaaaaaaaaaattgaactctggactaaaaagtgaagcttgaataattttaaactatagtaggctttatgaagattatatatatatatatatacacacacacatgtatgtgtgtgtgtgtgtgtgtatgtgtgtatgtatatatgaaccactacataatgatatgatttaaggaacacatagctgatattttgtgacttttttcccacgtggaatcaagagacccatggtactattctttgtgtttgttttatagagccatttcctgcttttaagtcttggcaggaggactctgagtctggagaagctcagctgtctccacaagctggaagaatgaatcatcaccccttggaagaggactgtcctccagtattatcacaccgcagtttagattttggtcaaagccagcgtttcctacatgatccagaaaagttggattcctcatctaaagcactgtcttttactaggtatatgatttttatgtacttacaagaggcaattcctattatgtacccaagtcttttgagagatttagtcttccagcctgggcttcaatagtgaaactccatctcaaaaaaaaaaaaaaaaaaa

SEQ ID NO: 4481 - DNA, 1136 bp, Homo sapiens
aaggtttgaatggtcaacgcctgcggctgttgatattcttgctcagaggccgtaactttggccttctgctcagggaagactctgagtccgacgttggcctacccagtcggaaggcagagctgcaatctagttaactacctcctttcccctagatttcctttcattctgctcaagtcttcgcctgtgtccgatccctatctactttctctcctcttgtaggcaagcctcagactccaggcttgaggtaagtccgcagccgtctccgccacggaatcacggagaccccattgtcccccttagggtccagtcgggcccccacagacagaggttgggagggccgaatggggactatcgcgagttacgagacccgggttctttctagtcaggagtctcgagctgtgtggcgtggaacaagtcaaaatcctctcttcattccatctttaaggtcctaaggttgcctctcgtcggtgaattcaggttctaaccttaagccaggctgtgaatcacccttcggggttgcccctcttccagtgttgattcgcctggctggaaagggtggaggagtttaggaaagctgagggaactgtgatgtaccgatttagatgacgttttcctcctagctaggttttgtttttctcctggtgagaattcgaagaccatgtctacggaactcttctcatccacaagagaggaaggaagctctggctcaggacccagttttaggtctaatcaaaggaaaatgttaaacctgctcctggagagagacacttcctttaccgtctgtccagatgtccctagaactccagtgggcaaatttcttggtgattctgcaaacctaagcattttgtctgggtaaatatacttttatttttacactgtattgcctttgctatttccaaacagttgggtttgtttgttggtttgttttcaattatcccggctcaaaggtcaggctttaagtctcaactctgcccttgactgtgtaacccttttgagtctcaccttcttttctgtgacaagaaataatctcagccaggcgaggtggctcatgcctgtaatctccgcactttgggaggccaaggagggcggatcgcctgagtctaggagttcaagaccagcctgggcaacatggcaag

SEQ ID NO: 4482 - DNA, 1172 bp, Homo sapiens
tggggctgctgtgaactgactttgctgtacaccttctctaggtgaagaacatcatttaccatgcagtgaaagatgcggttggcaccctcaaggctcatgaatccaaactggcaaggtcctaggcatggagaaactccaagctcctctgtgaagcaggtctttcactcacaacacttaacagggaacggcagggctctttgctggagcagaggcccttcacccagagccagtgtggtcagtattccaaactctccagccactctcttctacgctgcctcaacactgaaggttgacacaggaaagtcgtactgttcacacacacagtttgagactccaagccaagagtgccacatccctatcctgtggccttttggaaatccaaattgcctgaacatggcggggctttcctgcacattctcctgatttgagattcacgggcacacctttcttttcttttcctcttgtgcctagttaagtggaaatgtgtttggagataggggaaatcacataactggtacaagtatggggtaattgcttaaacatgcctggtggaagtctgatagcgtctctgcacgtgacctctgacaaagcccatcccaggagacggggtgaagctattccccacactctcctgtgaacactggagtcttgcaagacccagggagaacccactgcttttcccaggaggctccaggattaggaaatgtgtgtatttagtgaaaaataggtttgtagtgaaatagttactatttcatgaaagtagatatttttagaatttttgaaataccacagttgttttcctggattataaggaaaggcacattacatttagtcttcctttcgatataaaactctttgaagaaatatgatttttagaaatcagctacccattatagcacaaaatcagccaaagcagaatttttaaaaattggcttttttaggattctttttctccccctcccatcttagtcttaccttgagggaacagtcatatgagaaggaactttgtcacatctaagctgtggtgtgttccccatgtgtgtgtacaacactggtgactccaggaaccattttcacctattaccagtgttccctggggactcctcttaatgtttccaaatgggaaggacagttgatttccaacatgaggttttttgttttttatccagaaa

SEQ ID NO: 4483 - DNA, 1612 bp, Homo sapiens
gcaaggatgaagcctcaggaggggcctcagacccagcccctgctccacactgtgccagtagcctaggtgtctcaggcccctgggccccgcagatggccatttccggtgcctgcccagtggccactcttctggaaggggcttggaaaagaggaaggaggcccagctgtgggggttgagggtagagggtggaccagaggctgaggactgagccacccaaggaggtggggactgctcggcctccaccgctgttccgctgcagccccgccctgccccacccacccagtgccttgctgaagcccatagcaatccgcttctcagaggtcctgtcgtgtttccactgctcgccttggtttgggagcagggagggggaagtcctagcccagatggaccaaggacgggcctgaaggcacatgggggaaagggagcacacggggaggacgttggggaccctgggtggggcctccaggtgcagctgtggatggaagacagggattggcctgtgcttcagcgaccaggatggccaggccagagctgcagctgggggctcttttcctggtcattgggtggggctgagtgccacatgttcccacattaaaaaggggggtccagggctgtgtgagtgtgtctttctgggtctagggctcggggtagtttgggtcaaggactgtccctccagcagtcgcctcctcccaccctgagccccacagtcatctggccctttccctgctcaaccctccatcctaggctctgagcctcagaggacccagcccatgagagaacggggatctggggggcctctcacctgctcctatgaccttgctcccttttaggtcaccccattgccaccgtgcccctgggctggactcccgtgctcctcagggcccacccctgctctgtctggtacaggcccctgctgagtgggcccctctcctctgcccctggggtccatcccctcttgcccagggtccccatcctgtaccaagcagactgggccctaagacccctggcagaacccagcctctgctcacacccgccccagcttctgccacggcttcagtcagggccaggaggaacacgtgaaggagaaagagaaatgcaggagccgcggggctcccggttccttgggaagagggtgcccattggacctttggcactggatgagccaataaaccaaactctggcacctcatttattttggcctctgtgctttgttcttgccacaccagctgacaggtgggaaggacctcaagtgagaagcagggttcagctgggggagtggggaggccagcctgtgactgacaggagctctggtgcccagctaagagatgggcttgagggggctcagtctgggaaaatggttttgggactcaagataaaaccagaggcctaggctgggcgcagtggctcatgcctgtaatcccagcactttgggaggccgaggcgggcagatcacgaggtcaggagatcaagaccatcctggccaacatggtgaaaccccatctctactaaaaatacaaaaattaaccaggcatggtggcgcgtgcctgtagtcccagctacttgggaggctgaggcaggggaattgcttgaacgtgggaggcagagattgcag

SEQ ID NO: 4484 - DNA, 1141 bp, Homo sapiens
tgactcatgaagcatttgggccagtgcactgtttacttccatctgtttgcagacacatttgtgcccggcgtttgggagccctttgtatcaatgttctgacaagggtccctataaccttaacctactcgaaaccggtttgggatggatatgatggggcttctgtgctattgctgggattgggagaaataaaacatgcaatttaagtggaagcgaagaaatttaaagaggattttattttgcttgggtcaatccttgttaaaagggaggtggatgtgttttccttgtgttggatggcatgagattatgtgaatgttttgatttattaaaatgaactgcaaggtttttcacaggaacgacagacatgtatgactgcatgtaattataaactcctgacctcctggtggggttggagcatctgtttcaaatgtgggacttacaagcacttctcacatgagaaattaggggcgggtgggaagggatgggacacagcttctggcaccatggatttaagaccatgttggatccaaaagttggcctgaaaccctgaagcttatgcttcacagctgggctgtaagtcagacttgaacccagctgatatgcaaggtcatggcgtgcccagggtggtgacagttgaacaaagtgtatagtacgtgcccagtggtagcgatggaaaaaagtataccaaatggactttgaaggaccaaaggttttaaaagtcaattggtatcacctccacactgactagggtagtggggtgcatttggttttcaaattgggtacttttaacactttagtgcctgactgctgttctttactgacttgattcagtcactcgtagctttattggtctgaaccagctccttgttcccaggttacagacctgcctatcgttccaataatcctgtttcacttgaatgaagggagtatgtcttaaatgtaaagtttctggttctcacactgtactctgaggtccaaatactgtctgtcaatgtgtaacctgatgtctcaaccccctgtgagaagagtccattatttggtgttcaccaacgtgggagacttcaccggaacaggcttttttgctttgggctctgctatttgtttgcagaacacccaagagcgagcaaacatgctctcttcacag

SEQ ID NO: 4485 - DNA, 1202 bp, Homo sapiens
actatcgctccatgccaaaaagctatgcaagatgcagaagtcagcaagagtgacataggagaagtgattcttgtgggtggcatgactaggatgcccaaggtatggaccagtggaattctgtcgtggagagagagggctggcgcatagtgtattcttgggacaggtggcacaaatatatggcccattctgctggggtgacctaaaagggagatgagattatatactcactaaagaattcttttctgtttgttttgttaaaattgaaaaataggctgggcatggtggttcacgcctataatcccaacacttcgggaggctgaggcgggcagatcacatgagtctaatttatatatatatatgtatgtatgtatgtatgaaaaattagggaggggcagaatttctttaggggcagtagcagggaggatcccgaactcagtcatagaatttttaggattgaaacaaagtttgaggtcagaggggaacataaaaccttggtaataccccgcccccggccaccatctttgtacatgtgtctttgcagcttagtgcatctctttgacaaagatttgtgcaatgatgtattttattcaacacatcattctgaaagaacgtgtggaaaactaatgactgagcacaaacctgttgaagatgcagttcttcttggtagcctaaataggattatcttggacctaagatagtgaccttgttttttttcttaatttttccattgaaatacatggccttaaggaaatatgcaaaaaaaaaaaaaatgaacctggaaaaaaaaggtcctggaccaggtggatgcctcatatattaagaaatccccgaggccgggtacagtggcttacgcctgtaatcccagcactttgggaggccaaggcgggcggatcacgaggtcaagagatcgagaccatcctggctaacacggtgaaaccctgtctctactaaaaatataaaaaatttggtgggcgcctgtagtcccagctacttgggaggctgaggtaggagaatggcgtgaacgcaggaggtggagcttgcggtgagtggagattgcgccaccgcactccagcctgagcgacacagcgagactccgtctcaaaaaaaaaaaaaagaagaagaaaaagtatccccgatactattcaaatggaactttatcactaataaacacaagggaagaccatgccccatgttagcaatgc

SEQ ID NO: 4486 - DNA, 1202 bp, Homo sapiens; identical to SEQ ID NO: 4485

SEQ ID NO: 4487 - DNA, 1193 bp, Homo sapiens
agttattggagatgtattaagttggactggctcattttaatcatgagagatgcttgcagagggacatctggagaatctgaatccacttctcttgggtatttcaagtaatagttaagtcttagaaatgttgtaacacaaattgataggaaagaaatgggaccgaagtttacttttcatcctgtgtaatacttctttttagttcatgctgaagagatgggtgtgataaaatggaaaaatatctacctactctgaaaatactctagaaattgtcctattgtgtcagaatagtatgttaaatcagccatgcatatttgaactggttggagcttgacataaatctgggtataaaggaatcatgttttgggaaattcagaattgataaaaagtaaaatggtaatccacagtttactaataattaatgctagaaaaattgtccttattatgttacaaatgtggaaggaagactttaaatacggaagataaacttcttgaaacctgcagtttttatttttagtagagatggggtttcactagttgcccaggctggtctcaaactcccaagctcaaacaatccgcctgcctcggcctgccagagtgctgggattgcaggcatgagccacagtgcccggccttgaaacctgtagttgtgtgttaggtttcttttccagtcggagaatttcaacaatgatgtaggttttttaggttattggatatcagctaaggtaaatcgagccctgctatttacaggtgctttactaacccttgggagaacttcatagatctttcgtgcctgatggtagattgcatagtccagagtcttatgtcaaattcatccctgtggcagtacccataaatgggcagtgccttagatggagataacatctccaattgttttctgaatttgtgaacaaataaccttcaatggtaaatattttttcagttttcaggctgaagataaatatttctaatactgaaaatgatgaaattattagaattccacagtactaattaggcaggtatattagtttcctagggcttctataacataaattattacaagcttggtggcttagaataatagaaatttattctctcatcattctgaaggccagaaatctgaaatcaaggtgttggcaggcttgattccttgttgggacttaggaagaatctgtggatgcctctttcctagcttc

SEQ ID NO: 4488 - DNA, 1296 bp, Homo sapiens
tatatatatacacacacacacacaatgcattgctatttattatattctgtgtactagatcactaagtttgcttgtcttcctttttaggatgacttgaaagtagggcatccttcacccatctgaagggaggaaatagtggcaggtgacagtctgcatgtgcagttttcaggtaaatatccctattcattccaacattgactacctcctctgtgccaggcctgtgggctagttggtatctatcaggaaacaaatgggaggtaaattaacctgtatttgtaagatccatgaaggaaaggacaatatatcttgttttattcactgctagatcccaatcgcagtgcttggcacatggcaggacctccctgaatgttgcataaaacaactgaaaacacagaaggggattcctgttaaagggtttgacaacagggtctgcaattagtgcttccacgcctgttttgcagtcaatattcaactgatacgtcttctacctggagtgcctaggtatctgaaacaaataatgagaaagctgtttcaggaatcatccagcggttgtcagctatccaggctcatgtggtgcctgtgatggtgttacactgttggaagagcaaacactgtctttattgaggtttggctccaagcactgttttggtgttgtagctgagtacctttgggcagtgttttgcacctctgagagtggaatgactcctgtggagttgatcctagtctgggtgcaaacaatttttttctgtttgcagaaaaagacaggttgtcttagggacagcctgtcattctttacctctttgaatcctagatgccttcacctgaatgacatctacctccatcaggaccccagatgtctgacagccctgtgtgacaccaagataagtaacgtatgtagtcttcttgtcatgtaggtcccaattaaattactatagctcagatgggggtaggggacttaaaattatgatgtgaaaaattatgtagagtatcagacttttttttggggggggacggagtcttgctcagttgcccaggctagagtacagtggctcgatctcggctcactgcaacctctgcctcctgggttcaagcgattctcctgcctcagcctcccgagtagctgggactacaggcacctgccaccatgccaggctaatttttttattttaagtagagacgaggtttcaccatattggccaggctggtctgaaactcctgaccttgcgatttgcctgccttggcctcccaaaatgctgggattacaggtttttttgtttgttttttgagacggagtct

SEQ ID NO: 4489 - DNA, 1296 bp, Homo sapiens; identical to SEQ ID NO: 4488

SEQ ID NO: 4490 - DNA, 1296 bp, Homo sapiens; identical to SEQ ID NO: 4488

SEQ ID NO: 4491 - DNA, 1102 bp, Homo sapiens
actctccctcaaaaaaaaaagaataaaagtgcatgtcatttaaacccatagttcttgaatagtgtcagttcagtgtgactgtggtctttgttttctcatctctaaaaattagggttaattataacatttgaaatacccattttataccttttaccattttttccccgtgccttattgtaatgtcctgaaagtttttgtgtgctaatgaggattaactaattgttgaaaatattgacaaaattatagtttaagtccctaaacttggatataggatatttgattttggaattaatccattttgctgcatttctcttaggtgacttaatggctgtaattctctttctttatagaaatttctgaataaattggcagaagaacgcagacagaagaaggaaacttaagatgtgcaaggagatttaatgatttcaaagaaaataatggttctttgtttttaatgttaaccttttttaaatacaatactgatagttagaagaaaactattgtactcttttgttttagtggagaaataatagatgtctgttcatgtgttaagtgttatagcaaaaaaaatacacatatggttaagttaatgaatagtttttgttttatcagaatggcaacagacagaagtactttgtagagattgacttcctaagctacttaagacaacttgcaccactaagaaaaaaatgtagaaccatttggaaaaatgaaatttagtagttccaagtttcaaagaaatgtcaacattttattccattcaataaagaacaaaaccaatagtgtttttattactttcatctgaaacattccatgttttaatctgagccttgcagactttcatttggagtttgaacccgttttggttgcatttcatttttggagaacttaattaacgtgagattggcaattgaaatgcaggtgcagttttctgttaatgtcatgctgttgtttaggtaataagaaatattaagtaattggctttagattttgtaatttttttccctgagttcctgctagatttcgtattctagtagtcaatgtattttcagtgaaatgcaaaaatattcccgttatctttgaccagtattaatttttgaga

SEQ ID NO: 4492 - DNA, 1212 bp, Homo sapiens
tttagatttagtgttttacttgattatgacaaatgtgaggtaagcagacctcaataagcctttctttggcacaagtcactatactgcttgagtttacgtacaggtgaattgttttatgtaaatctatttttagtgatttcaaacttaatgaattggaatattttagaatgtgaaaccttgtgcttcagatatttagcctgcaatgtatcaattaggttagatcatgttatcagctattgagtagtataagacatcaggcttgtatttgatactacttttactcaggtgaaaagatactgggctgggcgcgatggctcatgcatgtaatcccagcactttgggaggctgagacaggtggatcatttgaggtcttgagttcaaggctagcctggccaacatggtgaaacccagtctctactaaaaatacaaaagttagccaggtgataatggcatacgcctgtaatcccagctactctggaggctgaggcaggagaattgcttgagcctgggaggcggaggttgcggtgagctgagatcacgccactgcactcgtctgggtgagaccctgtctcaaaaaaaaaaaaaaaaaaaagatgcctgaaactcactgtacagtgaggaactccagacatggaagaacttgacatggacctagagaaaaagcagacacagaatatgggctatcaaggagagatccagagctatatacatgaagaacctaagaagttattaaaaatctgttagttttcactttcaatccctggactttttgaagtcagtttttaaaaattgaatttgcttttcatcatttcatcacttgatgactcagtctttcagaccgtgtttggtttttgttgttgttgttgttgttgtttgaggtggagtttccctctgttgcctaggctggagtgcagtggtgcagtctcggctcactgtaccctctgcctcctggtttcaagtgattctcccacctcagcctcctgagtagctgggattacaggcatgtaccaccatgcccagctaaattttttgtttttgggtgttttttttttttttttttttttgagatggagtttcactctttttgcccaggctggagtgcaacggcgcaatcttggctcaccacagcctccgcctcccgggttcaagcaattctcctgcctcagcctccggagtagctgggattacaggcatgtgccaccacgcccggct

SEQ ID NO: 4493 - DNA, 1099 bp, Homo sapiens
gagttttagatttcttaaaataatagcacactaatggagtgcgtgattttctttagattaaatgtttacatatttataccatctgtattagtttcctagggttgccataataaattaccacaaaccgggtggcttaaagtaacagaactatattctctcacagttctggaggccagcagtctaaagtcagtctgtcttcaggtccatactctggatgttctaggggagaatccttccttgcctcttccaactttggtggatgtcagcattccttggctcctttggtttgtggctacatcactccagcatctgcctccatctttgtatcaccttctctgtgtgtgtcttctcttttgtgtcttatatggccacttgtcattaaacttgcccatccacgtaacccaaagatgatttttttttttgagacggactacagacacgtgccaccacgcccggcaaattttttgttttttagtagagatggggtttcacgttgttagccaggatggtctcaatctcctgacctcgtgatctgcccgcctcagccttccaaagtgctgggattacaggtatgagccactgcgcccagccagtaaattctttttattactgtagtagatgatacttgattaaatgccatctcgggtgctttcattgtcaacaaaggtgctcccatctctaagcttacataaaatgtaattttaaaaagacatttctttagatgtacctgttcacatttttgttaatagtctctcatgtctagttttggaggctggaatgttcaagggagccacaaaaatctctgtcagttggtgttttgaataattgttctgaaatatactcccaggcttgaaacttggatctggccttttttttttttttttaacttgaatttttttttttttttttgctcttatgttattcatatgaattttgcaaatagagagccagtcttgtagcatagtaaaatttaacagtttatgtgactattgatctacccatcttatagagattgtctgtctgtaggaagacggtggtaaccgtggtcagactcatcattttgaacactctaggttagtgttggagaatttgtaaaaca

SEQ ID NO: 4494 - DNA, 1134 bp, Homo sapiens
ctttgggtgctccaactcttgtaacttcacaggcaacaacgttatctacgttccagcccgctaataaacttaataagaatgttccaacaaatgtacgttcttctttcccagtttctctacccttagcttatcctcaccctcattttgccctgctggctgctcaaactatgcaacagattcggcatcctcgcttacccatggcccagtttggaggaaccttctcaccttctcctaacacatggggaccattcccagtgagacctgtgaatcctggcaacacaaatagctctccaaagcataataacacaagccgtctacctaaccagaacgggactgttttaccctcagagtctgctggactagctactgccagttgtcctatcactgtctcttctgtagttgctgccagtcagcaactgtgtgtcactaatacccggactccttcatcagtcagaaagcagttgtttgcctgtgtgcctaagacaagtcctccagcaacagtgatttcttctgtgacaagcacttgtagttccctgccttctgtctcctctgcacctatcactagcgggcaagctcccaccacatttctacctgcaagtacttctcaagcacagctttcttcacaaaagatggagtctttctctgctgtgccacccaccaaagagaaagtgtccacacaggaccagcccatggcaaacctatgtaccccatcttcaactgcaaacagttgcagtagctctgccagcaacaccccgggagctccagaaactcacccatccagtagtcccactcctacttccagtaacacacaagaggaggcacagccatccagtgtgtctgatttaagtcctatgtcaatgccttttgcatctaactcagaacctgctccattgactttgacatcacccagaatggttgctgctgataatcaggacaccagtaatttacctcagttagctgtaccagcacctcgagtttctcatcgaatgcagcccagaggttctttttactccatggtaccaaatgcaactattcaccaggatccccagtctatttttgttacgaatccagttactttaacaccacctcaaggcccaccagctgcagtgcagctttcttcagctgtgaacatta

SEQ ID NO: 4495 - DNA, 1134 bp, Homo sapiens; identical to SEQ ID NO: 4494

SEQ ID NO: 4496 - DNA, 1167 bp, Homo sapiens
ggctggaacgacccgccgcagttctcatacgggctgcagacccaggccggcggacccaggcgctcgctgcttaccaagagggtcgccgcaccccaggatggatcccccagaggtgcgtggggcccctgtgctcggagacagacggagaatgggggggggggggtgtaaggcataagcctgtttggaaggcttttttctctccccgagggctccttaaggagagaagttttggggctccagtaagggtctcagagcaggtgcttttccgagccccttctctgctgctcaggttaataaatggtgtattgatttaaaaagactattttttcatcctagatgatcttatccagacctgtggcttttaatatagttttaatcctgaagttatttttctttgttaacctatacctcttgccagaaccgtatagtggcatattcatttgtccattctgtcttcacttaggtatatgataatcgtcagacttcacagtttttcattcatttaatcactgttatttactgagcacttctataagtcaggcactgtttgagggcgaactagacagcagtgagaaaaaaaaaaaaaagatctctgctttcaggaagtccacgttgcagcactggagatgggctgaaagatgaaatagtggtgagggtgctacagaaaataagcggtgatgtaatatgactgggtaacgaggtgtctgaggggctgacatttaagccacacaaagatcatgtacaaaagcattccaagcaaaagaaacagctgcaaaaggaataagtttggccaattcagagactgatgaaatacagagtggctggctacagcatagtgggctttgtaaagcaggatgaggaatttgtattttaatctacataaagttagaagccattgaaaagtttaaagtagaggagagccacctttccccccgagaattttccaagccattaaatgggctgtgccgtggcccccataaaggggctcaggtttggttctttcagtggccctccattctccacaccctttttgctgtagaagaatgatacaaggcttggtttcttaaactcagcagtattgataggttgtggccagataattctttgtgagggactttcctgtgtcttatgttaatcagcaactctgacttctacccaaaagatgtc

SEQ ID NO: 4497 - DNA, 1197 bp, Homo sapiens
tttcgctggcgttcgtgggcctcccccggacccacacacggaaacacgcaaccattcggggatccagacgcccgtttacacgcaccacccctgggcgggctgtgcggctcaggccctcccccgggaccggcccgtgtcccgccccgtgtcccgccccgtatttgtgcggcgccagctggccccgcagcctgcggcgcagagaggctgggcttgcaggcgcagtagctccagaggtcgcgctgggctgagagtgcgggccggcagaggctggcggggagcagccggggttatgctgggcaaggattacatgctggccatcattctggtcaactgcgatggtgtgcacggaggggcccggtgggaagaccaggagctgagggaggacgagggaatccgaaaggctactctggggctcaaagacggtgggggatacctctctgtgtagggaccagggggcgaatgaacccggtctttacatgtgatgtcttcaagattgaggagcctggatcttcagcctaagaactgacccattttggggatggagaggggattatgacagcatgttattctgaactcacaaatcatatgctccctcctctctaatccggtgttcctgtagatgacttgtggggggaccacagtctggaggtggaggctggcctgcctcctggctggaggaagatccacgatgctgcaggtacttactactggcatgtacccagcggtagcacccagtggcagcgcccaacctgggaactaggagatgcagaggacccaggcacggtaggtagagtgtgaggaggaggtctgagcccatgtgtggacctaggtctgctgttaaactgactaactcccactctacagggaacggaggggatctggggactgcggccccccaaagggagatccttctccagcctggagagttcactggaccggaggtaacgggtggcccaggcaaaatgaaaggcttggggttccatggtgttcaaaaatgcagctggacccatggtctgctttccagcccaggttctggattctgtcacatgttttgggttctgttacgttcttggctctgtcccaggttcttaactgtcagtattttgagttttatcccttgttctaagctcttgtttgtagctacatgtttttcatattcttggtcctaacctatcatgttctagaccttggccatta

SEQ ID NO: 4498 - DNA, 1218 bp, Homo sapiens
tgcctccggcaccgcctctctgtgcgtcaggggttagcgctgctgctgctgatggctgcgggagcctgctatgcagcagggggccttcaagttcccgggaacacccttcccagtccccctccagcagctgctgccagccccatgcccctgcatatcactccgctaggcctgctgctcctcattctgtactgcctcatctcaggcttgtcgtcagtgtacacagagctgctcatgaagcgacagcggctgcccctggcacttcagaacctcttcctctacacttttggtgtgcttctgaatctaggtctgcatgctggcggcggctctggcccaggcctcctggaaggtttctcaggatgggcagcactcgtggtgctgagccaggcactaaatggactgctcatgtctgctgtcatgaagcatggcagcagcatcacacgcctctttgtggtgtcctgctcgctggtggtcaacgccgtgctctcagcagtcctgctacggctgcagctcacagccgccttcttcctggccacattgctcattggcctggccatgcgcctgtactatggcagccgctagtccctgacaacttccaccctgattccggaccctgtagattgggcgccaccaccagatccccctcccaggccttcctccctctcccatcagcagccctgtaacaagtgccttgtgagaaaagctggagaagtgagggcagccaggttattctctggaggttggtggatgaaggggtacccctaggagatgtgaagtgtgggtttggttaaggaaatgcttaccatcccccacccccaaccaagttcttccagactaaagaattaaggtaacatcaatacctaggcctgagaaataaccccatccttgttgggcagctccctgctttgtcctgcatgaacagagttgatgaaagtggggtgtgggcaacaagtggctttccttgcctactttagtcacccagcagagccactggagctggctagtccagcccagccatggtgcatgactcttccataagggatcctcacccttccactttcatgcaagaaggcccagttgccacagattatacaaccattacccaaaccactctgacagtctcctccagttccagcaatgcctagagacatgctccctgccctctccacagtgctgctccccacacctagcctttgttctggaaaccccagagagggctgg

SEQ ID NO: 4499 - DNA, 1140 bp, Homo sapiens
gggctcaagcgtcacacatacatacatacacacacacacacacacacacacacacacacacacacccggcttaagctcagaagctacaataatgcgccaagtgccccaagtgccatggggaagaaataacggatggcctgagccttactatctcgctccggcattttgttatcgttctttcgctgtcaccaacaatcgagtctccaacagcaacaccgcagcgacaagctctttcccacagtgcacctcagaatcaacccacactgctttgcgttcgcagcctttccgcttcctgtttttccctccgaccaaccccgagcgcaaagaaattgacctcgcagcggtcctacaatacttttatatcattggccaagctttaccccgcccctgcctcatgcagcctatgggctaggctttagggtccgcggttggtcagaccggagcacttggcctgaagacctggaattggcgacttcgatattaacaaggatggcggcggccgcagcaagtcgaggagtcggggcaaagctgggcctgcgtgagattcgcatccacttatgtcagcgctcgcccggcagccagggcgtcaggtgaggcgcggcgtggtgaggcgggcgggcttcgggacgccagggtcacgacctcgacctccctgaagttgagggaagcccccgcccacagcacgcgcggcgctctctccggccccgcagggacttcattgagaaacgctacgtggagctgaagaaggcgaatcccgacctacccatcctaatccgcgaatgctccgatgtgcagcccaagctctgggcccgctacggtgagtgcgggacgccaggggtctggggctccggtaggggaacaagggtttgagaagagaagggaccgcccaaggtcgtgcagaaacccgtggagaaactagaactcggactttagccttgctgttgatcttgtttccatgaagaaatttatattcgcagggttatatgatgcgttgtattccgggcaacataagtatgcaggctgaccgaatcctgcgtagggaccaggagctgacgtttttgtagttaagaatgggcttcagacaggagagaagttagtcaatatagtttctccaaataacgtgtagccagtgtcagtcca

SEQ ID NO: 4500 - DNA, 1210 bp, Homo sapiens
gccagtgcactgcggcctgggtgacagagggagattctgtttctaaaaaaattaaaaagagtaacaggaagtttcactgggcgggggttggaatgtttatctagtttagcagcgaagttctaagataaggtctgaaatacaatttacaccttgtaaagactccactcccctggcccaagcactagttgtaaaagtcgatttgatcacgaagtgaccctgtgtggttgttttgggagcgcagagtctggaagcgaaggaggtgggggcgtttcgagagttgtggaccaggtgactgctgagaaggagacagtaaaccggggacacacctgcggaagagctcttcagggattaggaaaggctacgtccttgtcactgctgtgtgtccccagatggacaactcctcaattgtctggaggtcgggggcgtgttggacagtcctggtcgctgagtcatgctgaagcactctctttttgactcactctttgtgacgtaggtctttctcaccagtcaataaaatataatccgaaagcaacctccgggctggctttagctcagcggttacttcgacagttctttaattgaaacaagcaacctgtctgggttgttcgagacccgcgggcgctctccagtccttttacctctctgggcggttcgagacccgcgggagctctccagtccttttcactgctgaagttcagctccctttccatggtaaaaggaatcagggctcctcggagaaatggctgattttagtactgggcaggaaatatagaaatggacgtggagcatctcatagagctagaaagtaaggaaatgcttaaaaaccaagaacaaccaaactcaacttttaaagttttttcaatgtttagtatgttcatgtgtttgttctaacagttgcctgtatacttgtatcttctcgcccttttttactgaggcccacaggatttttttctttcaaatctaatggatgttctaagatataccttagacttgatcattccatataagttttcctaggtttcctttcgatatgtagacccaatttttttttattatagttttgaagattacatcggttccattattttattcttcttcagggactgcaatgtatgttggatctttgcctctataccactttctctctgatcctttgaattgctttcttgattttatttttattttattggctgttttaatgcctttcctc

SEQ ID NO: 4501 - DNA, 1240 bp, Homo sapiens
tatgggttaagcctagatggggccattgcactccagactgggtgacagagggagagtctgtctctaacaaaaaaaatttaaaaagcataacaggaagtttcacctgggccggggttggaaggtttatctagtttagcagcgaagttctaagataaggtctgaaatacaatttacaccttgtaaagacgccactcccctggcccaagcactagttgtaaaagtcgatttgatcacaaagtgaccctgcgtggttgttttgggagcgcagtggctgaaggcgaaggaggtgggggtgtgtcgagacttgtggaccaggtgactgctgagaaggagaaaataagccaggtacacaactgcggaagagctctccagggttaggggaaggctgtgtccttgtcactgctgtgtgtccctggctgtacactccaattgtctggaggcggtggcgtgttggacagtcctggttgctgagtcatgctaaaacactgttgttttgactcactttgtgacgtaggtctttctcaccagtcaagaaaatataatccggagatagcctctgggctggctttagctcagcggttacttcgagtacattgtaaccacctctctgggtggttcgagacccgcgggtgctttccagctcttttactgctgaagttcagctccttttccatggggaaccatggagaaatggctgattttagcactgggcaggaaatacagagatggacagggtgcatctcacagtgctagaaagtaaggaagtgcttgaaaaccaaaaacaggccgggcgcggtggctcatgcctgtaatcccagcactttgggaggccgaggcgggcggatcacgaggtcaggaaatcaagaccatcctcgctaacccggtgaaaccccgtctctactaaaaatacaaaaaaattagccgggtgtggtggcgggcgcctgtagccccagctactcgggaggctgaggcaggagaatggcgtgagccattcgggaggtggagcttgctgtgagccgagatcgcgccactgcactccagcctgggcgacagagcaagactccgtatcacaaaaaaaaaaaaaaaaagaaaaaaaagaaaagaaaacctaaaacaaccaaactcttaactttaaaaatatttttcaatgttcagtaatgttcatgtgtttgttgtaacagttaattgtatacttgtatcttctcatcctttttgcctgaggcccagaggagtttttctt

SEQ ID NO: 4502 - DNA, 1271 bp, Homo sapiens
tgcactgcagcctgggtgacagggtgacagaggggtattctgtcaaaaaaaaaaaaaaaaaaaagcgccgcaggaagtttcccctggggagaggatgtaaggtttatctagtttagcagcgaagttctaagataaggtctgaaatacaatttacaccttgtaaagactccactcttatgacccaagctctacttgtaaaagtcgatttgatcacaaagtgaccctgcgtggttgttttgggagcgcaaaagctggaggcaaaggaggtgggggcgtgtggagagttgtggaccaggtgactgctgaggagagaataaaccgggggcacaaccgcggaagagctctccaggggttagaggaaggctgagtacttgtcactgctgtatgtccccagatggacactctgcaattgcctggagatagcggcggattggacagtccaggtcgctgagtcaagctaaagcaccgttgttttgactcactctttgtgacgtaggtctttctcaccagtcaagaaaatacaatccgaaagcaacctctgggctggctttagctcagcggttacttcgcgtgtcatcaaaccacctctctgggttgttcgagacccgcgggcgctctccagccctcttactgctgaagttcagctcactttccataataaaaggatccagggtttcttggagaaatggctgattttagtagtgggcaggaaatatagaaatggacacggagcacctcgtagtgctagaaagcaaggaagtgcttaaaatccaaacacaaccaaactcttaacttttaaagttttttcagtgttcagtaatgttcacgtgtttgttctaacagttacctgtatatttgtatcttcttgtcctttttgcctgaggcccacaggagtttttctttcaaatctaatggatgctctaagatatacctcagacttgatcattccatataatttttcctaggtttcctttcgatatgtagacccaagtttcttttattatagttttgaagattacatcggttccattgttttattcttcttcagggactgcaatgtatgttggatctttgcctctacaccaacgccactttctgtctgatcctttgaatggcttttttttttttcagatggaatctcactctgttgcccaggatggagtgcaatggtgcgatctccgctcactgcaacttccatctccttttttcaagcgattctcctgcctcagcctcctgagtagctgggactacaggcacatgccaccatacct

SEQ ID NO: 4503 - DNA, 1361 bp, Homo sapiens
cttctccaggaatgtctggtcacaggcagggccatgactcattagaacatgatgagcttcgggagatattcaatgacctcagcagcagcagtgaggatgaagatgagacccagcatcaagatgaagaagatataaacatcattgacacggaggaagatctggagagacagctacaggacaagctaaatgaatcagatgaacagcaccaggaaaatgaaggaaccaatcagctggttatgggaattcagaagcagattgacaacatgaaaggcaagctccaagagacccaggacagggcaaaacgacaagaggatctcatcatgaaagtggaaaatctggctctcaagaacagatttcaggctgtactggatgagctcaaacaaaaggaagaccgagaaaaggagcaactcagctctttgcaagaggagctagaatcactcctagagaagtaaaaagaactgatatttaatttcagtcttcagactggtcagcattagaaaattcttggctttattgtactgggtattaagaccttgctcttcctagtccttttaatgctgtgtgttctgttaagttctttcatttgtttgtaattttgtttttcagcaaatttatattgttttgctaggtgttcatcctataagaagcaggattgtataggcagaaaaatgattgtaggaaagttgcaggattagcggaatgtatggttcaaccttaattatagcttcattgcaggactttactgtttctccattttctagaagctgctgttgctgctttgtgatgacgtgagatcaataagaagaacctagtctagagacaatgatgctagtttgcatatgttttcctatgcaataattgttttcccagttattcaaagcagctttctatatgtagagatgcaaattattaagttgtttccaatacaataaataaaagcatctgtttttcactttatagtgtatcttgttctttcatggttggtgggagtcaggtcctcttgtgaggtggttttatggtggagtttagtgactaagcaatttgatcccgttctgcaggtagaggcagtagggtttatgaaaaaaaggaacacagcaggggtaaagaaattgggaatggtcatgtttgcatcatattaagattccaattctatttgatctacttgaaagctgggaaacattagatacagagctttcttaaagtaccctaatttttgtagatgaaggcctttgtgccttttttaaaaagcgctaaatctacctgcataaaatgttggaaacaaagcagtggttatcaagtgcagtccaatgaaccattccattggtttggattaatatttctaattttcttcagttgagttc

SEQ ID NO: 4504 - DNA, 1187 bp, Homo sapiens
gtgaaaccccatctctactaaaaatacaaaaattcgctgggcatggtggcatgtgtgcacttgtcgtcccagctgctcaagaggctgaggcaggagaatcacttgaacctgggaggcagaggttgcagtgagccgagatcgcgccactgtactccagcctgggtgacagagcgagactccagctcaaaaaaaaaaaaaaaagaaaaaagaaaagaaataattattgaatcaatggaaacagaattacaactcttcccacttttgggaaggagaattgagattcctgctttccccttcaaccctagctttatgtttgttgtgatggtatagaggtcacacatggcagccttgtgtctgttcttaggctgagttcatctacttagggacggggaatcccagattgggcaaaaccaaaagcagggacagaccttggaaaaattgtaaagcagttcttggttgtgctcacccaccatgacaaaatatgcacacacacaacgcaacacacacacagacattttcatgccttcaaggcctaccctacagcctttcccatggtgccaaacccttcttcttaccttacagtcacttaactgtctctgctggtctcttcccactcatttaggcaacaaatatttattgaaaaacttctctgagccagatggtgccaaacagttacctaaagggcagactgtgtgtgtgccagggctgtttcccgccaacactcccctgcaaattgaaataatttcatccttggaaattcaaaaaaatcatgaaaattgtcactgtgggaaaattccaagtagagctgaaccttctaagaagcagagagttcttcttatggtttagtatttttttaaattatgaatcatttcatgttttttcaacactcggagtttctaaaagtctcacttaggtccaagtgctaggctttgtgctaggtgcttcagtaggaagcaggtggagtcgctgcctcacagaagccagtgtggtggaggaacagacaggcactacaacagctgcagtgtgactagtgccatgtggggcagccgctgggatgggagtacagtggaggcacctgcccagtctgagtggatctcctctgatatattttattcgtgtcatcatggcaaatgttgggggactggcattctagggaacaccatctgcccaggattcacagcaagagg

SEQ ID NO: 4505 - DNA, 1187 bp, Homo sapiens; identical to SEQ ID NO: 4504

SEQ ID NO: 4506 - DNA, 1187 bp, Homo sapiens; identical to SEQ ID NO: 4504

SEQ ID NO: 4507 - DNA, 1187 bp, Homo sapiens; identical to SEQ ID NO: 4504

SEQ ID NO: 4508 - DNA, 1187 bp, Homo sapiens; identical to SEQ ID NO: 4504

SEQ ID NO: 4509 - DNA, 1187 bp, Homo sapiens; identical to SEQ ID NO: 4504

SEQ ID NO: 4510 - DNA, 1187 bp, Homo sapiens; identical to SEQ ID NO: 4504

SEQ ID NO: 4511 - DNA, 1187 bp, Homo sapiens; identical to SEQ ID NO: 4504

SEQ ID NO: 4512 - DNA, 1187 bp, Homo sapiens; identical to SEQ ID NO: 4504

SEQ ID NO: 4513 - DNA, 1187 bp, Homo sapiens; identical to SEQ ID NO: 4504

SEQ ID NO: 4514 - DNA, 1187 bp, Homo sapiens; identical to SEQ ID NO: 4504

SEQ ID NO: 4515 - DNA, 1187 bp, Homo sapiens; identical to SEQ ID NO: 4504

SEQ ID NO: 4516 - DNA, 1187 bp, Homo sapiens; identical to SEQ ID NO: 4504

SEQ ID NO: 4517 - DNA, 1187 bp, Homo sapiens; identical to SEQ ID NO: 4504

SEQ ID NO: 4518 - DNA, 1187 bp, Homo sapiens; identical to SEQ ID NO: 4504

SEQ ID NO: 4519 - DNA, 1187 bp, Homo sapiens; identical to SEQ ID NO: 4504

SEQ ID NO: 4520 - DNA, 1187 bp, Homo sapiens; identical to SEQ ID NO: 4504

SEQ ID NO: 4521 - DNA, 1187 bp, Homo sapiens; identical to SEQ ID NO: 4504

SEQ ID NO: 4522 - DNA, 1187 bp, Homo sapiens; identical to SEQ ID NO: 4504

SEQ ID NO: 4523 - DNA, 1187 bp, Homo sapiens; identical to SEQ ID NO: 4504

SEQ ID NO: 4524 - DNA, 1187 bp, Homo sapiens; identical to SEQ ID NO: 4504

SEQ ID NO: 4525 - DNA, 1187 bp, Homo sapiens; identical to SEQ ID NO: 4504

SEQ ID NO: 4526 - DNA, 1164 bp, Homo sapiens
tttcttctcacaggcccaatcctgaatgtgcccctggaccttctggacccttgagtccaaggcagatcctctctcccagggaatccgacacaggaggaaccccttctctggttgagctgggccaggcctaagagtagcaggaactctaagaccacagagttttttataaatgtataaatgtatcaagccaaatgtgcagatgctaactggacattctggggaactgggcaccaggagtgccttcatacactgtaccccagctctcttctaaaagagaagtgggtgggcacactgaactgtttggtggccccaaccacaggaagctgcaattctctggcttagggtgatacttttgccctccttgtgcccctctcagctttccatccccagctaggaagaaagaatggcactcttgggcttggcccagaattagagttattagagcaagagagagcttaggaagcatgagggcaactatagtgaggccttattgccaggagggagggttttggttgctggcgcttgtgtataaaggggcaagagcagctcctttggactattcctgggaggactctgatgcagggcgtctgttgctcccctgggtcacctcctccctgctcgctgacatctggggctttgaccctttcttttttaatctacttttgctaagatgcatttaataaaaaaaaagagagagagagagaggtgtgagggacaaaatgcaaacctatttcccttgcctcataggcttctgggatgtcatcacctccagtttgttggttttgtttccaactgttaataaagcattgaaacagtactgccttacagcttcctgtgtgaatttctgagctgttttcttttcactctagtccaggctcctctagtctttcctgcctcaaatccctggttgacctgacaaatcactgtgaaaaagctaaaggtgccagacactttacttgggcacagggctagagatgattaatacatggtggctgctgccccaccagagctcacctcagggccgtttggccacagtaaaggagtgggcgcctggttcagctccctgactcttccacattgctgctacttggtttggagcccttttttggaactcacttggaacctttcatgttcccagatgtcacgcaaggtttcctggcagta

SEQ ID NO: 4527 - DNA, 1191 bp, Homo sapiens
cccgcctcggcctcccaaagtgctaggattacaagcgtgagccactgcgcccagccaacttacagatattttttaaagcagatttcactatctgttctaggtgatcatttttacaaatgatactgcagtgaacatccttgtgcatatcttctttcacatttatgcccatatgttggatacatttctagaagtagactatatgttacatgcatgagaaattgattagtactgttaaatgcccctccaaaagttgtatcaatttatacttcattgaataggggacttgatttggtatttatggacaggagcctagggatggattgtagggaatgcatttccctgaagagatggtccttagctttcagcagtttctggaaactgagtggtgagaataataatgtgagaaatccggaacactgataatgtcctgtttcctaatcggtctgtgcccctgtgtaatttactcattatacgtgtccgtgtcacagtacctggaaagttctctccgtttcctttctcttgggcaggaatgaaagggttttggaggcaatgacagaaagagctgagatggatgaagtggaacgtttccagccgctgctggatggattaaaaagtggaaccactattgcactgaaggcatgtatatcccctgaaactgggcccaagaatagaattcaagatggacagacttaaattcatttgaccttttaataaaatacatggagtgcctcccaactatatattttacatttcagaatctgttatgaagggaaaatgattaaccttctttctaagaaggtaaagaatgaactgttttcctcattatgagatggaaaaaggcatgatatctatttacaatctaggaaaaccaagacctacaataacatatactctcaaatccttgaaaccatttagagtttaggctctccggatctgtactcaaaccaggtctcattgctatagtagaaaagtcatctttagagtttttgtattgtatctttcaggttgtattggggacctaagaatgcatgtaaagaaaatggattcttgatctccaggagttagcattgacatagctgctgaattttcttattttaggttggatgcctacagctgatcaatgctctcatcacaccagcggaggaacttgacttccgagttcacatcagaagtgaactgatgcgtttgggg

SEQ ID NO: 4528 - DNA, 1153 bp, Homo sapiens
tatatatacacacacacacacacatatatatgtttttttttttcttttttgagatggagtcttgctctgtcacccaggctggagtgcagtggcacgatcttggctcagtgcaagctctgcctcctgggttcaagcatttctcctgcctcagcctcctgagtagctgggactactacaaaggcgtgagcaccgcgccgggcgtgagttatattttcaaggctagaattgacagaacttgggttgatgagaatagttgattagcaggcagggtgccagggagggtgttgagcagaacagaggggggactgtgctttattttaaaatttttattgagacacagcatataaagtatacccaaatcttaagggtataacataatgaatttcactatcaagataaagatttagaacatttatagttttcttgtgctcctttcaggcaatacctaaaggtatttaccttgtcttttgataacctcctccacatcttcctctggttccttttaacagggaatgcgttgaatatgtcaagagcttcaatatccctctactcgtgctgggtggtggtggttatactgtccgaaatgttgcccgctgctggtgagcactctcctgatttcctcccctgttgtccagtgtgagctagggtgtccctcagatatggccacatgggtccttcagcccacttggtcagcctgctcccctctgctggttggtttcaggacatatgagacatcgctgctggtagaagaggccattagtgaggagcttccctatagtggtaaggaccaccccacaacacccccataacaggaaggccattctcaccagattccagaatgacctggtttgaaggcacatgggaaattttacactctcagagctctgcagactaaacccctgggctcagagcagggaagagattgggcagctattatgtaggtgctctggatgggaaggaaaaagattgggaagtcttgttagctgcctttctcagtctgagccatactttctcctctcctccccaagaatacttcgagtactttgccccagacttcacacttcatccagatgtcagcacccgcatcgagaatcagaactcacgccaggtcagcagctcagaaaagctgagcacaaacttctcctgaaaggtg

SEQ ID NO: 4529 - DNA, 1125 bp, Homo sapiens
ttttaaattttagcttatctgaattttctgactagtctataattattatgtattagttaattaaaataatttttaaaaatttcactgagtgcaaaagatgcttacagagttgccagccgactgggtgtttctccctttgccccaggcggtcctttattatcagttggctgccagccagggccacagcctggctcagtaccgctatgccaggtgcctactacgagacccagcctcttcgtggaaccctgagcggcagagggcagtgtccttgctgaagcaggctgcagactcaggcttgagagaggtgagtgccattggcagggtctgttcaaggtctctgaggcctgtggagcctgaaagtgaccaagatgccttcttttccttcctccttgaccacaggcccaagctttcctcggggtgcttttcaccaaggagccctacctggatgagcagagagctgtgaaatatctttggcttgcagccaacaatggggtatgcgatctcagtggacaagcatgttggggatgaagcctgataagagaagggattttggaactggtactgagttcttctgtgcttaggagattgttggataggagccttggcctggcttcaagccttagcgctcactgacttactgtgtgaccgttgggcagttgcagtagtacgccagagctggcttgcaccaggctgtgagagctgttggcagcttaaaatctgctatggtgggaatatttgcaccacagaaattgctaaatgccataaaacagggctttttccctcctcgagagccagttgttcaacatttaccagcacactactgggcctggtcacttcttgattcaaacctgtttcctcgtctttaaaatcagaataataatgcttgccttacctgtccagtacttcacagggtggttgtgaggatcaaaatctaactgagataactaacaggtgtgacagtgctgtgaaacctgtacacatgaaaaacacatcattacaagtgatggtaacccagggaaattagaagacgcatcaagtggagacagtaaacagggaacactgctcagtttggggtgggtggggatgtctggttgtctgtgaactggggtcattggcattcagaca

SEQ ID NO: 4530 - DNA, 1120 bp, Homo sapiens
tggctcctctgttttacatactcattagtaagtgggaggtccactggggcaacagacactgccacaatttcagtgttgtgttcagccaaggggacggtctgggcaggcagcttaagtgtgagtttagtcacaactcctgagtgtcccgctctcctgcttacctaggaggtgagtgccaggaaaatacaccaaatgcttctagtattgtttccccacttaaaatagtcctgcttaaattcacatggtgtggtctgatgttctgagagcatcaggaaatacaacccttttgcccatttacccttctccccggatcccaaggtggtctgttgctctggcttcctttcattgtcttaggccttcatggagtggatgctgcctcctcctggctgtttttgtgcctgtttgaagctactgctgcctccatttctgggaaagacctttgagagcctagcccaggcctaagggctatgtttggtaccagtgttttgtctttagcttttctatgtgattgtgccgtcattctgttttaagctcatggatcaatggatttgtttacaatgtgatattttctattaaatccagtattttcaaataacatgtcatttgtggatttgagcccccaattttagaagactctctgggctatttatatattttagaaagagctggtaagcaaagcctcacattcagtcctcacaagagcctgcaggaaggccacaagcatagcaaccatcatcagagtgaaaaataagattttatgaaaatggagcacttacaggaaaaagggtaggaatgaacagatgagcaataaattgtcatgttggggctgtacctgagatccaaacgaggatacagctgttataaagattaaggcagatttgtgatgagggatattattgcaaggtatgcaaaaatacatataggtttttttttttttaaagttaatataatggaatatcttagggcaatatagccaattaaggaggtagatatagaagttaaaagaagggtttaatttttttaactattttgaggctgggtgcagtggctcatgcctataatcccagtgctttgggaggccaaagcaggagaatcacctgagatcagcagttcaaaacca

SEQ ID NO: 4531 - DNA, 1099 bp, Homo sapiens
actggtatagagcacctagtccagtgacctgctgggtaaactgtggatgatggttgcaaaagactaatttaaaaaataactaccaagaggccctgtctgtacctaacgccctatttttgcaatggctatatggcaagaaagctggtaaactatttgtctttcaggaccttttgaagtagtttgtataacttcttaaaagttgtgattccagataaccagctgtaacacagctgagagacttttaatcagacaaagtaattcctctcactaaactttacccaaaaactaaatctctaatatggcaaaaatggctagacacccattttcacattcccatctgtcaccaattggttaatctttcctgatggtacaggaaagctcagctactgatttttgtgatttagaactgtatgtcagacatccatgtttgtaaaactacacatccctaatgtgtgccatagagtttaacacaagtcctgtgaatttcttcactgttgaaaattattttaaacaaaatagaagctgtagtagccctttctgtgtgcaccttaccaactttctgtaaactcaaaacttaacatatttactaagccacaagaaatttgatttctattcaaggtggccaaattatttgtgtaatagaaaactgaaaatctaatattaaaaatatggaacttctaatatatttttatatttagttatagtttcagatatatatcatattggtattcactaatctgggaagggaagggctactgcagctttacatgcaatttattaaaatgattgtaaaatagcttgtatagtgtaaaataagaatgatttttagatgagattgttttatcatgacatgttatatattttttgtaggggtcaaagaaatgctgatggataacctatatgatttatagtttgtacatgcattcatacaggcagcgatggtctcagaaaccaaacagtttgctctaggggaagagggagatggagactggtcctgtgtgcagtgaaggttgctgaggctctgacccagtgagattacagaggaagttatcctctgcctcccattctgaccacccttctcattccaacagtgagtctg

SEQ ID NO: 4532 - DNA, 1210 bp, Homo sapiens
ccccaaaatttacagcatcaataagatttgtaatggccctctgctgtgcatagagcttgtattagtgtgttttcttttctttttcttttttttttttttgagacagaatcttgctctgtcatctagactggagtgcagtcgaatgatcttggctcactgcaacctctgccttccaggttcaagcgatcctcttgcctcagcctcctgagtagctgggattacagtgcctgccaccacgcctggctaatttttgtatttttaagtagagatggggtttcaccacgttggccaggctggtctgaaactcctgacctcagatgatctgcccgtctcagcctcccaaagtgctgggattacaggtgtgagccactgcatctggcctagtgtgtttttatactgctataaaaaactacctgagactgggtaatttatttaaaaaagagttttaattgactcagttccacaggctatacaggaggcatggctggggaggcctcaggaacctacaatcatggaggaagggtgaagggtaatgttaaagatacattttgatcacttctaggaccttctgatgtaaaggcatatttgttaaaatcacacccagagcttttattgtaagggtactttttttttcttacactttcagaactttccaatgtaaatatgcattttgagtacttctggaatttttcatagttaaggtacattttctcttttgcaattagaaatatgtggaatagttatatttttgcaccttgagaatatttggttcctaatcttttttatctaatggttttaatgcttctgaatttccttcctgatatgttgttatgctggggctatgcaaaatggtgatattctaatgctattatttctttttcataaatatttggcattcttttataaagcacatgccttttctattcttttcattttatttttaaatgaaaaagctgtgtagcatgtggattagtcacttcatacaatagacgtttgattagaaaagttgggcgcaaatgaaatgtaaaaatatggagtcatagcttatatgtaccatggtggtttactcttcaaaggaatcttactgtaaatctttttttttttttttttttttttttgcaaagctagtaatcacctcttaatttctgttattcttataaacctgaattttcatgtagggcacatttattcaacaaattattgagtgctt

SEQ ID NO: 4533 - DNA, 1212 bp, Homo sapiens
agcttaagtaagagccatctaaattgtaaatgaaatcaaccacatcaaatgattaaatctgcctgtaagtgtgaagtgacttacacaaggtcactgggtagttggcagggtctggactaaacctcaggtctcctcaatcatagtttatacaatttgcccccatatatcggtagcatctttttatttcttgcccctccagttaaagtattgtctttagcattggggagattgcatatctggatagagaacttctattgtagaaaaataccttatgtttgtatttccatgatgttcttgtgaaatatttttgttccttctattcatgcaagtaggcttttgtttttcagaaaggttgtaagtggtaggaatgcaaatcacaatagatggaaaatttatagacgttccaaataccattaaagtaacttccagagtcatttgtatagatcctttccctagagcctttgtttacctatcaatacttaagatacttgcaatctaaatttccttatctataaaatgagaataagaatattctggtgttatcactgactagctgccttaagaaaatatttttctgtgctatcatttcctctgtaaaaatggtgtcaaacttaccttattgggctgtagtgaggattaagagttaatacggataatgtctgtataaccatgctggtatataggaactttactatcattattaaaacaataatgtgttttaatgtgttgcaacagtatactaaagggaactatatactagtggctaaagataatacagaagtaaatgggagatttcttcatagcatttatcataatcgaaaactcaaattaggaataatgatcctgagagggcctgtagaggccagaagtgggaaaacagtttgaggtgacatttgaactagaggctgagtaatgagaaggagctagttatgtgaaaatctggggaagaacatgctcggcaaagagaacaggtgcagaggcttcaaagtaataaacttgaaatatttaaaggaaaagactagaatttgtggaaaggttaatgtgggccaggttatacagggcctgatataataattatagtaataatagctaacattactaatattaatattatttaacacttaccagtactattactgtcctaatgttacagaaacagtaatgatagctaataacttagatagcacttacatactaagcactattccaagt

SEQ ID NO: 4534 - DNA, 1193 bp, Homo sapiens
tccgggaaagctatgtgttaccacagtgcccataaaattgcccaaggccaaaagcaattcagaagaatctttactctctgaaacaggctaagtcccaaacattgcttggtgggctcaagaagaaagaggtatattgttatataagtaaaggtagacagttgtaaattaaaaatcacgcacctttaatgtaatctttcttttttccccttgaaatgttgctactttgttgatatgcacctctattaccttggggaagatgaaatttctaggagtccttttcttggttcactatccaaatattgtctatttctggtgtagtggtcctggaaccctttgaaaaactggtaaaagctatggactttcattccagagaaatccaggtaggtacacataaatttgactttaactttagggggtttatagactacccaacgctcattggtggcaaatgtccctgacgtaaacacttggttctgatctgactgaagaataaaaatagtttgtgttctgttggaatttttagtaataagcctatttttttcagaaattttagtaaataaaaagttgattgcatggggaacctggcactaaaccattcgtagatgacctacttctgggttggggttttgtacgtggcagaacggctttcttgctgcgtcctattgaaagtcagccctcaacacgagggtttgtaagtttttaaaaaaaatttttctaaattaaaaaaaagtcagttgcaagttttttgagggcatacattagacttaatcagcttacaaatgatttccttctgccatttcctcccaaaataatgtattttagtttgatcactgtattagtctgttttcatgctgctgataaagacataccccagactgggcaacttacaaaagaaagaggtttaatggacttacagttccacatggctggggaggcctcacaatcatggtggaaggaaaggaagggcaagtcacatcttacttggatggcagcaggcaaagagagagcttgtgcagggaaactcatgtttttaaaaccatcagatctcatgagactcattcactatcatgagaacagtgcaggaaagacctgccccataattcaataatctcccactgcgttcctcccgtgacacatgggaattgtgggagttacaattcaagatgagatagtcttaactcgtgtcaacatta

SEQ ID NO: 4535 - DNA, 1946 bp, Homo sapiens
ttcctgggttgggaaggccaggcagggacagagcaaatgacacttctcttcctcttgccctccctgcctctttggtgctcttaaaagccagcagctgagaacatagcacaggcccacgtggtgagggcacccacagcttaaagacgcttccttctaaacacggcgaggtcacctctcactcttctgtctttgcaaaccgagaagagtggcatgcttctggcatcccaagtcaggattttagctcagatgaggcagaatgaagggcctctcttacaggcagtttgtgtttgattctctcgatcctggcacatccatgataaataggagtttttgaaagttggttttattaggtgttccctaatttttaccgtaataggtcatctcagcttatatgaaagtcaagtggggaactgggaaagccaaagtcagtcttgagcagagggagcacattttgtggacctggttccacctttccattccaaaccacctgtttccccttccattagcagaaactctgggggaactttgtgtctcagtcctagaatctccccaagtgagtggaagtgacatgatgcagtcttcctcatggggcacctgaaagaaattagtgtgggtgcttcgatctaccttgtctgtcagagttgaatatctctttccctatcatgctgcttctgaaaattcagttttggagcaagtcctgtgagcaagataagaatctatagaaccaagatgctcattttcagaagaaatatgttcaacctgggatcagacttccatgctctggggaatccaagtggtagcacctgtaaccctgtgtactaagtgctttgaagagaagagcaggcctcagacaccttttaattgcttaggagaaaccattgtctctgactgcaggtttgaataagttgaagaccagagaaaagtacacactgggctacaaaggaatttggagatagccaaggaacaggatttcccctagcaagctaccttctgttcaaatcatgaaaaaagactatttccccttagaatagggaagcttgctattttaaagctcttgtagtgcttttcttttaagggagatgtagtaaaagggaaaatgtagctcttagtttacacttcaaagatgtgggggtctttcagagaactaagaataacagttttatgtgcagagagagtttgccagatctgaagcatatacctcattgactaggctgttactttgggataggttgcagtaccagccacagccagcagatagaggaaaagacacacataaactcgcttctgagcgtccacttctgcactctctgctctgctgttactcagcccctgagtctgactcatctctgcacaacctctctgtgccatgaagataagtcttccatggccaaatcggtcatccgcactgcccttgggacttccgaagtgaaccattccaccagaacctttgattctgcacaagatttccttgctctgggaacaacccccaaatgcccttgggaggaacaacatgagctcaggaagcctctctttcttcacttaccattactaactctccaagcatagaaatccctgggaattgcgagaataactcccactattttaaaatttatattcagatttgtttcgtttcataagacacatcaaacaggcctatacaaaaggtttaggaaaagaaaacaatggtgagtcccggccctcttcgaattcactggcacctcatgcaagtgtaggaaggcacgctggatcgtctatctgattccaaagctgtcctttgccatctcatcccttggcctgccccccaaccctgaggatgcccctgccatccccccaacctcctcatattgcctctgaacccagatggcaatccatcccggttctctctgagggccacgggcttgggtagtggaaagggtgtttgggaaattgttaaatcagttacccgt

SEQ ID NO: 4536 - DNA, 1193 bp, Homo sapiens
aatgaatcttgtgaactgtgtcttcccttaggaaaagtaatggaagagttcagtttcttcacgatggaagttgctaaattctccatggacatagagagaaaggaatgatattctcatcatcatcttcatcatcccaggctctgactgagtttctttcagttttactgatgttctgggtgggggacagagccagattcagagtaatcttgactgaatggagaaagtttctgtgctacccctacaaacccatgcctcactgacagaccagcattttttttttaacacgtcaataaaaaaataatctcccagaaagtttatctttgcttctgtttgtgtttgtttcttagatcggggtataaaataacacaattataaaagaaaattgaaaaacacacaagtcttgatgtttaggaaatacttttatacaaagaatcccaatcagcttccaagaaacacatgcacaccacacacacaaacacacacacacgatacatagacatacacacacacacaaatgccagtgaacaccacaccttctcctggagtctttatccactagcgacaagtctatgtactatactgttgctttacattggtctctttttttaaaagacccttaaaagagaacctctcttgttccaagaagtcatttctggaagggaagtttttcttcctattcctttccagaaacataccacaatttctcataggccagctcttctagagtgctgatgggaaagccactgcttcaacaggaagcatgtccattgttgtagagatctgattgttgagatgttctacttgtctagaattgaagactacattcatgaggctatcaaccatcagcgccagtgagactatataacaaagaagttcaccctttttgccaattaacagaattttcattatttaaaaatgaatattctgtctccattgaaatttattttctccaggataaaaatctctggttaattcaacccttttttctcaagtgttatttcccttataatatttctatcctggaccatactccttggatctgttacaattaggcattgtccatcttaaaatatgttagtatgttgtccaaaaatagactaatcaccaaaattttttttttccgacagatacagagaaattaaaactaccacctctctactaaaccttcccttctattaatgcagctgaatacg

SEQ ID NO: 4537 - DNA, 1198 bp, Homo sapiens
ccactggcatagcatggaactctcctgaaggtgacgccttggtgacagtgtctatactgtggcttcagccactttgcccaggcaaaaccaatatccctgatgcccccaccccattacccttccttccagcccactctcacactcacaatcaacctgcctcctgtgcttgccctaccccagcacctcccctgctcagacttgaaaggttaagtccaaaagctactgaatatgcaggcatatcaatggtgataaatccctcccccttcctagccccagtctttgctcatttccttcatgtaagcagtggcttccttggaggcctcttcccttccaacaccctcccctaacaagggcaggtcctctggggtagagattggcattgtcctctctctgactccagccggtattgctcactcagccaggcatcatggactaggacaaggactccacgggagcccactcccagaggggccccaggaagccaggcaatgacggagtctctctctgtcctccttcttgggcagggggaaggccgcgtggtgtacattcaaaatctctccagcgacatgagctcccgagagctgaagaggcgctttgaagtgtttggtgagattgaggagtgcgaggtgctgacaagaaataggaggtgagttgaaccaagccatggcaaatgaagggagcagagaggggcactggtcctgatccagaattgggtaccagaagatgcccaagatttgtgaaatgaatctgacaaaatccatagcctagatgtggaaagccaggcccatgagaaggaccagaaatggtaatgcagtcagtaatagcagcaaacacgtgctgatggtttacgaagtgccaggcagtttcctttcattcttttatctaaacttcccagcacgccagggacataagcactcctggtctttcaattgctctcctttctgcaggagttcagacaagttagctgggcagctagttggtggcagagccagaaccggagcccatgtgtctgcttcagggcctttggcctggagatagtgcggggcagcagcccctggcagcttgaagacttgcactgggactccactctacctcagccctgtgcttcctctgcagcaccctcccttcctctgcagcagcaagtcccaggccttggttgggtatggcggctcacacttgtaatcccagcatttgggga

SEQ ID NO: 4538 - DNA, 1216 bp, Homo sapiens
gaggtgggaggatctactgcgtaaacctcatttgttaagcactttacttgcttaatattgcttacttgtggcagggctgggattcaaacccaggaggctcacaacaaagctagcactccaaacactacagagtgctatatagctggttctgggaactactaatattgagaggagacatagaaagagaatgaagcaagagccaaatcagacaagtcttggtcaagctaagacgtctgaattttattttaagtgaatgagacactggagggttttaagcagggagtgacttgatcagacttacagtgcaaaatgatcaatctgactgcttcgtggagaatggattgtagaggggatgtggggagaactacatcagtccaggcaggagatgatggtggctagaaggttggtgatggcggtagatgcagagaagtaggcagactggaatacagtgagggttgtgcgggaacttgtacaaatgtggacaacttgtgacactggagagaaaggacaatccaatccaatccctatttgatttacggaagctctccatacggtcattcagctcagcttgagtcactccaggaactcactaccatcactattcgtgggccagtgggagagacggattgagggcagatcactggagtgatgaaggcgctacttgatgcggcactacgtatgaacccgatcctgaatgagagggaaagactgagacaggctgaggtcaggccttgaacgtcgtgctgaggagagggtggtattgtaggcttcccagcgcccgacgtggctctgaaaggtgaggcggggcctagatccctcacgctcagcacagccccgcccctgttacctgaacgccccacagcagtgcccgggggctgagcggccggggcgtcccaccgccggcagccacagcttcctcctccgcccgggacctctggccggaagcagtccgttcgccttactagacccgctccaagcctttgagcagttcgtgtgggtccgctcccaagctagggctgggctgttgcgcttgcgccaggggtcgcatgcagtcacgcgctgccgaccgcttccggtgcgccgcgagggccgccgggacgggtctccctggcgatccgtggtgtgccgctactgccggtgcagccgccaaaccggtgcctcggtgacgaccgtgtccctgccgtcttcctcgagctccccggggcttgacccccgg

SEQ ID NO: 4539 - DNA, 1157 bp, Homo sapiens
catgcgccaccacgcctggctaatttttgtatttttttttttttagtagacatagggtttcaccacgttggccaggctggtcttgaactcctgacctcaggtgatccgcccgcctcggcctcccaaagtgctgggattacaggcgtgagccgccgtgcccggccgccactagcctgtttaaagcaggtaaatagggtgctgagaacacttgaaagggttagaattggattctctcactaactgcttatgtgatcttagaagtcctaaatgtcttagaacctcagttttctcatctataaaataaacatagcacacttcctgtggaaatagttttctctttgttcttaaactttttgagataatcataaattcattccttttgataagcacattgggatgagtacactgtctgttattaaacttaatccaggcttccagtgttgagtggcctgggtgttctttattactctgtttcagtgaaactgtccttctcttcattgcccataggattccagtgagagtagctcctctgcaccagccacacagttcatcatgttgcctctgcctgcctactcggttgtggagaaccccacctccatcaaactggtcagtactgtatgtgggggattgatggcaattagggtgtcataagcattttttttctaagtagatttgtctttttttctttctgagctaccagttgtaggaccaagaagatttctaaaagtcttagaacctcaggatgcgaggactggcaaagatttcagggattatgtggtccatatgttcttaatgggggtgagggggttgtagatagatctccatgggatccatgaactcacctcaagttttatacaaacttttttcctggaatggattccatgacttttataaaattttcgtaagcatacatgatttaggaaaatgagcagccactgatctaattcaatactgtgatcgtacagattaggaaaagggccataggagagaaaggacttgttcaaggttacaagacaagtcagactggattcgtttcttgattcccagttgatatttttttcagcatcggggctgagatttatccctgtttatctttttctcacactattataaatggcatttttagaaaattttcaatatctgattgcctacaacta

SEQ ID NO: 4540 - DNA, 1157 bp, Homo sapiens
gaataattttaattttgtatgctttatcttttctttcttttttttagctatataagtaaaatatacattccttataaaacatttgaggccaggcatggtggctcttgcctgtaatcccagcactttgggaggctgaggtgggagcattgcttgagtccagcagttcaagaccagcctgggcaacatagtgagacccacatcgctaccaaaaaaaaagcaaattttgtagatagtggtaaagagggagaaacaaccatgattgtcctcttaccctgtgacattttagtgaatagtctttcagacatctttctatgcaaagttgttcaaccatgtatttatatgtataaaagctattatgtgcttttataactcagtagtagttgtaaatctgattcatggtgtttctaatacatggtattagaaactgcacagaagcatgtggcaaggcctggacttgaacatgacactcagcctttggtgggcttgtgactgccaactggcagtccagagggctcatttggagaatagctctacaaattccccgggaaagcattccctcaagtcgtttcaggacatgggagctcaggagtttggctaaggttcaaaagcactaaataatttgttctgatccacagctaccaagtggcccatccaacaggacttctcaggtgaaagttgtggaggtcaagcccgatatgtttcctccatataagtacagctgcactgtcacattggtaagtatgcagctaggtggtggtgggttgacatggaggttgttttgattttgtggttgaaggtcagtaggaggctgggggagagggtggtggtagctgggagggagaacagggtcaggtatagattgttaatgatgaagatcccatccctgatgcaaataatagctactggatgaatctgctgggttgttttggtctctttccaggtgagatttataaagtgtaggacagctgagattagtgtatttttattgagagttgccagagatgagaatctagtccagatttaacatttagctgtcttggaaccttttagcttagaaagggtgttccacagttacatttaggcaacgttgcctttttctccctaaaacagagtccagttcaacacgagtatcttaaagtaaaatagagaagtacttt

SEQ ID NO: 4541 - DNA, 1215 bp, Homo sapiens
ctgagtagctgggacaacagtgtgtgccacaccgggctttttttttttgtagcggggagtttcaccatgttgcccaggttggtcccaaactcctggcctcaggcgttccaccagcctcagtctcccaaagcccaaagtgctaggattacaggcatgagccaccgcgcccagccttaaaagattttttcagactttttttcagtgtctttttacttaatgaaaacgagacagttgcagttaccctgtctaaaagggttttttcctctagagaagacggtgggctagatgtcagaacctggatttgtcctgtgcctctgacatcttgcgcacagctcagcctgtttccctttctggaaagtgagttaagaccacgtcaggaaattcgaggaactggcagatggggccacttcatgttcacatccatctgttaggtactggggagtcatttggggagcagcaggatctgttgctgattggttaggccattggtctagggagtcctgggggcccttcccatccagctccaggcaatgacgctttctcttcctccccacagaggatgtcacccccatcccctctgacagcactcgcaggaaggggggtcgccgtggtcgccgtctgtgaacaagattcctcaaaatattttctgttaataaattgccttcatgtaaactgtttcaactccagccttctctccttcatcaggggctactcaggcatttgatttcttcctcctatttggcttcttgggagaaaggagcctgaggagagctgagatcctggtgctgcatttggggtcttttccatgctacttgcggcattaagttgccttggtcatctaaagcagaccaaggcgttggagacctcgttttgagtggagatgctggttctaaatatggaccaattcttaaagagccagagtgggaactgttgatccaagtgtagcctgaagcgaaagaggagccttccagacccatgccatatataaacacacgtgggtgtgcattctccccccacaccttctgtgcaaagctgggagctcactccactgcgtcttgctttttttcacttggcagatcttggagattgttccacatcagtacataaagtacataaagattgtcaccccacaaatacacaccaagtcctattttcatcagcgataaaaaagaaaagttcttgctttccggaagcttgcatgcggctctgagtacc

SEQ ID NO: 4542 - DNA, 1113 bp, Homo sapiens
aatagttgtgggagtcaaatcagttgcatttttgaacattttgaagggatcaggtggagcacaggaaaacaggagatgagaggcttgagggctgtgttggtaagggtcccttgaattctaagctgaggagttcatgcaggaatcaagcagctccctcgccccatgaagggtgttaggaatggtaccagtacatgggtagctgttggtcttgggtttcttcttgccttttggggtgcagccttcaggcatctgctgctagatccctaggcttctatcttgtaggtgctgtgagctgagctgttggtagtttctggggaaaggatacttctcatggtactttgccatgtggccacagttgatacccccccaagtgcaaggagaaagaagttttagtgaggcagaaatgagagaatacagtagagtattggatggaagaagacagggacatgaagcaggactagggtttcatttaatagccaggggaaagggattctggaaatgttttgtctgttaaccttgagtttcttttccttccactcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaagtgagtacctgggtggagaggcatccagctggcaaaaggctgaggaaggcaatggctgggacgggctagcagttcaggggattctctctaaagaaatgctgttttgtccaggtaagaaaatgtgcttgtccatttagcccacaaatattgtgatttcccaggggttacaagagaggagacacattcttcgtccttacagcgtgatggtcattgaatccttggtttcttgggaattatcttctttccctagttccctttgcaggagcagcagtggactgcaagtgggctctgggtgcgggttcgacggccatttagcaagttgtgacttgtgtgaaatcactcagattctgagttttggtttcctcatatgtaaaattaggacagtaatgtctaccttgtggagtaatggtaaggattaaat

SEQ ID NO: 4543 - DNA, 1199 bp, Homo sapiens
gacagactggacatttccctgtttcgagccaggctcttccaaggggccagctgggtccccggagtcagtcctaggctggatgggagggtggccccctcaagaggactcccagcctccacatctggttcctaccttcacatctcaccctcccgttctggggaagaatttctggttcctacagtatccactccatcctcaaggcttcccgcagggccttggggcactgccttgccatcgggcccagttctccgggccccacctgcacccctttcttccccctgggatatgatgtgtggtgtttcctgtggtaaaagactgaggcaggccaggggtctgccagtaacatgttcccatgtacagacacggtccccacaccctcccagcctcaggcccaggcagacatgggcgagctggtgagactgccagccacggctttgcttagccacctgtggccgagggctctcagagacccccttaacctcccaaatactaagaagctaaaatattttaatattttgtttttttttttcttggtgccagagtttataccctgggtgctggggtcgcactgtgttatatatatatatatatatatataatgtgtatatatatatattctattttttttggttgggttcgtttttaattcagtcctacaaaatggtggtaagccccagtctcaggggtcaccctgtcttagagctagagatgaggtggcagggagggaggctgtgtcctcagtggcctggggctgagcagaccttaggaaggggccctccccagtgccgtggctgctctggggctaccccaggtgaacagaggtggtgagatgcgcagggaagaccagctctctccaggacatcgggctgcgtgaagtccagtgaccctgaggggattttggccaaaggaaacagccagggctgggctaggagagctggggtcaaaagctgccccacccactctccctcacatggtgctaggctgggagctgccctgagagctgggatgcccaccaaggcccacagaactgtctccaggcccttgtagacagtgggatctctgggctgatttctggttggggtctgctcctaccccaccccatttaacaatgtgaagtgactgaggctggggtgcctctccctggccccctccaactgccaaattctgcttccctctgaaccccaggaaatactttctgg

SEQ ID NO: 4544 - DNA, 1448 bp, Homo sapiens
gtaaaccataaaatagttcagcaagtagcccacagttctggcctaacagcagacttgctgttttcacttggtatcctggagttgggttgctaaccttaatttctatgatgttttctaaaatgaaacttgataaagtagaccaccagctgcaccgtgttttctgtaaaagtattgttagtaagtggccaagagacttgaggaaaatacagattttttgtttaccttggtcttgttttaagtcttaaaaaattaaagataacattataatgtagaatacagatgggacatagtccttgtaagcttcccttgaaaatgttttaaatatttaggaagcttttaaaagacactaaattgtactctaaaagacactaaattgtactaattgtacaaaggtcaagccaattttatgaaacagtcctacagagtaatatatgtgatgcagtgtaagaaggaaaatactcatctctaacattatggtaataacatttagcctcttaggagttggagcagggggatgggtaattacagatttgcagactatagaaagagtttcatttttttgtgaccccacagagtctcaaatttttatttcactacctgctagagcctactgtgaaatcactgctccatatttgccagtggaggaaatgggcatagagtagagaatagcttcatatgtttacacgtttgcatagactacacacatgtcatgcgtttatggcaggtagctggtatttattccccaaagtaataatgttgaagtatgggtctcatcattcccatacacagaaacacaaaacactttgatcataaacttttttcttcagaagccaaactaacttgcagaataatagagccactggtttaatgtttcctcaagataggttttagtgtaagctagtattctgtgtgttcgtagaaatgattcaatacctgcagctggtgaattaggaattgtatttgttgccttttttatattagatgaggtgcaaaaattttaatgctagtcagtatgcaccaccacaggaaagttagatcccattagcacttgaaactacagctttggaaacttaggctaagttaatttggatttgttacttgattcacctactgaccttttcttttgtttgaagtgcttatcagcataatgagctaagtgtcatgcatatttgtgaagaaacaccctttttggtcccttttgggacagagaggtactccttgatctttatgaatgacaggttactgttttgccttattgcttaacttaatgtagtgaaataaagcagacaaagcttgagcgtgtcttttgtttgctctcatgtagatactaagtagcatggctcagagccaaaagacaagcgtgaagttaagagagttggctaagagagttggtggggcatgctcccttccattccttaaatgaagtaatctaaaatctcttagcaggt

SEQ ID NO: 4545 - DNA, 1224 bp, Homo sapiens
gggctactgtgaggcttttaaaaatcttattcttataatagttattttaagctgataacaacttaactttaattgtatacaaaaatctctagattaatttccaaaacatcttttatgatattgatgtcaaattttacatctttttgtaatttgtatttcttaacaacgtattgtagctacagtttttaaaatagttttatcctgtaaccctcatagcagagataaaattgctttactcaccacccttacagtattagcgtattctgaatattgattatattacttataccattgaggtctttttacttttctatgttttgtgttattcatttgcagtcttttatttcagcttaatgaaaaaaaatccctttagcagtttctttaaggcaagcctagtggtgatgaaatactttagcttctgtttgtttgagaaagttatttctcccccatttctgagcaacagctttgttaggtaaagtatcttgattagtagttttttcacccttcagcacattatatatagtctgactctcttccctggcctccaggctttctgctcaaagatctgctgatagccatattgagactcacttgagtctacggccatgccaccctgaacgcgcccaatctcatctgatctcaggagactcacttgaatatgatgtaattcttatctcttgttaccttcagaatactttgtctttgatttttgaaaatttgaatatgatgtgtcctggtgaaatattcttttggttgaatttaattggaggccactgttggtgtcttatacctggatgctgttattattctccaaattttgaaaaatttcagccattatttccttttttctacattctccttctgaaaattatattgtgtgaatattcattctcttgatggtgtctcataattcccataagtcttcatgattgtttgaaattcttttctttttgttcctctgactaaataatttcaaatgtcttgtctttaagctcactgattctttcttctgcttgatcatgtcttctgttgaagctttctactgaatttctcagttcagttattatagttattatctccaggatttatatttttcagctgtttttatttctttgttaaatttcttattttgttcatgaattgttttccaaattccattaatatttagtttgctatctgcattttcttgtagttctctgagcttctttaagagggttattctaa

SEQ ID NO: 4546 - DNA, 1111 bp, Homo sapiens
gaacacagataaattatgaaagtagtaaaaccacagaaacaatttttctatatatatagaaacatgttttaatatactgtcttaactttcttacttgataatctggagtcatctttcagggtaatacttgtatcccattaattttagtggctacacagctttttatagagatgtagtgtactttaatctcctaatgatggatctatagattgcttctattattttctcttacaatgtcgctttatacaaaactgtctatttatgtggacttgttagaataatttcatagaagtttcaaaatgtgtatttgctggaccagaactattttttcccttacaccttgaccagcttgcatattggataccacatgattatcaggtataaaataaaatttatgaatgtattcaatatgaatattttcaattcataaaataaaatttatgaatgttttgacattgctctgacaatggaatatatctcgtgtgtgtgtgtgtgtgcatgtgtgtgtgtgtgtgagagagagagagagagttaagtctcagctgtctcccgggctggagtgcagtggcaaggtcacagctcactgcagccttgaactcttgggctcagacgatcctcccacctcagcctcctgagtagctgggactgaggtgcaatccaccacgcccagctaattttttgtagagacagttttaccatgttgcccaggctgatctcgaactcctgggctcaagcaattcgcctgcttcagccttccaaaatactgggattacaggtgtaattgggtttttttttaaggctttaaaatttccagaacattttttctcatttcctcctgatcattacaaaaatctttactgaaaggtagggcattgtaagagagttaacttcattttgcagatacactcagaggggttaaaaatttgcaggtacatatgcacatgactattaagtgataaaacaagtctcaaagctgtttttaccctttctttctttttttttgagacagtcttactctgttgcccaggctggagtgcagtggtgagatcatagcttactacagccttgacctccagggctcaagtgatcctcctgcctcagcttcctacat

SEQ ID NO: 4547 - DNA, 1146 bp, Homo sapiens
ttttttcatcttaaccatttttaagtgtaaagtacagtagtgttaactgtatagatgtggttctatgacagatatctaggacttttcaccttacaacttttattgaagataactttatataccttataaacagactatacccattgaatggcaactttctttcccgccccccccgccccagcctattttgagagtttttctgatgttgtatgctaaatgaattgtaatagttgtgggattccagccataaagtggtttggttcattttgatgtcctgattcatttgcttatcagaatttgccaaacaaatggattccagttaagttattgagtggcattttaaaaattactttttaaaaactcagatagatatacaattcttagatttttgttttggatagaaggagctaactctgtgttctggtttctgattaataaatgatggaggaattttttgtgaaataaatggtggcagaatgatatttctcaaattttcctgtcaaagtaatgacatggaagaacatttagaggagcctgttgctgaaccagagcctgatcctgaaccagaaccagaacaagaacctgtatctgaaatccaagaggaaaagcctgagccagtattagaagaaactgcccctgaggatgctcagaagagttcttctccagcacctgcagacatagctcagacagtacaggaagacttgagggtatgaaacgtgtcttcatttttattctattcctagttattttttttaaaaaaagtttctgttcttttgtattgctgtttggttgacttgtagatacattttcatattggtggttcatttcagggaaatttcttagatattgagccatatgtttgataagagagaggtaagatgtgtattagtttatttcatcaaaagaaaccactcccttccccgaggtaacttgaatgcctgttagaccagaaattttaggtgccactgtagcaccctatcagtgattccttttctatttaatatttaatcttttacactataaattattacatacttgttactacaagtgcataacatcttttcaagaaaaataacatggcagaatatactttttctatgaaattttattgaagataactttatagtggaagtagaaatgaactgc

SEQ ID NO: 4548 - DNA, 1377 bp, Homo sapiens
tctgagtcggagtctcgctctttttcccagactggagtacaatggcgtgatcttggctcactgcaacctccgcctcctgggttcaagcaattctcctgcctcagcctccttgaatagctggaactacaggcgtgtgtcaccatgtctggctaatttttgtgtttttttagtagagacggggtttcaccatgttggtcaggctggtcttgaactcctgacctcgtaatccacccgtctcggcctcccaaagtgctgggattacaggcatgagtcaccgtgcccagcctctgctggttcattattacagctttctttatctttgatagtgatagccagctcatcagtactcttaagtctggtcaccttgattcttacagcccatcatgttcagaggtgaggtccgtctgaatgtcgaagagaagaagactcgagctgccagggaaggcgaccgacgagataatcgccttcggggacctggaggccctcgaggtgggctgggtggtggaatgagaggccctccccgtggaggcatggtgcagaaaccaggatttggagtgggaagggggcttgcgccacggcagtgaatcttcatggatcttcatgcagccatacaaaccctggttccaacagaatggtgaattttcgacagcctttggtatcttggagtatgaccccagtctgttataaactgcttaagtttgtataattttactttttttgtgtgttaatggtgtgtgctccctctccctctcttccctttcctgacctttagtctttcacttccaattttgtggaatgatattttaggaataacggacttttaaagaagcaaaaaaaaagactgaatttccttgcttactttgcatatacagactggattttttttttttttttacagccatttccccaaaggaatgtcttgcatattactgacatttggtatgtttcattcattggaatatttcttattttctacgtgtttgaaaagcctgtaagaaatacaggatttgataatattttgaaggcaggaaaaacccaaattgtttcttctttgagagtcatgactaccttctggtgtggagaaattgccattggaaaatttgacaattttgattctcactggtatgtttaaaaactgaataaaaggaatagaatttttttttgataaaggatcacaaaacaattctaaaacctaactgtttttaccattgaaatttaaattgtgataataggttttaaatgtctagaatgcaactgataggcttttcttgaactgttagtttttttgaagtagttttttcatgtttaatttgtatttgtaaaaaaacaaaaagcaaaaaaattcccaaaacccagataacaaccagagcaaaactg

SEQ ID NO: 4549 - DNA, 1173 bp, Homo sapiens
ttagctgatgaaaatatttaataatgacaataactgctcagctataacttctgtaattttctagttataagcttaagctttgggaaaaattggaacttctgtgtaacttggtaaagccatctgtgagtaggtgtgaagtaaatatcctccgatgtagcctgccagacaattgtctagagccattgcaatggcctttgaaagagaacaaatggaacgtggcaggcttttggccttccttctgaggactgactcttggctctgatgttcagacttctgcggaccagctggccaaataaagtacagctgactttctccccactctgttcctcacaatagcaaatggaggggagaatacaagaaggtattatggaagaggtatgataaaccctgaggccctattgtcaataagaaaattgcaacatcgatgaagacattctggagggaataagggaaactgagaagtaatggccagtaggaataagtattctttgtaaaaagtacttcccattagttaaaagagacttcagattaaatgtgggtctcctcacagaatcctatattcggggggctgtatagctcagtggtagagcatttgactacagaatcctatactcaggggaaggagaactgggggtttctcagtgggtcaaaggacttgtagtggtaaatcaaaagcaactctataagctatgtaacaaactttaaagtcatatgtagctgggttcaaatcctgtttctgccattaatgagctgtctgatttggggcaactgatttccactctccatgtgttacttttctcatctattaatggagacactatttgtttccctctcattgttgataaagaatttcagataatgatgggaaagcacttagcctaatgtatggcactggtaatcattcagtaaatgttagctgaatgaatagtaaaggtaagattagtattaatagattaattctctattaatcttagtattaatagattaattctctattaatcttagtattaatagattaaaagattaataccaatgttacctattaataaagggaatattatattgaaatcttgtctctggctaagaaaatcccctttatctttctcgaatctcagtatgcaacaagaaacccagaaacaaatcagcagtgcccccaaaggcctctgcataagg

SEQ ID NO: 4550 - DNA, 1099 bp, Homo sapiens
tcttcatgtttagcaggctgagaaggaggggttggtcttgctctctcgagtggcaaaggggaatcatcataaaggtcctcatcctcatggtcttcacattgagcaggctgagaaggaggggttggtcttgctgtctcaagagtggcaaaggtggaagaaatctgcgtataagtggacccacgcgtggatccatgcatttcaaacccatgttgttcaagggttcactgtagatggattgacccatgatggctcattaaaaggttaaatgcttaaagttaataaatggttaaaagctcaagttttatcattggacacgtttctgccattaaatagtcttatgaccctggatgagtctcctaatctctgtaagcctcagtatcctctgtaaaactctctgagagttgatgcagagttaatcagacccatggatataagttaaaggtccgtaactgggcctccttgtttgataccctgtgagaggatggatcttggctgacagaacggatcagagggacccctcctgacatggtggggctgctgtggggaacctggtgacagtattttttgtggtttctgtagctccagcccctcagaagggacgcctacagttggcagctatggctgtacccctcagtcattgcccaagttccagcatccttcccatgaactgctcaaggaaaatggcttcacacaacacgtctaccataagtatcgtaggcgctgccttaatggtaagaagtgtggggggcaggagatgagcctctgggcccgttatttagacccagagtataagagttgggggatacggggataggtgactcttttctctgacttcagagcaaaaaaaagacatgacattatagcaagaaagactgaagttagactcgggccaggtagttttaaactgtaggaagctagggggatatggcactcacaacgttcgtgttctttgatcttcctctattgattattaaagctgtcaattaagtatttccatatctctggcaagattactgactcagccattgtcaggtctagtccactgtccatcacaaaagggtatgtaagaggtgacatatgctctctagaacaaaggttg

SEQ ID NO: 4551 - DNA, 1725 bp, Homo sapiens
ggaaaccaaaggatctaaaactggggtttgggggaaggtttcagcctctccccactccccttgccccacaccctttactccccagcccagagagacgctgcttttaccaggaaagactattgaaagatgttttattttatttttctctgacctttccatccttgaaaaaatggggaaaaaagaagaaaaaagacaaaatcgaccataaaagaccaaaaaaaaaaaaaaaatcagaaaacccccacctaatccacagaaagtaatgtctttcccctccccttggaatttttgttttgtttttggaaataatatttttttaaaagttgccttattgtggagcgggaatctgaaatacccaaatgcctgttttcctcggtggagtcaacccgaagagctcccaccttctctggatgtgcctgggcttggactggctagaatctttctctggactgttgcatgtacagtgcctccatcctggaggcaagagagttgggagtggctcgaatcagagccgtgcccaagatatccctgctgttgcatcgtttgaagctgacgtcctgtgtctgtacactgctgccactgttgtgtcctcgctctgcttgctgttgcctcacgccaggccccgtcctgccgtgacacccttcatcctacccttggaaccccaaggccaagttggttcaaactgttggagaacagagttggcctgcatctggaacacacttgtcctcagcttaccatctcctcacaccccagagtggaaaggtgaacacctgcagctgaggcttggaaacgtttcttgtgttgccctgaaaaatctttgagacctcagggaggctctgtctctcttaaaaggtggagaaagatgccattctctccctaaggtctggtggagtctccccatcttgcatacccttctgcaagccatctatctctgctcactctccaattgacccgcctgggaacaagggatgaggaggagttgggggctggggggaatcctgccagttggtgaagccctgtggcaggaaggtatatgtggacatagagtatacctgattctctttcttcagccactgactgcttgggttgggctgtgaatgataatggaatggctggagtctgctgttgtcagaaggcagggagggtgatgaaggactgacccacatggactgggatgtgtgtcggttatgggcatgactgcacgttcactctcagtgggatctgggcaacatggagttcattgtcctgttgcttacttactgcaatgtctttggccctccttttcaactggttcctctgttgggcccaaaggttgggagtaggagacagtatcccaggctgacaagggcttgccctttaccttgggcaccttgttaatttttagcctgtgcccttccccacctttgccctcccagtggttggtatgtgggaagcccatctcagttcctgtgacttcatgtctcaaaccaaggatgagcgtctggtctctgctatgatggtggtatccgaggcctttccctgcccagtctggtgcctgccccacattgtaccggacactggattcctggacccccttctcctttcctttctttccttcaggtcacgcagccctgtactgtatccagcaccacagaaacctcagtgtttttcctctgctggtttggggcacaaggaagccttagggtatggggaaaggctgttattacctagagtttactcccaggc

SEQ ID NO: 4552 - DNA, 1218 bp, Homo sapiens
ttattgtactttaagttctggggtacatgtgcagaacgtgcagttttgttacataggtatacacatgccatggtggtttgctgcacccatcaacccgtcatctacatcaggtatttctcctaatgctattcctcccctagtcccccatccatgacaggccccggtgtgtgatattcccctccctgtgtccatgtgttcccattgttcaactcctacttatgagtgagaacatgcagtgtttggttttctgttcttatgttagtttgctgagaatgtccatcatcttatttttaaaatgggtttgcctacctttcatgagctaatatgcatgaagcacttggcatagtcatttttccatttatagtaattactaccaaattttaacctagaaattccaggtacctgctgccttccatgtcacctctgtggcttggtcatttgatgatgacagtaggaaggagtgagataatgtgccttcttctcagtggatttggcagaaaaatgaaggagccaaattataaggcccacaactggttttacaaattactgtctacggccataccaccctgaacgcgcctgatctcgtctgatctcggaagctaagcagggtcgggcctgcttagtacttggatgggagacaaattacctttcctgtcattttcttcttgtccaaatgaagttattacaatgaataattttaatacaactctctttctccaaaaatgttcagcgttctcatcctgcttaaccatcagctggaaataaagcttggagatatttcacggttgtaaccacagtggtgaaaaggtgggagacttttaggaagacatcaaatgcctttttatatttcacacaacctcctgggaggtggaggctaggagtctctggcaaaactaattcattatctgtaaacctgttttttatgccaacctagacctcacagaggaccaggacagaatgctatctgaattatgctgtctctctggggcactgctgtctcttcatctttgatgttctgtgccacatgctcatttttctgggccatttgcccatgtactttgttctggataggtttgcttttttaaatttcacatgtaaacttgagaagaaaggaacttgggagtttttcatgattggcaaagcaatgagctctgcagctatccatggaagattatggcgatggatgaaaccagcattctggaggtcatctccagcaac

SEQ ID NO: 4553 - DNA, 1190 bp, Homo sapiens
cactaacatggccaacactaaatattagaaagattaatgtggtcatgtagaagatgaatgaaaagaagatacctcagaagtggagagatagttaaatggcttttgtaggaatctcagctagaagtgtcagtattcttaagtgcagaactaacaggtgtgggaaagtaatgggaagtagacaccaaacaaatagttccccaaagatggtatcaaatatcccagtgacagcttgcagcctgctcagctttatgatatgcccctgagatcatttttcaggacaaaaagtagtgaaactacctttatttacttctcaaatttacctttatttacttctcaaatatacatagaaagtaatattgtaaaaagcagctctggctgggcgctgtggctcaagcctataatcccagcactttgggaggctgaggggggcagatgacttgaggtcaagagttcaagaccatcctggccaacatggcaaaaccgcatttctactaaaaatacaaaaattcgcgtggcagcacgtgcctgtaaccccagctactctggaggctgaggtacaagagtcgcttgaatttgggaggtggagactgcagcgagccgagatcctaccactgcactccagcttgggggacagtgcgagactctgtcttaaaaaacagtggcctggcgcactggctcacgcttgtaatcccagcactttgggaggccgaggtgggcgggggtggatcatgaggtcaggagatcaagaccatcccggccaacgtggtgcaaccccgtctctactacaaatacaaaaattagctggacatggtggtgtacgcctgtagtcccagctactcaggagagtaagatgggaatcgcttgaacctgggaggtggaggttgcagtgagccaagattgtgccactgcactccagcctggcgacagagcaagactgtcttaaaaaaaaaaaaaaaaaaaaaggatattttcactcttgggacttgataaagctagtttatttttattatctcctatatcctatacatatttaattggcccctatgaacaatgttacctctttatgaggggacccaaagaagtagctgctggtgtgagagtgagagatcatccatcttttttattgtgctttttgttgtttctttgtcctgctatgtgttataagtaaggccgggcacggtggctcatgc

SEQ ID NO: 4554 - DNA, 1229 bp, Homo sapiens
gatccacccaccttggcctcccaaagtgctcgaattacaggcctgagccaccgtgcctggcgagctgtccatttttgtgctttgattggatgaaaaatggacagctgtgtagaaatatgattggactaaaagagtatgacccaatgctaataggctgcgtggggaagcccagcaaggcctatgcagtttcttcttgccctctctgttgtagcatttcttcctcctaggtatggatgaggcaggacccctctggaatgacagtcttctgacctaatattgcacaaggataagacagagaatttctttatgtccagctcctagccagaacagtaaagaaaggttacagtaattattctagtttttatggctggctttggaaaagagaagttctagtttctatgacccaccttggggaagaggaattctggtttctatgacttgcttcaagacagaatgaagggtaagagacagcaaggcagaaaatctaagagaccttggttctgagattgcttctgaggccttctgacatcctttaatttattgcttctagatattttggctaagatcaagtgtagtatctgttcttatcagtttaatatttgatatgtcctctatccaagggcaatatattaaatggatttttggagcagggagatagagtaggagcttgctccatccactccacacactgacttggtattgcagtacctccaggaatgatgcaaccctccaggatatttttatttttaatcctttaatttaaagtgctcagcatgccaaagtgccatactttgaagtatcactttctgagccccaatagaagtataatatagtagttaaaaacaaaggctccatagttagccttctgcccattactcaccaggtaatcttggcacactaatctctctgactcaggtttcctatatagaaactagacataataatctccctatctcctaagtctttttgcaagaacaaagtataaaaatataagtaaaatgtctaccatataacaatagcataagaagtcaccagtattgtttttattatttgtattgcttttgttgttatcacatagctagtgatccaacactagctatgtgataacgccagctgtgtggcaaagtggagacacacatccatgacctgaaagtcatactacctacctccaactttcaataaagagagtgggaactctggctgtcctgctctcccaaatgagaagcaag

SEQ ID NO: 4555 - DNA, 1179 bp, Homo sapiens
ccccctttgtttatcagggacacatataaccaatcaatacctcagccacctcctcggaaaattaagcgacccaaacgaaaaatgtacagggaagaacccacttcaataatgaatgctattaaactacgacccaggcaagttctgtgtgataaatgtaaaaacagtgttgttgctgaaaaaaaggaaattagaaaaggtagtagtgcaactgactcttctaaatatgaagataaaaaacggagaaatgaaagtgtaactactgtgaacaaaaaactgaaaactgaccataaagtggatgggaaaaaccaaaatgaaagccagaaaagaaatgctgtggttaaggtttcaaatattgctcacagcagaggcagagtagtaaaagtttctgctcaggcaaatacatcaaaagctcagttaagtactaaaaaagttctccagagtaagaacatggatcatgcgaaagctcgggaagtgttaaaaattgccaaagaaaaggcacaaaagaagcaaaatgaaacctctacttccaaaaatgcacattcaaaagtccatttcacacgtcgatatcagaatcctagctcaggttcccttccaccccgggttcgtttaaaaccacagaggtacaggaatgaagaaaatgactcttctctgaagacaggacttgagaaaatgcggagtggcaagatggcacccaagccccagtctcgctgcacctctacccgctcagcaggtgaggccccttcagaaaatcagagtccctcaaaaggccctgaagaggccagcagtgaggttcaggacacaaatgaagtgcatgtgcctggtgatcaggatgaaccacagacattgggcaaaaagggcagcaaaaacaatatctctgtttatatgaccctaaatcaaaagaaatctgactcttccagtgcttcagtgtgtagcattgatagcacagatgatttgaaatcttccaactctgagtgtagttcttctgaaagctttgattttcctccaggcagtatgcatgcaccttccacctcctccacttcctcctcttcaaaggaagagaaaaagctcagtaattccttgaaaatgaaagtcttttccaaaaacgtctctaaatgcgtcacaccagatggcaggaccatatgtgtaggggacattgtttgggccaagatatatggcttc

SEQ ID NO: 4556 - DNA, 1173 bp, Homo sapiens
aatctcaaatcttccttgaagctttgcatgactattttgtccctgtccacacaccccaaattactccctctataatacccttagcattttaacctaaatgtctcttaggtccttaatcattttctgatttgtagttttagagaagtaaatttcttatttcttgactgtgaatgtttgtctttcacgataaattaaagttggttgaaatgataaatctaaaaattatcttacagaatatattgcttcatctgccttaaagaagatacaaggcctgtttttagtttataatgatggataaattcgttttaatctagattactaatccttcttttcaataattcttctaggcaatacaaactgttaccgagctcctatggagtgtcaagaatcatggaagtaaacatctgagaaacctgttgaagattatttcattcgtcttgttgttattgatgttgctgttattatatttgacatgggtattttataatgttgtatttaattttaactgccaatccttaaatatgtgaaaggaacattttttaccaaagtgtcttttgacattttattttttcttgcaaatacctcctccctaatgctcacctttatcacctcattctgaaccctttcgctggctttccagcttagaatgcatctcatcaacttaaaagtcagtatcatattattatcctcctgttctgaaaccttagtttcaagagtctaaaccccagattcttcagcttgatcctggaggtcttttctagtctgagcttctttagctaggctaaaacaccttggcttgttattgcctctactttgattctgataatgctcacttggtcctacctattatccttctacttgtccagttcaaataagaaataaggacaagcctaacttcatagaaacctctctatttttaatcagttgtttaataatttacaggttcttaggctccatcctgtttgtatgaaattataatctgtggattggcctttaagcctgcattcttaacaaactcttcagttaattcttagatacactaaaaatctgagaaactctacatgtaactatttcttcagagtttgtcatatactgcttgtcatctgcatgtctactcagcatttgattaacatttgtgtaatatgaaataaaattacacagtaagtcatttaa

SEQ ID NO: 4557 - DNA, 1194 bp, Homo sapiens
aggagacagaagaattatgaccaatgtttgattttccataatgagattttaccaaaaatacaaaggttgtccaaaggttgacaaagtagataagacaatcaataactctcatgatgttgactttcattttaaaacataaatcaattctacagctcttgaatattcaatttagaaactatgaactatggaatataaattagcaaaatttatgtctaactgttgaattgaggagagaacatacagagaaaacagtgctcaattttaacaaaatacgtattttcgaaatgtactttttaaaattttttcacacaatattcaggatctggagcagtatatagaacatagcacactctcctttctttctttcttgtttcttttcttttctttccatttttttccttttttgagacagtgtctcactctgtcactcaggctggagtgtagtggcacgatcttggctaactgcaacctctacctcccaggctcaagcaatcctcccacctcagccttccgagtagctgggactacaggggtgtgccactatgcttagctaatttttttgtattttttatagaaacgaggtcttgccacattgcccaggctggtctccgaactcttgggctcaagtgatccacctgccttggcctcccaaagttctgggattacaggtgtgagccactgtgactggccccataacacactcttaataaggatatattaacttgaattttacttaaaggggcttcatattttgttttgcattgatttaaaaaataagtctcatatagggactattcactcttttctttttaatataaacattatatatttgcatggtaaattaaatgcaaaccatacaaaatgtgaaattccccaccccaagtttaactccttaattattgccactttttacaagctactgcttgttgtactttaacacaatgtatttttaagcaattttaaagactgcagagaaaacaagcattgtttttatgcactcttcctaaacaagctctgcccgtcaaagatactgagttgatgtcagataaaatgtcccttcatcaaaaggctcctaaaacctttcaacccctctctttttctctgtgcttgagtggttacaggatttaccttctgctgctggaggctatagttggtaacttactccatagtcaagatggaacttgtgggttctta

SEQ ID NO: 4558 - DNA, 1099 bp, Homo sapiens
gctgtaatgatgagtgagttttatagcattactgaggacctgaaaacttgctgccaaggacactttgaaggttttgttggctggaagaagtgtctctggaatcccactcctagctcttcttgaatatttgaaaagaattagataagggccatggggacccaggtcaccccacctcttcttttcagtttggctacaacattggagtcatcagtgctcctgagacagtcatacaggactttctcagttacactttgaaagagaggtcagaagactctccctctgaggttttgctcatgtccccctggcccttgtctgtggccatcttccccaatggtgatatgattggctcctttctgttgcactctttgtcaaccactttggcaggtgcagttcaatgcttatcataatttgttggctattactggttgccttatgggattctgcagacaagctgagttggttgaaatgctgatcctgggccactagattactggcttgtaatgcggactctgcacaagttttgtgcccatgtacattggagagatctcgcctactcccctttggggtacctttagtgctctcaaccagctggacgtcgttggtattctggagatccagatctttggtctggagttcatcttggggtctgaagagctatgcccagtgatactgggctttaccatccttccagctgtcctataaagtgtagcccttccattttgccctggaagtcgtaagtttttgctcattaacagaaaggaagagtactaatgagatccttcagcaattgtaggggactcaggatgtgtcccaggacatctaggagataagagtgctaggatgatacaagaaaagcaagtcactacactggcgctctttagagtacccagctaccaacaacccactgtcatttccatcatgctccagctctctcagtagctctctggaatcaatgttgtcttctattactcaatgagaatcttcaaggatgcaggtgttgagaagccaatctatagattagtgcaggagtggttaatattatcttcttgactgtagtctctctgtttgtggttgaaagggcaggaaggactttacatat

SEQ ID NO: 4559 - DNA, 1223 bp, Homo sapiens
tattctatcttatatctttgacttgcaaaagcctatatttttagaatcagtttttttagacattagtctgatacagaaaccaaggttctctgcagcagaccattctgaggttgtggggatattgttggaaaaaaatatgattaggatttattatacattcttacctttatttgttttttgtcagagaagcagtcacccctgattgttgctttaggccatcaattgatgtgcactgcaaggggtaaattgttctacacattagtaagctgggtaagcaaattgttgtgcaaacctaatttgtttcctagagaaagtgactgacatacaattttgaaaatggaaatattcataaattgggtgaccatggtggaatagatccattgtgaaataaccactacgtttaagaatcctgtactcattggtgagactgacaaaaaacagtactgtgactgaggtaaacacaaggttacagcagcccttaagaggagtactttcctcaggcttggggaaggtaggacagacaggagagaggaatcagaagtcttcacaatattgatatctattctgggccttgaagatgaagtgggagttggctaggtagatggaaggtaggaggggaagggggtaaatttttccaggttgtgagagcaacatgtttgaggaactataagataggggaatagaatgagaatactgggtgttagagaagaatgagatttttctagatgtaacttttttgcactatatagcccaccagttagagggtctgttttgtgaagaaactagtcagttcagaggaggaaaatgatggaagtagtattcattaaactaaatattttattctgttgacttggtcaatcaagtcagacttggagcctgataatccatttgggcatcgatttgtctttattgttaactttgtaacttggaaaaattttttcaaaatcttcacatggttctcaatactggttttacaatataatcacacgaggaagttttgtaaaaataacactgtggatttgctgtaaaatgtcccaatggaaattttttttaatgtttgggggtggggaaatagatgatgtaagatttgcaaaatattgctaatcactgacacttggtaatatatttccattatgtttgtatatgtttgagcatttacataactaaaagtttaaaaagtaaaattagaattttttctgaacagccatcaaaagatactcata

SEQ ID NO: 4560 - DNA, 1209 bp, Homo sapiens
aatacttatggaacatttactgtgtatcaagctctgctaggcattttcacataaatttatcacatttatttggcacagtgcctctgtgagaaatgcattattagccccttttatagatgacaaaagtaagcctgataaattgccttgccttaagttttaaagctgggattcaaattcgagtcttatgacatcaaatatagaactcttttccttacatcttcctcacttggggaatgtgactgccattctgcgtatatcatagtacatgtaggtcacttggccagttttattttgtcctgaagttattaaggatattcattaggaatttttaaatgccagtgcctttctaggatagactctaaattatgttgtggggccgcttgcatgcaagccgatgttcaagatttgctgttattaaataatgtctagaccctgtacatatctgttttgtgtaattatcaatcctcatcttttttttcagatttggcattattcagaaacaaagtatattaagactctaaatgcttagctacactactggaattatgacttagctaaatttataagaagtaaagtggagttgatcagcagatttgatggtctgtttaaagagtctgtgcttttctgtagaaagaggtctgaacgagacattttagctaatgaatcaaaatcagatatgtggtcattattgcctgattattactccatctgctctgcgctaacgtgaaaatcaattactgtgtctctttcccactgacagcgtatgttgatcgggctggcaagagatcttcgagggattgcctttgcactgaacacaaagaccagctacaccatgctgtttgactggatgtatccttattacactgtgacaataccagctctgtgcacagagggatgccaggcccctcgctttcgtttaatagtatggcacagtagggaagaggaaacaaagctaaatgaactaatgtgtaatcagctaaaaattacagcacagtggcagcagagcagataactgagcacagtatttggagacccagctcagagaagtcacttttttggtgccgttaaatattgataacttaaaaatgacttcccccaaatgattgtttatgttggagttgaagggataatctggctaacatctttagggatcaatgaatcctaccatttgacatttttgaggggagatttgaatctccatctcaatta

SEQ ID NO: 4561 - DNA, 1247 bp, Homo sapiens
cagaggttgcagtgagccaatattgcaccattgcactccagcctgggcaacaagagtgaaactctgtctcaaaaaataaaataaaaataaaatcatataaagtggaaatgctttgcctcctagaggtaaaaatgaacccctttaaaaaattttctaaatacaatttgccatactttttgtatatatctaattccattctatgttttatcatataagatgtgtgtctggaccttttttcaaaaacagcatggtatattagaaaaagcacagttttcagatttgcaagatctcagtactaatcctgttaccaatacttaccgacttcatgaccttcagctaaaatactatatatacctctttgtggctagttttcttttgtataaaattaggactactaaatacctactgacttatctgcctagttgggattaagaaggctaattgagctattctggtaaaaggcctggcacaggaggtaacatggaagagttactcgctgtttatgcctctccttccaaagcctttctcttatactcaccaacccagccttctttggacaggggttcaacaacccacatcattgttttgctcagcagtgtttcctgtttggaccacactgccctgcttcctctgcctgtagccagtgattagtttttatttcctctcttatttaaaggaaataaacagcatatatgtataagaatctcttagtaatcagtagaactttaactatgcatatgttagattcctgttaccagtcacagttgtgtcattcctacccctttttctggatctttcttttcactaaatatattttttcctttagggtttatttactgttgcactagggctgttaagggaagtgagcttcctcttccagtgtcactgactttctaggacagaatgtatgtccagtaagtgacaccaaaaggattctcacagaataatgccaaatctatgggcttcaaaggttgttctgttctctgttgggttgtctgacatagaaaaaggcattgcagcaaaagttgagaaaaataactatgtgaggattatgtcggaggaggaggaagaggagacagaagagaaaggaaatgaagggataggagaagtgaagtggagtgggggaagagacaaaacgtccagagcattcttgcaaagaaaagccagtaaggagttttcttacacggaagaaagatgagattagagtaaggctctgctcctcaatttagactaatagtattggtagc

SEQ ID NO: 4562 - DNA, 1198 bp, Homo sapiens
cctgaactttggggtaacgattaactgcgatccgaagccttcaggcaagtaaaaaattcctgaagtgattacgcctgtttggaggcttgcagggcactaggggatggggaaaggtgaatcgaggtgctctctggctcattcgcagccggctaacccgccatatcttacacagctaagggctgccgacgccattttgcagggtgggctgcgcagactcttggcgggaggccggcgcgcttgagcgggagaggacgtggaagggttggaggtggggagtgcgcgttacgactggaaagcacgcgtgcgcacaggcgacagcagcggaggggtggggccagtgtacgagtgcgcgtgctcggtgggagcccgcggagtacctggaaggaggtgggggcgaggtagaaaggagtggggttgaaaagcgcttgcgcaggacggctacggtacgggggtgggagggcttcggagcacgcgcgcggaggcgggacttgggaagcgctcgcgagatcttcagggtctatatataagcgcggggagcctgcgtcctttccctggtgtgattccgtcctgcgcggttgttctctggagcagcgttcttttatctccgtccgccttctctcctacctaagtgcgtgccgccacccgatggaagattcgatggacatggacatgagccccctgaggccccagaactatcttttcggtaactgctggggggagctggagcgaggccgagcggggcctggtggcggtgagggtgggggtgaggggcgggaatccggctgcaaccgggtctggtggagaccgccagaccgacgggaggcctgagcgggtgggaagagctgcctgagccctggacctggagggattggagccgcggggggagccggtggcgtgaagggggaggagacgagcggcctgaagcgtctggggcgtgagcggtccgaggcccggggcctgaggtaaagtggaaccggccgcctggaagttcggcctttgccggggatacgtggcggagctccaggcgtggtttattttctaacggcggtggttcataggcttctgatgccaggccccgggttggtggtcctggaggctgggttcaccgggaagcatgggcctgcttgttggagcgggtagatgcacagcctggcgttattctggcctcagagcctggagctgccggacgtagacttac

SEQ ID NO: 4563 - DNA, 1240 bp, Homo sapiens
tctcatctgcttgactgggggatttgagtaggatatggaataaatggtttaaatgccttggaagcacatttgagagaagctttaattctatgaataatacttttagactccaactattgagagcaaatgtggggtggtgaaaaattgccaactcatttccccatgtttttcttgtaatctatagatttttcgtggcttcagtagattccttgtacagtgataagtccactggaaaaagaattttagaactggaacatatttcttttagtcacactgtaaaccctttagccttcctggttatcactgatttttgtcccttggatacaatgctaaaatgacatcttttagatgcccctcccctccattttaatatggtcctatctccttggtttaattgcaggcgcattgaacagtcctgggcactacatgtaaattaagcccaaagatggggagaaaggaaaaggagagacaaatatagtccatactgagtgtcatcaacaatccagactgaagtcttctattttaatctcaatccccttttctgatttgccacccatgcctcttcaggctggaaacaatctcttggttccctaaagcactttcttctgactgctgtgattcagtgaaccttgccctttgctttctattacttgtgcatttgcctcacctgacaatgttttaaatcgcctttgtatctccttagctgctcaataaatatttgaatgcatcaattaagaatgtatgtgacaataattttgaaatggaaattgtgaggtttattttactaggttattggaggcagttaagtttcttaatgctatacctgattctgccaaagtcccttggacatttgaaaaccttttcaatcttttaaaaatgcataaaagatacttagagggaaaggtattaattaaatttagtaaaaacaaatatattcaatgctttaaattccaaagtagtgataaatacaaacatttcaagatatttgcaatagtaatgttttgaaattttggttacaaagtcacaggtcttgccaatactgttgtagtttcttgcctatatccgtaatttgaaggaaatggtgagagtgattagagaagtgtaattactgtaattttttcccctattgtagtttcttgcctgtatccataatttgaaggaaatggtaagagtgattagtgaaatgtaattactgtaattttttccccattcaactttatatatctttaactgatgacca

SEQ ID NO: 4564 - DNA, 1215 bp, Homo sapiens
cagggtttcaccatgttgcccaggctggtctcaaattcctgagctgaagtgatctgcccgcctcagtctcccaaagtgtagggattacaggcgtgagccaccatgcctagcctcagcatatagttttttctaaatgtacacatgcccaggcacacatgcacaggcaattcagaataagtttctggtgtttatgtaactttatttgccaaatctggccaactctaaagctgatctcgggagatgaagttggaagtaacattggccatatgggtctctgttctttctgttgatttccttaagtaaataatgctaaactattaaataattattagtatattgttcacatttttatgactgattaaagtgtttggaattaaattacatctgagtataaattttcttggagtcatatctttatctagagttaactctctggtggtagaatgaaaaatagatgttgaactatgcaaagagacatttaatttattgatgtctatgaagtgttgtggttccttaaccacatttctttttttttttttccaggctattcaagatctctggcagtggaggaagtctctttaagaaaatagtttaaacaatttgttaaaaaattttccgtcttatttcatttctgtaacagttgatatctggctgtcctttttataatgcagagtgagaactttccctaccgtgtttgataaatgttgtccaggttctattgccaagaatgtgttgtccaaaatgcctgtttagtttttaaagatggaactccaccctttgcttggttttaagtatgtatggaatgttatgataggacatagtagtagcggtggtcagacatggaaatggtggggagacaaaaatatacatgtgaaataaaactcagtattttaataaagtagcacggtttctattgacttatttaactgctttatactttgtcaaagaaataattaatgtagttaggaatggcaaatagtcttgtaaaattctatgagaatgtccctgccctccccttcaatattctctctggagctaaccactttttcatcataaggatttagtgctgtgttcccacctcctgatgatagttaacaattattataactatgcaacatgtttccaaatgttccattagacctcctatctgcctattctagcctcacttgcaaagaaaatgtggcatgttaaaacagcttaaaagcagcctttcaa

SEQ ID NO: 4565 - DNA, 1232 bp, Homo sapiens
tgacaacaagacaaataatttcttggaccttttatcttggacaccatttattttccctcagccccggggcaggactgacctcatggtagggcccaagcgtggcagctgcaccgtcactgggggctgggccaggccaggccaggctgggcagggctgagccatgctgggcttgtgcacctccgggccagctgcctcccttctcccaggcatcactctttaccgcctccgttcccctcccactctctttccccttcttcctttcgcagcttttccccgttccccgttttgtttttgtccacctctctgtccccctccccaccagctctgtctccctccttcggaccacagcttccctcctccccacctctcccaggccctctgctggctgcctctatggggcctcccatccctcgtggccccctccacagacgcctggctgtgctaggctgacccaggtggtggttttccctcggatctgctgtccagtggctgccagaaggggcagctggctggccgtggcaggaggaggtgcccttctggggagtcccagagctctcattggcccctccaggctgggagagtacaggggggtcagactctggtctgaaccatctgtccacgccctgagacaggaggcgggagctcgagagggaggggagcctggaaatggccggcccctcaccccagaagtcacttgccctctcattccctctgcctgaactgggaactcagggaatctttcctgctgtgtgacctcagacaagcactttgccttctctgggccttggtttctcctctgcacaatggttgggctaacgcagtgcttcttctttttcttttctttttttttttttttttgagacagtgtcttgctctgttgcccaggctggagtggtgcagtggcatgatctcggctcactgcaacctctgcctcctgggttcaagcgattctcctgcctcagcctcccgagaagctgggattacaggcgcccaccaccacgcctggctaatttttgtatttttaatagagacggggtttcgccatgttggccagggtggtcttgaactcttgacctcaggtgatccacccgccttggcctcccaaagtgctgggattacaggtgtgagcatggccgcgcccggccatgcttcttaagtgtaacatgggtgtgaccacggagggatcctgtccaaatgcccatgttggttcagtgggtctcgggggcgaggcc

SEQ ID NO: 4566 - DNA, 1172 bp, Homo sapiens
attgaatttcctattgcctgattaaatatatctgtaattgtaacatcatgtttctgagagctttaactacttccttatttttatgcaatcattttaaagattgtggctatatctaatttaaatttgctgatgattgaatctaaattcaagtgaagaccacagcattaatcccaaaggagattttttttatgtttagaggtggagatattagggtaaatcagtatattgctcctgtcatcaaagtttttgttcatttgtgtgccacatcgaatagcagcacttctcaaagtttgtcaactggaaaaaagtgtttaaaactgtttttttcttaagcagatttggtgatgtcatcaatatctatgatatcgattggtaaaaggtctttctttgttgaggatttgagctctctttttaagagtttattttattttaaaggaacatatgctttgaataacaattctctgggcatgtttaactaacctaggtgggaaaaccatggtgctgtttaattgtaaatagattgatataagattggaccagtacttgatgtgtataattttagtatgtagggtttatgtgctttttttaaaaaaaaaaaaaaggttcaatttttctctttgtctttgcctttattattggtttctaattgtttttactctctataagggtaattgcctcattctaagtgagaattatgaaggttttcctcctttttaaaacctctgctcagtaaataacaggttcattatcaccaaacttaggctctgctatgccaagtcatacatggtaatttataaatgtgcttcatcttctgcactgaaatcttggtctaaaataggttgttgtgggtttttttttttgttgtttgttttgttttgttttgttttgagacggagtcttgctctgtcgcccaggctggagtgctgtggcatgatctcagctcactgcaagctccacttcccgggttcacgccattctcctgcgtgaactcagcctcccgagtagctgggactacaggcgcccaccaccacgcccggctaatttttttgtatttttagtagagacgggatttcactgtgttaaccaggatggtctcaatctcctgatctcgtgatctgtccgcctcggcctcccaaagtgctgggattacaggcgtgagccaccacgcccgg

SEQ ID NO: 4567 - DNA, 1136 bp, Homo sapiens
ccaaaaaaaaaaaaaaaacactaaatcaaccactttccaatttattcttggcaagggtggctagttctagaataggcttttaaaggtctcatcttatgcagcagatgatgtctgaatcttgtgaagttgtgtgtaatttaggattctctgtatgccgacttatttcttgaaatgggagaggctgtcagtcggcgccacatgtgggctggtggctctgtggcagtggtggcggctggactccggcaccatgagcggcttcagcactgaggagcgcgccacgcccttctccctgaagtaccgagtcttcctcaaaaatgagaaaggacaatatatgtctccatttcaagatattccaatttatgcagataaggatgtgttccacgtggtagttgaagtaccactgtggtctaatgcaaaaatggaggttgctacaaaggaccctttaaaccccattaaacaagatgtgaaaaaaagaaaacttcgctatgttgcgaatttgttcccgtataaaggatatgtctggaactatggtgccatccctcagacttgggaagacccagggcacaatgataaacatactggctgttgtggtgacaatgacccaattgatgtgtgtgaaattggaagcaaggtatgtgcaagaggtgaaataattggtgtgaaagttctaggcatattggctatgattgacgaaggggaaaccgactggaaagtcattgccattaatatggatgatcctgatgcaggcaattatactgatatcagtgatgtcaaacggctgaaacccggctacttagaggctactgtggactggtttagaaggtataaggttcctgatggaaaaccagaaaatgagtttgttttaatgcagaatttgaagataaggactttgcaattgatattattaaaagcactcatgaccattggaaagcattagtgactaagaaaatgaatggaaaaggaatcagctgcatgaacaaaactgtgtctgagagcctgttcaagtgtgatcctgatgctgccagagccattgtggatgctttaccaccaccctgtgaatctgcctgcacagtaccaacagacgtggatacgtggttccatcaccagaagaactaatgggatttctctggaataca

SEQ ID NO: 4568 - DNA, 1244 bp, Homo sapiens
aatggtcatgttccaacatgatttcaccgcttcgttgtttctctcccatccttcttttagttggctgattgcaattctggcccaactcaaccctctctttggaccgcaattgaaaaatgaaaccatctggtatctgaagtatcattggccttgaggaagaagacatgctctacagtgctcagtctttgaggtgactatgcttgtgacctttcttatcagtatggtcaggcagtcagagtttgccttgactttttctcacattttatggccattttaacacgtggcaagggcaagctgctgaatgcaaacacgatctgaagagcagaaataaaattggaacttaagccttagcttacctaaatctcattaagattctttttagattctgctatcaccctgcctttttaaataaatacagtttaatttacaaaattaagcttgcatgcactctttcagacgcagatcaaaaaagtaactgtttatacttggcattgtgagatccagcaactttaaaaagtggctggcagatttaaaattgagcaggtttctttccagcagtagtcagccatccggacagaaccgttcctgtgatggtgttacactgctgggagaggaatgtcttgtcttcatccggttgcctgcgccactgttctggtggcgtctggcactggtgcaagacagagctgtgcttccccgagagtgtgctaagcattcactttggctgcttagttctagtctgggagcagacagagaaaacaaaattaaggtttttgaatgctttggatggagaaaggtgcctgcgtccgtttgttttgtgttgctataaaggaatacatgagactgggtaatttatatttggctcgcagttctgcaggctgtataaacatgacacccgtatctgtttggcttctggtgaggcctcaggaggtttttacttatggcagaaagcaaaaggggggcagccgtgtcatatggccagagagggagcaagagagagagaaggaggtgccaggctcctttaaacaagcagctcttgtgtgcactaacaactacttcactcgttactatggggaggtatattagcccattttcacgctgctgataaagacatacccaagactgggtaatttataaagaaagagaggtttaatggactcacagttcctcgtggctggggaggcctcacaataatggcggaggatgaaaggcagttcttacatggtagcagcaagagagaatcagaa

SEQ ID NO: 4569 - DNA, 1244 bp, Homo sapiens; identical to SEQ ID NO: 4568

SEQ ID NO: 4570 - DNA, 1486 bp, Homo sapiens
acagggctttgtagctcagctgaggttgactaagctttgggatccttcagggtctcctctttctatctgtgtgactctgggtacattacacacctattttaacttactcatctgtaaaattaggatgataatagcacctgccattggtagttgtcgagagaattaaatgagataatacatgaagagaggttagcccagtgccgggaatattttaagtttttaataaatgttctgtggtatttttattatcggcaagcaggctcagatccacagactgattttattcttacatgaaccttaagaggttgaaattaggactttcccccagttatgattcttagaagaatcttaattgagattcaggcagatgaagtgacttgcctgagggcaaacttcttagaagtggcaggtttgggtcttgaactttgattttgatgccacgtctcacaggttttctgttccactgtgacctcatgccctggagaggaacacaaatgtggggggcagacagcatgcaaatggaggcagcctgtagtccttacctggaaacttcacgggaaacctcacccagcctggacaaggacgggattgacagattgacagctctttctcgattctgtgggtggtggtgcatggccattcttagttggtggagtgatttgtctggttaattctgataaggaaccagaccctgacatggtgactggttacacgatccctgagcagtcggcatcccccaacttcttagaaggacaagtggtgttcagtgacccaagattgggcaataacaggtctgtgacgctcatagatatctggggctgcacgtgcactacaccaactggctcagtgtgtgcctcccctacaccagcaggcgctggtaaactcttgaaccctattcgtgatggggattggggattgcaattattccccatgaccgaggaattcctagtaagtgcaggtcataagcttgcattgattaaatccctgtttgccttgataagtccggctcaaactggacttgaggtctgactttggtgagactcactctgacatcccaggtaggagactataccttctagtctctttccagaaacagggcatcaaaagtcttactttactcctgaaggtttgcagtaaaaattaaatattcagctatgataagtggctatagagatgcagagtgtgaatgggaccctactaggtatcctaggtatagggaaataagacacataagaaatttgcttctgtttatgacaggagtcattctgctaggcattcacaaatctgctgccatctagcccagtctgaggctgagggtacacccaaactcattgaagaggaaggggctttcattctgctcagtctcttgctggctgactccccaagacctaagccctgcaagtgtccccagacccatctctcactatgcctatcacctctctcctatgctcttccagaacagaaatttgtcatcttcatgtttgaa

SEQ ID NO: 4571 - DNA, 1214 bp, Homo sapiens
ccaatgaaggtgatgaagcttttggatttggagggtaaaagctccttcacaccccttccaaaagtcagtcacagaccactgcaacatgccttccctgctggatcattatatacattcagattgtgagtggattgccttggttgacttttaatttattgttttttgttcttataaagatgataatcttaccttgcagttattgactttatattcaattatttacatcaaataatgaaataactgaaatgtacaaatgtcaaattttggaagtatattcaataccaatgctgtatgagtgggctgaatccagttcattgttttttttttggtaagaagtgagactacagttccagctacctacatgtcttttcttgtcatccttatagatctctttggctttcagaaagatacagtgataatgtgtgtatgaatcagtcacaatgaattttacttgaatattgtatgttgcattccacttcatttgaaaataatgaaaccatgtaccactgtttacatcatctgtagtgatttcatagataatatatttaatatgacagattatgtttcaactctgtagatgtttaacgtcatagacagttggccctctgtatccgtgagctctatatctgtgaattcaaccaagtttggatggaaaattttttttttttttttttttttgagacggagtctcgctctgtcacccaggctggagtgcagtggcgtagtctcggctcactgcaagctccgcctcccgggttcacgccgttctcctgcctcagcctctctgagaagctgggactacaggcgcccgccaccacgcccggctaatttttttgtatttttagtagagacggggtttcactgtggtctcgatctcctgacctcgtgatccgcccgccttggcctcccaaggtgctgggattacaagcgtgagccaccgcacccggcctgaaaatattttctaaaaagataaaaaatatacataacgatgaaaaataatacaaatttaaaaaccaatacagtataacaactatttacatagtgcttacattgtattaggtgttataagcaatctagagatgatttagcaagtatacaggaggatgtgcctaggttatatgcaaatactgtgccattttatatcaggaacttgagcatctgcagatattggtatcggagggcggtcctggaaccaagcatccacggatactgag

SEQ ID NO: 4572 - DNA, 1119 bp, Homo sapiens
attagagattaagtttcaacatgaattttggcaaggacaaaaacatttaaaacatagcaatcactatcatcatcatcatcctcatcctcagcatcatcatcatcaccataatcagtaccaccatcattatccttatcatcaccatcaccatcatcaccattaccaacattatcaccatcaccatcatcatccttaccatcatcatcctcaccatcatcatcctcaccatcatcaccataattataatcaccacagtaataattatcatcattcaccatcgctatcatcatcctcaccatcaccattgtcatcctcaccatcaccaccatcaccatcatcatcatcattctcaccatcaccatcactgtcaccaccatcaccatcaccatgatcatcatccttaccatcaccatcactaacattgatctagtgcttaccatgtgccagatcctctcttgaatttctgccacacattccatagcagtccagtgaggtggaaaccatagctatcctcattttacctggggaacttgagggcaggaaaagtgaaatgacttctctggtaaatgccagtgaaagtccactaggatctaaagcccaggctacctcattgcagagcctgcgctcacagatactatcttgtaagctgccatgcagaagtcttcctgcttcctccccttatccaattccaggctgctatagatggactatgtctcgcccagaattcatatgttgaagccttaactctcagtgtggctgtatttggagatattaaggaagtaataaaggctaaatgaggtggtcacaagaatgggtttctgatcctgtaggattagtttccttccaagaagcaataccagagcgctgtttctctgcacatgctcaaagaggtcagatgtgcacacagtgagatggtggccacctataagccaggaagagaggtcttaccagaaagtgaccgtatggacaccttgatctcagacttccagcctcctgaactgtgagaaaacacatttctgttgttcaagccaccagtctgttgtattttgttatagcagcctggagcagacaaatacacaggtagactcagtaaagggaaggagatggggagggaagtct

SEQ ID NO: 4573 - DNA, 1140 bp, Homo sapiens
aagcaaaccttgtgactggtcaagatgagagaaggcaatcttaactcaggtttctggctaagccaattgtagggtactcaacttagaaagcccctctgagtaattcagaagatcactgtgttgtttaactattgcttgtacttccttactgacaacccagttggtatttatttagcagcaactataacgcagatactgttctgcaagctgagggtacagtactaaacacaagtcagtgttcttataaagcttacctttttgtgagggaaacagataataaatacaatttaagaaaaacaaggcaagaagaggggatggagagtgactagaacagaggaaaaagggggctcgattaaagagaaagatcaagggagacttcttgaggtgatatttgaatagagtcattctaggtcagggaataaatacaaaggccctaaagcaagagtgtgtttggcatgtttcttagagctgcaggaaagacacaatgactgaattagattgagcgacagggggaaaggagagaagaaataaacagtggtcagatcatgtgaggtgaggtttttgtacttcattccaaatatgatgaaaagccataggggggttgagaacgagggaatgatgtaatctaactctggctacaatgtggaaaataatctatagagggatggggcaaaaatggaattgaggagactaagcaggggtggaggggagtggctgttgcattattccagggaagatctgatgtttgctttgaccatagaggtagctgtgaggtaaagaagttgtcagatttgggaatgttttgaaggttgaacctacaggatttattggagtgtgagagaacaagaaagactaaggtgaaatcaaggttttgccccaagcaactgggttaatgatgacttcgttgtttgagagcgggaacactggggcaggaacaggtttggaggaagaaattaagaatttggttttgtacataattttaagatgcccagtgaataaccaaatgaagatgttgagcagacagcaggatatacaagtctagaaataaccttatgggaaatattactgcatatttgtatgctgatggaatgatctaaaaaaagagggaaaaattgatgtttcaggagagatgatggcagg

SEQ ID NO: 4574 - DNA, 1177 bp, Homo sapiens
gcagcatcaggggtgcggagcctgggaggcacgcgagggccgggccgggccggggctcggcgcacacccgccgccaggctcgtagctcagtcaccaccgcaccgcgcccaagcagctgccgccgccgccgccgccgccatgagttgtccggccgcgcgccacttccggcgcagccacacagtagccaccgcttccggcgcccgcgccacgtgaccttgcggccccgccccctcgccctctagccccctcccgcgggagtcgcggcgctgcgggtaggagccgggttgcgggagaccccaggttcggttgggattcccagccagaacggagcttaagccgggcaggcgagcgaatgacggagtagcgagctgcacggcggcgtgctgcgctgttgaggacgctgtcccgcgcgctcccaggccgccccgaggcttggggtcttcgaaggataatcggcgcccggggccgaacagcgggggcacacggggcgctgccgaagtgcaaggccacggccagagctcgagcccgacgcgctgtctggagtcgtaggttggcgccgtttggggtcggggtctgaggcttgggcgctgcctgggccgagcggagatcggggtttgcctcccgtccccgctcaggaccctgacgtggctgaagcggccccgggagcatgagcgggcagcgcgtggacgtcaaggtggtgatgctgggcaaggagtacgtgggcaagactagcctggtggagcgctacgtgcacgaccgctttctggtggggccttatcagaacgtgagtgcatccggaggggccaggcacggtgggcgggggagtggggggccggtaatctgcacctatggccccgatctcttccctctcgttgcagaccatcggggccgccttcgtggccaaggtgatgtcggtcggagaccggactgtgacattaggtatttgggtaagtcccccggccatctattcttgggagactcattcctgaggaggtgtaggtcctgcctattactggttgatttgtggcctcacagacccatttctcatagacccgtttccttatctggaaaatagcggggtctggagaacgtggccttaagtttgactcaggccttactctttaggacacagcaggctctgagcgctatgaggccatgagtagaatctactatcggg

SEQ ID NO: 4575 - DNA, 1165 bp, Homo sapiens
cccctggcctggctgagtttggcagggcctgggccatccctgggacaaaggtgcgtcccttcagctcttctccgtggagctcggggctttctgtatttatgtatttgtacgaatgtatatagcgaccagagcattcttaattcccgccgcagacctggcgcccccgccttggctcctgggggcagccagccctggctgggagagcgggagctggcagaggagccactgccaaactcaaggctcctctggcccagcttggatggctgagggtggtcacacccctgagccttcagcactgtgctggccaccccggcctctgagtaagactcgtgcctccccctgctgccctgggctcaggctgctaccctctggggcccaaagctgtcccttctcagtgcttgtcagcgctgggtctggggcctctgtatgccctaggcctgtgccaaagtggccagagattgggctgcctgtgatacccatcagcccactgccccggccggcccagataggtctgcctctgccttccagctcccacagcctggtccctgatactgggctctgtcctgcagacacctctttcagaaacgcccaagcccagcccctaggagggggtggggcatccctggtcaaccctcaaacattccggactcccctcataacaatagacacatgtgcccagcaataatccgccccttcctgtgtgcgcctgtggggtgcgtgcgcgcgcgtgtgtacctgtgtgggtgaaggggatagggcgaggctgtgcctgtgccccaggtcccagccctggcccttcccagactgtgatggccatcctggtcccagtgttagggtagcatgggattacagggccctgttttttccatatttaaagccaatttttattactcgttttgtccaacgtaagctgccacatgtctctgtgtgaatagtccgagcacaaacctggctagccgcccctgcctgcctctttcttgcttccggtgctccaggggtcttcctgctcccctggcccagctggaagcgggaagggattggaggtgggcctggagggaagcagggtgtgcccttccgaggcccaggagcccccagggctgactctgaactagcctctccagacagccaggctttggtagcctttgggctcacccagtgggtttcc

SEQ ID NO: 4576 - DNA, 1195 bp, Homo sapiens
ctcgttcggactcagagctggagtccgtccttcgcgcgccccctgctggcccgcctcggctcccctcggcgcccgggctccgcggcggcggccggggctcagatcggggaaaccctaccggggaaacctcgaggcgtgacgtcaccctcctcggtgacgtcaccgggcccccggggagcgcgaggttcccacggaggaggctttccccggactgcgcagggcgcgggcgggggccgggaagtcgttgggggccgcggcgcgccttcactgcgccccgtgtctgccctacaggtcccgcgcggccccgggtgaggcacgcccgcgcgcccgccggcgccatgggaaggagcgggcgccgctgctgtcccccgccggcgcgcgcacgacttgagacctgccacgggcagcccccggccgcgggtccccgagtgacgctggcggcacctgagagtgtggcgcgggcccggggccacgcagcggagcccagtgtccagtgaagcgtctgaggacccgccgcccgtgccgccgccatggtgatgtcccagggcacctacacgttcctcacgtgcttcgccggcttctggctcatctggggtctcatcgtcctgctctgctgcttctgcagcttcctgcgccgccgcctcaaacggcgccaggaggagcgactgcgcgagcagaacctgcgcgccctagagctggagcccctcgaactcgagggcagtctggccgggagccccccgggcctggcgccgccgcagccaccaccacaccgtagccgcctggaggcgccggctcacgcgcactcgcatccgcacgtgcacgtgcacccgctgctgcaccacgggcccgcgcagccgcacgcgcacgcgcacccacacccgcaccaccacgcgctcccgcacccgccgcctacgcacctgtcggtgccgccacggccctggagctacccgcgccaaggtgagtaccgacctccgccagggggcgatccgggccgccggaagtgggcgggcgttggagggctcgctgcttaccctcagggcttccatccgcagcctccgggagaacacgggcggcggcgggctcgggttcgggctagggctggggcgcgggcggcccctggccggggcctctgcgagaggctgggaaccggcggcctcacctcctccgaccgcctcccactccgcagcggaatcgg

SEQ ID NO: 4577 - DNA, 1120 bp, Homo sapiens
gcccaatcggaagagctctgtgccaaggctccgcctcctgtgttctacaacaagcctccaggtagtactgggctggatgatggggaggaatttgggtgcgggggctggatttgagtgtgggtagccaccccaccactacccaccgctcacagaggctggggacacaagcggtctgctaggtccctaactcctctccctttctaacgccacagagatcgacatcacatgctgggatgcagacccagttccagaagaggaggagggcttcgagggtggtgattagcggtggcgccagccctaggctacccttgccaaggccgcccacctgcatcagcctctggccagacggcccgccgtgcctgcattcgcagcagctccgcctggcacccactccggattccggccctggctggggacttggccgcttccctacccacagggcctgacttttacagcttttctctttttttaaaaagttgataggagacttgtacagttgactggctttcctctcgttggtagttgagacgctgttgcaaattccacccctccttccctggtccagattgtagctcttagtcctccctgctcagctggccgggttggaggcctcaccctgcttggggcctggcgtggggggagctctggtgggaaaatgtcccccacctcttttcctagttttatgtttcttgggaaaatatcactttgtattctctgtccagggcttcagatattttgcacgaattttaaaacatggcaataaatggctcgtgggctctggctccctgggaccccctccccgcccttcttttgaccccttcctgtctggcccaaaggaagtagcaggcccagctggggcccctcggctaccccccgtctcctgccgggcaggtcccaggttggaggccctaggcgcggttcaggtcagggctatggatggggcccaggggctttggtggcccctccccaactccttcctctttgcttgggttcctttttcacgtttagtaactgttttttttttttttttttttttttttttggaaagcacaaacttctgtaacgggtcgtgctcatgtctgttaataaagaaatccagatcccttcgggctgccgcctg

SEQ ID NO: 4578 - DNA, 2174 bp, Homo sapiens
tccttccagatgggcattggtccctgggctgtacaggcagcccaagaattgtggacactcccagccatgccagagagggaagggccatcttctctttaacctttaagatttggggatgtcagagaattaggatatttgagcatgagttttggagccagactcactagggttcaaccactcgctagcttttaaccttgggcaactcatttaacttcttgaaatctgtttcttcatcttaaaaaatgggaataagaacacctcgtttgcagagctgttacaaggactaaattttaattatgtctaaaaagtgcctaacccagtgcctggcacgtaataagtggcattactaatattgttactattattttgaaggagagcctttcccctcctgggaaaccctgtttctgtctgttggacaggtcccccccgcctccagccagcctgtgcagacttgctgcctgctgtgtcaccgggaacgcaaaggctgggaagaaggcccttctcaaaatggactggtgttgcagggtgagaagctgccccctgacttcatgccaaagctcgtcaagaatctcctaggcgagatgcctctgtgggtctgccagagttgccgaaagagcatggaggaagatgaaaggcagacaggtcgagaacatgcagtggcggtaggtaaccgctgacaggggtccctgaatgcaggagggctcctccccaaggaagtcaggctgttccctgtcctcaggtggctctccttgggcagctcccatgcccaggcactgagagacttctgggctgcactggcacagcattggcagctcaagttcagatttgggggaagaagagaaacttctggcagcccaccggtcagtccctcagggtggtctgtgcacaggatgagggcccactcataggtactggtagatcacgagcctgctgccttcggctctgtggcagcttgaaagccaaccagtatgacatgggagacagagatgagtttgagggtctgaaatgtgccctagttagaaggacagacacttgggagtcatctaagtctgctgtttcatgaatcacgatggccagactttcctcatttctcacgtcgctgcagatcttcccttttacccaggaacagtttagcttcaggactcctggtcaaaaggcccttcctgtcattggccgctctctactccccaaaggcccgcagttcacaggcagtctctgcccctaccagagtctctctccccagtctccacacattgcatgtaagtgggaccaccgcagccctttcccagcaaaggcctggccctcatttgttcttatagctggagttgtattaattgtgtttttgctatggcacatggtctggaggagaaggagctccctcaggaaaagctgaggcagcagagggtcagctccgatgtttgctgtttgaccgtgagcctttttcctcccccttctccagatctccttgtcacacacatcctgcaaatcacagtcttgtggagatgactctcattcgtcctcgtcttcctcctcatcatcctcatcctcgtcctcctcttcctgccctgggaactcgggagactgggatcctagctcgttcctgtcggcacataagctctcgggcctctggaattccccacattccagtggggccatgccaggcagctctcttgggagtcctcctaccatccccggtgagtctccaggctcgggagagagccaggccctataaatgtggacagctgtgttttcctatccactttgttcaaacaaatcataagactggttactaaaataagtaaaagtggaactgttctggtggaagcaggggcagcttagaccttgactatttctggaactcctttccccacaactctgaacttgaaaaatactgctaatagaaaaacgtttgcctctcaaagttgtcattggctctggtagttcacattggatcaagagggcatccggtgaggtctgtctgagtagaaagtggagtcataggacttagatcacctgacccctgcagcaccacagaggacctgggcaaccttgtcttcctaggccttgatttccccacctaagggatgggtataaaagcactgaatttaaatgcccaagagattggcagtgtaagccgtaatagttattagctaatttagcagctgtgtaagtct

SEQ ID NO: 4579 - DNA, 1300 bp, Homo sapiens
atgtctgtctctgctacttagctatataatcttaaggtagataacctaacccctctgaactctagtttcctcatctgtatgatggattgataatgcctaccttatcaggtcattgtgaaaattaaagatacgtgaaaatactcagcatgttcttagcacatagattctcttacatttgcttcacttcttaaaatgtagcttttgttgtaggttatcctgtgtatttgaccttccaaacaaaggttgcttttgactttgtgacttaaggttggaatatctcctactactcccctgtcctccttggaccagaaaaaaaaaaaaatcccactatgatcctagtcatgcttatgtggcatttggagaatttaagaaggtatagaaattgacagctttggcaatattattgcttatgttatacaagatgtgtaacttatcagtaaggtgaaatggcaaagtaatgcttatccttaaaagctaagacttaaatcgtctcagataaagctaatactcccatcttgacctcttctattcacacaatccttcaacaggacttcattgacttaactagagagatcagaccaaggacaaaagatcgcagtggactgtgtgattgacctgacaagagctgagggagaaaatagacctattgccactcttgacttaactttagaacctgtcactccttcccagagggagccaaccagtcttcagacatgtgccagcctctctggcaaagcggtgatggaagggcaggtggacagaagctctcagcctacagcacggagactcattaacagtgatcctgtagatttggacctagtggaagaaaacacctttgtaggtcccccacccgctacatccatcagtggaggctctgtttatccaacagagcctaattgtagctcagccacattcacaggtaacctcagcttcttggcaagtctacagctgtcttcagatgttagctccctctccccaacaagcaataatagtagcagcagcagcagcaatcaaaaagtacccttgccatgcccacagcaagatgtgtctcgcccaccacaagccttgccttgcccactgagagcctcaccttgtccaccacgagccttgtcatgcccatcacaaaccatgcagtgcaaactaccagctctaactcaaccacctcaagaagtgccatgccctcggcagaatatcccaagcccacctcaagactcgttatggcatcctcaacactcaccaagcccacctcaagactctctgggcctacctcaagatgtgccaggcccgcctcaaagcatat

SEQ ID NO: 4580 - DNA, 1201 bp, Homo sapiens
gtccagcatccagccatgcagatccttcatgtaactgcatgtccctgtgacgcggagacactttcctgctcagtgacctgctcttgagttaacccacctgtgctcagaaccggctctgtcctccgctggcttgtgggctctctgtgcctgggggttctctgtaaaatgaggtaatagttgtatctatctcatgggattagtaggtggattaaaccagttaatacaggtaagtacttaatgaatgtgtccttcgttttgaacgtattgattggtttctctctattgttttctataggggacaaactatgggaggtacagtgtgagtctccgaccttcacagtggcatggcaccccaaaaggcctctgctggcatttgcctgtgatgacaaagacggcaaatatgacagcagccgggaagccggaactgtgaagctgtttgggcttcctaatgattcttgagaggaggttgtagggagaggaggccccggcagaggtcttccttcatgtggttagtttggtctgttctctcggagttggtgggcaccctaaatatttgtaagttggtataaattgtaaacgtctctggtcaggctgcgcatttcgttcttttgctttgtctgtgtattagctctttccattctttgcccccagcatgagttaactcgcgtggactctgcagtgcgagtagtgaccccagcataccttgtcctctggacctcctgtcttctctgcttctgggtgcatggtagactttgtggcatttgatacaacttggacaatacctagtttggagggaggggaatggaagggcatggaagtttttttaaataattaaaaaaatatatatataattttgagaattgagcatttaataaactgacttttgttattatggaacttctaagacttttaaaattattatgtccttgagttgcagttttgtatttttttttttttaatttcagaaagagaatttaaatgttataattctgtcatttaatgtcccaaccaagaagcctctgaaatatagggacaaagctaattgaatgaccgaactaaaattttgactctgagcttcctggtggcaaagtgaagaggggagtaagtcagttagctttcttattgaaaagaaaaacacttattggttcctcatggaaagcaaagctttattagttcttccctctaaaaaaaagggcttatg

SEQ ID NO: 4581 - DNA, 1178 bp, Homo sapiens
tttattgggtggacattttgtggcatgttcaagcttttgaattcagagagtgagagaatgagaaagaaaaggctggtctgggtcactcctgggaggcctggccctaagcaccgtgtggctcacgtgccctggagcccctgtgcaccggacatccctgactgccctgctgcaagctttatagctcccccatcacctttcccggaccagctggtacaatctcaaacttttcaccaattctgacatctaaacaactaacgccagagacaggctctgtgggaccagcagctgcgacctcacctccggtcactggaacactgagctgttaaatgaaaggtgcgtcctttttttttttttttttttttgagacagcgtctcgctctgtcacccaggctggagtacagtggcacgatctccgctcaccgcaacctctgcctcccaggttcaagcgattctcatgcctcagcctcctgagtagctgggattacaggtgcctctcatcacgcccagctaatgtttgtatttgttgtagagacagggtatcaccagactcctgggacctccgcctcccgggatggtctccatctcctgacctcgtgatccgcctgcctctgtctcccaaagtgctgggattacaggcctgagccaccgcgcccggccaggtgcgtccttctttctccctttccagggagaatgctctgctcttcttcctgctggatccctcctctacctgcttctctcccacctcctgcagcccccggagccccatggcgatgcaggcagactcatctgtaccctcattctgtttgcagagccacatctctgggctggctctgcccaaggacaccacaccttctccattcctcttgccctttccccgtggggtgcaggtggggctgggcccacgatggcatcaggcccactctctctaatgcaggaagggatcagatgccgggagccatggagattgtcctcatcccgatcatctcccatcttagcaaatgatgatgaagacagttttcccacaagataggcatagcctctgggacagtgcctcgtttattttctagcacaaaatagacgttagaacagtggggctttgtgggcatatggagatttttaaggctccttaggaggcaggtaaaaatttcttcaataagacaaaacactatccccaaaga

SEQ ID NO: 4582 - DNA, 1168 bp, Homo sapiens
tgcctggcacatggtgagctctcagtacatattcactgttattatccttggcctttgacaatcaagattaccaccagcccccttggctggtgaagtgaaaccagttgacagtcaccccccaccccacctttgtcatacaagcctcaaaaggccttccagcctgggcaacataatgagaccttgtctctaccaaaaaaaaacttaaaaattagccaggcatggtgactggtgtctatagccccacctgctcaggaggctgaggtgggaggaccacttgagcccaggagtgtgaggatgcagtgaatgccatgatcacaccatacactccagcctgggtgacagagtaaggccctgttaaaaaaaaaaaaaaaagtcctccttaaagacatgggctttctagacagggttcttctgctgaagcggctttccttctgccagaatctcaggaactcctggatctgcctttccagaaccagcttctctctccctgctctgccttcagactgccctctttctacctctccctctagaactacatctcttctggctgggtttatagcttggggctgggggaggcccagtgggactggctgagtggagccagccgtgtgacggaggcggccctcttccagttgggcactgccaccctctcgtggtccaagcagcacatgagcagaaccaggtgctcaacaccaacagccggtacctgcatgacaacatcgtggactatgcgcagaggctgtcagagaccctgccggagcagctctgtgtgttctatttcctgaattctgggtaagtggactgtggccagcccccgggaagagggtgagacggtaacaaagacagtcactcacatgggcccagtgtagtgtagctgaccgagtgtggactcggagaggcagcccccactgcaccaggctcctgagattcccggctgtaggccctgatgctttctctgttggatccagtttccttgtctcttattgaaggatgttattacctcctttctaggatcattgctggagcttagtgaggtaatatgttcctttatttctgccttaaggatacagccaaaatccctgcctgtgggttgctcagtaaggaaggaaaacatcaagtgattcttcaaagaaatacagaattgcaaggagggctctggaggaagtgt

SEQ ID NO: 4583 - DNA, 1169 bp, Homo sapiens
ccttatttaggttgcgcaggcgcccgctggccatttcgtcttagccacgcagaagtcgcgtgtctaggtgagtcgcggtgggtcctcgcttgcagttcagcgaccacggtgggtaccgtttttgcgaggattgtttgtccccatatctctgggagggccacggggaccttggcgagctgcaggctgccgtcgagagccgcgagtggttcgctgaatctcggcaccgccgctgaggcctgcaggccgcgccgactctattgtgtgagaagtcggaggaggcggagcggaagcggccgccgccatttcctttcctctacgctggctctcggcccgggcccccacggttcggggcgccgacagctgttgctcaggacagctttgggggtccggtcgccggacgaggaggtgttggagtcgccggggtgggtgcatccgcccggtttttgctccgtgggggggcggtgcgggcccgggcgcgcctcggaggcgaaggacagcttaattggcgctctcagttctggtcctccccgctttgcagtttgtttcgacgccggaccgcgtaagagacgatgatgttgggcacggaaggtggagagggattcgtggtgaaggtccggggcttgccctggtcttgctcggccgatgaagtgcagaggtttttttctggtgagttagaactaggacgcgggagttcgagttcgaggccggggcgggcgggctggcgggcggccgggctggggcggggcggggcggggcgggccgggccgggccgggccgggtgggacccggggcgccccctggcgaggcgcgggcgactacactcaccgctgtgctgctcgcgcccggcggcccgctgttacgcaatggaaatttcgaaagccccgcccgtcctcctggcccttgggggagtgcggcaggtttggcagactttgttttctttacctatctttgaacaccagcttttcttttatgggtgtctttttttctttttcttttgagttggagtctctgtcacccaagctggagtgcagtggcgcgttctcggctcactgcaacctccgcctcctgggttcaagcgattctcctgcctcagtctcccgagtgtctgggactagaggcgcgcaccgccacgcccggctaatttttgtatttttagtagagacggggtt

SEQ ID NO: 4584 - DNA, 1225 bp, Homo sapiens
tctcctgactcagcctcccaagtagctgagactacaggcgcccgctatcgctcccagctaatttttgtatttttagtagagaagagtttcgccatgttggccaggctggttgtgaactcctgacctagtgagccacctgcctcggcctcccaaagtgctgggattacaggcgtgagccacggcgcccggccatctctgttatttcattgtaatgttttaacgggtaccccctgtaaattagtgtatgaaagggcttttgtctgttgtaaagcactttacaaatgcaaaagtttgttggaaattgtatttgaatgccccacatctgtgtaaccaatcctctctatatgaggatgttgtgtatgtttcagttttattttgaaattttccagaaatggaatcttttaactgattttagggaaaccctttaatctctctaggctgcctttctttatctatgaaatgaaatagtaagttctttttagctctgcgatttaaaagctttaattttaaatgagagagtggttagtgatcttcatgaagtttgataggtggcaatacatttaactgattttgctctttatgtgtagatcatggaagggaagtggttgctgtgtatgttactggtgcttggaactgctattgttgaggctcatgatggacatgatgatgatgtgattgatattgaggatgaccttgacgatgtcattgaagaggtagaagactcaaaaccagataccactgctcctccttcatctcccaaggtttgaaatggtctttgaatctattccttttacgtcttgagatgataaaattatgaagatacccgggtgcagggaaatgtagtctcaactactcaggaggcctaggacaggagtgtgagtccagccttggcaacacagggagatatcatctctaataaaatataaaagaaaaacatggtgaagataaatttggaacgttttcaaagggaaagcaaaattcgtgaaaatacttattgatctctctggcagcctttgtcttgctagaggccaattatatgggttgaatttgaaggccagctatgaaatttttgtgacagttgaaagcaaaccaggagaatagattctagataaaaaggcatgttgctgaaaatttaaatttttaattcatttatgtatttaacacaggttacttacaaagctccagttccaacaggggaagtatattttgctgattcttttgacag

SEQ ID NO: 4585 - DNA, 2099 bp, Homo sapiens
acattcagaaaacttcaagacatcaccatcagcaggctccagttgaacactagtctgtgtaactttaaacatctagcagtaaatacttgcagttgtgatataaaggaccctgtttctgtagaaaagaaaacatttaacataatggttgtgaaatgtaacatgaagcaaactaacttttttttttttaacatctttgtttttaaaatagaatgatagaactttgccagtctttaagatcttggcttaatttaatgtattaatctgtttgtgcaaacataataccaccatttaaaaatgttagggagatgagttgcagtttttataatagattttttttaaagtttggtattgtaaaacattcacacctctgtccctcaaaattgataattacgtttaaagtgcagtcatttgtggttagaatcttgttttgtttgcttccattattgagttcctcctaaggaaattgaggagagggactgaatagaagcccaaattcatataaaagttgcgtttaagttgtattaaaaatagatatataagaaaaaattctttcacttgatgtttgttagaccagaaagtgtgtgtgttctgtagctcagttcccagacagctttttaggtagtggaggaggtggcttcatgtggcacttgggcatttatattccacttgggagggtcaggctgtggccttctggagcaggtggcttgttaaggaatgctagcagggcatggcacgtgagctccggaatagatgtcttcatcacttcttccactgtgtgttgacactgttttccttacctatttcctcagatccccagctttctcctctgctatgcattttcttcacagtgcagcttgcagtccgttgctgaaaatgattataagccctgcataatgttaagctttattgtgattacgtgtatgtttcttctttcttttaagcagacccatacctttccagggtcaaagtacagaatagaatacattgatacaaagtacagaaaaatactttgatttttatccatttcttttactctgtgtaaagacttgagaagtctaattcacaggcaaaccaatacagaattgactgcagttgaacagactagaagtatttgtgggaggagtgacatgaagcatgagttatctgattttttttgtagctgctatatattttaagccttcatttgcaattcatgtaacagttgtgtcataaattacacaataaagcagtcctgttcaaatttttttttaacgtggcttgtagaatttttaaaaaagtgatcttaggtttgttttttcatgcgggatgcagatgggtgctatcagagcctctcccacaccactatagtgtaataatgttattattactctacactgaaacgtattcagagttagatattattttagcttcagttgttctttagaggctttcaaatgtaccgatgatactgtttcttgcactgaatatataaacactccacagtgtttatattgggaagatattgggaaggaaatatatttgtaaaagatgaaggctgtatctatttttttttctttttaaagtttgttcacttaaattcttttgaggatgggatgtatttttcttgctgttcagtgctttttccttttcatctgttgttctgtggtcacagtgaccttagctacatagcagactttcccaaatgtattgattacaaataaacagttgttacttagcaagacctgaaaatatgtctgcaggtttctccttgaagcaaatgtgtgggatcattgcatttccagaaatctgcctccttcaccctccgttgacagtatatgtcatgcctcactttcttctagctgagctttaaatcattagagcttaaattgtcagatcgttcattgcctttccagggttatttagtaaagtttgttgaaaacaaaaacgccttttcttggttcttttttcagttattttgaaggtccagcatcctgattaaatgtctgacacattaatgaatgaccagcagcagctttcagctcttaaaaagacacttatattttgattttacatgctggttacctgttccattgttgtcaaatgcccactctccatcagat

SEQ ID NO: 4586 - DNA, 1151 bp, Homo sapiens
caggggtctttgatgcactttgttctcttttgtgatggttgtcaggaagatcagagccaaagttgctgaagtcctttgaaacatagttataagtgaaagacttaccgttagctttgtagtctagatttttggattctgattttattaatgttactgtgtcctgtgaatcacctcaccctttgggacaaagatggggatgtttgcttgactttgagtaaataacatatttactcaaggaggtgatcaatattcacagtgtactgagcctgagcctctgtggggttgctgagcaccagggtcacagatgagggggagatggcacgggagagtggagatgctctctgtgcagggccagggggtgcagagtgggaggaaggagagggggatgctgagtgggtcactggacaagatgtccgggttaaaggtcacccgggaacacagggaccttggcaagaaggtgacaggactgtgacaggtatccaaggcattaaagatatctttatcttatctttgtaaaaatcaaagcttctggtccatcggaggatccgagtgtgaatttcctgaagaacgttggggagagtgtggcagctgcccttagccctctgggtgagtgcacctccttgcccagtgcttccctaactcagcctgcactttatgtaactttcacctggaatactgcaaaggaatgggtaattgacatgcccttgacactggtgaggatttgttgcctcaaatcaacctttagtagtgctggaccacgggcaactcaaggttgaattccctgacaaaattctcgagctttctacatggagtgaagtcgaatcagctggcatttggttgggataatcccagtgagggagggtgaccagactgtggttgcaggtcttgcctgtcacctctgactgccctcctttggatgaacaatagtctgcaatttcccctaagccaggccttgggatttggacttttgaggacctgggtagtagttagttgacatgctatttatcttttccttcttttagtttacaacccccaaacctttctggtgcttctgagtgctgggcctgcctcagagcggggagaaggtggaggcaggtgctctgggtgacacccggttctggtgcctcaggttgcacagtgggtctgtgggg

SEQ ID NO: 4587 - DNA, 1132 bp, Homo sapiens
ttcacaggggacccggtacttggccatggaggctggggtgggcgtgtggccctgaaaagctttgtgttcacaggcacttcttgtttctggttttttgtttgtttgtttgtttgttttaagctataaagtattggactctttggcactaaaaccccagattgctacaaaccgaaggctaaaatagaggtcagcaatcattcatattgtgtaaaatgtcacccttagctagcaatttatttttccatatttgtgtgtttagtgcactgttagaattccttttcctcacttttgttttgttcatggcacttcataattttatcatttcattttattttcagttgatatctggtcagtgggttgcatcatgggagagctggtgaaaggttgtgtgatattccaaggcactgaccgtatccttccccgcgaccttggccccgccatgctttcttaatgcctcaggcagcatgaccacctgcttacacgagcgctcacgaggacaaagtcgtaaaatccactccagactgtgttctaaggggggctttactgtatttgttaattagtgtcacaagccaagtggttcaatttcattctttatttttaacttgactacctgtgatgactttgagacttagagttcagttaaaccgattatattagctcttaattttgccaaaaatagctggacacatagaagaaattatttactctttgataagtatattctgatatttaaatgaaaatactgtattatttagtttattccgttaatttaactaggaaagatgctatctaaatttaataggctagtgtgcttgtgtgctttaattaagtactattttgttagttactggtatgcattgaaatattttcccccaaagtaagaactgaagcacattacaaaggacctaagtgaaagagattaaaatgaaaattttgtgaggaacaatatgttaaactttcttgtttgttactgtgctgacattttgtagaattttttttaaaaatctgtctagtgggttattttgtgacacactggggaagtcaaaataaatgtaaaatgaaagagataaactcatactgtagtcagcaagtcatgttagagatacagcagaaaggagaataactactctaa

SEQ ID NO: 4588 - DNA, 1157 bp, Homo sapiens
attttttaaaaaaaacttgtagagaccaggtcttgctatgttgctcaggctggtcccaaacttctaggctccagcgatcttcctgtgtcagcctcccacagtgctggtattacaggcgtgagccaccgtgcccagcaccagtcatatctcttaagaacaatggttttggaggagttggggtgggaagccagactctcctgctggcatattctgactgcttcttcaggaggtccggcaggtgatcacatggagctcagatgaactggtttatctgcctccattcaggggtagacagggactgacgtgattctgcacttaagtgatgaaagtaatggtaatctaaacatatcatggtttactgtcagaccctttctgtcaggagaaagtaagaagtttagctttctgacaagtgcatgatgagcaggagaggagagactgagatgttcgagcacatttcaaaaagtggaagcatcaatctagattgggctggagtccagcgaagccagtaactgggtcactctcagctttttggccaacagccttttctcgttgcctcattttcttcttaccacagatagctccttctcaagaacctcatgctgtaggatgtgaaacagcttcagatgctcttctcctttgacacgttcagataaccatgacgtgaccatcccattgacattagtgataggatcaattcgtgctgaaatgcaagtgatactcagcagaattcattagggtgacggtgggatagtgttgagttgaattaagaacttagatgataggaagtttgagggaagtatattgggaattttatcagtgagatggggctagattctcctctgccgtatttatttataatatgcccagttctagatcaaaataacaagtggaataatgctttggaaatcttttctcttccaaacacatagcaacaatgtataaataaaagatatagagacacaactttagtataaagtaaatatatctggaacagaaacggaagagaaacaaaaacagtgagtgagaccatatctgattttgtcctgcacttgttttgcccatgtatggactggtcattataagattagtttctgaagggaaaatgtctctaaatactgtaaatgaaaaagtgtctgagacatgtctcaatcaattta

SEQ ID NO: 4589 - DNA, 1255 bp, Homo sapiens
gcccagaactgagcccggcggggccgtgcacggcgaggctgctcggggtccctgcgcggactggacggcgggcaggagccccgggccggggcggatccgggcagagcgggcgccaagctccaggggacggggctggggaccgcaggacggacggaccccgcgggccgcggcctccccggagtcgcgccctgtgcgctgctgcctgtggagtgcggcgcggcggctgcaggactaggcggccccgagcggaccgggtctgccctggtttatttatttttatctttctttaaagagtgcagaaggcttcccctcctctcacgccgcctccccaaagagggccaatgtgggtgactttctgagtggcccccaaagcaaatcccgagacctgcgcttcgcgaaccttctctgccggggcgctggtggagccgtttcccagccggggcctctggcccagcgaatcctgctggaaggcggtggttctgcgatgccctgtggattcgcctcgacgccttgttggcccggggaccctggggatgttttataaggaaggaaaagatgtaggtgaagcccagaaggagggtagcgtggccgagcggtctaaggcgctggattaaggctccagtctcttcggaggcgtgggttcgaatcccaccgctgccagcttgttgtgattcctccatttttgtcccttcatgggttacaaaaggaggaagtcgccttgggccccacgctttcccggcatcgggaattccatttggcattgtgcatccatccactggacgggctttgtggggagttcgtcatgctggtgtcaacagcaagtgaggtgggttccgttcttcccagatgccaatgattgcggcggaaaggcaacggtataaatacccttgatagccttttctccttaagtgggtggagatattggtgggatgttctaggctagtcttcggtgtaataaatttgaagcagttaagtgaaaagtagaaggaactgtttccgcccggtttcgaaccggggacctttcgcgtgtgaggcgaacgtgataaccactacactacggaaaccggcttgatgcttttctgccatcataattagtcacgacacacggcggtattttatttctcataagagttctgagcttcttccgtgggtccctttgagcttggtaatgggtatgagcgcacaagaatacagagtccagtgcaaccatttaaaaggggagggttgcagagtcagagagtagctcagagacaca

SEQ ID NO: 4590 - DNA, 1230 bp, Homo sapiens
gcgggtggatcacgaggtcaggagtttgaggccagcctgactaacatggagaagccccgtctctactaaaaatacaaaaattagccgggagtggtggcacacgcctgtaatcccagctactcaggaggctgaggcaggagaagtgcttgaatccaggaggcagaggttgcagtgaaccgagattgcgccacgacactccagcctgggcgacagagccgcagttcgtggtgaaaggtaggcccattttttgagagtcttctctgtcaaaaaaaaaaaaaaaaaaaaaatccacacggtgagagctccagtggcgtcagggtgcacgtttctccatctccgtgccgtgagcttcatcgcgggtagaaaatggcttggtcgctggtagggtagaaggggcaggaaacggacgtaagtgggagggacggtcaggcactgacggcagagtttgaatttcccaggagccgaggcactttagtagttttatcacactccaaataaatccaagttcaaacccgcagttgaatacactccgactctgatctagaatgaaaaattgttgagatacggtcatcgggcgcccggctagctcagtcggtagagcatgagactcttaatctcagggtcgtgggttcgagccccacgttgggcggcaactggtcgttttagtcctaaatctacgactactagccatacctaaaaatatattataagtagaccagctcttaggaaaataatctgctctgaagtcttgcatttctgtgtgtgtaatactcttgcgggcgctccactgttcattatctacccattatcttgcgatacaattaggatttaaagctgtggtaaaatatgcccaacaaaatttaacactttttaactgtacagttctgtagcattaaatacatttaaatggttgtgcatcagtctccagtcctttttcctgtttcccagatgaaactctgaacccattcagcattaactctccattcccctctgcccacagacgctggcaaccaccattctactttctgtgtctttgaatttgactcctctagatacctcatataagatgaatcgtgcaatatttcctttttaaattgtcttatttcacttaatgtcttcaagattcatccttatatttcctttttaaattgtcttatttcacttaatgtcttcaagattcatccttattgtagcatgtgtcaaaatttccttccttttaaagctgattag

SEQ ID NO: 4591 - DNA, 1136 bp, Homo sapiens
attcgagacggagtctcgctgtgtcgcccaggctggagtgcagtggcgcgatctcggctcactgcaagctccgcatgccgggttcacgccattctcctgcctcagcctcccgagtggactacaggcggccgccaccacgcccggataatttttttgtatttttagtagagacgggggtttcaccattttagccaggatggtctcgatctcctgacctcgtgatccgccagcctcggcctcccaaagtgctgggattacaggcgtgaaccaccgcgcccggccttgttttgcttttaattgctggaagtgactggggtacccttagaggtcacgctttacagtttgacaaacggcattacgcagggccacaaggagactggtgttctggggaagaatggatctaagggccatgactccatgggtgaagccgacacctggatgttgactataacacttataaaagtcatagagtaacctctccgcatctgtttccgtagtgtagtggttatcacgttcgcctaacacgcgaaaggtccccggttcgaaaccgggcggaaacaagactgtgttttccttccagttcaaaaaggtttcttagtgtggagtctatgtgtataaacgttcacaagttttgctacacttagacaccggccggattttccaatccattgccaattaacttcaacctgcgtattccatgtctacgtctgtaatatgagggtgagaagtaagtggtcttactggtcattattagggtcttcctgcaaagtcccggcggatcaaatacagtcagccgccggggaatgccacggaatgacagatgaacgattaaaaagtgcaagaaggctcgggttggaaatccttggtggaagttcacgccgtggaaggtgtgcaccggcgggccaatagtgatgccggtaactacaacgtgtaccacacatcaagtagtctgcaggtgtggccctgggcttcctgcagaggaacctaaccattctgggaggttgtttacagatgaggccactgaggcatggacaggtcacacaaggctgcggaacacgtaggacggagcaaaaggacagggaacggaaaagaaacagggcacagagaaattcaagtgaaatacaggctggttcagg

SEQ ID NO: 4592 - DNA, 1099 bp, Homo sapiens
gtttttgaaaggtgctgccagccatcatcctactgaggggtagggctgggaggtctagcatttcatgggataggactgtttgccctaatttcctttccatcttctgtaggatgagagccactcagagtgggtgtcttgtgtccgcttctcgcccaacagcagcaaccctatcatcgtctcctgtggctgggacaagctggtcaaggtgagcgtcaagccaaggcaggggctttaccagtcagggtgtgctcccaggtggtcatacactccaagtcctgtggaaagctttgcagatgccctcagttgactctttctcttgtcacatggtctgatgtcccttgtaagtcagcacactgcattggatatgtgttataatctaacgtgaagtggccaggacatgttactgaatgagaaatggctaccgtatccagaagtgccaagcccttttttgttgggcctgaccctagctcatcaagagctaggatgttcacctgtcaaccgcacgtctatgcaggtatggaacctggctaactgcaagctgaagaccaaccacattggccacacaggctatctgaacacggtgactgtctctccagatggatccctctgtgcttctggaggcaaggtatttggggacaaggcgtctcctactcagtggaagacagcgtcatggaaggagcacttagccagcgtctctaacgtaaaatggcaaacattagccaagatggttttaggaggataatgagataatggcaatctgagaatatgtttccaaagattactttcagcaaatgacagttaaggcatactatctggaagaaaaagatgattttctataagcctgtgggttttttttgttgtttttttgtttgtttgttttttgttttttttttgagacggagtctcactcggctgccaaggctggagtgcagtggcgcgatctcggctcactgcaaccatctcccgggttcaagcaattctcccatctcagcctcccgagtagctaggattacaggcacccgccatcactcctgggtaatttttgtatgttagtagagaggattttaccatgttggccaggctggtcttgaactcctga

SEQ ID NO: 4593 - DNA, 1451 bp, Homo sapiens
ttgttgttaacccactcatgaccttgacacttagtgaattatccagtgtgttaaacgggctgcgggttcctcactgatttttcttctgttttacctcctttagataagaccatcatcatgtggaaactgaccagggatgagaccaactatggaattccacagcgtgctctgcggggtcactcccactttgttagtgatgtggttatctcctcagatggccagtttgccctctcaggctcctgggatggaaccctgcgcctctgggatctcacaacgcaagtagctgctcacttagctctggggccttgggaagaatctgggcagaagtgaggtggatgcaattggctggtttcccaggggagatccagtccatttgggaactggaaagcagagcacacctacagaagatgtttggcctccctcactttaaataagttactcagcattgctgaggagtgtggctgaacatttttgccaggtgcaaaagttctgagtgggcagcagtttgaacatgttttaccttgaaagctcaggtaattggcaggtggaattagagggtcctggtgatgacagatggcattgtcagccaatccccaagtgggagtgaggacatgtcctgcaattctgaagggattctctgtcacttggctcttctctttcatatactcagtcacttgactctgtgatcagagccaaatccagggttgtatgagtgatgcaatgagacagagacaaagcccaggaaatgagtctgaccgttgaatgagagtgtttgctaagtctgagaatgacaaactcctccctctcaggggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccaggtaaagtgagccatctccaaggatctcttccaccctcttaaactttgctttttttttttttttttggcgacagtctcactcttgcccaagctggagtgcagtggcgcagtctcggctcactgcaacctctgcctcccgggctcaagggattctggtgcctcagtctcccgagtagctggtactacaggtgcgcagccaccacgcctagctaattttttgtgttttagtagagacagggtttcaccatgttgcccagggtggtctcaaactcctgggctcaggcgatttgcctgcctcgccctcccaaagtgttgggattacaggcgtgagcccccacctgcctatctttgcctttttttttttttttctcggagacagtttcgcttgttccccaggctgaagtacaatggcgtgatctcggctgaccacaacctccgcctcctgggttcaagcagttctcctgcctcagcctcccaagtagctgggattagagg

SEQ ID NO: 4594 - DNA, 1451 bp, Homo sapiens; identical to SEQ ID NO: 4593

SEQ ID NO: 4595 - DNA, 1705 bp, Homo sapiens
tgccttagtccagcctggactaagtccttccggagttggtgtgcatcagaacaaaaacctcgtgaggggagaacaccctccggaagcacagttttaaagtttatttttaacattttaatactctactttttaaattgcccatcgttacccacgatagtgaaatgaaaattaagctcccctggggttgccccgtcaaccctccccgcaccaagtggaacaggcggagctcgagctatgccacataggggcggggaagcagcccggcggtcctcatgggaatgtgccgtacacttcacctctttcgcttctcgctctacatcatccctgagaagcctttttaaacacttgaatgtgcttgtttcagagtgtatttgtaaagtgcagtcagattttgttgtacggaagacgggactgtgatgccttgcaatttccctctgccttttgcattacatggcgccgccatcttgagcagaaatgtatcatggggctcgccattttgcatggtcgagcgggtatttccggttccggcggggggcttttctctctctctttcactgcaaggcggcggcaggagaggttgtggtgctagtttctctaagccatccagtgccatcctcgtcgctgcagcgacacacgctctcgccgccgccatgactgagcagatgacccttcgtggcaccctcaagggccacaacggctgggtaacccagatcgctactaccccgcagttcccggacatgatcctctccgcctctcgaggtacggactaaggtagatttcaggacccgagattgcagggctgggggattccgcgtgtcgtgtagggaattccgcgtgtggtgtggcaggccggtggcgcgcgagttggcggggactgacagacttctctgccccattgtgaattggggcgtgcggacccgagcctaggcctcaacccgggcgaaccacattgcagatgagaacctacgtgtacatcagctcgcagctgctaggagggttggagagttggaaacttttaaaatatcttttgccttctccttcgtagtgtggccgggggcctacgggccgggcggggcggtgatgaccccaacatgccatctgagtgtcggtgctgaaatccagaggctgtttctgagctgccgcccggcccaaggctcgtggggaggcaggtggactccagaggacctcgtggctcaagtgtcggcctactttttctgcccctggttctccccgtccctatccctgtgttcctgactgcgtttagacgcttcttgtgcttccgctttgctgctacactgttaagaattgtctgacttttgaatcatgtctggctgttaatcgtaaaatttgttgagtgggacaggtttcagtaaaagcatccaatcctgtagcgcctgaagtggcttttccagcattcattactacatttctgtcggccctcagaggtaggcataggaggccccagctactctacagccacaaactgctgtgcatttggttgcagagaagacacaaagtggctgttgagttcgtctgagtttcaggaaagggtgtctgtatttctggcacctaaattaagttctcaggatacaggctgggcgcggtggctcacgcctataatcccagcactttggaaggcagaggcgagtggatcacttgagatcaggagttagagactagcctggccaatggtgaaaccgcatct

SEQ ID NO: 4596 - DNA, 1705 bp, Homo sapiens; identical to SEQ ID NO: 4595

SEQ ID NO: 4597 - DNA, 1283 bp, Homo sapiens
tttttggggaccgggaaaaacaaagttgcctgattccgcgcaggtgcacaggccccggatgtacacccggaaaggggagtgtggctgtagaatcatccatccgtctacagctaaaacaatttgccaataaagtacatgtttttcctaagccaaaaataaatacgttaacagaaaaatgatttaggatatagcttgaatgcttaaatatgtgcacctttacaaacctctcagtgtattcttggagttcttgaaatgttgttttaatatttgttgccagtaatgttctttcttcacagccgctccgggaattctgaagttctgggcctttctcagaagactgtaatgtacctgaagtttctgaaatattgcaaacccacagagtttaggctggtgctgccaaaaagaaaagcaacatagagtttaagtatccagtagtgatttgtaaacttgtttttcatttgaagctgaatatatacgtagtcatgtttatgttgagaactaaggatattctttagcaagagaaaatattttccccttatccccactgctgtggaggtttctgtacctcgcttggatgcctgtaaggatcccgggagccttgccgcactgccttgtgggtggcttggcgctcgtgattgcttcctgtgaacgcctcccaaggacgagcccagtgtagttgtgtggcgtgaactctgcccgtgtgttctcaaattccccagcttgggaaatagcccttggtgtgggttttatctctggtttgtgttctccgtggtggaattgaccgaaagctctatgttttcgttaataaagggcaacttagccaagtttaaggtcgcgtgcgatgcattcttccctagccaaggggcagtcaccacgcgcccttctgcctgtgagggattccaaggcaagactgaagcctactcctggttttattttagaggctattgtttgcctccagaaggcgctatagcagatgctacaaaaggtgaattcatgtctccaagaaagaaaaataggccatgagtgtgaggcgaaggaaatgtggacatgagagttagttctgttttgcctgcacggtgggagcggcgtattcggcacctggaacgagttgtgtttgcccaggagcatgcagccagccgcgccgtgtgcatctgccgcacagcattgaacacagctactctcattccatcttcagcttttaatctgagggaacgtcacctgaattgacgagaaatttaagtcaatttgtaaaattttccttctctgatctggtggaggaaaag

SEQ ID NO: 4598 - DNA, 1230 bp, Homo sapiens
aaacaacaagtaatttgtagtatagatatatttatcactaaactaatgttgcatgggatatacttctactaaaacattgttttgagaggtgacagcgtgctggcagccctcacagccctcgctcgctctgggcacctcctcggccttggcacccactctggctgtgcttgaggagcccttcagcccaccgctgcactgtgggagcccctttctaggctggccaaggccggagccggctccctcagcttgtggggaggtgtggagggagaggcgctggtgggaacccgggctgcgtgcggcacttgcgggccagcgcgagttctgggtgggcgtgggctcagcgggccggcactcggagcggccagccaacccgccggccctgggcagtgaggggcttagcacctgggccagcagctgctgtgctcaatttctccccgggccttagctgccttcccgcggggcagggctggggacctgcagcctgcagtgcctgagccaaccccccccgccatgggcttccgtgcgcccgagcctccccgacgagcgctgccccctgcttcacggcccccagtcccatcgaccacccaagggctgaggagtgtgggcgcatggctcgggactggcaggcggctccacctgcggccccggtcgggatccactgggtgaagccagctgggttcctgagtctggtggggacttggagaacctttatgtctagcccagggattataaatacaccaatcggcacactgtatctagctcaaggtttgtaaacacaccagtccgcaccctgtgtctagctcagggtttgtgaatgcaccaatcgacactctgtatctagctactctggtggggacttggagaacctttgtgtccaaaatctgtgtctagctaatctcgtggggaggtggagaacttttgtgtccagctcagggattgtaaacgcaccaatcagcaccctgtcaaaatggaccgatcagctctctgtaaaatggaccaatcggctctctgtaaaatggaccaatcatcagcaggatgtgggtgggggccagataagagaataaacgcagcctgcccgagctggcagtggtagtttgctccggtttctttccacactgtggaagttttatttttttgctctttggggtaaatctggctgctgtttatactttgggtccacactgcctctatgagctgtaactctcgccgcgaaggtctctagcttcactc

SEQ ID NO: 4599 - DNA, 1242 bp, Homo sapiens
aaatgcgcctgccctgtggatgccacttgtagtgtggctggtttacattgttctggttgcagattatgaaaaattattgacttgctgaaggcggtgaaaggtgggaggggacggtagggatggaagagggaatttgaatatttgaccaggttaatgtgaagaacagagataaacccttacattaacccctcgctcggagcacctagggctgcagattaaaatcccatgggcctgccagtcaaaggcaaggccccaagctactctctcacactggcctcccacagcaatgagacagtggcttggagggtgatgcatgctttatgtgttcctgagccggtgtgcagcgggagcacccggggagaaggaaagcccagaaatgggcaaaagatgttggttccctggacggtgaaatttcccaaataggccttttaaatgtgggtctcagaggttaaccaaacaaagacagtctcggcaggaccacaccggagaggattttagcctgacttaacccactgagaacagagtcttgttcaattttatgggaatttcaacaagtaaccaatacaggcggccttcccctcttatttttgtattcccttggaccggctgtcaatcacacacacacacacacacacacacacacacacacacacacacccctcggtgcactggccccttcccttccccgcctgcctgctcctctcccagcctgccagctgccctccctgctccccttcttctcctctcccggcagatccactcaacttgaacccggactctgaggcttagcagccttggagaaaccgtactctaggaagaaaaaaaagcacacaggaaagagactcctgacccttcctcaaggctgctctcgccccacctcataacactgggcgcaggcacaagctcccaaaacttcggaatctggatacattactgtcttggagggggtgaaaactgcccagcaaagcaagccggcctctgtgcccctacccagcggcctcccgcggccggccttccctgggagcctcgcagaacccccgaccgagtctgggaacgcccgggggagacaatagctcgggcctgacgcccgacagggaccctctgcccttccttcctcgctgtcttgctcccgtccctataggatacccacccggccctgttgccatctccctggagcgccagcggtggaggcttcggaggagccggccggatgcaccgggaccccgcggggcctagttggga

SEQ ID NO: 4600 - DNA, 1199 bp, Homo sapiens
caagctcctcctattccttgccctgtacatctcctcatctgcatcctttgtcatatactttgtcataccagtaaactggtaatcctgagtaagagattccctgagttccgtgagccactctttcagattaataaacctaagaagggggtcacgtgaagcccactttttggccagtcagaagcacaggtagaataacctggggcttgcaattggcatcagaagttggcgggggcacagtattggggactgagcccttgacctgtgggatctgatgctatctccaaggagacagtgtcagagttgaatggaattgaagggcacccagctggtgtgccctatagaattgattgcctgcttgtgggtgggaagaaatcccatgcatacttggtcacagaagtcttctctgttgattggtgttttgttagagcaggggaaaaacaatttgagtttgtccacactcagtatgataatgatctttatttcatagagtcagaaactgaggattggaaacattaataaactcgcccaaggccacatagctagtggctggttatggtagatattatgctcattcaactcccattccatactctctttggaaaaattagagtgctcaaagccacatgtcccagaccattttgcatctcatatataggaagcaaattgagctttgtcaattagatgcgttcctgctcaatctggcaggtggaagtgaaacagaagccatccttctgctttctggtccaactgacatgaggattaacggcagttagagtccaagtttgggtctagtcaccgttttcatgggcatgagagccacttgggttgggggagcagcatggcagcaggagtggttttctgaattctggccttcagctatggtggtaatgtcctgacatcaacaactgaaggccctccgagttctcttcctctgtctcataaatatttttttcaactaataattgtagattcaaatgtatttttaagaaatacagtgagtgacatggtcatgtcttcaaatactatagagcaatagcacaagcagcatattggcgttgatagaattcaccaatctcattcagatttcctcagtttttgtactcatttgtgcaagagtatgtgtatttacttgtgtaccgtttggtttggtttgttttgcctgagacaaggtctcactctgtcatccagactcacttgca

SEQ ID NO: 4601 - DNA, 1105 bp, Homo sapiens
ctgaatctaatcgtgctgcacagtcccttttgccatgtaaggggcattcacaggtcccagggattatgacccaggtatctttggagcacttgctcagccaaccccagctccaaatgtaaaggcatgcacagtggagagccgcttaattcagcatctcctcacagggcctccagtaggcacctccttccctctcccatctgctccaggaaatgtctgctccagcttctccccttccttgttccgtgggttcccactcactgctcaagtgagtcactgggactgtcttagaatgctggcattctctgactgggacatattcatttggtaaacatctgagaactgtgtcagagcaggcaggccccgcatccctgcattcctgcatcccctccttcccagcctgactgcctgtggggcccttagctgccccttgtcctctcacctgattctgcagattcttcttcttgagcagcagctcagaaagcgcatccgccctgcgtttcaagcccagctacttcttagcttcacttccgtcaacttcaccttccctgtagtgcagtggggcattgatggtaggtctctctaagggcttggtggactttaacatgtgattctgtgattccgacttgcctgaagataccccagctcccccctcccgactatccagctgcattcctgctctggaccctgctggggctgccacacccactgcacggcagggctagagagatgtgcagcctgaccctacccctgagcctgtctgtgaaggtggagatgggcatgcacccacagcccatgaggcaaggtggtgtcctgagtgtgctgtgagttcaggcgcaggaaggcctggcttgttgcagcaggatgtccccaagcgtggtccaaaattggggctttgccacctgcagggatttcctagaaggagatccaagggtcaggaggcatttgaaaggctttcacgcatctttgtatgtggcttgattgatccttttttaaggctcttgctacccagaaatgggattctctctctcattataaaaacatttggccatcttttcttgtgtaactgtcagtgaatgtatcattttgaatatttttcaaattaaaa

SEQ ID NO: 4602 - DNA, 1230 bp, Homo sapiens
gcaggggcgtccctcctctcagcacagcctccccgcgctggatttctatcaatccagtttccacctgcctggaagtcagcagggtcctccccagtcccagatcgccgggcgaggccccagatggacctcaggggcggggagtgggcggagcttaggggccgaggcgaggtgtgggtggggcgggacgccgctgtggaggcggggcctgggcgcggacgggcgcggagcgaggcaccgcaccgccggggcggggagtgggcggggctcgggggcggggcggggtgtgggcggggctcacgggcggggcgggtgagtgggcggggcctcggcgtggtaggcgcgctgcgtaaagaggcctgcagtcccgcggcgcggggcaggttccgggctgcttaggttggcaccggtccgtggtccccgggggcgcagtcgcagcgctcccgccctccaggcgtcagcgagtgcgcggtccagtgcggccggaacctggcgcaactcctagagcggtccttggggagacgcgggtcccagtcctgcggctcctactggggagtgcgctggtcggaaggtgagtgatcccctgtcggggaccgggggacttgggaaggacagttcccggactggacggccagaacgctctcagggatttcagctggccggccatatggccctgtgggtcgtcgcgcccgggccagggaccattctgtacataggatcgtgcttggctctcacggaacgcgcccacacgcagggtcccggtgtcgaatcgtctggtggaatctgccctcaaccctatggagcgggtgctggtatcatagtcatattacaagtaggaatcagcgggcccaaggtcagtctgtaaagggggtaccggggtttaggcccgtgcgctgcccagcgctgccctgaaggcgcggctgaaccactggtttgcgctgcctttgtcaaggacattgtggcactgtggaaaaaatgaaaaatcagcttctctaacctataatctctctgggaaaaaaaaaaatcagcttttttttttttccccgagacggagtctcactctgtcgcccaggctggagtgcagtggcacgatttcggctcactgcaacctccgcctcccgggttcaagcaattctcctgcctcagcctcccgagtacctgggattataggggcgtgccaccacgcctggctaattttttgtatgtttagtagagacgggtttcatgttggtc

SEQ ID NO: 4603 - DNA, 1264 bp, Homo sapiens
ccggggccgcatgtccatgaaggaggtggacgagcagatgctcaacgtgcagaacaagaacagcagctacttcgtggagtggatccccaacaacgtgaagacggccgtgtgcgacatcccgccccgcggcctgaagatgtcggccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgacgaacaaggggagttcgaggaggaggagggcgaggacgaggcgtagatgcccccgcgagacgggttagggaaagcggaggaggaaagcgagggggtggggggcttcccgggacgataacctggcagtggaaggaaagaagcatggtctactttaggtgtgcgctgggtctctggtgctcttcactgttgcctgtcactttttttttccttttttgtaatattgatgacatcaatgtaacatttgagatatttctgaattactgttgtaatggctaaaatcacataaacgtttgtgtcggaatggtgtcctctctttctcttcctttttctctttattaacgatttaaatgtaactttctgaacacattgcattgaattcttcctttaacaaaaagcaaaggcgtaggtaaaagctcaaatgaatttattctttcggtatggtaaaattgaaccaatcacagttaagatgagagatcaacctgagttttaaaatacctttaataaatattagttgaaaaaatgtctacttgaaagcacagtgtgtgtcttcatgtgcaattcctactatgcttttatctcctttacaaaaaaaaaaaaagcatttttggaatagttcctacatactcacagcacaaaattctgaagagtggaaagtgagtgtgtctttttcctgtgttccttgatgcagtttcctccctggagggaaaccatcctaatcacggttatctttcttacttccttgcagaaatactccatatattttcaaacccatgtaggatatttcctttttctctttcttcacacacatgatgtgatactaacacaattctgcagccttcttcactaaacagtgtatcttgaacctacagagagcttccctcctttaaatggatatgtagcgtccattatatagttgtgctat

SEQ ID NO: 4604 - DNA, 1123 bp, Homo sapiens
attccccttagcaaaaatcctcttaaaatattttctaacttaggaataagcgaatcgaatctaaaatttacttgagaaaatattctcaatatttatagaatgtaagttccttcttctgccatcctgtgccttctgtcttctttcccaaatgaaacattttttcattgcttcttgtgtgtatgtatttaagggctgctctctgttcggcaccaatgtttgacagtgattggctcttctcttaaatacagccagctccccaaggtcatcagtcaacgtcattatgttcagaagcagatagatgggcaattcaagagcgacctagggtctttcgacatttggccggctgctgagtatttaattacgtctcgacaaacatgggagagagccctcattgataagcttagcttgttaagagctggtctcattaatggtcatggtgataaattgtgctagtcttattgaaaaaaagatgtctaaaacgaggacattatgtctaaatgatgaggatgtgtgtgtgtgtgtgcgtgtgtgtgtgtatttgcaggggctggagatgtttccttcgttcttaaaggataaatctggtgtttaaaatccaaagatctgaattcaagtcctagatactataaaccatatgacctaaggcctatttggtaactaacctcttggggcctccctgttaaatgggattagcacttgtttacgaggcaagagtgtggttgggaatagatgtggaaatgcagtgtctctgtttgctgctgaagtggtccagaatatgccactggccataaggactgttgtgagctgacagcatttgagaaccagcagatgcaggacgcagctttgtcggaactcccccatctacctagaaacagagctttcccgaagaattcaactgtcataaatccccctttaagggagatttctcccagcagaggtgaagatgagaagttgatgcaggatgagaaattgcataaacacaccttactaaaacaaaccttctcttatattatttcccccgtgtatttctctgtcatttcccactatttcttgtctcttgaaatcctaaccccttccctgcattaggatggtatataaagccccaaattccaacctcttctct

SEQ ID NO: 4605 - DNA, 1155 bp, Homo sapiens
ctgcctgcagggatggtctccttttaaagcaggttgtgtgcagcattcagtacactgaaggtaagctaaaccatcaacatctctggtgttttaagatgttattttattggaacaactgacaaatgagggatgttagctttgtggcagaattccctgcatgtgtgataactgatcttgttttattttttggcattgcaactgtggcatagttacaatttctgtttgttcatcacatttaaaattggaagagaacgcgcttgatggatagagcgccttcagtgtactgtttcttattaactttactttttttaaatcaacttgctatagactttatatacattttgttaaatatagttcctagtgacatagaaacgatgcgtagttttcatttactaattacaaatgttgaggcctaattctgaaagtcctcatatttaaaggctagacaacgtaatgaaatttttaactatttgtatgtcattttgaaagtgtactgctttatggtaaaagtgtttttcatttgttcattgttttcattatttgtgatcatgttgtctttcaatacaggcataaaccttccactcttgaacaaagcagctgctttttaaaagcggtaattgcttctttaccttttatttcttttgtaaatgaagcttttctttaagaatgtgactttaaagtgttgtctattgcataaaacagttgacactcacttattgtaaagtgaagattgttctactgcatgtgaagtggaccatgcagatttctgtatgttctcagtatgcatcactagataataaagtcttttgtgaacaaggcatttgtagccatttttaaaagtttttgtcttcagtgctggtaagtcaggtaaaccataaatagttaaaagcaaccttttgtttttttcctgaaagtttttaattgaaagtattattagttaaagatgtaaacctagccaaaattaccagtttattaataattaggatcctaattatttcaaaaaatcctacaaatattgtcagctttcagtgtagtgagattattcctgtaggttatggggtataattcaggatttaactaatgtttctgctattttctcacttttccttttgatggtgcggaaagagaaaaaggaaaacggggcacaggccattc

SEQ ID NO: 4606 - DNA, 1280 bp, Homo sapiens
ctggaaatggactccaatccactatttgcatttatagatcacagggctaaaacaaagttagttttctcctcgcaaagaaaaaaaaaattccctgtaatattttagctgatgtgacaaatgagagaaacctggggacatgctgaagtttgaagctggtgctcactttcatcattgcctgagttttcccaagcagcttttgaagagtgaggaactaagttttcttagaagagtaaatgtctcacagaggggtcacccttataccttggatgttgaaactttgtacttctggaactaaagcagttaccacggtgctgggcattgggggtagggctaaggcgttctaacctcaggagggctaacagttcggggacactctttttatctttggcgaccccatttttttcaagcccaaaatgaggccaggtgatctggcaagttttgtgtttctaacattgtgacaaaccccagaatgatattgcatcacggaaaaaactcctaggcccaggcaactgggacccctgggctaggccccacactttggggggcccatctggccttttccagccacgtctacggccataccaccctgaacgcccccgatctcgtctgatctcggaagctaagcagggtcgggcctggttagtacttggatgggagaccgcctgggaataccgggtgctgtaggcttactttgtgtctgacccatgtttccctgagacaaaacaccaagctcacaccacactcacaccacaaaacaaagaacgggtaaaaaaggcacacacacactttttcagtttacaccaaaccagaatcaaaaccaaaatcagagtatccagaaatccaagccaggtcaaaaccaaaaccaaagtatcaagcaattcaagtcaagtcaaaaacaaaaaccaaagtgccagtacaggcacgccgtgggtgatcaggccacgcttccactcaaatggagtgggcaagttccaaagaccagtcttaccaagtttcagatgtccggactccaagtgccagttccttcccggtgttcagccactgcattgatcctccaccggggcctgccacgcgctgctctgacgaggtgtccaaccggggcaactgcctaccccggagcgctctcaggatccgcgtcactcaagctggccaaataactcttcggccagttctcccttgcacggcagcagcacagtgagaatgttcatcacagaatttattcagtctcagggcggtgtttctccaggtgtggacttcagaataccaccaggtcagaacca

SEQ ID NO: 4607 - DNA, 1711 bp, Homo sapiens
tctagactgttttattacaatcaagtatgatgttctctgttgacctttttagttttaattgagtgcttctgaatgatacttgtgatacagatcatatgtttctttgatggcagtttcacaccacagaaggttctcagcgccttgtagctcattgctgtcaccactccaggctgttgcctgggtgcccgctgctggaaccctgggatgaccaggcacagctgcagatgcctcgagctgctccagccatgagtgtggaaaccaactcggtggtcaggcttcaacacagaaatagcagagagcccctttcagtcacaagaaacataagtcacctaatgcatatccacacgttctcagcataaaaatttagcatcttgtttgacttactttcagggaaattgtccacaacccaaatggcctattactattttattgaggttgcagaagagatcattttatcatctattgtggtttttgctatttttgatgtttcctaatgaaacttgcacttttccccccaaattttgatttttttaaaactatttttttccttttatgaacaggttgaaaggattgttgacaaaaggaaaaataaaaaagggaagacagagtatttggttcggtggaaaggctatgacagcgaggacgacacttgggagccggaacagcacctcgtgaactgtgaggaatacatccacgacttcaacagacgccacacggagaagcagaaggagagcacattgaccagaacaaacaggacctctcccaacaatgctaggaaacaaatctccagatccaccaacagcaacttttctaagacctctcctaaggcactcgtgattgggaaagaccacgaatccaaaaacagccagctgtttgctgccagccagaagttcaggaagaacacagctccatctctctccagccggaagaacatggacctagcgaagtcaggtatcaagatcctcgtgcctaaaagccccgttaagagcaggaccgcagtggacggctttcagagcgagagccctgagaaactggaccccgtcgagcagggtcaggaggacacagtggcacccgaagtggcagcggaaaagccggtcggagctttattgggccccggtgccgagagggccaggatggggagcaggcccaggatacacccactagtgcctcaggtgcccggccctgtgactgcagccatggccacaggcttagctgttaacgggaaaggtgagtgtctagggagctgctcaggctccgtggtgatcccagagggctcgggtccttctctagagatcaggccttgagctgggcagagtccggggcttctcacggcatctgctggagccttgcagagatttcgccttctcctttcttcgctggaagcctttgatatttctcttaattcggcaactagttttttctgtgtaattcgccatccacagactgtgctaccacactgacttgctttaaacagtatctccctctaactaggttattaggtgataagtttttacagcaagtttctgaagctgtctacctttcttcacctctgaagtgctgagtcttgtctcgtgttaagcgttttcttctaagtgtggccagcattgatacagaagtgcaggttcttattttgctcatctgtgtgaatacccaggaatgcctttcagtgggagcgttgctaacccagcagagcctttgggagccgggctcg

SEQ ID NO: 4608 - DNA, 1178 bp, Homo sapiens
tcacaattgtatcaaatacacactcaaatcatgtaccacatctaccattatatgttctccctttaaaatgaaaaaaaggttatattccaaactggagataaggcaaagctgtaagtttgaatagaattgaattttgatccggcactgtctcttggcactcagtataaatcttcatacccccatctgactactgcctcaaggccacaatctctaaactcattcctaatccagttacatgggaggacaagcatggtcagacagcaaagaaaactccaaatacacacttgtaggggctatagtgggagaggggcaagcaaaacaagtacgccaagttctcccaacaaggtgtagaggaaaggacactggaccaggaatcaggacccaacttggggtccccagtcacccaccatctgtgtgatcgtggggaagctatttgctcttctttgtctgaattgattcctctataaaacaaggaggtctcattcaatgttttgggtggttatataaatgagtcaaaggtctctgctggcattactttccctaagtttctcagttgaaatttcctttcctttatccctgtgaggtctgctggaggtttcacatgtgggcaggcaaactgtgggatcccactacttcaacacaaggctttgataaaatgcctgggactatgaggataaagtagtattttccctcattcattcaatcagcagacacaaaactaccatacacgtacatcatatacaatacaatgtgctagacattttaggaaatgggtagaaaattgtaattttaaaaggtacagttcctacatgaaggcatgtaatgtttataatccaactggataacaaattgaagaaaactgcaatgacaaagatctagaacaaattgctaattaatcacagtatctttcccactgagcctaggtgtgacctcaaaatccttctccacacaagcactccattcagcacccaaaagactgtcctcaccaggtgaggtgaggtgctttgtgcagtccacaataggcactcttctgagcgcatgcccagctacttccagtgccctcccactactgctcctaccaagctcctttgacttccaccttcgcctccaaatcactaggtattcccaaaaagaagggagccactaagaacctagtcacactggctgaacactcttgt

SEQ ID NO: 4609 - DNA, 1186 bp, Homo sapiens
tggtgctaagtaatatgccattgtctggatgtaccccagtttatcccctcacctactgaaggatatcttgattgtttccaagttttagcaaatatgaataaagtggctctaaacatccgcgtgcaggtttttgtgtggaaaaggttttaactcgtttcataaataaggggtgtggctgctggaagttacgcaacttttactttaccttgatggctgtcaacctgggctgcccattgtaaccacctggtgagcatttaacaaataaatccctgtgcccacccccacccaggccacttaaaccagactcaacgagggtggggcttgaacaaagtgttaaccaacccattgggaggtcctgaagtgcagccggtgttgagaatcaccaattcagaggctgacaccagattcctgagtttctgcagatttctcctcagcttctctaccaagggacatttagactttgagagcagtaagaaaatggttaaataaacaagtatttgttatgttttataaaacatttctttttaaaaatttatatatatgtgtgtgtatatgtgtatatatatatgtgtgtatatatgtatatatatgtgtgtgtgtgtgtatatatatagagagagagagagagaaagagagagagagagagagagagagactcactctgttacccaagttggagtgcagtggtgtgatcatggctcactgcagccctgaacccaagggcccaagtgatcaagtaattctcctgactcagcctctcaagtagctggaactacaggcacatgccatcacgcacagctaatttttcttttttttttctgagatggagtcttgctttgtcgcccaggctggagtgcagtggtgcaatctcagctgactgcaacccccacctcccaggttcaagcgattctcctggctcagcctcctgagtagctaggattacaggcttgtgccaccctgcccagttaattttattttattttttgtatttttagtagatatggagtttcaccatgctggccaggctggtcttgaactcctgaccttgtgatcctcccgcctcagcctcccaaagtgctgggattacagacgcccagctaatttttttaacttttcttgtagaaatggggtctccctatgttgcctaggctggtctcaaactcctgggctcaagtgatcctcctgc

SEQ ID NO: 4610 - DNA, 1212 bp, Homo sapiens
ttccctctcccgctcctttaaacccccctgcatcgtagagagcgggctggattctctgtggtgctgatggaggagggggagcaggttgaaacaatcgagtgggcgcgccaggactccccagctcctggcggggaagggagggggagcccctgttctgcgcagggaggcggcggggctggggggcccccggaacgaggaagaggcaggggtgaccgctagaataggaaagtgctcacccccgggaggcaaaatttcgttcagatcgcacattaattggagatatctgattaattccagcttctgatgactataaatggcgattctctaccaaggtgtctatattaaaaaaaaaatcattccgtgtcatcccccacgtcaggcctgctcgtgggcgtgaggctgtacttcctccgcccccttctaatggagtgaaccattcccagctctcccccccccctcagcctctctctctctctctctttctctctctctctctctttctgtctcttcctcgctccctctctttctctcctccctctgccttcccagtgcataaagtctctgtcgctcccggaacttgttggcaatgcctattttttggctttcccccgcgttctctaaactaactatttaaaggtctgcggtcgcaaatggtttgactaaacgtaggatgggacttaagttgaacggcagatatatttcactgatcctcgcggtgcaaataggtaagtggccgctcagcccggctggaggctggaggcgggaggcagcctgccccggcccgaggcgcggagggggactagcgggtccgcggccgccccagggtgcggagaagccggcaatcccccgagggtgggggcatcagttcctggggactagcgcgtcccagatcggtttttcctaaagctatagattccaaatgttcgccaggaaatgtgtgcggccggacattttctggacacggtttttttccccctttttcctgagcacacatccatttttgtttccctttctgggtttataccaggtttggtgcgctctggggcaatgtactggcccctgcgatactgcaagatatgattttgaagagtcgaaatgtgaatgcaggaataaaatggctaggcagccaggactggaaagtttatgtgctgaaagcaaagatattccagggctcagactgctgcatttagaactttgtcattctcccgcccc

SEQ ID NO: 4611 - DNA, 1130 bp, Homo sapiens
ccttgcatttgatatgtcatccagttcataatcaagttgcctttttctggctaaaacataatgattatgtatttttctcatttggtcctacaagctgctggccctttgtccctccactgtgggaatcagatctagaggaggctgagcctgcagacacagcagtggccaaaaggtcactctaagtgttttgtcttgactccttacttgaagtccacccagctagcacacatctggtttatactgaagccccctgcctagaaatactcatttcaggaaccaccagtaagcatctgtgaccacacaggctttttgactgatggcttcccggatctggtttcaagggataaccccgtctgtgtgcatctatggtcttctctctacagcgaggactttgcagtgctgcttgtggtccacacaaggggctcagagctgagtctgaactgcttcatggtcaccagctcctgtcccttccagtcttgagaggcttttttctccagatggaacctttccttcccgccgttttctcggtctctggctgtttttctcttgtgcccgtctaattggacacctcctggcttccatctctgtggttctcctgcctcacttcctgttctgttgtttttccgttttgtcaaaatatctcctatgttcttggcttccttttcgtcgccaggttttcagctttcctttagctcttcttctaatatggcttctgcccacaaaagcctgctctgtcaggatctcatggttctccacttgccagaaccttcttcagcctcagttcctcggcctcaacttgtacgtttaacccattgaccaccaccccccaaattcaccttcatttctttgaccctgctcctcactccttttctgttgaggaatctgttgactaactccaggctcactcaggctcaccgtcctgctctctgcaccagcctttccagagcgtgccagttctcatggcttcatctgttaactgttgatcacttcagtcctgatttttagacctaaatggtttccttaacgccattctaactgcctgtgactcattttcacttacagtgtttattgtaacgccaaaccaacaaatcacaggtgcttgcttctctccataaatctccccagtctaa

SEQ ID NO: 4612 - DNA, 1133 bp, Homo sapiens
atgttaaagattgtttttaaaacctagagctagataggaggcattcattattagatggtgttcacccatgtgtgtgtgtaacttagtggtaaagttgaaggtaaatactttttaacatgtcttttgaattcaatatacttataataggcaagcttaaaactttctcttttcttccagataaagcttcaccaagaaggttgcccaggaaacgggcacagaagagatcagtgggatctgatgagtaaatgttcctttgtgcaacaattcggtctttacttaacctgccctaatatttttcggcctgatgggaattagtgcagagaagccatgtcaccatagaaggcaactcctacttgtgtgtggactgagcaatcagagtctgtggcgataatattgctgaaaatgcactgcattcatttttctaaagtaacaaatttggtttttttttaaaccattaaaatctatgtgtgtgcgtgtgtatgtatgtgagcagttggtcttaccagaatcattgttgaactacctgaaacaagtctttagaatactaaatataatgctgttgtctcttcctttttgacattttctgattttttcccccaaaactcagttaatatttacccactatgattattgatgtcctgccttgaacagttttaaagaaaacaatttttggaatagctcaaatttcaattgatggcacaaatcagcattttgttgttgttactgtattacaattagtattctaaaggcagaagcagaagtagctgctttttagcaatagaattgtttcagtattttgctgctgtttaatgcgcatcttcagaaaacttcccagtggcttcaaggaatttggggatctctctggcaacaaattgtgaaacatgaaatttctgctgactttaatatatgaaacctaatcctacccccttttttaacaaaaagaaactagtacatttgtgaaaattgtgttgtgttgtccattgttgctctagttctgacccagaggtagctctggagtgattttagacctactcactcagttgtgtgtaggtttttttgttttgttttgagagagaatttttctctccttaatagaagcatcctttttaaagagaagttgccttggtccacac

SEQ ID NO: 4613 - DNA, 1122 bp, Homo sapiens
agaattgtcattacttaaccatgggagagggtgtgggcagacaggggacaaagattttccactgtgtattttcatggtttttcctttgaacaatgtcctctcttccaacaaaattttttgcttttaagtgccacataaaggcagctcatgttccttacatcgccgttatcaagaggatcgtcattcaaataaagtaaccactgacaatgctaattaattggaagtaaagaactgggcggaaagaacggctaaccgcaagctgccgggtcgcaactgcggcggaaggcggactctcgcgggagccacaaagaggcagcagccggccacgtgacttcccggtggcctgctctccccacctctccgcgctgagcagccacgtcggcggcggtccctggtccagggaggggcgtggcaaaggcccgtgcgcggtacgtgtcccgcccctcgctgcccggagcccggatgaagagtaacgccattaccgccggagccgccgagagccttagccgacggaaactggacactggaccggcagcgccatgagactcctcccccgcttgctgctgcttctcttactcgtgttccctgccactgtcttgttccgaggcggccccagaggtgaggctgggggagtgtgcggaggggatggccaggaaggagatgccagtgatggcaagtttgaagttggaggcggtggccgctccgggtcctggggtccgcgtccaccccgctggcctctctccgccctctccccaagcctaggctcgtagcagcaggggtccccgcgggcgctggagaccccgctgcggcctgccccttgcacgcggagcgcggggccgtgcccgggcgaccttgcttcgtggccggccgagggctgggcttgctcctcttgccctggaccctcgcctgcaggagcggccagaactggagggtcctcggctgcaggaggaggcgctggacacggctgcgctccgagcgcgccgcagccgggctgtttcttttggccacctccggctccgctccacccccagcccctcgcgctcagggctgacgtgtctttagcttccacgccgggagtccgtcttcattcatttgccaaaacccttgttttctacacatcta

SEQ ID NO: 4614 - DNA, 1261 bp, Homo sapiens
aaagtagaactaccatttgatccagaaatcccactactgggtatctacccagaggacaagaagtcattattcaaaaaagatacttgcacatgcatgtttatagcagcacaatttgaaattaccaaaatatggaaccagcccaaatgcccatcaatcaatgaatggataaagaaattgtggtatatatatacaccacggaatgctattcagccataaaaaggaatgaaataatggcattcacagcaacttagatggaattggagaccattattctaagtgaagtagctcaggaatggaaaaccaaacatcatatgttctcactcataagtgggagctaagctatgaggacacaaaggcataagaatgatacagtgcctttcctttcagcggagcatggcggcaagatcgccttacaaatttccaagaagaggaagtttgtcactgatggcatcttctaagctgaaatgaatgagtttcttactcaggagctggctgaagatggctactctggagttgagatgcgagttacaccaaccaggacagaaatcattgtcttagccaccagaacacagaatgttcttggtgagaagggccggcggattcgggaactgactgctgtagttcagaagaggtttggctctccagagggcagtgtagagctttatgctgaagaggtggccactaggggtctgtgtgccattgcccaggcagagtctctgccttacaaactcctaggagggcttgctgtgcggagggcctgctatggtgtgtcgcggttcatcatggaaactggggccaaaggctgtgaggtcgtggtgtctgggaaactctgaggacagagagctaaatccatgaagtttgtggacggcctgatgatccacagcagagaccctgttaactactacgttgacactgctgtgcgccatgtgttgctcagacagagtgtgctgggcatcaaggtgaagatcatgctgccctgggacccaactggtaagattggccctaagaagcccctgcctgaccacgtgagcatcgtggaacccaaagatgagataactgcccaccacccccatctcagaacagaagggtgggaagccagagcctcctgccgtgccctcagtcaccacagcataacaggatctccttggcagctgtattctggagtctggatgttgctctgtaaagacctttataaaatattgtacaaagacagaaaaaaaaaagaatgatacagtggactttggggacttgggggaaagag

SEQ ID NO: 4615 - DNA, 1200 bp, Homo sapiens
cctccaccaacccataatcattttcttttcttttctttacattacactcacttttattcttctatgtgtgtattttatttagttataatcataataatactccaggtgggtgcagtggctcatgcctgtaatctcagcattttgggagatcaaggtgggtggatcacttgagcccaggaggtcgagaccagcctgtgcaatctggcgaagccccatctctaccaaaaaataccccaaaaaaacctagccaggtgtggtggtgcacacctgttgtcccagctacccaggaggctgaggtgggaggattgcttgagcccaggaggtggaggctgaagtgaaccatggtcacgccactgactccagcctgggcgacagagcaagaccctgtctaaaaaacaaaaaacaaaaaacaaaaacaaaaaatgcatactccaaatgaatgaaagttggcttttttgtttgttttttacaggaaagaaaaaagatggtcaaggaagcccagagagagaaaagaaaaaacaaaattcctaaacatgtgaaaaaaagaaaggagaagacagccaagacgaaaaaaggcaaatagaatgagaaccatattatgtacagtcattttcctcagttccttttctcgcctgaactcttaagctgcatctggaagatggcttattggttttaaccagattgtcatcgtggcactgtctgtgaagacggattcaaatgttttcatgtaactatgtaaaaagctctaagctctagagtctagatccagtcactgactctgtctggtgttgacagaggatttatttaagctattattttaataaagaactttgtacatttttatttttatatttttttctcttacaaatatgtttttggaagcatgataaatgtttaaatgtagtcaacatctgtaactcttacatgagtgtccagaggcactcatgggaaaattggttttgctttctttgtacacaccagagacccatctgaggtcatctgattataaggccatgtttatataaagggaatttcacccacagttcagctggctgttgattttcactgcaactctgcctttgtgtgtattggcgatcatttgtaatgctcttacacttcgtctttaatgttctttttggagttaggacctctcagttcataaagttttttacaattcaatcatttggcatattcattcat

SEQ ID NO: 4616 - DNA, 1201 bp, Homo sapiens
aaactgcttactagctttcatgcaggctcacctatctcttggtgttcatgcatctgtacaactgagctaggctaagacagctgacattttcttgtttcaggcctatatggacactctgcagacgcagtggagttggattcttcagatcaccaagtgcattgatgttcatctgaaagaaaatgctgcctactttcaggtttttatatttagtgataattttgttgttatttaggtcttaatacctaatcttttgagtgtgttttataaagcactgaaaataatcttcaaaatgttgcataaatcctcttcattgattttgagtgcagagtagcatagatttgcaaccttgccatcagtcctacaaatagtttcccgctgccacatacctaaatactttctgcacgaattttttcctttagccacctgtcaaagagatgtttagggatgacaatccttgaaacagaactactagatgaaattgctcattgagttgctgttcattcactgatcactctcatccttcacagttttttgaagaggcgcagtctactgaagcatacctgaaggggctccaggactccatcaggaagaagtacccctgcgacaagaacatgcccctgcagcacctgctggaacagatcaaggagctggaggtatcgtctcagacccagaacctcagcagctgtgcctgatcagggagataaaacacatgccttggatgcagttggctctgattagtattattgtacaatgcacgcccagagccaagcaagcattttcttcagcttccagtggcttttctcaaaattaacttctttacatgcccaactactcttgacagttacttttgcttcagtctgggcaattggttgaaaataagaacagagagaacattacttcacatgacaattcctttgggaacgcatacttcaaattttatcagcatagccctttcacacaaggatgttcttccctgcccacttaattcctgcctgcatagcttctggagagtgttgtcatgaaaggttctcatgtttcctgccgacgaatttgtgattttttacaattgatgcaactgcagtgatactcagtgtgtcatgtagctacattaatgcaggttgaaaatctcctctaaaactcacagggtatctatgtttaagtatgattttattcaccattgcagaaagaacgagagaaaatc

SEQ ID NO: 4617 - DNA, 1226 bp, Homo sapiens
ggtccccccgagtctccgggactgccctctcgactgtcagtggggcagcctctccgactctgcacccgcctcgacctccccacccgctcccacacccctgtgccctcatgtggagcctaagagaacagaacaggccgtgaagccagcagagaaaagttctgccaagtttgtgaacccttttttttttaaacaaaacaacaaatcaacaacagcaacaacaacaacaaaaattaaaaacttttttctaaaaaaaaagtgaaaataaaaaaaattatatgcgcttcatgggactgagtcaccaccttcccttacatacttcagttcagattgtagccatacttaaaaaaaaaaaaaaagccaaaagatgatgacaacatttttatcagtattgtgaataaacttgaacacaaatacacgaagttccatgtcatgtcttcagttgtagaagtttttcctctttaaggtaaagcgaccaacttgaactttctctggcaacacgattcgcagttatataagggaatcagtgttcacgtctctgtatatatttatttatgtgtaatttaatgggaattgtaaatatggtgagtctgttttaagcctttttttttttatttatctgatcttgtttacctcttgtttagtgggttttgaatcttccctattagttcttcatgtggttcatggtactgatttagaaatccagtgtttgggggatttttttctctgggattcatgaatttagccctgttgtagcatgttaaaggtgacaaacagctggacaaatttttaaaaagtaaaataaaattttatctataattagtattattacatttagcttttcattgaaccgaaagaaaaaaagtgatattggaccctggaaagattttgaaacttgagtggtttgataacccttctatgtattgtagggagaaaaaaaaaagtttattttattccactgtcctcccttaaaagcatcatttgagcaataaatgaatattgtctttaaaccaagggttagggaattttcctctctctctctctctcctctctctttctgttcaaagaacttcaaacatttgggaccacctggtattctgtattttcactggccatattggaagcagttctagttgcattgtattgagttgtgctggcagtagtttccatgcctgtcaatgtatcatagtcctttgttgcccagataaataaatatttgatacgcttta

SEQ ID NO: 4618 - DNA, 1154 bp, Homo sapiens
aaatgattgaaaaaagtttagaatagcgaggaggcagttagtgaaatcttaacaccatcagaagaagctgttaacttggcacgtggtgctctacttcctgcaacgaggcatgtcaatttcaaatgggaataatgattgtcattcacaagagcatcgtaaaaatggaacaagatcccctctgatacgttttggacatctgtcctctctaaatctcatgttgaaatgtaatccccagttttgaggtggggcctggcgggaggtgtttggaccatgggagcagatccctcacaaatggcttggtactatccttgcggtaacgagtgagttctcactctgagttcatgcaagacttgatcgtttaaaagagtctgggacctcctccctctctctcttgctccctctcttgccatgtgacaggctggatcctctgccaccttctgccattattctaagtttccaaaagccctcaccagaagcacatgctggcactatgcttcctgtacaacctgcagaaccatgggccaacacattctttatagcaatgtaaaaacggactgacacactctctacacacacacacagacacacacaccccactcatctgttaatactgagaactgttactgtgagaagattcttaccttttcagaagtatgtggaaagatttgtgttttgtggaaggcaccaatattaagcaaatttttttctttttttcttttttttgagacagagtctcactttgttacccaggctggaatgcaatggcacaatcttggctcactgcaacattcacctcccaggttcaagaaattctcatgtctcagcttcccgagtagctgggattacaggtgcacaccaccacacccagctaatttttgtatttttagtagagacggggtttcaccatgtcagccaggctagtttcaaactcctggcctcaagtgatcaacctgcctcggcctcccaaagtgctgggattacaggcctgagccactacacctggcctgttaagcaaacttttcttcttttagggtctacatgcatttatatttaatgagtaaaataaagttaatgcatggcaaaaatatttttctgaggaatttgaaatcttaccgaaatggagaatcttttttccttttttctttaaaaacacc

SEQ ID NO: 4619 - DNA, 1197 bp, Homo sapiens
tttggactgaaaataccttgggtagtgtgtcttaatcggtttgggctgctgtaacagaaataccatagaccaggtggcttataaacaacggaagtttatttctcatggttctagagggctgggaaatccaagatcaaggtactggcagatttaatgtctggtgagggcctgcttcctggttcatagatgtctgtcttctcactgtgtccaaacatggcagaaggggaaggagtgagggagctctctggggtgttattttaataaatgcattaatcccattcatgaggactccaccctatgacctaatcacctcccagaggctccacctgcaaatactgtcacattggggattaaatttcaatatatgaattttgggagcacacaaacattcagactacagcaagtagcaaaatcgtattctcattctctagatagtgctttgtgtttcagtcatactgtcaccatgaaaatctgagaaatttgatacgctgttaagattcattgctctgtcttatgtagctggctgtcttccaatgtcatgagtcactgtgtgcctttattttcttatttagaaaatgggaataatgattgctggtctcattcagatgggtcgtgtaaaagcacagtgattgaatgtaaaagcactgtgtgaactgataactgtgtaattgaaggtgaaattacacttctcccctgggtttgtggtgtgttgatagtgatggttcatcactcaagttcatctatcacaacccttctgctgccagcatgtttatcttacatagaaaacaatttacagtgtgtttcatgaaattcatcatttgaacaaatgcttagttattggcacacagaagtgagtgctcttttgcctatctcagaatacacaccctctattgctgattagttattctggcatacaatgcgatactgaagcaagacataaacttccttttaagctgaaaaactgcaaaacccatcttaacaatcagtatattgtggactgtactttgcccctcacctctcctttcttctttcactctctactgtttctgtcttactaaatcccaggacatggttccagacccatgcccatagaataagagttaagaagtttctgatatgtgcactttgggtctgggaattgtataagctatacttctgttagaagtccgctgtaggcatgcagggtgcaatgggtaa

SEQ ID NO: 4620 - DNA, 1099 bp, Homo sapiens
gtgaagcaaatattcgtcgctggagaaatgatcgcaattccatattttcctgcaaagcaacaacaaaatgttttacgggacctaagaaaggtaggtacccacaagtagatgaagctgtactacgtttcgtcagtgagacacgtgcaaaaggattgcctatcacacgccaagcaatgcaattgaaggcaggagaagttgccaaaaccctaggaattgatgaaacaaaattcaaagccacaagaggctggtgtgaccgattcatgcgtcgagcaggactatcattaaggcatcaaacatcgttttgtcccaagctccccactgccattaaacagaagacagtgttggagcactctttcaagaagtgctgcataaccagtactcttgacaacaccgggagagacgttctgtggaaaaatgcagacatcaatgactgtggtttgaaaagtgattcagaagagttggattcagaatatgaagttataattataacttaaccaatttatttcacacattttctttacatatgcacaagattgatgtgataaaaatctgtttaactcaaagcgctgtttcaataaatataaacattttctgtgatatgaaagcattgtgtcatagtttaatgggcagtgttttttcttagtgatacatatggtgcatcttaacaattggtagtgtcttaggttaaattaaaaatggtagcttgtaaatttatttttctttttaagatagcagttatttattggggaatttgattctgactcttacaatgttaaacttgtaatcctgtgtgaaacacatgtttttgggggggagggggtaaccaagatttcagggtagtaacttaggaatctaagaactatcttctactttaggaagagtgggattagttactccctttgtataggaggactttatgctcaaggaatgtgttgtggagaaaaacacttcttcacaaacaattcagtgacaagacctcaaaggtaatgcgtattgaggaaaacagtagtgggtgaaaattcccgcttagctgtaaaatgactctcttgccaggtttccgtgtttgtctcaactgaactctgggctgagtgtttaccag

SEQ ID NO: 4621 - DNA, 1141 bp, Homo sapiens
ctttcattctgatgtttaaaagtgacttacgtatctttaaaccaatttggtcatgatgtttaatcttaatcactgctagatttgatttgttaatattttattgaagaattttgaatccatgttcaaggcattggtttatatttttattatgttttataattttctgtgcctgattttgttttaaggttatgctagtttgataggatgatctgaggactatatgcttctgattcccatggagctgtttgtttgatattggaactgtacctttgtaggcaagtcttacaacatattttgacttttgggagggactgcagggtagacttttaactcccaagtgtacttaacaataagggattatccaaacattctattttctcttcagttttaggaagttgtatttttcttataatttatccatcttatctaaacagtcacatctgttggcaaaaaatcagtcgtagtattttcttactctctttcatttctgctgggtgtgtagttatgtctgttttttattgcttctatcattgatttgtgcctctcctcgctttcttgattagtgttgccagttttctgttttactttctttttattttgccaacatctgattttcatgatactttcttgcctcatcctttttagtttcattaaattttgttctttattatcttttcctgtctttttcttcaggtttgttctgttactcaaatttcttaacttggaatgctcattcatttttaagcctttattctgctctattggaatcacttaaagctgttaatttccttgtaagtattgcttagatgtatcatacacaattttatatttattagtttcattcttttctatgctggtttcttctctgaccctccccccaccccaaatcatgttggaatttttttttctccacatggatggggatcttatttatttttagtaatttctcacttaattgcattgtattgttaattgttttttaaaaccatttaggatatccaaaattatttcttctctgtttctgaataccatgtaatcaaaattttctgagaatgtagtataaaagtactcatagattttatgttagaaattgagcattttataagtaaattaatcattttgccatgatgaaaaagctgaa

SEQ ID NO: 4622 - DNA, 1204 bp, Homo sapiens
aggaggatagaggaaggtgaggttggaggcaaagtacagattgaagattgtatcagctcttggggtagaacatagctcacattttctacttgaaagttccattgtgctgatagtcagaactttattttgccgcttagttgttctattgttattacattcatcagattttcctctctactactatattgaaaagtattcctgccctgacacagcttacaatgttttttggtacctcctctgctaaccttctgcaacagcctcatacacacacacacacacacacacacacacacacacacgcgcacacacacacacacacacacacacatctccgaggaaaaagatacaaataaagaagatggacaggctttcctttccgtctggcggcagccatcaggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagttggacgccactgtggggctctgagggtcctgaattcttactgggttggtgaagattccacatacaaattttttgaggttatcctcattgatccattccataaagctatcagaagaaatcctgacacccagtggatcaccaaaccagtccacaagcacagggagatgcgtgggctgacatctgcaggccgaaagagccgtggccttggaaagggccataagttccaccacactattggtggctctcgccgggcagcttggagaaggcgcaatactctccagctccaccgttaccgctaatataagtaaagtctgtaaaattcatacttaataaacaatttaggacagtcaaaaaaaaaaaaaaaaagaagatggacagaaaatgcttttatttgacagattcctcaagagggattaatagtacacagcagtatgagtgtggtcagcagcagtgaatgtcctatacacatataagctcttaa

SEQ ID NO: 4623 - DNA, 1249 bp, Homo sapiens
ccatccttgtctccccatttgctatggtttgagtgtctctcctccaaaattcaggagttgaaacttaatggccaatgtcttagtattaacaagtggggctttgaaaaggtgattaggccatgagggctcctccctcatgaacgacattaagacccttgtgaactggacttcacacagcagcataaagccctcttggccttccaccatgtgagcgtgccgcgtttctcccagccagaggctgcagccctcaccagacagccaaacctgccagcgccttgatcttggactttccagccccgacaactgtgaggaaatacatttctgttcttcttaaattacccagtcttgggtattttattatagcagcacaaatgggccacaatctgccatagtacctgtcatgtaggaagtattctgaaactatttatggagtgggtttcattaaaagttactctaatctttgaaatagaaaaatatcttacttttatgatcaatgttttgttacaaactgtctcaattatagaaacaggcttttgcatacttacctggcagtggagataccatgatcacgaaggtggttttcccagggcgaggcttatccatcgcactccggatatgctgacccctgcgattttcccaaatgtgggaaactcgactgcataatttgtggtagtgggggactgtgcttgcgctttcccctgaaaaaaaaaaaagcaagaaaagaaacaggcttttgctgaggatccactcctgcttcccctgttgggccattcctgttgtgttgtgtttgatgttagaaacaacgtacaaagttcctcccttaaaattaaatctagatctttacttgtcatgcctgataatatcaaactagagctccagatactataattttgattatgaactttagccatcattgaagtacatcgtcccttcttattaattctcttggagcaaatccttcatgaatgataaaatgggagaggggtcatcatccttagctaaggtagggatgctaagatcgctaaggtgtagggaatcgtatttgatagttcagctctatccagtgtccttagactaaacctgaaagttaacttccagaattttacgctgagacctgaaaaataggagcaatcatgtaaggaggagaaaggcaatgcgggtacattctagacggattagaggaaggagtgtgttggtagaccaggtgagttcacatgggaagaataattgaaatctctgagtttgatct

SEQ ID NO: 4624 - DNA, 1131 bp, Homo sapiens
acctagccagccttaagagaagggtgatcagaaggcagcaagggtgcaaaagttcagatcagacccaaagtacgacttgatgggaggaataagtcctagcgttctatagcactgtagggtgactgtaattagcaacaatttattgtatattttcaaatagctataaggagaatactgaatgttcccaacacaaagaaatcataaagatttgatttctttggcatgggtgcagtggttcatgcctgtaatcccagcactttgggaggtcaaggtgggcagatcacctgaggttgggagtttgagaccagcttgaccaacatggagaaatcctgtctctactaaaaaatacaaaattagctgggcttggtggcacatgcctataatcccagctacttgggaggctgagacaggagaattgcttgagcccgggaggcagaggttgcagtaagctgagattgcactgttgcactccagcctgggcaacaaaagacaagagtgaaacttgatctcaaaaaaaaaaaaaaaaaaaaaaaagatttgagatgatgaatatgctaattaccttgatctgatcactatacattatatgtattgaaacatcactataccccagcaatatgtataattattacgtgtcaattaaaaaaacttatttttggctgggcgtggtggttcacacctgtaatcccagcactttgggaggctgagacaggcagatcacttgaggtcaggagttcaagaccagcctggccaacatggagaaactctgtctctactaaaattacaaaaatgagccaggtgcattacaggtgcatgcctgtaaccccagctactaaggagactgagcaggagaatggcttgaacctgggaggcggaggttgcagtgagttgagattgtaccactgcactccagcctaggcgatagagtgagactctgtctcaaaaaaaaaaaacaaacacacacacacacacacacacacacacacacaaaaaaaaaacatatttttaaaaagactaggctggctttgtagccagacaatctgggttcaaattccagatttgactctactactatcgagttgtggaatcagaggcaagttgcttacccctcagaggctcagtttccacatc

SEQ ID NO: 4625 - DNA, 1165 bp, Homo sapiens
gggtcgtggccgccgctgccgcgctgcagctcgggatcccagtccggcgcgctccgggccgcatccttagccggcctcctggcggccgcgggattatttcattcccaacggagagctaggaagaaaggagactcccccgcggagcggttccgtgctctggcagggtgtagacgtttgtctgtgcgattcgccggctgcgcaaacgacgcgggagagagccggtcccgggctgcggcggcgcggccgcggggatgagccggccatggagcggccttggcggggcgcacgcagcggactggcgctgccgcgggagcgcagcctgagccggggctccagggggcttcgaagcctccggcgccctgggggggtccctgccgccgactccgggaaggacgcgagccccgcgtggcggacactgccgcagtcaccgttctgaggcgccccgagcttgctccgcctgcagctcggtgcgctctgggcacccgggcgccttgcccggtgcacggcggctggcgcaccgcggctagattggctacaggagcggggtgcaggactggctagaggtgggtgtgtgcgcgcgttggactggagatccgagcagaagcagaaccaggcggctctgagcagccatgcttcccggggtgggcgtgttcggcaccagcctcacggcccgtgtcatcatcccgctgctgaaagacgagggcttcgcggtgaaggcgctgtggggccgcacgcaggaagaagcggaggagctggccaaggagatgagtgtccccttctacactagccgcattgatgaggtgctgctgcatcaggacgtggacttggtgtgcattaacctgccgccgcccctcaccagacagatcgctgtcaaaaccctaggtgagcgacccctaccccgcatcctccgtcccacccccgccctttaaccttctctaggttccttcccccctgcctttccctctccgcatcccagaagcttaccctgcatctacgctgccccggggatctgagatcccagatccgactcagagctccctccttcctcgtccccggccttccccacctttgcgcttccctcctgcctcctggcaccacttggacgcgcttccccacgtgtgtagattgcaggctggagaaggcgtgtgttccggggatccgaact

SEQ ID NO: 4626 - DNA, 1109 bp, Homo sapiens
tttaattgattttatttttaagtgcgcattaaaaatgttcatctaaaaagttgagtgtgattaagcttctctttatgtgttgtcatttttatttcttctacaaattgcctacatattcattgccttttttaagaatttgaactggtagtctttgtcctcctgaattttttctgtatttgtaaaacacattttgccatatgtgtggcagatttttttttctagagagtcatttgtctttgccatttgtggcatgttttgtcatagggaagttttaaatttttatgaaatagttttatcagagaattcatgaatgttgattgtctttgatagtgttgatagaattattttttctgaatttgtaagaaaatttagatgagcagtcattttaaaaatgtctttatttagacaatactgaatatcatcattataaactgcttaatgaacagaattgtctttcactcaattgtgtttggcttatatgcttttgtgttaaagtatctcataactctgtagtgttttttctgtttttttgttttgttttgtttctgtttttgtgtttttaagacagagtttcactcttgttgcccaggctggaatgcagtggcacaatctcggctcaccagaacctccccatccccggttcaagcgattatccttcctcagcctcccgagtagctgggattacaggcatgcgccaccacacccagctaattttgtatttttagtagaggcggggtttcaccatgttggtcaggctggtcttgtactcctgacctgaggtgatctacctgccccagcctcccaaagtgctgggattacaggcgtgagccaccatgcctggcctgtttctataaagtctttaggtctcagttttctcattggtgaaatgggaaggctgtactatctcacctgtttttggcttaaaagtttataaacttgttagctctgttgattattaagaatcaatacatttgcatactttgctttaaccatttatttccataatccagtagtactttatatttttgatattttgatgtaatattttgtttctgatttgttctgcttgattgaacggttgtttttaaacacaccctctttgcatttta

SEQ ID NO: 4627 - DNA, 1207 bp, Homo sapiens
atctggagagaggagggctcaggactgtgttcactttatttggtcagatgtattttatttgaaaaccatttgagcccaaaatacaagtgtacccttcccacttctggctcaagcacccgtgagccgactagacgtaatattaaaacttactgatgctgggtgcggtggctcatgcctataatcccagcactttgggaggccaaggcaggcagatcacctgaggtcaggagttggagaccagactggccaacatgacgaaatgctctcgctactaaaaatagaaaaattagccaggcgtggtggcacacccctgtaatcctagctactcgggaggctgagacaggaaaattgcatgaacctgggaggcagaggttgcagtgagcagagattacaccactgcaacgagactcgggcccagacgagatctgcctgggcgacacagtgagactctgtctcaaaataaataaataagtaaatagaacctcctgagctaccctggcttataaggattcagattactttaggaaattaggcattagcactaggaggggggaagatggctggcaaaacttctagctagcaacctatgtctagcacatgggtaactaaccatagcgagatcctgaacacatatcctctaggtgcaggtggagggaacgatgtccaatacctgaagcagaatctcacatggacggaacgtctgtatttccctctcctgcacgaatcactcatcattcttggagggcttctctgcattcctccttttcttctctcccctcccctgccttttgtcttttctaaagagtctgaactccgatttccatgctctcctgctacattaataagcaaaacctgcttgtgtgtacggttctttactggaaacatgactttttgtttctgtattggttttactgtcatccagttttctagtttaatatctagcaaaactaaatctgaatgtactcgctttttccgttaagtatgccaagcacctcggttgaaaggcttgactcaaaccagaagtcttgctggaattcgtctctgaacacttgaaaaacagaaaccctgagccgcaacaaacatgcctctgtgtgtcgggattgcctttgtctctgcttccatgtggcttttccttttgtagctatgcttagtgacataatcttccctcttctagccttctcctttcaagcctgtctgttaattaacc

SEQ ID NO: 4628 - DNA, 1195 bp, Homo sapiens
tgtatgatttcacttacgtgaggtccctagggtagtcaaatttatatagagagaaagtagaatggtggctgtcaggaactgggggaggagcctgggttgttgttctatggaagagtgcagccatagaaaagaacaagatcatgtcttttgcaggaacatggatagagttggaagctattattcttagcaaactaatacaggaacagaaaaccaaatatcacatgttctcatttataagtgggagctaaatgatgaaaactcatgaatgcaaagaagggcacaacagaaactagagtctacttgagggtggtgagtgagaggagggagaggagcagaaaaaaattttaaaaaaactattgggactagtacctggatgatgaataatctgtacaacaaacacccatgacgtgagtttacctccataacaaactgcctatgtatccccgaacctaaaatacaagttaaaaaaaacaaaaagagtttcatttcgggaagatgaaaaagttccatagatctatttcacaataatgtgaatatacttaatactactgaactgtaccgttagaaatggttaagatgagtaggcaggcgtggtggctcatgcctgtaatcccagcactttgggaggccaaggtgggtggctcatctgaggtcaggagtttgagaccagcctggccaacatggtgaaaccccatctctaataaaaatattttaaaaattagccgggcgtggtagtgggtgcctgtaatcccagctactcaggaggctgaggccagagaattgcttgaacccaggagatggaggttgcagtgagccaacatggtcccactgcactccagcctgggtgacagagtgagactctgtctcaaaaaaaaaaagaaaagaaaaaaaaagaaaaagaaatggttaagatggtaaatttcatgttgcttcttactacaattttttaaatggctaccttatttaatctctgtgagaattaaatgatatcaagtgcaaatgcctgacacacagtagatgctcggtaagtgtaacattcttttccttctccttctgaatggcttgtgaattatcacaaacattaaagagacttctagcatccaaagcctattgatatgggtagaaagggaggataagatctcaattcattttctttgcctctctcctcccttttcaaccctttgaatcaggccag

SEQ ID NO: 4629 - DNA, 1208 bp, Homo sapiens
cgccactgcactccagcctgggcaccattgagcactgagtgaaccagactccgtctgcaatcccggcacctcgggaggccgaggctggcggatcactcgcggttaggagctggagaccagcccggccaacacagcgaaaccccgtctccaccaaaaaaatacgaaaaccagtcaggcgtggtggcgcgcgcctgcaatggcaggcactcggcaggctgaggcaggagaatcaggcagggaggctgcagtgagccgagatggcagcagtacagtccagcttcggcttggcatcagtgggagaccgtggaaagagagggagagggagaccgtggggagagggagagggagaggggggagagggagagggagaggggctaacttatattgtttagaatggaaccattacagagactttcatcctgttctgaatgtgaaggtggccctgcctatctcctttctcattttgcccttttattccactcagttcttcttgtaaagtgtgtatttgccccatcagtctctcagtatgtgtagaaaccagaatggatggattttggtcatttgggtgtggacttgtggtcagaaactctttggaaggatggttatggaggtgaggattatttgtttgaggaatgaaacgataatgtacagttaatttggtgatggtatatttttagatgcaagtaaatacgagatctgaagtgtacgattcaaaagaggtcatctgagttggcgactaaaatagagagcaagattaactgtttatttttatctgtgggtgagtagggggaagagggtagaaaaatttcacgagaacagtggttcttaagcgggttttgtggagactgtggtgcagcataagagtatagactggggccaggctgtgtgacttctcattatatcttgaacatttacttgttgtgttatataatgcaacaggtattgtatcatacctgttgggcaggttatataatatgtctgggccttagttctctcatctgaaagatgtgaatcacagtagtaactgcctgatggtgttttgtgacctgaataaattaattcttgaagagaattttggtgtattggttgggtgcaatggctcacacctataaccccagcactttgggaggctgaggccggccggccacttgaatccaggagttggagagacctgcgtgggcaatatggcgaaactccatttctaccaa

SEQ ID NO: 4630 - DNA, 1222 bp, Homo sapiens
cccccaccagcccagcagaaccagtacgtccacatttccagttctccgcagaacaccggccgcaccgcctctcctccggccatccccgtccacctccacccccaccagacgatgatcccacacacgctcaccctggggcccccctcccaggtcgtcatgcaatacgccgactccggcagccactttgtccctcgggaggccaccaagaaagctgagagcagccggctgcagcaggccatccaggccaaggaggtcctgaacggtgagatggagaagagccggcggtacggggccccgtcctcagccgacctgggcctgggcaaggcaggcggcaagtcggttcctcacccgtacgagtccaggcacgtggtggtccacccgagcccctcagactacagcagtcgtgatccttcgggggtccgggcctctgtgatggtcctgcccaacagcaacacgcccgcagctgacctggaggtgcaacaggccactcatcgtgaagcctccccttctaccctcaacgacaaaagtggcctgcatttagggaagcctggccaccggtcctacgcgctctcaccccacacggtcattcagaccacacacagtgcttcagagccactcccggtgggactgccagccacggccttctacgcagggactcaaccccctgtcatcggctacctgagcggccagcagcaagcaatcacctacgccggcagcctgccccagcacctggtgatccccggcacacagcccctgctcatcccggtcggcagcactgacatggaagcgtcgggggcagccccggccatagtcacgtcatccccccagtttgctgcagtgcctcacacgttcgtcaccaccgcccttcccaagagcgagaacttcaaccctgaggccctggtcacccaggccgcctacccagccatggtgcaggcccagatccacctgcctgtggtgcagtccgtggcctccccggcggcggctccccctacgctgcctccctacttcatgaaaggctccatcatccagttggccaacggggagctaaagaaggtggaagacttaaaaacagaagatttcatccagagtgcagagataagcaacgacctgaagatcgactccagcaccgtagagaggattgaagacagccatagcccgggcgtggccgtgatacagttcgccgtcggggagcaccgagcccaggtaacgttagccagggtgg

SEQ ID NO: 4631 - DNA, 1162 bp, Homo sapiens
tcaggggattggcttaagttggatccaaatgttattcagcatcaagagtctcagcgagatgatgaacttttgactcttaaaagaacttcactgggtcattgctcagcttgcaagatttggcagatatgaactatttgtctctccagtgtgataggtggtggtgtggcgctgaacgcaagctctaagaataaaacgtgcagcaaaaggaggtcacgctttagtcagggtggccataaggaagcttagaactcacatcccctctgcccctgcctcgcccagtctcattttctctccttcactagaacagtgaatgaatctgagctcattcatgtcaagatgatagagaagaaagatcactttctcttagctggcttagggaaggccagattgtctttcttacactgagtgaaaaattactgaggacttttgttttttttttttttggtcttcaaggcaacatctcttgcttttacagacccacggaaatcgagaagaggatgcaagatttactattcgtgccctagcctggcagcttcagcctacatcacagctgtaatcatatgtgatgcatttttatttacagattagtaggctctgactctgacatatgactaaccgggaagctcctccctgtaacagttgtatgtcgtctgcttcagagaactaattgcttggcaattcccctttggtaattccctctttattttctgatgagttacttaacagcgatgggcttgttgagcagagcgtggagtttaatgtgtgctccagaaactccactgtaggcctgggggatatgtttttcgagttctgtttagctttactgaaggaacagtgaaaccattatatggcctgttaatatttcactcaataccagattaaacaccgagcagcgtgcagttttccaaaagaaatcaaaaccaggcttctttttaaaatgtgcccctgtgcattagaaaattattaaaaaggaatttaatatgtatagaatgtttaatgatcttttgaaaatatggtttcaaatggagtagtcttccaggaccctacagagtgagtatggtgtgctgttggactggtagtttggaggctcagtttctgttgcctgccctgcaacaggatgacttgtgctactcactgtaccttgctgggtctcagttttcct

SEQ ID NO: 4632 - DNA, 1316 bp, Homo sapiens
ccccttacccttgtgctgctcatggtaaatgttagcatttggaaattttgctcagagcatcatgtcacattatgaagtttttatttttcacaggtcaaatgggaaaaatgtgttctcttcttctggaacttcattctctggtcgcaagataaagactgctgttagacgcaggaaataaaggtcacattggtgttgtactcaattttaacaacagctggtgccctgctttcagatactggattgtactttgtgctggggttatctgaagtcagatctgcctaaggacttctttaattttggaattttcctcctttctctttcgttacagaagccccaccctgcctcacccacccttttttaaataaataaatagctagactggtgactgattcttcagcaaaaatattttatgatccagcagattattcactgatttgacatagtctggctgtacccaggaatggagcctgcacggtgaatggctttgtatagaacctctttgtctacaccattatgtgcgctgataagcgttcatggaacgcgttgaaattgtaattatatctgaggaattctgtatagattagaattctgtatagattagagagtgttgaaacggatgatttctatgctgagtttgtgctggtgtatgtgtgaagtgagtgagttgggtgtattgtgcgctaaacttttctgatagaggaagcctgattaaagaatggtccgtgctaaggacttgttagatctagttcactctccatttaataattatatgctatttctatattttcattctcctatcacctgtcttgcctttttcattattttattatgaaacttgtgtaaatacaattttgtttctgtactttttggcataacataaatctgtgaacttgaaatttgaattttgtgttagagatttttttgttgtttgtttagtcttgtctcagattttattatgtaaatcccattattcaaagttgcctaaatccatttggaaatctttaaaaaaaaaattggggattcttaaagttgaatttattggcttttctgatccagttttgtttggaccaaaaaccagtattgtacaaagtattaagcatatatttttatatttactaaaatggactgtggtgactttggataataaggaaaagtttaatattaaagccatgtttattacagtataattaacatgttaaaccatgggataaatgccatcaataaaaaattatgacatactttttgttctagttttacctcataatgaaggcacacagtattattggggggactttgtaaaataaagattaacagtg

SEQ ID NO: 4633 - DNA, 1465 bp, Homo sapiens
tgtggtttttagtgcacttaatattagcttgcttaaggcatacttttaatcaagtagaacaaaaactattatcaccaggatttatacatacagagattgtagtatttagtatatgaaatattttgaatacacatctctgtcagtgtgaaaattcagcggcagtgtgtccatcatattaaaaatatacaagctacagttgtccagatcactgaattggaacttttctcctgcatgtgtatatatgtcaaattgtcagcatgacaaaagtgacagatgttatttttgtatttttaaaaaacaattggttgtatataaagtttttttatttcttttgtgcagatcactttttaaactcacataggtaggtatctttatagttgtagactatggaatgtcagtgttcagccaaacagtatgatggaacagtgaaagtcaattcagtgatggcaacactgaaggaacagttaccctgctttgcctcgaaagtgtcatcaatttgtaattttagtattaactctgtaaaagtgtctgtaggtacgttttatattatataaggacagaccaaaaatcaacctatcaaagcttcaaaaactttgggaaagggtgggattaagtacaagcacatttggcttacagtaaatgaactgatttttattaactgcttttgcccatataaaatgctgatatttactggaaacctagccagcttcacgattatgactaaagtaccagattataatgccagaatataatgtgcaggcaatcgtggatgtctctgacaaagtgtgtctcaaaaataatatacttttacattaaagaaatttaatgtttctctggagttggggctcttggctttcagagtttggttaatcagtgttgattctagatgatcaacataatggaccactcctgaatgagacttaattttgtctttcaaatttactgtcttaaatcagtttattaaatctgaattttaaaacatgctgtttatgacacaatgacacatttgttgcaccaattaagtgttgaaaaatatctttgcatcatagaacagaaatatataaaaatatatgttgaatgttaacaggtattttcacaggtttgtttcttgatagttactcagacactagggaaaggtaaatacaagtgaacaaaataagcaactaaatgagacctaataattggccttcgattttaaatatttgttcttataaaccttgtcaataaaaataaatctaaatcactggtgttttaagtcacttgcatttgatatcttataggtgtatatagcatttccttatggggaataattctgaaaagggatttttaaattgattcagccctataacctatacaatttggaatactcttttgtggtaatggaccattttcttggagtgacttcacaaaactgaataattaaggttaattttatgaccatttgctataaagaaggtaagtagtc

SEQ ID NO: 4634 - DNA, 1164 bp, Homo sapiens
cccagcatgatttctggagcattgatgagaccgctgattaattctcctccgcctcagagtaacactgtcgatagcgacttcggagatctctaaacttctttaccgcgcccgccgcgcccctccgcggcccgggactgctcatcatcttttccaggaagcgaccgtggaaacaataaacacgcaggccccctagcgtccttccgttccgcgctgccaggccgcctcgcctcccgctcccgcccgccccgcgggacacagcccgcccgcactccggggcccgagcgccgaccacactccaggcgcagccggggagagccccgcgcgcgcatccctccgcccgcggccgaggcgacccctcgcggtcccgcccgcccgagcttcccgcggaggcacccggccgccccgcctcccccgccccgcgcccgccaactcccagctcgcggccctgattggtcgccgcattcccgctctccttcccgaaccgccattttgaaaatcttgttgattctggggagccgagcgcgcggcgcgagcgtcacgccagacagcggcccgcgcgccttctcctcggcgtcggccgccgccgcctcccagaacctcctcgtgccctcgcgtgccaggcccgcggcggccgaaatccgcggtaagggctgcttcgggacgccggaggcccggtcgcccctgccgcggccgacgggggagggacgcggccatttggacggcggcctggggcgggggaggggacgtggagggccggcagctcgggccgggccgggaacagcgcaggccgggcgggcgcgcgcgcacgcggggcagcgggcgcggtttcccgcctcgggaatccctggacggcggcggcggagcgggagggaagccgcccctggggactgagcgctgcggtcccggctatgggaggaggcaactttcagggcaggtgtcccgcgggaagggtagcatcattcagggtggccgcccggtcctgcctgcgggagtaggaggaccgagacgtccggctttcttcccgcatgcaggttcacagcatgtccgcctcggcccctgctgcggagggggagggaacccccacccagcccgcgtccgagaaagaacccgaaatgcccggtcccagagaggagagcgaggaggaagaggacgaggacgacgagg

SEQ ID NO: 4635 - DNA, 1225 bp, Homo sapiens
caccctcgtgggcatgggagctgccccggtgtcctcccgtgcagtctgtcacccacaaagggggacgcgggcagggcgccggagtgggtcccctctccgggcttcccgagggccgcagctgcctgctcggcgcctggcccggccgcgggcgggtgttgtctgacctggtggtttgttttgggttgttgatcaagcatgtcttgagtttggtcggtggcgccagttagtctgcagcgagaaggttcacacaccccctctattcattcctcttccacaggtgtgcggccgcctgagcccgagccaggagcactagagagggagggggaagagcagaagttagagaaaaaaagccaccggaggaaaggaaaaaacatcggccaacctagaaacgttttcattcgtcattccaagagagagagaggaaagaaaaatacaactttcattctttctttgcacgttcataaacattctacatacgtattctcttttgtctcttcatttataactgctgtgaattgtacatttctgtgttttttggaggtgcagttaaacttttaagcttaagtgtgacaggactgataaatagaagatcaagagtagatccgactttagaagcctactttgtgaccaaggagctcaatttttgttttgaagctttactaatctaccagagcattgtagatattttttttttacatctattgtttaaaatagatgattataacggggcagagaactttcttttctctgcaagaatgttacatattgtatagataaatgagtgacatttcataccatgtatatatagagatgttctataagtgtgagaaagtatatgctttaatagatactgtaattataagatatttttaattaaatatttttttgtaaatattatgtgtgtgtttttttttaatctatgggaatatttcttttggaaaatcatttttcagctcaattacagagctcttgatatcttgaatgtcttttctgtttggcctggctcttaatttgcttttgttttgcccagtatagactcggaagtaacagttatagctagtggtcttgcatgattgcatgagatgtttaatcacaaattaaacttgttctgagtccattcaaatgtgtttttttaaatgtagattgaaatctttgtatttgaagcatacatgttgaaaatacaccttatcagtttttaagtacagggttttatagtgtaatatat

SEQ ID NO: 4636 - DNA, 1099 bp, Homo sapiens
agtgggttatcaaacttttggatttttgccaatctcatttgtaaaatatactttattgatatggtttagatttgcataccttttttaaaaaagcaaaagcctggacatcttttcaagatgtttaaaggccatttgttggccaggtgcggtggctcacacctgtaatcccagcactttgggaggctgaggagggtggatcacgaggtcaggagatccagaccatcctggccaaccaacatggtgaaaccccgtctctactgaaaatacaaaaaaattagctgggcatggtggcacacacctgtagtcccagctgctcaggaagctgaggcaggagaatcgtttgaacccgggtggcagaggttgcagtgagccgagatcgcaccactgtactccagcctggtgacagagtgagactccatctcaaaaaaaaagaagccatttgtttttcttgtttctttctttttgtttgtttgtttgtttgtttgtttgttttgcaaactgtacttaattcctgtacgtgatttactcttctgttggattcttgctctttttcttgttgatttgtaagggctctttatataatagggagattagctctaagtctgtgatatgatcttcaaatttttcttggtttatcatttcctttagtatttgtggggtttttttggtcttatacagaattttccattctttcttttatggcttctggatttcgagtcacagaaagcatttccaccaaccccttccacacatacacgcacaagaattgacccatattttcttgcagaatttctatgctattactttttttacatttaaatatttgctccatttgaggtttatcctgatattctgttaagtatggattcaagttttttgtttttgtttttgtttttgttttggaaataggctctcactctgttgcccagactggagtgcagtggtgcagtgacggctcactgcagcctcgacctcctgtgctcaggtgattctcttgcctcagcctcctgagtagctgggaccacaggtgcacaccaccatgcctggcaaattttattatttgtggagacgaggtctcgctacattgtccaggctggtc

SEQ ID NO: 4637 - DNA, 1102 bp, Homo sapiens
gccaggatggtctcgatctcttgacctcgtgatccgcccgcctcggcctcccaaagtgctgggattacaggcatgagccactgcgcccggccccagccagagttttaaaatatgtaacccttattagaagcctttctcgtttttttttggtggaaagaagggggtatatatcccactgcagtctataccacaggaacatggtcagtctgttaatttcagtgctgagttgggatttgaaagtaagctgtttcttggccgggtgcgatcgctgtcgcctgtaatccctgcactttgggcggcctaggcaggtggatctcctgaggtcaggagttcgagaccagcctggccaacatggtgaagccccgtctttactaaaaatacaaaaattagcctggtatgatagtgcatgcctgtaatcccagctactaggaaggccgaggcaggagaatagcttgaacctggagggcagaggctgcagtgagctgagattgtggcactgcactccagcttgggtaacaagactgaaactccgcctcaaaaaaaaaaagtaagctgtttcttcagttatagatagcagtgtcagcagagtgctacctggtccattcctacctccttaatcataagtataaagtaattgatccagtggaacctcaataggatatttttggaaattctagtggattcaatgaaagaatcatcaactatcttagtatagggctgttaacttatactttctacacataactctttaatctagctttcttgctcctttactatcaccatgattatttacatttatatagtgtcttacagtttgtaacatacatttagctctgctaattttgtatagcttgtacctgaagataaaggaaaaacaaaatgttaacttaggccttacagaaattatttaaaaacatcctgacataggccaggtgtggtgactcacacctgtaatcccagcactttgggaggctgaggcgggcagatcatgaggtcaggagatcgaggccatcctggctaacacggtgaaatcctgtctctactaaaagtacaaaaaaattagccgggcatggtggtgggcgcctgtagtcccacctactcg

SEQ ID NO: 4638 - DNA, 1204 bp, Homo sapiens
ggcagcagaaatctcagctgtacttctagcccttttaaaaagtttgctctgtaaattggaatgaggtcagatttggagcttctcattgcacgcggagattattattgcatcgggttccaagccaatgggaagcccgggggaggggtttggcatgaggaagcgttggttacagcagctgattggctgcagccaagactgtgaaaggataaagaggcgcgaggcggaattggggtctgctctaagctgcagcaagagaaactgtgtgtgaggggaagaggcctgtttcgctgtcgggtctctagttcttgcacgctctttaagagtctgcactggaggaactcctgccattaccagctcccttcttgcagaagggagggggaaacatacatttattcatgccagtctgttgcatgcaggctttttggcttcctaccttgcaacaaaataattgcaccaactccttagtgccgattccgcccacagagagtcctggagccacagtcttttttgctttgcattgtaggagagggactaagtgctagagactatgtcgctttcctgagctaccgagagcgctcgtgaactggaatcaactgcttcagggaaaaagaaaaaaaaaaaaaaaagacttgcctgggaggccgcgagaaacttgcattggaagcttcagcaaccagcattcgagaaactcctctctactttagcacggtctccagactcagccgagagacagcaaactgcagcgcggtgagagagcgagagagagggagagagagactctccagcctgggaactataactcctctgcgagaggcggagaactccttccccaaatcttttggggacttttctctctttacccacctccgcccctgcgaggagttgaggggccagttcggccgccgcgcgcgtcttcccgttcggcgtgtgcttggcccggggaaccgggagggcccggcgatcgcgcggcggccgccgcgagggtgtgagcgcgcgtgggcgcccgccgagccgaggccatggtgcagcaaaccaacaatgccgagaacacggaagcgctgctggccggcgagagctcggactcgggcgccggcctcgagctgggaatcgcctcctcccccacgcccggctccaccgcctccacgggcggcaaggccgacgacccgagctggtgcaagaccccgagtgggcacatcaagcgacc

SEQ ID NO: 4639 - DNA, 1152 bp, Homo sapiens
ctccaaaccggcgcagaaaaagagctgcggctccaaagtggcgggcggcgcgggcggtggggttagcaaaccgcacgccaagctcatcctggcaggcggcggcggcggcgggaaagcagcggctgccgccgccgcctccttcgccgccgaacaggcgggggccgccgccctgctgcccctgggcgccgccgccgaccaccactcgctgtacaaggcgcggactcccagcgcctcggcctccgcctcctcggcagcctcggcctccgcagcgctcgcggccccgggcaagcacctggcggagaagaaggtgaagcgcgtctacctgttcggcggcctgggcacgtcgtcgtcgcccgtgggcggcgtgggcgcgggagccgaccccagcgaccccctgggcctgtacgaggaggagggcgcgggctgctcgcccgacgcgcccagcctgagcggccgcagcagcgccgcctcgtcccccgccgccggccgctcgcccgccgaccaccgcggctacgccagcctgcgcgccgcctcgcccgccccgtccagcgcgccctcgcacgcgtcctcctcggcctcgtcccactcctcctcttcctcctcctcgggctcctcgtcctccgacgacgagttcgaagacgacctgctcgacctgaaccccagctcaaactttgagagcatgtccctgggcagcttcagttcgtcgtcggcgctcgaccgggacctggattttaacttcgagcccggctccggctcgcacttcgagttcccggactactgcacgcccgaggtgagcgagatgatctcgggagactggctcgagtccagcatctccaacctggttttcacctactgaagggcgcgcaggcagggagaagggccggggggggtaggagaggagaaaaaaaaagtgaaaaaaagaaacgaaaaggacagacgaagagtttaaagagaaaagggaaaaaagaaagaaaaagtaagcagggctggcttcgcccgcgttctcgtcgtcggatcaaggagcgcggcggcgttttggacccgcgctcccatcccccaccttcccgggccggggacccactctgcccagccggagggacgcggaggaggaagagggtagacaggggcgacctgtgattgttgttattgatg

SEQ ID NO: 4640 - DNA, 1200 bp, Homo sapiens
ggaacctctgtcctcaactcatctgtaaagtgttttggatcagttgacataggtactcacagattggccacaacaatagaaaagacaaaggcagccaggcgctgtggctcatgcctgtaatcccagcactttgggaagccgaggcaggcagatcacaaggtcaggagttcgagaccagcctgtccaatatggtgaaaccccatctctactaaaaatacaaaaattagctgggcgtggtggcgggcacctgtagtcccagctactggggaggctgaagcaggagaacagcttgaacctgggaggcagaggttgcagtgagccgagatcgcgccactacactccagcctgggagcagagtgaaactccatctcaaaaaaaaaaaaagacaagacaagacaaaggctagcttttccactggtagctgaatgctatatactaatttaggaagtttttgtcactaagtatatgatacacatgttgggagtatgttaattattttctcttttaattgaagtgaaaagagcagtgctgggattgaccatgcagaagagatggagttgctgttggaaaactactaccgattggctgacgatctctccaatgcagctcgtgagcttagggtgctgattgatgattcacaaagtattattttcattaatctggacaggtaagaaagcattatataaaactaagtttttttaataaaataattataagaaagtttttaaggaaatattttgtgaggaattacgccatcattatcatctatactacattattattattttttttgttgtgtaggtttcatccatgtggtctgtatagatttgatgaatgtgctgtatatagttagtgggcccttctaatctgaataggtgttctcctctccagccaccgaaacgtgatgatgaggttgaatctacagctgaccatgggaaccttctctctttcgctctttggactaatgggagttgcttttggaatgaatttggaatcttcccttgaagaggtgagaatgtattattatttctaaaacttgggggttttggccgggcatggtggctcatgtcagtaatcctagcactttaggaggctgaggcaggtggatcacctgaggtcaggagtttgagaccaacctggccaacatggcgaaaccctgtctctactaaaaatacaaaaattagacaggcacggtggcag

SEQ ID NO: 4641 - DNA, 1145 bp, Homo sapiens
tgaaatgagtgaaaacctgagtgatcctgtgtctcccgtggtgcgagtgagtcgctgccgctgaaggcaaggggtgggggtgggacctgcgggggtggaaggcaggtggtctccgggcaccgcctgggatttgggagaagaacccgccacctttgcctcggcaatgctcacaagaagataaatcgcactccccaccattttgaacgggggcagatccacagggaagtctcccttggggaatgtaggactagttgcaggctgggggtgttgggaacccgggcattaatcaggtctaaccacagagccggaataattaataccgtattatataccccttttccttctgccgtcatgattctccttggcagcagcgttagcagccgcctgagggtgaaaatgtgggtgatggggaagttggtaatgactccgctgttttttctcatggctcctttgggccacagctgcccgcccccggtatacactgtagttgattgcagggaaaccctgtacctctccctttccttctctaccgattttgcacttttctctatgctcaccaccaagtgtaatcaataacaagcactgacaatacatagcaatagtgaaatctgaaataactaagaattaggtactacagccatggagctggctgggtaaaatctaattggatatttcagtttcattcacctaccctgttttggtgtttggttttggttttggttttggtgagttttttttttttttttttttggaaagcaaggatcacacttccccctccctgttccttaatcccttttctaaaaaggggggaaaatccggatggattttagggattggtctggtgtcagctgtgttttattgcacacctaaatcctgattataggcttttcatttctccgcaaagcctttattttggcagttaagccaaatgtgttttccagaaagttagttattttctcctctttctttcctttctttcctccctttttcccgtctgaccccaaacgttattgtccaaacatgactggacagcagcttttgtttcttgaccctgtaatatgacagtctgctaatattgacagaaggtgcagtttttgggttatagtcgtgattttcgctaatcaatcatattagcaggaaaaaaa

SEQ ID NO: 4642 - DNA, 1194 bp, Homo sapiens
taaataatcatctgtagagttggaatagaatatagtagccggtgaaactgcacgattgttgctggcttaaagatagaccaatcagagtgtgtaacgtcatatttagcgtcttctatcatccaatcactgcactttacacactataaatagagcagctcatgggcgtatttgcgctagtgttgggtgttccgctgtgctgtttttccgtcatggctcgcactaagcaaactgctcggaagtctactggtggcaaggcgccacgcaaacagttggccactaaggcagcccgcaaaagcgctccggccaccggcggcgtgaaaaagccccaccgctaccggccgggcaccgtggctctgcgcgagatccgccgttatcagaagtccactgaactgcttattcgtaaactacctttccagcgcctggtgcgcgagattgcgcaggactttaaaacagacctgcgtttccagagctccgctgtgatggctctgcaggaggcgtgcgaggcctacttggtagggctatttgaggacactaacctgtgcgccatccacgccaagcgcgtcactatcatgcccaaggacatccagctcgcccgccgcatccgcggagagagggcgtgattactgtggtctctctgacggtccaagcaaaggctcttttcagagccaccaccttttcaagtaaagtagctgtaagaaaccaatttaagacaaaagggaatgcattgggagcacttttcgttttaatgctactgaaggcttcaaaaccaatcgatttcggccggtcgcggtgactcacgcctgtaattcaagcactttgagaggctgaggcgggcggattaccagaaatcaggagttcgggatcagcctggccaacatggccgaatcccgtctctacgaaaaatacaaaaacacgccgggcgcgacggcgagcgcttgtaatcccagctacactctgaaggctgaggcaggagaaacacttgaacctgagaggcagaggtttcagtgaatcgagatggctctaatgtactccagtctgggcgacagagagattcggttaaaaaaaaagttcgacttaaaataattctggagtcagaatgggtttacatttaattcttaacccagttcctcaaagcctgtagctctgttaagaaaataaaggccattggtcaagcctgcttggtcccaccctcat

SEQ ID NO: 4643 - DNA, 1206 bp, Homo sapiens
gcacttgaaagacttaaaaagtttaccactccggcatattagtgaaagcccttaatataagcccttattaaaattctcagtcgagggtataaattcagattcaaatagtagtgtcgtaaacgggagggaaaaactaaagggattaaaaagtgaaactattgtgttctccctcgcagtccttaggtcactgcccctcgaggggcggagcaaaaagtgaggcagcaacgcctccttatcctcgctcccgctttcagttctcaataaggtccgatgttcgtgtataaatgctcgtggcttgctttcttttcgcgtacctggtttttgttgtcagctggttagacatgtctggtcgcggcaaaggcggtaaaggtttgggtaagggaggtgccaagcgtcaccgaaaagtgctgcgggataacatccaaggcatcaccaaaccggccattcggcgccttgctaggcgtggtggggttaagcgaatttccggtttgatttatgaggagactcgtggcgttctcaaggtgtttctggagaacgtgatccgggacgccgtgacctacacggagcacgccaagcgcaagactgtcactgccatggatgtggtttacgcgctcaagcgtcaaggacgcactctgtacggcttcggcggttaatcttttcgtcagttttcttccaatggcccttttcagggccgcccactccctctcagaaagagctgtgattgtattctttcggatggtaacatctcaatggctttactcggctattctgcctagtatgtagaactattataaaccagttgggagagaccaggttgtttggtctgagtggctgctaaagcagaaatcagctaagtaaacgaggtctccgagataagtgagctataaacttcaatgctatagttttgacatgtcaagcaacttaacgtgcagcgcgagtccgataaatgagtagctcagctttttagttttaaaaacgagttgtgcgttatttgtacgagagcctaagatgctagctgcctggaactgagtaggtggattaaaatgggtgtcaggtctgttttcccaggcgtatctgacttaacgtcagcaaaagctgtacttttagcttccctggtaacacctgccgtccttaaccgccccctgccggtagcgccagaagcctttacttccatttctagttgagcttggcgtcctgctgagtgac

SEQ ID NO: 4644 - DNA, 1292 bp, Homo sapiens
cggctaagagcatttttctaattgcccacacttcttatgcgacacccagaaaaatacaattttaaataaagcgcatatgcaaatttccctaatcgtctccaatattctctgatttcttttttatattttaactagaaacaattggaggtttccgcgttgctttgtgtggttgtaaattttaagacttcaggaaacttttccagtacaagacttgtccacagtggatatagcagctaaggggttaacaaaatgacgtcagagtagctacggtaatgggcaggagcctctcttaatctgcaaccaggcacagagatggaccaatccaagaagggcgcggggatttttgaattttcttgggtccaatagttggtggtctgactctataaaagaagagtagctctttcctttcctccacagacgtctctgcaggcaagcttttctgtggttttgccatggctcgtactaaacagacagctcggaaatccaccggcggtaaagcgccacgcaagcagctggctaccaaggctgctcgcaagagcgcgccggctaccggcggcgtgaaaaagcctcaccgttaccgcccgggcactgtggctctgcgcgagatccgccgctaccaaaagtcgaccgagttgctgattcggaagctgccgttccagcgcctggtgcgagaaatcgcccaagacttcaagaccgatcttcgcttccagagctctgcggtgatggcgctgcaggaggcttgtgaggcctacttggtagggctctttgaggacacaaacctttgcgccatccatgctaagcgagtgactattatgcccaaagacatccagctcgctcgccgcattcgcggagaaagagcgtaaatgtaaagtcactttttcatcagtcttaaaacccaaaggctcttttcagagccacccacttattccaacgaaagtagctgtgataattttttgttgtcttaacagaacaaatttctaaggacccccccggaaagcattagactatggtcttaaagttgattaacagaaataacggtttggtcagtcttgcagtgtaggttatttctgaccttattaaggtgctatttggagagaagctgtgtaagtccactatcattcaggcctctagcttgctatgattagcatttgtttaaacaactttgtaagagtaagggaaaaatctggtaagtagttaactggcgcttactaggcatttttgcaaagctttgaaaagattagaaaattgtgtcttgcgagttccagtgtcttcctcaaaatgcttaggaagat

SEQ ID NO: 4645 - DNA, 1228 bp, Homo sapiens
tgctttggactggccgtggaatccttgtcccagtccacagttcctgtgcgactgcacgaagaattcacagaggacctgtgttacttcccttgtgaagaaacagaattatcatgaaaatttaggtggaaaccatttcgcttttttcttcaaaaataagggaagcatgtgcccaaccacccctgggaaaaagaaccttcaggggcaaaggagcgaacaggtaatttataagaaaaacagaaagtggtctctgactgccccagacttccttcggagttgggggaattggggacgcctggacgcgttgtttttgtgtttgtggaaaaaataaatgaagagcatgaagcccgaggcttctgagatcctttcctgaccaaacccaagtgatttggtgcggggaattttaatatttttccccttttgtgaggtggaacaaacacaacttgggagcagcgcagcggctcagagcctgccagccaggcgggcgaccagagcaccaatcagagcgcgcctgcgctctatatatacagcggccctgcccaggcgctgcttcatcggcgctttgccacttgtacccgagtttttgattctcaacatgtccgagactgctcctgccgctcccgctgccgcgcctcctgcggagaaggcccctgtaaagaagaaggcggccaaaaaggctgggggtacgcctcgtaaggcgtctggtcccccggtgtcagagctcatcaccaaggctgtggccgcctctaaagagcgtagcggagtttctctggctgctctgaaaaaagcgttggctgccgccggctatgatgtggagaaaaacaacagccgtatcaaacttggtctcaagagcctggtgagcaagggcactctggtgcaaacgaaaggcaccggtgcttctggctcctttaaactcaacaagaaggcagcctccggggaagccaagcccaaggttaaaaaggcgggcggaaccaaacctaagaagccagttggggcagccaagaagcccaagaaggcggctggcggcgcaactccgaagaagagcgctaagaaaacaccgaagaaagcgaagaagccggccgcggccactgtaaccaagaaagtggctaagagcccaaagaaggccaaggttgcgaagcccaagaaagctgccaaaagtgctgctaaggctgtgaagcccaaggccgctaagcccaaggttgtcaagcctaagaaggcggcgcccaagaag

SEQ ID NO: 4646 - DNA, 1260 bp, Homo sapiens
ttccgtaatttattagttagcaagtggaaataaaaagaaatgtggaatggggctatgcttagcgtcattaagctgacaggaatacagcgcattcaacttgcaaacacccttccactcccacaaagagcaagctgtcactggccaatcaaaacaatgaaccataatgaaacagtttttcttgctccacccacttggtgaccaaatttgaaaaaaaaaaaaaaccgcgccaactcatgttgttttcaatcaggtccgccaagtttgtatttaaggaactgtttcagttcataccttccactgcgataggaatcatgtctggtcgcggcaaaggcggaaaaggcttggggaagggtggtgctaagcgccatcgtaaggtgctccgggataacatccagggcattacaaaaccggctattcgccgtttggctcggcgcggtggcgtcaagcgcatttccggtcttatctatgaggagactcgaggtgtgcttaaggttttcttagagaacgttattcgagacgccgtcacctatacggagcacgccaagcgcaaaactgtcacagccatggatgtagtatatgccctaaaacgtcaggggcgcactctgtatggcttcggcggctgaatctaagaatacgcggtctcctgagaacttcaaaaaacaaaaacaaaaaaacccaaaggcccttttcagggccgctcacaaagtcgtttaaagagctgaaatgcgttgcgagaatgagtttggatgacagaaataaccgtgacatcctgcataagaatgaattgtgtttgccatgaccggccacactgtgacaaaatttcaaagcataaagtaggcatagagaggtaagcgctaataaagtgattggctccacaaaaagcattttgctgggcgcagtggctcacgactgtaatcccagcactttgggaggccaaagctagtgtatcacttgagatcaagaatccgagaccagcctggccaaaatggtgaaaccccctctaccaaaaaaaatacaaaacttagccgggcgtggtggtctgcacctgtaggcccagctagcccggaagcagagattgcagtgagccgagatcgcgccactcccctccagcctgggagacagagagagactcctcaaaaaaaaaaaaaaaaaaaaaaaaaaaaattatgtattttagagcattctaagaatggtactttggacttaaccgaagggctggaggcgcgtgttgaacaaaggttatcaccttttggctcatgc

SEQ ID NO: 4647 - DNA, 1213 bp, Homo sapiens
tgatgaactcaaatgccctcggctcaataggcaggactctccgaggagcctgtgttacttccctcacttaagtgcagatttgtaataaaaatcttaatgccagtggcatgctttttggatatataagaagctaaccacttggagtatcatatttgagaggtcagaaaagtccacagttaaagatcggtttataatttacgaagaaaatagaaagttttgtttctctgagttgaaatttgccaagcacggcgggaaatattgcaagtttttggcacaaggctttgtgcttcccttataatttgagatctgcgtgaagcctgagggttcggggatcattatctgagaaaaaccgggcagttcggtgtagacaatttttatatttttggctttttttgaggtgtaacaaacacaactcgggatccgagaggacactctgcggctgccagcgaggcgggctggacagcgcaccaatcacggcgcagctccgccctatataaacgggcgggcgcagcgccgcggctcgagtcccggccagtgcctctgcttccggctcgaattgctctcgctcacgcttgccttcaacatgtccgagactgcgcctgccgcgcccgctgctccggcccctgccgagaagactcccgtgaagaagaaggcccgcaagtctgcaggtgcggccaagcgcaaagcgtctgggcccccggtgtccgagctcattactaaagctgttgccgcctccaaggagcgcagcggcgtatctttggccgctctcaagaaagcgctggcagccgctggctatgacgtggagaagaacaacagccgcatcaagctgggtctcaagagcctggtgagcaagggcaccctggtgcagaccaagggcaccggcgcgtcgggttccttcaaactcaacaagaaggcggcctctggggaagccaagcctaaggctaaaaaggcaggcgcggccaaggccaagaagccagcaggagcggcgaagaagcccaagaaggcgacgggggcggccacccccaagaagagcgccaagaagaccccaaagaaggcgaagaagccggctgcagctgctggagccaaaaaagcgaaaagcccgaaaaaggcgaaagcagccaagccaaaaaaggcgcccaagagcccagcgaaggccaaagcagttaaacccaaggcggctaaaccaaagaccgccaagcccaaggcagccaag

SEQ ID NO: 4648 - DNA, 1181 bp, Homo sapiens
tgcagaaaaatacttggtccttaaatgtggcatttggatggattaaggacttgccgaaacgtaaaactgacagacttgggggggggggatgtcccaattagcacggcttctgtatgcaacgagtcccatactttgttaaaggaagaaaggaatgtgagttctcctaatctgttaagtatctttcggtgtaagttctgacaccacaatgttaaaaaagtcggatctcaaaaaccaactgctccaagcgaagtgcacagctgtcttgcctaaagaggcctatttatagtagcctcgggtagtctggtctgggctttctcattgggtacaagtaaaggaacgaaatagccaatgaaaaggtagacttttaagtgtcgtttacattggcatttgtgacgacactctaaaattaatccaatcataaacgaaatctgattaacctcatttgaataccgcatctataaatgaacagggcctcggcgggagtgattattttctcaggtgtttgcaacagtgttctaactattaacgctacgatgcctgaacctaccaagtctgctcctgccccaaagaagggctccaagaaggcggtgactaaggctcagaagaaggacgggaagaagcgcaagcgcagccgcaaggagagctattcagtgtatgtgtacaaggtgctgaagcaggtccatcccgacaccggcatctcttccaaggcaatggggatcatgaattccttcgtcaacgacatcttcgagcgcatcgcaggcgaggcttcccgcctggcgcattacaacaagcgctcgaccatcacctccagggagatccagacggccgtgcgcctgctgcttccgggggagctggccaagcacgccgtgtcggagggcaccaaggccgtcaccaagtacaccagttccaagtaactttgccaagtaagcatctttacacctaatcccaaaggctcttttaagagccacgcatgttttcaataaatgagttgtaatcatttcattcaaaaggggggttattggacttagcaccacagtaccaatctttaatgttacgttagtactgcagaggaaataacttggaagttacagggaataacaataggtactagaaattgagtgctatgggtacgtattagatcgttagctcatttagtatcacataacactagcataaactga

SEQ ID NO: 4649 - DNA, 1198 bp, Homo sapiens
atgatgcccatggccttggatgagatgccggtgtcggggtggacctgctttagcaccttgtacacgtacacggaatagctctccttgcggctacgcttgcgcttcttaccatccttcttctgcgccttggtcaccgcctttttggagcccttttttggagcaggagcggacttagcaggttcaggcatgataaataaacacttcgtccacaacctaaagagaaatgcaagtgtcctcactctgcagctggtaatatttgtagagctcctatcgtaaactggcatttaaaagcttacacattgattggatgaattgtctctgtgtgccctgtggtatgcaaattaggtgattctagcgtttctttgcaattggttggttgttctagccaatcaaatagcgttatttacaattcgacctccaagtataatagtttctcacttgctaacaaaattcacttttacatttttgtcttcattgcttaacatcgtttttaagaattcaaaatgtccggacgcggcaagcaaggcggaaaggcccgagctaaggctaagacccgctcttcgcgggccggactccagttccctgtgggccgcgtacaccgcttgctccgcaagggcaactactccgagcgagtcggggccggcgcgccagtgtatctggcggcggtgttggagtacctgaccgccgagatcctggagctggcgggcaacgccgcccgcgacaacaagaagacccgcatcatcccccgacacctgcagctggccatccgcaacgacgaggagctaaacaagttgctgggtaaagtcacaattgctcagggcggtgttctgcccaacatccaggctgtactgctccccaagaagactgagagtcaccacaaggccaagggcaagtaaaacgagaactcttatattggctttttaaggaagcagtcttaacaaaggctcttttcagagccacccatgtattccttaaaagggctcacattttctgtgtaaatagctattttgcagttttctttaataatttttccatttataagtgggtgttcttaacactgaatcgtgaaactaaccgtccattttaaagatgccataaaaatacataagcaaattggcggggcgcggttccttacgcctgtaatcccaggactttggaaggccaaggtgggcggatcacagggtcaggagttccagga

SEQ ID NO: 4650 - DNA, 1198 bp, Homo sapiens; identical to SEQ ID NO: 4649

SEQ ID NO: 4651 - DNA, 1366 bp, Homo sapiens
ttatccgtgtttttctcttcgggaggaaaatccttttggtcagatttcccttggcttggtggtggagagggtgagatcttgcagttttcaaacacttcctaagggggttccgtccccaagagagcaagcagcagaaatgccagaggaaccgtgcctatggggacaaagctgaactcctcatggaaggagattactgcagttccggtcttgtgagccaaagctcctgttcaatcgtcctagagcatcccaagcagcaaatgattttaaacatgttaatgtatttaatctcatttagttgttaaaatatgcctaaatttcctctttgggaacgcaagacttgcagagatgactccatggagagcggactctgccggcgggaactggagtcgttggtgacgtcatcccagtctgatctgtgaagggtagggccagcaggcagcaccaaagttcccgtatgcgcgttttcagtcttcatttaggtccgaattcccggcatataagaatactaccgtcgcttgtttttcagatttttgcggctattttcgttggtgtgttggtcatgtctggtcgcggcaaaggcggaaagggactgggtaaaggaggcgctaagcgtcaccgtaaggtcctgcgagataacatccagggcattaccaagcctgccatccggcgccttgctcgtcgcgggggtgtcaagcgcatttctggtctcatctacgaggagactcgcggggttctgaaggtgtttctggaaaacgtgattcgtgatgctgtgacttacacggagcacgccaaacgcaagacagtgacagcgatggatgtggtctacgcgctgaagagacagggacgcactctttacggcttcggcggctaatgctaccgcttaaacgactcagcatctcgacttcccaaatcaaaggcccttttcagggccgcccacagttttccgcaaaagagctcatgacttgttagacgattggttggtctctttataagttaattgttcctgtcaacaggtacgtatatttttcagccgttttttttttttcgttccaaattacatttggggtttcggcatacgattttttaggctacgatccttttatgtttattgtagtagggccttagattgcactgaaaaggctagggtaatagtgtctgtttaccttaccacttttattttgagtacctaaaaatgcatggttttcgacataagtgggaaaaccgcaagacactgcgtaaccgctcaaaatggcggagagcgaagaacaaagccggtgcctggcaatgggccggacccgcgaattagcgcaaccaatcatcttcctggaaaggagtgtgggccttaaattctagcggcctgttttct

SEQ ID NO: 4652 - DNA, 1232 bp, Homo sapiens
aatggtcgagcgcttgttgtagtgggccagacgggaagcctcgcctgcgatgcgttcgaagatgtcgttaacgaaggaattcatgatgcccatggccttggatgagatgccagtatcggggtgaacctgttttagcaccttgtacacatacacggagtagctctccttacgactgcgcttgcgcttcttgccatccttcttctgcgccttggtcacagccttcttggaacccttcttcggagcaggagctgacttagctggttcaggcatgctgtcagaaaacaataacagcagtgagaatgaacgcacttaaataaaagctcgtgtctagagtctctccttttataggcctttcatgcaaataaagaattcaaaatatccagctctgattgggcaatgtgttagtgacgcatacatgtaaaatagccttcaccttatttcctttctaattggttggctcgtcaaagaacaattttaaccaatcaaattgcgcctttcacaattctaccgatgactataactagcttcttattcctccatcgagcccattctttttctttattcagtggattgttagttcttctgctgttaggaagccactatgtctggacgtggaaagcaaggcggcaaagctcgggcaaaagctaaaacgcgttcttccagggccggtcttcagtttccagttggccgtgtgcaccgcctcctccgcaaaggcaactactccgaacgagtcggggccggcgctccagtgtacctggcagcggtgctggaatatctgacggccgagatcttagagctagctggcaacgcggctcgcgacaataagaagacccgcatcatcccgcgccacctgcagctagccatccgcaacgacgaggagctaaataagcttctaggtcgcgtgaccatcgcgcagggcggtgtcctgcccaacatccaggccgtattgctgcctaagaagacggagagccaccataaggccaagggcaagtgaaatgattactagtcaaatccgtcagtgatcccgagtcccagaaaccaaaggctcttttcagagccacccaccttttctgtaaagtgctggaatacacatacgatgcctgaaatctcaatgttcactgtcctaatttttaacgaacgcttctgacgttactggtcagttctttattgaaatccttgctcacatttcatgcactaatttatcttactggtgtttctttgcagtaaaaatg

SEQ ID NO: 4653 - DNA, 1138 bp, Homo sapiens
cttcaaagtaagagttttttaaaaaatataaaggagacattgagctggaccaatcactctcaaacgcggtatttttgaatcgctccggaactgcagaacgttcatttccgtctgtcaaacataatcccaaacaaactgattaaaataaaatcaatgaaggtacgtaatacaggtaggcacataaaacataataaaatgtaaggaactaggggaaaaaagcatttagataggttaagattttctaaaatgagacctagtagctgatcacaagtcctatcacactacataattcagggcgcgaaactggaagattcggaccaatcagaaggactttgcctttataaataggagtaagaacaactgtttgttcagttgtgaccattgcttgaaacccattcctatggcacgcacgaagcaaacagctcgtaagtccactggcggcaaagccccgcgcaagcagctggccactaaggcggctcgcaaaagcgcgccagccaccggtggcgtgaagaagccccaccgctacaggcctggtactgtcgccctccgtgaaatccgccgctatcagaaatcgactgagctactgattcgcaagctaccattccagcgtctggtacgtgagatcgcgcaggacttcaagaccgacctgcgcttccagagctcggctgtgatggcgctgcaggaggcctgcgaggcttacctggtggggctctttgaggacaccaacctgtgtgctatccacgccaagcgagtgactatcatgcccaaggacatccagctcgctcgccgcattcgcggagagagggcataagttgtactgagggtgtgcgccaacttaaaccaaaggctcttttcagagccaccaacaatttcagttgaaagcgccgtagcactagggagtaatgtctcctaaaacaaggagggtggagggttaggggatgggggcagggccggtggctcttctaaactaggcttttgtgtcttggccattgtcttcaaaatggccgatagtggcggctcacgccttgtaatcccagtactgtgggagcccgaggagggcgggttacttatacaaaggtcaggaattcgagactagtctgcctaacatagtgaaaacccgtcttcactaaaagtacaa

SEQ ID NO: 4654 - DNA, 1399 bp, Homo sapiens
ataattctaccacgaatcactaacctatcatgccttcgccatcgggaagaaaacccttttggttatgtttcccttggcttggtgatggagagggtgaaatcttgcagttttcaaacacttccgaaggggggtttcggtccgcatgtgctttacagccggcagcagaaagccagtcactgtgaccttggggacaaagctgcactcctcaggcttccggtcttgtggaccgaggctcctctccaatcgtcctaaagcaactgaaggaacaattgataacaatttaaacatgttaatttatttaatctgatttggttgttaaaacagccttaaaactctcattcctatttcccagcaattgcaagagacgcctccgcggagccggcgctcagatgccaaaggctggagtcgttggtgacgtcatccagggctgggctatgcggggtggggccaagaagcaggaccaaagttccggtatgcgcgctttcagtcttcaattaggtccgaattcccggcatataagggcgttgctttgccttggcgtttaggtttcttaagttggttttagaagttgcttagtcatgtctggccgtggtaaaggtggaaaaggtttgggtaagggaggagctaagcgtcatcgcaaggttttgcgcgataacatccagggcatcactaagccagctatccggcgccttgctcgtcgcggcggtgtcaagcgaatttctggccttatctatgaggagactcgtggtgttctgaaggtgttcctggagaacgtgattcgtgacgctgtcacttacacagagcacgccaaacgcaagaccgtgacagcaatggatgtggtctacgcgctgaagcgacagggacgcactctttacggcttcggtggctaaggctcctgcttgctgcactcttattttcattttcaaccaaaggcccttttcagggccgcccacttttttcataaaagagcagacatcttgttatcctgctttgttccagatttttgctgagaagtagttactgtgcacatgtgtagatttgcaggtaacgtttaattactcgtgcttaatctcgcatgtttaggatttgggcataaagtacttaaagccactgttttctgcttgagggaagttggtatgttgaatatgtttagctttcttgtggcattttaacactagatatcagtgagtaagctggattgtgacagtttataattcccgtgggccttcctccttcagtttaagcttgaagcgttcgtaaggttctcaaagactacagaagttggaaacttcgcggagagactgcaagttaccctttccaaaatggcgggaagggctaaaaacaaagaaagctcgcacccagacggcgggccttaaaccaaggcgaatccgtgagcgca

SEQ ID NO: 4655 - DNA, 1198 bp, Homo sapiens
tccctcagatggccccacgattctttaagatacagtccaaactctagggtctgacactcagaaccaatcacaatttgactgtaacccatcacttcaacactttaccagtcacccacttgggcttctaggagagacaatggttatttctcagatgcgttagtgccatcatatggcaggcatccctctgggaatcctaccagggagtgtccaggaatgcaacaacagacatacctggtttaatgatggtgttcatatacatgacctaagaaaaaagacaaaatccaatttgatttaaaaaacaggagcagtcactaattcgtttttcctttttaatttctcttatttttcccttagaaagtgtactttgtcatctttattagggtctattcctccctcccagtctcctctttagtttttcttcctttatgagagtaagagggccatttatccattatttccgtcactgaaaacatttaacaaaagaataggaattgccaaatgaaactgttgagaagagaaacattacacatatcaggagaggcctggccgagtggttaaggcgatggactgctaatccattgtgctctgcacgcgtgggttcgaatcccatcctcgtcgctcggctttccctgctaactgggcttttttaaaggtttcccctcagtaaggtatcgtctgctatacctccccgtttgctcactgagaattaggtgtttttagctccctttaagagaggtattcttcagtatgtattagcacactaacgtgtgctggcactaacaaccttctgttggtaacatgattactgattctattttataaaggtccgaaaaattacagtattttagctccgctccctccgcgcaggcagaggtgtatccaccgctgctccagatccgcaagactcttgtagttgaaaactgatttccgaccctctgattttttgcttaaccccctgagtagcgcctagcatttctccttatctagctgtgatccggtggttgttaattatacataactggggagatttctcaaaatgctcgtgtctcctcctctcccctagaaccagttaaatcgaaatctttagaggggtggagtctagtggtcgttttgcaagtgccttgggtctcccgggttaagaaccatcactgtcctcacttccttcttagttttggtttcgctgtttcggcagttttca

SEQ ID NO: 4656 - DNA, 1246 bp, Homo sapiens
atggactagaaatccattggggtctccccgcgcaggttcgaatcctgccgactacggcagtgggtttttgcatcttcaagcaggtttcatccgaccgatcgatatttcacgtgtaaaaaggctttcgatcttttacaagttaacatcaaaatggatttcttggggattcagggcaggacaatttcaatttatgtctcagaggtcctcaaaatggatttctcattgcccaaagtaaaccttatctctgatcttttacaagttacatcataatggatatttcattgttcaggaaggaatcattgtgcacaaggatggatttctcattacccacgaaggaatcatacttcatgagtaaaacaagtcaaaggaacaaataaaactatattttgttttaattggagggttttgggttcaaaatccttatgatcagaaagaaataaaatttcatatattcatgtataggaggacgcggtaatcccaaaacgtttttttctataggtataacgcctgtcttcgttcgtcagagggccagtggcgcaatggataacgcgtctgactacggatcagaagattccaggttcgactcctggctggctcgttcgactttagtggaaactttgaggtttacataaatgccccttccctgggcactcatatacattttatgtattttatcattttaatttttaaaagaattacacaagatgacaaaaatttttataatatagactccagcttcagttcactattgttttacatacataagagttttttttttttaaatcacatcactaaattgataagtttcagaactgaccaattttcacattgcttgataaaacttaatacaggggaatttttttttctttttttgagatgtatcactgtgtcgcccaggctgcagagcagtggcgcgatctcagctcaccgcaacctctgcttcctgagttcaagcgattctcctagcctcagcctccagagtagctgggattacaggcatgtgccacgacacccagctaattatttttgtatttttaatagagaggaggtttcgccatgttggccaggctggtctggaactcctgatctcaagtgatcagcccgcctcgccctcccaaagtgctagattacaggcgtgagccaccacgtccgtttgggaaaaccttgtgtcattctgtgagagttacgattgagaattcacaaacagaaaatttctagatagcaaacaattttggtttcttttcta

SEQ ID NO: 4657 - DNA, 1209 bp, Homo sapiens
cctgggaattaagtgtaaatttaagccaggtattctagtaatgttgagttcaacaggattgccattattttaactagaattcagttgagagcagagcgccatcgccgtcttccgccttagtcactcggccctgggctggctcacgcccgccccgccccctccccgcccctcccacgcccgccccgcccctcccacgcccccgcccccgtcccgctccccctaccccgacccgccctccctcgcccgccgccccacccgccgcagccctccccgcgcagcctgggagtgactcggcgttcactcgggagacgccgctctgtggcccggacaaccggtcctatgcagcgccgtccgaggcagttcgcggagaggcggcttaccttttaacccaggaatgcccatatcttgagaaaaagaacaacaagggggtgggcgggggtggggacatggggtaggggggcggctggtggatggggaactaatagcgtttagacaagagacagaagtgagtcctgagcacaatgtagcataagcgcgtcaggatggccgagcggtctaaggcgctgcgttcaggtcgcagtctcccctggaggcgtgggttcgaatcccactcctgacagttcgtacttttagtatttagacacaaatcgagtttaagtttacgctacgttttcctacctgctctttgtgacatggtcttctctctttttaaaaaataaattttccgagttccggaataaaagcactctttgtttttattagccactccaaggacagcaaaaagtactctgtactccgaaaataatttcagaacctaccggtgttttgaaatctcacctcctttttccgtttctcctctgtctctagttgtctttccctctccctccttcacaggcagagttgaataaatgttactcttcagttcatggctcattacattactgcagggctcctctttatttagttatagttatctttttaattccatttcttcagtctcattccccacctcatccttactccccgtaagaaatcactgcaagagttccggtctggcagagagcgcggagagacgcagagcgcgggccgctcctccagggcgctccaggccctccggccccgggtcggcgggtgagctagggggcgccccgggacaggccgcgccctctgccctgcagataccggaggcctctgctgtggctgcccact

SEQ ID NO: 4658 - DNA, 1209 bp, Homo sapiens
tgcttccacctccaggccttttccctagcgatttttccctgttccagatcactcatttccccgatatcagcatttatccctcattcatcactttcactgctggcctttcctatcctctttccctgttttattattatttttctccaatcgcttatcactattattttgtttatttaatgctttattatccgcttccgccactgccatgtaatcttgagggcaagggtctctcatgttttcttcaccgttatctgcagtgccttgaacactaatactggttgaatgaacgaacgcattaatggagcggtgatattggggcagagaggatgcagggcttgcttttcaccgccatttttcagccggcagagacagaccgagaaaggaatgaaggccacggggcgtgtgcagaagtagctaccagagagtccatgcgctgcgagcctggaccagcgggcaaacgcggcttacaggcgttcacccagatattacgggtacaacctagtttcttatgaaatacctcgcccctaaggtacgcgcagggccagtggcgcaatggataacgcgtctgactacggatcagaagattccaggttcgactcctggctggctcggtgtaagcagggtcgttttacaactttctgactccgcaggagtaaggaaattcctgcaagataaatttgcctggaagactcagaagcaagaggggcagctcccgacaacatatggggttatcatttctttgcggagcattctgccactgaccacgtggtaacgccaactacgccagagaaacgctcgccctacccaagttgtgcccagccttgcctggccattttggccgaagaacgaaggaccgttcagagattaaattaaagtctctattgtgttcttccctattcagtcatttgtagaataaattctatggcttcagtttgaacactggaggggctgggtctgagcttttcattggtttttctggtttgagaggtcggtacagagacgcacgcgcacatcagcaaaacacgcacttggaacgaagaaacacggaactaggcaggaagaactatttactctgaaaaataagcccttagtgggtttccgtagtgtagtggttatcacgttcgcctcacacgcgaaaggtccccggttcgaaaccgggcggaaacacgtttttttttcctcatcttactacgaaattcttccagtgtg

SEQ ID NO: 4659 - DNA, 1099 bp, Homo sapiens
tatggctttcttttagccactgtatgtagaattgtatatggagcacggggaacaagattgctttgaagtattttgaactatctatgtgaaacaaatggaattgagaacacagaaaaacatgcccaatggggagatgacagaagaggagcaacctggaaagttgcccggaacccattaatgagccctatttgtggtatatggtttgcctttagggcagaaataatcttggcttgagaacatggaaaggggagggaagacgggctattgttagtcctgtgagtcataggatgataaaaataggacaaatatcgaaagaaggatgaatctcagctcagcacgggcgaatttggctgctctagtgcaccggtctcccgtaggggaataacaaaaatgaaaacattccgaaacactgatgaaattcttgatgcagtttttaaaacttcttggagacaggtggccggttagctcagttggttagagcgtggtgctaataacgccaaggtcgcgggttcgatccccgtacgggccaactttgttttcttccatcacgtaacttacggccaaagacaaggaaaaatcaattgtctgaggactgttactacaagaaagactgtgctaacctttataactaacactttgccagaagtccaaacctttgtagcaagtccagaggtcctgttttcttaagtcatggtgctcaaaatgtttgctcatgagaagcagaaaagcagtaggatagtttaggagttagatttaaattcaatagagggcaaaacagtgccaccaatttgtttagtgccccaacactgtccttgaaatagtctgaaaacagataaatcttcagataatgaaatgtggggcaagtgtgagaaggcagtgttcattatctctgattgcccaattaaggatccctacttgggaagatcaacactcacacatcaagacagaaattccattccgagagaaacattttcttgttactttgatttcccaagaaaggactatgcccctttccaaaatctacctttttcacatcagcaacctggacctgttggtccaggttggccaacgccgggaataactgctcagtccacatctt

SEQ ID NO: 4660 - DNA, 1210 bp, Homo sapiens
gtgccttgattatgaaggacaacaaatgagcaaacatacgggtcccgcaaaggtgggagaacaccgcagacattttcttgagggccatatagcttggcaggaggggcaagaattgatgggttatgagaacaagagaggaacgcctcactgggccacagagagggtccaggaaattgtttgggctcgaggacctaaggtccttgggactatgcttggagccacattggtaaccgggtctggagttttgggagtgccagtgcaggggtcactctggtaagcatccaatgacactgacttttaggtcctggaaacattttgcggcctatcaacacaaattggtgagaatggggaaaagagggaaaatgtagagaaagtgactggaatgcatgctaatgattcaggttacgtttacgtcctttgagtttcatttcatcttacctataaaaccaacatagacattgaaatctagaatcctaatcataccaaagaaattatgtattctcttagtgtattgggggaagagctacgttcgggtgagcccggctagctcagtcggtagagcatgagactcttaatctcagggtcgtgggttcgagccccacgttgggcgctctggttttcaatcctaaaatgttttcaggtttctcattgcggtccaaaaaaagggcattattaaagctcatccctctggaagaagggaattgtgtgatcatcgtgaccattttagccttactgacttgactgacgcattccagccttctctgaaattctagctgaacttagtctcagtgatccctggtgtggatacacttctctggcctagaggttttgtaaaaccagatatacttaaacataggttatgtaagtcgttggtagggcatgagctcttgtatatttaacaagttcctgggctgattctaaagcacaaatcccagcaaaaaaggtttaggaggcaggaaggacccatgaccatgagttaaaaaagcataccacacacctcttcgttgatttcaaaagcccaattagccacataccttcctctcacttcactaacatagttctcatctcttcaggtctcaggacaatataaagaaaatgctctagctcaggtgtccaagactggctgtacatgtgaatcacctgaggcacttctaaaattttagattcctgggctcacaggatctgaatctccagtggtttagaaaccatt

SEQ ID NO: 4661 - DNA, 1239 bp, Homo sapiens
ggcgtggtggcttgcgtttgtaatcccagctgctcgaaggctgaggcgggagaacgggagaatcgctcgaacctgggaagcggaggttgcagtgagccgatatcgcgccactgcactccagcccaggcgacagagcgagactctgtctcaaaaaaaaaaaaaaaattattatgctttcgaagttgcattatttagcctgctcttccttctcttcctcctgtcagttatctcaataaaatcccattaaaattgcattgttaaagtgtttcaaattctatttttaggtagaggttaaaattggttatataatgcattcatcacaacaaaagatggtcattgctaaattcttatcagttccttgtgcctccttaacattttatgtttctttttgtaaactagtgagggtggtgctcccgttttctccctgtttcagagaaaagggcctctgaatatcagtcagttccgaaggggtagtggatgtcaaaagaacatcaacgacgcaggtaaacaggacgacaagcatccacgattgcccaaccttccgcagagatggcatccccagcgggaagtgaaagtcgtgtgaatccttcgatagctcagttggtagagcggaggactgtagttggctgtgtccttagacatccttaggtcgctggttcgaatccggctcgaaggagttcacaattttttttttttgcgtaagttttaaaattcattctcagaaatgcgtatttcacttatacatatcctcgataagaatctatttaaaactattctggatgtgcagtgaatctctttaattttttattattctccgtaacaatttttaacacgcgccatcaagacttcatccctataattcgtataatccaaccctcttagaagccctgggcactgaggaagtgaatcagacactggtccactgggctagagatccacagaggcgtctccacccctcaaccccggatccacagccgggggaaaggggcggctggtgggaattactcggagcaactggtaattggtggggcacgcgcgtgccctggtgttcagagttctgaatcgttgcgagtcagttacaagctgaaccactagcgtctgaaccctatacatctgaagccgggatgaaattcaggagttctattcccccttctccttttaattgtcatggtggtgtctttcgaccctagcagagaatatgtggtcgatattagaatcacctggggagattttacaaag

SEQ ID NO: 4662 - DNA, 1207 bp, Homo sapiens
caataaatttctacttttttttttgagatggagtcttgctctgtcacccaggctggagtgcagtggtgcaatctcggctcactgcagcctctgccgcccagtgtctcctgccttagcctgcccagtagctgggactatagacgtgagccaccatgcccagctaatttttgtatttttagtagagatgggttttcaccatgttggccagactggttttgaacttctgacctcaagttatccacccaccttggcctcctaaagtgctaggccacagcacctggcctctactctttataaattaccctgtctcaggtattttgatacacagcacaaatggattcattatacagagtacgtccagtgtctgaaaaaactgctttaaagccgattgtagttttaaaaatgagtatcaatgtaattaaaactgagtctccttaatgcaacaagacttgaaaacccagaaactttcaggacacattattttaggaattctagaagatgaagggctaggggtcctttcgatagctcagttggtagagcggaggactgtaggttcattaaactaaggcatccttaggtcgctggttcgaatccggctcgaaggacgaaagttttgaactacgggctaataattccagaaataacggaactttacgaaaatcaggatctagacaggaagatgtattagactgctgtttaatcctttctttaatcccctttgtgatacaggaagtaggactctgttaatcacattgcagttccaccacttgaccctatgggtaagccttgccaaaagggtggttagagactccaaggctgaaggtgggaaagtgaacttgttttctttctggggccttcctgtttctctaggtgtcaccccagtaatcctaacagagacaacaattttgtagcagccccgtcttgaaatttcacttcttattggcatccctgtagcttttccgcctggtgtctaaggcacagataggacacacaataatgtcaggagagactgtccacatcctgggatccctcctctctagctgctagctctctattaggttagaaacattgaaagttagcatatactattttcttagttactcatgcaagggacttaattacagagttcaatatcaactgtatgctattaatatttctgacaagaggcactagcagttgccatttgaagaaaaatttgggatttttc

SEQ ID NO: 4663 - DNA, 1204 bp, Homo sapiens
gagaactgcaatgataccagaatgctttgttcacagccctgggatcctcatcaacccggttgtctgtatttatcaagcaaatacattttatcaagcaaatagaaaagccatagcatttatcaagcaaatccagtcacttttaagacagaaaggaggagttaatcagacaaaacagcaggacagagggcgtaatctgggagattgtgtatatctaggggaggaggacgggggattccagtaaggtttttggtttgagctatacataaatatcctaatgttttcaatataaaacccaatgccttttacatatttataaacccatgaagccaattacctagaacattacacagaatacttccggtgtatgagaatactgctttaaagccgatcgtagtttaaaaaatgagcattaatataattaattaaaaccaaatctcctaaatggaacaagacttaaaaacccagaaacttccaggacgcacattattttggggattctagagaacgcagaactacgtgtctaaaaaggacagcgttccgtgtccttcgatagctcagttggtagagcggaggactgtaggctcattaagcaaggtatccttaggtcgctggttcgaatccggctcggaggacggtagttttgacctaccaagctaataattccagacaatacggtctttacaaaaaataaggatccaggcaaaaaaaatgtattagatagctctttatgctcaaacatgcacaagtaaaccatttttggttacatgagtaaaaaattttaggaataaactagaaatgtggtagcttcaccgaagggcacctgcgtagatgaaaagcagcgtttccaggaagtctgaggcttcactttttccttgtgaaatttgtacctcgcaacactcttcacctccactccctccctgagtctcctgctggctggctcttggtttctcgatgccattcttatttccggctactgatcgtcaaatgcagtttttattcccacttcccctctccatccccgacccgagctgacgttcgaccagcaaaccacagccaacgcccgcaacacagttcagttaagaaggcgcgtgggaggtgtggggaatgacaggagcactctggccccaaggttttcgtttcagtttttactggaggttaggatatacgatgacttttggggtcctctgttatcctgttacttttc

SEQ ID NO: 4664 - DNA, 1243 bp, Homo sapiens
tgagccgctcaattcctaaacatatgtacacacacaacgcacttctgttttgtgtctcgaacacaaattacaaattatacaaattgtgtaattttccttgcccttcagaaaggagaatctcaatgtttccgaaatgaactgggcagtaacttcgcttcaaggcggtaggtcccccctcttcaacccagttgtctaaaataaccttgtctttattatttacttcctatagagagaggaggtgctaagcggacaggacagctggacaacacgcgcaataagggcaatggtcctatctattctaagggaggaggacatggaatattggtgtggttttgtttattttttatttttttggacctatgtgaaacatttttacagtaaaacccacaaattttaaatgttcaagagaattgttcatatacttgtatagtcagtatccctactcagataagaacattttagaacattttggaacatttctaatatcctagaaaatttcctcacgtttccctatattttcaaaatgaacaagaatacaggatagtcaaaagcaataggtaaatcctaaagaatccaaaacgagggtaatgacatccttcgatagctcagctggtagagcggaggactgtaggggtttgaatgtggtcatccttaggtcgctggttcgaatccggctcggaggagttccatttttaaaagtgtctcttctgggcctgaaataaggaaacttggagaacgcatgtgcagcttgcttattcaggaatttgtaagacgctcagagaaggaaaataatccaccctgaaaattgctaacaagggttgcttcacagacagttgagtgggactcgattttcaccaagttgagaagggatcatgaggaatgtggggaacgggaagaacacgctgccccaaggcttcatttttttttttttgtcggtttcacggtcctttagcaccccctgttatattgatacttggtgtgaataaacattttattaatgataatttcaaatatatacaaagtagagaaaatagctaatagctaccattagccaccacactggcacaacttaccgacactcttgcatccatcatgcccctcccctagctccagatcttttaaagccaccccaacacgtgttctcatttcattaactgtactgtgttttgaagatgtcagtgtttataattaaatagcagtagacggagtttatcgctctcatcgtaccccgctcctcttcaaa

SEQ ID NO: 4665 - DNA, 1144 bp, Homo sapiens
tctgctctaccattccagacagtttttcctggtaaagacctcttttgtccccgctaatggaattcagtaaagggatctctaccatcattcatgtggttcttaccttttccataagctcagctgctgaaatggcttgctttattcctaagactagttttacctagtagctgctgaaatgacttttggtgactctaagacattttacttactactgtcacttgcaggtcagagcttgccagctcccaagagcttctctagtgccaattagctttctttcaaaacaatatataacgtttctctttctagtaaaatctccaactttctctgttcttcagacatacagaggaccaacccagtctgtgcatatgtctcgaattgcaattttgtgattcccaaataaaatgtttagagattcatctctatattttattttgactttgacagtacttaggccaaaattaggagttaaatataacagaaattgcttctcggccttttggctaacatcaagtgtaatgtttgttcttatcaatttaatatctgatatatcctgtatccaaggaacaatatattaaatggacttttggaagtaggagatagaatagcaacttcctctgtccactccacacatcatcttggtattgcagtacttccaaaatggtgcatcctcctctgggggaaattttttttaaatgctagcaagagattacaagtgaaatatgattcatacctataaataactgctttagaaaggggccagtcttgtttttatttaattaaccacatctacttataattatactattctttagtgtcatttttgcctaacacctgagtgccttataagatttttaagctctataaactatggtccatgtttctatgactttccattttagtctaggtccaacaaataatattgacataacattaaatagttccatgatgtgatacaagcatttatatttttaaggacaactccccagaatccttagtaatgttttatccaaagaatgttcaaggtttagggggcagaggaatttcatttaaaaaaatgatgtgagacaattcctatacttcctagtctgtctacttagtctttaaaagaaaaaaaaagttccccataataaacacatatccctca

SEQ ID NO: 4666 - DNA, 1132 bp, Homo sapiens
ggtgatggtcgagcgcttgttgtaatgcgccaggcgggaagcctcacctgcgatgcgctcgaaaatgtcgttcacaaacgaattcatgatgcccatggccttggacgaaatgccggtgtcagggtggacctgcttcagaaccttgtacacatagatggaatagctctccttgcggctgcgcttgcgcttcttgccgtctttcttctgcgccttagtcaccgccttcttggagccctttttcggggcgggagcagacttcgctggctctggcatagcactgtgtagctataaagcgccaacgaaaaggaaaaacagcgtgagcagggtatgacaaggcgcttttatatagaatcgcttatgcaaataaggtgaagagttgaagtcttgtgtctgattggtagttattcagggtaacgtcagaggtcaggtctgcccaatcaggattcgcaaatccagaagacgcactactattggttgaaattaaactgcagccctaaccaacaacacgtcttctttttcgcgcccaatagtgtttataaaaagcgccgcctttcccgttcactttgtggttgctcgtagtgagttgcgctcgctatgtctggacgtggcaagcagggaggcaaagcccgcgctaaggccaagactcgctcttctagggccggtctccagttccccgtgggccgagtgcaccgcctgctccgcaaaggcaactatgccgagcgggtcggggccggcgcgccggtgtatctggcagcggtgctggagtacctgaccgccgagatcctggaactggcgggcaacgcggcccgcgacaacaagaagacccgcatcatcccgcgtcatctccaactggccatccgcaacgacgaggagctcaacaagctgctgggcaaagtcaccatcgcacagggcggtgtcctgcccaacattcaggccgtgctactgcccaaaaagactgagagccaccacaaggcgaagggcaagtaactatctgtactagtttgtggcagctcaagtaaaatcgagtccaaaccaacggctcttttcagggccacccacgtcttctctaaaagaacttaacatttattccatgtgaaagaaagtgagacatggacaagactctagtcataaa

SEQ ID NO: 4667 - DNA, 1162 bp, Homo sapiens
gcttgttgagctcctcgtcgttgcggatggccagttggaggtgacgcgggatgatacgggtcttcttgttgtcgcgggccgcattgccagccagctccaggatctcagcggtcaggtactccagcaccgcagccaggtacactggcgcgccggctccaacccgctcggcataattacccttgcggagcaggcggtgcactcggcccacggggaactgaagcccagcccgagaagagcgggtcttggccttggcgcgagctttaccgccttgcttgccacgtccagacatactggtcacaacttactgaaagtagccaacgaggaaaggcagcgccttttataaacactattgggcgcgaaaaagaagatatgtcattggttagggttgtagcttagttttaaccaatggaagtacgtcttttggatttgcagattgggttgattgggtataactaacctctgacgtcaccctaataaccaccaatcagatacaggactttcactcttcaccttatttgcatgagaggtcctatataaaaacgactcctggtaccttgctcccattacttcccgttttctcgatctgctgctcgtctcaggctcgtagttcgccttcaacatgccggaaccagcgaagtccgctcccgcgcccaagaagggctcgaagaaagccgtgactaaggcgcagaagaaggacggcaagaagcgcaagcgcagccgcaaggagagctactccgtatacgtgtacaaggtgctgaagcaggtccaccccgacaccggcatctcctctaaggccatgggaatcatgaactccttcgtcaacgacatcttcgaacgcatcgcgggtgaggcttcccgcctggcgcattacaacaagcgctcgaccatcacctccagggagatccagacggccgtgcgcctgctgctgcccggggagttggccaagcacgccgtgtccgagggcaccaaggccgtcaccaagtacaccagcgctaagtaaacttgccaagtaagcgtcttaaagcccaaccccaaaggctcttttaagagccacttaaattatcgatattagagctgtaaacacgtgttcctaatccaggcttaaattcgggcgatctttttaaagggattatcatgatcttatcacactgagtaatgcatg

SEQ ID NO: 4668 - DNA, 1197 bp, Homo sapiens
gccgccggacatttcctgacggctcaggtgggcaggctgagtgcgcgagcgcctcactggcttctcataggtacctgggtcaggacgaagccacatagttcctcgtgatgagaaactcacttctggcacctgtcgagatgccagattccatgccaagcccccgaagattctgactagtttggcaaaaaatgggatctggcaggtccacttcaaagcagcgccctcttccttttgttgccaaagatctgaggaccacactgctaaactgagcaagaaacatgcgtgggttggagatagaagtgagaataatgagtttacaagcacagtattaccaacccccaaaaacaaccaccacgctgggaaaattccatataatgaaacttaatgtgttacctttggcttctttgccataagcaaaatattggggacggggagtggataaggaagtaaactgggtaggtgtgtaaataaggacgaaagactgcaccattctttagatgacaaaaacagacgtttctgggaaataagcaaaggaagagccccacaagcagcggcctctggtggcgtgccgtgatcgtatagtggttagtactctgcgttgtggccgcagcaacctcggttcgaatccgagtcacggcagtaccttgatgtcgcctcaatttctcaacgtactgagcagtaccttgacgtcgcctcaatttttcaacatactggagtggagacagtctcggaaaaacccttgcaaaattgaattgacttacgatctaatctgtacacaaaaaacactagtattcatcatggtgccccaaccagtcagccaagcagagagtgtctacgcttgttgccttgtcttttttttcccctctccaaagattctcttcccaaccctacccaagccctacagtcttgttggcattggctgtatgtgaagaaactgaggtaatttttttttaatggaaaacttttactttcaaacactggtaggcatgaggaaaggactgttcaaaaggggatccaggtttgttgtggagatctttcttaaaacacaaaagacaaattattaatcacgcgtttctaagtatcctagctggaccaatgctgaaaaactgtaacctttgatcatctggagaaaattaaagaaatttgagtaattgaaggaatttgggtgggggggaataatggcccagaagaacagcc

SEQ ID NO: 4669 - DNA, 1232 bp, Homo sapiens
tttttttttaaccaggttcttagtacagtctgaatgcttgaccacataccaccacattaccatatggcctcagatgcagatcttgaactggatagtgtgtgttaccaagccataaatttagacatgcacagcagcgttccattatcaaatggaaatgggatgtattaaataaagcttgagcagctcctaaaggcacaagtaggttgcatgaggaagtggcacagctgtttatggcatctactcttgctatattgccttctgtttatttgtgtgtgtgtgtgtgtacatctacatctatggcctcataagagttctaaatgaccagttgactgaagaagaaaaaactcaagaatggtttatagatgttctgtatgttctgtacaatatgcaggcaccacttgaaagtaaacagctgcagccccacagccccacatacaaataaacaagagaggctagcagtgagaattacagcatgcagggccctatgcgtatgtgtttttgatgcataaatagtaaccatttagagggctgtgatggccgagtggttaaggcgttggactcgaaatccaatggggtctccccgcgcaggttcaaatcctgctcacagcgcttctcggtacctctctctctcttttttttctaaatcacaaatcgctgtgactctcagtctttcatcttatttcacatacaaactgagaagagggccgcgtcctatctcgaactctgtgttggaccgcccacctttaccctaagcacccggacctgctcctcccagctgagcctcagtgaacccctgagccccgggcggtgcttccatcaaagatctacctactcctcagagtccacaggaagcctggggcttcttgggctttcacaatagctgctcactttgttttgagattgctaaatgggaaagcagcgacagattctaacggcaaagaggaaattttgctttaaaaatacaactcccctcagtcgggcgcggtggctcacgcctgtaatcccagcactttgggaggctgaggcaggagaattgcttgaacccgggaggtgaaggttgcggtgagccgagatcaggccactgcagtccagcctgggcaatagagcgagactccgtctcaaaaaaataaataaaaaataaaaataaaaatacaactccccaggccgggcgcagtggctcacacctgtaatcccagcgctttcggaggccaggcgtggtggcgggcgcctgt

SEQ ID NO: 4670 - DNA, 1165 bp, Homo sapiens
tggcttacgcctgtaatcccagcactttgggaggcaggttgatcacttgaggtcaggagttcgacaccagcctggccaacatggtgaaaccctgtctctattaaaaacacaaaaaattagcctggcgtggtggcgcgcgcctgtaatcccagctcatcgagaggctgaggcaggagaatcgcttgagccggggaggcggaggttgcagtcagccgagatcgcgccactccactccagccttggtgacagaaggagactccgtctcataaagaaaaaaaaacgaaaagaaaagaaaaaaagaaagaagtgggcacatcaagtaaacaaatgtcaacgacagtaactctattatgtacatgatgttccaaagcagaaaatttctttataaatataaatatctgaagggagtgaaacttatttaaattgaccacaaagacaatcgcgctttgctagaatccacagtcttgttcaatgtacgcctggttgtattgcaaaccaactattttcttagtgatcctaatgaagaatagataatcgagagacccacaacgacgggccagtggcgcaatggataacgcgtctgactacggatcagaagattctaggttcgactcctggctggctcggaggcttattttcttcccccccccacacacgaattctcgctcttgtcccccaggctggagggcaatggcgcgatttcggctcactgcaacctccgcttcccgagttcaagcaattctcttgcctcagcctcccgagtagctagtaatacaggcgcctgccaccacgctcggataatttttgtattttaagtagagacggggtttcaccatgtcggccaggctggtctcgaactcctgacctaaggtgatcagagcgcctcggcctcccaaagtgcttggattacagacatgagccaccgcgcccggccttttttttttttttttttttaatttttaaagaaaaatatcatcctgtgtgttttccgttttttctttttttttgaaatggagtttcgctcttgatgaccaggctggagttcaatggggcaatctcggctcaccgcaacctttgtctcccggggtcaagcgattctcctgactcagcctcccgagtagctgggattacaggcatgcgccacccacgcctgtctaattttgta

SEQ ID NO: 4671 - DNA, 1236 bp, Homo sapiens
caagaaagtattccattttctttttcattatctcaaaatttttaaagtatttggatctctgatcactgttccacacaaagcatcagtatccaacacaagtatgtttaaaaaatgaaattatttaatgaatgagcagatgcaccgactgcataaattaatgaagctttcacaagtgcaatagacacaagggggcggtggctcacgcttgtaatcccagcactttgggaggccgaggcgggcggatcacctgatgtcaggagctggagaccagcctggccgacatggtgaaaccccgtctctactaaaaatacaaaaatcagccgggagtggtggcgcgcgcctgtaatcccagatactcaagaggctggggcaggagaatcgcttgaacccgagaggcggaggttgcagtgagccgagatcgcgccagtgcactctagactgggcgagagagcaggactctgtctcattaaaaaacaaaaacaaaaacaaaaagcgggtacatcaatgatagataatcgacagacgcagactgagtggccagtagtcaaaagcgcaaccgagggccagtggcgcaatggataacgcgtctgactacggatcagaagattctaggttcgactcctggctggctcgggtgttaatcttggctttttttttttttttttttaagaaaaatatcctgtgtgttttcaaactgatgacagaaaccggttcttaaagtcctttgaaagaaaattcatctgatctggctcttcaccttgcaccgtactgctgcacatcacaatcgtgacctttaagtctggtttaaagttaagtatcaaactgaaatttgagaccttaagtctcttcggaaattgctttttttctttttttttttgagacggagtctcgctctgtcgcccaggctggagcgcactggctgcatctcggcacactgcaacctctgcctcccgggttcaagcaattctcctgcctcagcctcccaaatagctggtactacaggctgacgccgccaggcctggctaattttttgtattttagtagagacaggggtttcaccgtgttgcccaggctggtcgcaaactccagatctcaggcaattcgccctccttggcctccccaaagtgctgggattacaggcgtgagccaccgcgcccggcctggaaattgcattttttaaatctcccctttctttttttttcccaactgatactgagaaatgggttggttcaaaga

SEQ ID NO: 4672 - DNA, 1221 bp, Homo sapiens
ctatctagataagtatattttacaaaatccacagatgattatactgtatagtccatgttttaaaaaatcacaacaatagaataattaaaaactcttctgtatgtcaatgtatgggagactcttttctctgacatgttctttcctacacccagcaatcgcctgaacccgggaggcggaggttgctgaatctttaggattcagctctgatcctagcattgacaggcgtggatttccctcaacacgcctcattttaatggaagtccaaggaatcagggatggttcgtctttccctaacacctagcataatgcctgtcgcaaattagtgattaagtcatacttttggaaatatatcttttcatttgtttatttccaagcaatattagaaagatttattaactttgtacactcttttaaacatggtcctagttttcgcggatataaaattactcataatcttccagaaactacaaattctagcctagtaaacgttgacaacaaaactggctgttatcaccgggatggctgagtggttaaggcgttggacttaagatccaatggacaggtgtccgcgtgggttcgagccccactcccggtaagcgttggtgtgtactttgacgtttgcggtttctgccgcagagttggaagccaggtatgcttacataaaaactaatatgacaaccttctcactttgcgtgtaaacgcttcaaataataacgaaggttattaaacaatattctgcccaacactacttttttttttttaatcttcaaggaaattgcttcggtgagcagtattaagtaggagacgcctcttcccacaattcctatggcctaacagcacagtgtattcaagtcttgaatacattcctatcactgtgggatgtattcaagtacattgacaagcctgtaatcctagcactttgggaggctgaggcgagcggatcacttgaggtcaggagttcaagaccagtctggccaacatagcgaaaccctgtctctactaataatacaaaaattagccaagggcggtgacgggcgcctgtaatcccagctactcgggaggctgaggcaggagaatcgcttgaactcgggaggtggaggttgcagtgagccgagatcgcgccattgcactccagcccgagcgacaagagcgagactccgtctcaaaaaaaaaaaaaaaaaaaaaaaaaatcagcagagtgtggcggtgcacgcctgtaag

SEQ ID NO: 4673 - DNA, 1212 bp, Homo sapiens
gactagaaccacatttctagcatttttcaataccaaggtcttcgaagcgacctttgatttgaggtcactttaggaatctgaaggaacacataggaagactcccaaattgaggatctagacataagaaacctgggacgatctcgatcatgggaccatcgagaatcagactcgttgggaatatccttcaagtaccaatttgtatgttgtattagtgagcggcttttacgaagcaaagactcattaatatttcaccgaatctgattcattgtctgcatgtattgactagacattcagaaggcagcaaatatttccataaattgctgggccattagccacagtttgaaatgtttaagcgtcctctttcaagtctacgaatacagccattttgctttgtttttgcgttaagaggaaatttctcgttatttctattaagactctaaagcaactaagaaattgttcctccctgtaagacaaacaggaattacgttgaagaatttaatactttcacggagaaggggcgaggatgcgggtgagatgaataacaaaagcacagatttgcggtcggccggttagctcagttggttagagcgtgctgctactaatgccagggtcgaggtttcgatccccgtacgggcctttggctttttcccccctcgagaaatttggttttcatgctctaagatgattcaaattaaccgtccccatttcttaacgaacctagaacctaagttcgtttccgaatcatctgaaatgctacatctccccaggtaataatcttcttcttcttcttcttctttttttaaatgttctttctgtttcctccaggaataagggttggggacagaaagctgttcagagcagagacctccaagactgggagcctgcttaatgaaagggggggggggcggggaagagttcaaggagtggaaaaataactggcattttttttaaaaaaataaagcttatttgatttcagattttccttccaaattagtcctgaaacctaccttctttctcaaattgtagagacacaagataaagagaataaatccttagaaggttgtggatatgtgtctctgaaaaccctttcgaatttaactgacagacgacattgtcctgtgaggaagctatcactttaaacaaggaacacagactttttgttttgttttgttcacagaaaccgattctgtgtgtgtgtgtgtgtgtgtgtgt

SEQ ID NO: 4674 - DNA, 1153 bp, Homo sapiens
gatttttgagaaaataattagatctataacgaaaaggagtaaagcatctcaggtatctgactcaaatttctcacctgtaaaatagagattatgggtcccatctcacagcgtggttgtgagcctcacaggtaaggtaacaatagaaaacacttgtcacaaaaactggcacacggtaacctggcatactgtgtgcctggcacctggcacacagtcttgtttaacaatctcacttgtctaccattgatgaaatagaggccgaggcccggggcgccaagctcctaaagcacttgaaaggagtggtttaggattagaggactcctgacagttggaagtcaacgttttccattaagactgtggtgtaaaaggtgttgaatgtaggcatgtggcaggtaagcgtcttcttgacttaatcctccaagaggaaaagcagaatgcacccatcacccaaactatggggcggagggaaggaacctaaagtggagaaataggtcacctatgactttaggaaatgctagttcagcttcaggttccatggtgtaatggttagcactctggactctgaatccggtaatccgagttcaaatctcggtggaaccttggatttagtcctctgcagtcaaatccccatcgtctctccacaatctatactgttgctcatacaaatcactcgaccaaattttattcctggtatttccacgtcacatctcttgagcggagtatctttagctgccaaccaaataataactttctttttgctgcgcacaatttgttctttggagaaaaaagagagaagcctcaaaaggaaatgcacgaggcagtcgctcgagtcctgctggaactgcaaatcaaagtctccagaaaagatctgcaaacaagtgaggagacaatagataggaggctagtgagaagagagaaaggaaatttggtgatagtcacgaacagagaaaagctgggatggaaactgaggaaaggacttacccactaaatgggtctgggagaggtgacagtcgccgaagccgagagaaaactgtcctcagacaagaccacaaggggatagaagctcaacttgtgagggctgggcagatagaacaggtgacgggaaagatacaactggcgatagtcaatagtcaatagagatagatgctgtttcgag

SEQ ID NO: 4675 - DNA, 1163 bp, Homo sapiens
cataaaaatacataatattgggataaaattctgtggcagaaacagaaaagaaatacattggcagcagaaaaaggattccccccaccccaccccgccgcctcaattttcagctgcttagccttcagtaagaaggactgtaaggcctaacatgagatctgaggaatgagtaatgaactaaggcaggtgaagtgagggcaaagagaagagttaaaagagtgctgagggtggaaaatgagaaggagagcatggagcttggggagaaaaaaaattcactgtagttggaaagctagaatggatacggaggaacgatgacactcaagactggacacacgggcgctgggcacgatcattaaactgtaaaaggttctccatatgaaggtggaaagaacttgttttgcgtaagaattctttaaggagaccacagtttgaaggacattacaatacatatcaacatatcaccataattaaattgcaagtcttcgtcaaaagcaagccttaaaggagtatcccaaaaacacattttccccagaaggacgaggtggccgagtggttaaggcgatggactgctaatccattgtgctctgcacgcgtgggttcgaatcccaccttcgtcgaccgttttctttaagagggtaaccaggtttttgtcgcaggtctgagttgctctcagaaaagttatatagattatctacagctttcctccttttgcttcctctcatttctctcgaccatctatcagttttatttcctcctgaggttcaaaggaattcttgaggatctgagtggaattactctccattcttagattacaatttactacatccggcacgtgggctgcgggcattgcctgcacctgaagggctcttagccaagatgtccgcatggtgcaatggatcccttgctccactcacatagtgcctcatgttgcaaagcgaaagaaccaaaggcgttggtcagacactgataacctctccttctccgaacaattaacagaagtttgtgtgtcaccttcctttctatttacatatgaacgagtaatttgtacctttgcttattgtccaagtaaagtgctttggaatctcctgtcttggatttgcttcaaaatactagttggtgttggagagcagcagagaaaacaacattacaaaatgttgttaattgtt

SEQ ID NO: 4676 - DNA, 1118 bp, Homo sapiens
ttgtttggtacttccccgatcctgaaaccccacaacaatggagggtggaagttactgaatacctactattttcataagattatgggtaccttaattagcagatacctagtcattttcccgttagcggtacctttgtacggttcttggggacgcctctcgtttccctgccttccaaaccctcctgaagcctatacctgttacaagtcttgatagtgctttcctcttcatggaaatttagtcctagtcagaggtccaagtctttggtcaattatcagtttctgtggaatcaatggttcaactgctttggtcacccggtctcgctggttgcaaatgactagaaacactgtcagagatctcgacaccaccacaatcgaaagaccaggctgtcctgacagaccccgtcgttttggcttaggcggcagattaaagtgtaaattcgccaagtataatcaatttagtagaatacaaacttacagacttaaaaaagtgggcaagaatacttaagtttattagaggtagtcaaaactcgctgacgcagagttcttcctcgttagtatagtggtgagtatccccgcctgtcacgcgggagaccggggttcgattccccgacggggagaaaagttgctttttgcatcttctgcccactgatggcccctacctggctctgagagcagagctgcggtgggacccctctgccattcctccttaactgccaatggaccctctcgactttcctcactcctaagaccgctgctctgatcagagaaacattccagtcaattctgaaacctcaaagtcacagttactttaaggcccataggagaatctaggtttaaatgacacaaaatgtactcattaaaagttaacgagaatacagttgtctagcatctgcctcttatttgcatggtcagaaagctcatgtaaatgttcaagtcctccatccttctagacatcaaatcttggaatgaagatatcgacaaggcccagctgggggctcgtgtatgccccagctgcaatggctgacctgggcaactccaaactatagaatccacaagatgtcgatcaaatgtatgagggaagatgacaaagtggccacagacttttgaggagattcccaa

SEQ ID NO: 4677 - DNA, 1212 bp, Homo sapiens
ccaaatttaaataattctcagtcgatcgcacggaaccttcaattattttgtgaattccctggaatcaagatattaaaggttgttttcctagaggcaataaacctgataactcacctatgtggagaaaaatatcccgtgtctgaaattgagtagagttgcagataagacatgagttctccaagacttaatttccccgtttttatgggggactagaagcgtccacttaatctagcttttaagcattaaattgcagaaagcatagaagaagttcggtccagttcaggtacgtataaaagtcgctcaatttttcttaatgaagaaagcaaggctcaggaccaccaagtttctgagttaattgagggttaggggaaagggagactttatggatcaatgtaatcggcaaaaataaataaatagatcccccagggttttctttgaaagggtgttctgagtgggcataaactaaggatttttgctttgatacattaaatgcgtttagtagaatgcctataacccagcatgagcaatatttgggtgaagcgtaccaagaggggttccatggtgtaatggttagcactctggactctgaatccagcgatccgagttcaagtctcggtggaacctgctcgaagatatatgtatatatcctcttcctggaccttttgttttccccagggaaaacgctctctacataaattaccaaaatcaattttcggcctgatatattccatgaattcctacaactcccgatagcacacttgatcttagtcaaacggcctagaagctatgcaagtcccaatatatctgcctctgggtaaggaggcggaatagaatccactttccgggatcacagctcactacagcctcgacctccccaggctcaggtgatctcaggtagctaggacgacaggtgcgccccaccacagcagcgaaatttttgtttgtttgttttttggagggagacagggttttcgctgttatgcccaggatggtctcgaactcctgggctcaggctatccttccgcttctatctcccaaagtactgggattacaggagtgagccatcgggcccgtcctgaagggattgtttctttcaataatttgtgaagtccacggaaacattttgtcccctgaacatgatggaggaagtaggaagtgctgataaacagaatctgctctttgggtctttatgcaggagagcagagattttaa

SEQ ID NO: 4678 - DNA, 1210 bp, Homo sapiens
agggtctgttaggatctaggattttccaggaaaagaactcacgggccggctttacttgcaaatttcttcttaacccgtctggaaagtgagagcgcgttgtcatttgcaaaacaatttcccaaacacaatgagataaatattttaggtttacatttaggggcttagggacaccaagtgagaagatccagaggttttctgtatcgtttttctctccctcagcttagctgagggagcatttccttttctgaaatccattaagcaacagtgtcattcagtgaggagaggttggtctcctggaagttctagcagaaggtcccatcgtctagcaaaaggtcccaggtttaaaactaggattaaggccgggctccacctccgtggtgagtaaatttgttttcagtttcgaggactccagcaaccagcacagagccaaacttgcccccaggggagctggtttctgaattgacccggtttgttcaaaataaagatgctcctgtggtggatacacttatcttagtgcttccgaagttctgtcatgtctgtagttgtgctgtcatgtctgtagtcatgctgtcatgtctgtagtcgtggccgagtggttaaggtgatggactagaaacccattggggtctccccgcgcaggttcgaatcctgccgactacgtttgaaattttaccctaaaatggggtcaggttaatataatacggaaaatacaggagaacttgtatcatctttcacccctctggttaatgtaaagcggaacgaacaggagcacttatatcatcgttagcccctctctaattctgccctggcggtgtatgtgtttgctgtcaaaatgtcgctgagctgcccgaagtaaataagctagtaaccacagtaatcctccttcactggcaacgtgcagtgctccagggtctcaccgggttttctctcctccaaaccctgctcaaaataaactctttcaagagctcggtgaaagtgtttctcacagaaaccatggagaaggtacagtctatgccacaaatgggagctatctgtatttttaaaaagtattaagtaaaattgacttttaaaaagcacttacatgtatatacacatacccattaccatatcaggatacacaccagttctatcagtccataagcctccctagcactgttcctttatagtctcatcctaatcccacacatagcagctgacaatcataaatact

SEQ ID NO: 4679 - DNA, 1180 bp, Homo sapiens
aaacggctatgcaaaaataaacacgcatttaatgtcaccgctgcaaaatctaaaacctagactttaagatctttcctttatgaaagaaaatgtagaaattcatatatgtacgatttttatcatggtaaacagaagcagaggaagggcatctaactcacattggtccgagaaaaaatcctgggggacggtgaccttgaggtaaacctgtaacgaataaacttgagttgaagaagaaaggaggatatttcgagcagaggaagctttttaagtttactgtactccttactattaatgaacatttctttgctattcatgacctagaactattttcagcaaagtcataatcttttgcagaactgccgttttcagattttcgaagcaacatgggaaatctgtttcatagaatcttataacaactttttaatatgaagattagcatatttttaggaattctctgccaagaacaaattcagtagccaatgtataaatgccatttcaattgagtttcttttcacgattttttttgttaagtcttcctcgttagtatagtggtgagtgtccccgtctgtcacgcgggagaccggggttcgattccccgacggggagacgaagcagttgcttttgattacaacataaacaataccaatcttattgagggactcaggccttaataaggccagtcttagaaagcagctcttcctggttttgtttttattatttatttattattattattatttttgagacggagtttcactcttgttgcccaggctggagcgcaatggcgcgatctcggctcactgcaacctccccctcccgcctcccgggttctagcgattctcctgcctcaggctctggagtagctgggattacagctatgcgccaccacacccggctaattttgtatttttagtattgatggggtttctccatgttggtcaggctggtctcgaactcccaacctcagaggatccgcacacctctgcctcccaaagtgctgggattacaggcgtgactaccgcgcctggccctggttttgtcatttgaagtcggattccggcgtattggtttatcaatgggttcacgcagcaagcgatcatctgatggaagtccactgccactttctctctgggaagagagatcaccgaacgcgccaggattcacagtgttttcagctggc

SEQ ID NO: 4680 - DNA, 1077 bp, Homo sapiens
actgattttatttctgcttcaaagtattcacagtgtattttgggctaggtgggggaaccggaaaagtaaaaataaaaatattgcatgacttttgtttctctctacaaagcacctgcttaggacgctgaatactgagctttgagggtccctctagccaggaaactgttacggagccagatggtaacttaggaagcactgttctgagtatttgccactttccctattgtttcatttctgaattaacccgaaagatagcaacataaggtattttgatgatgctatgtttagcatcatttagaatagcaccgggcaaaataataaataccgttgtgaaaaccaggagcgtacgccacccatccgaggtcttttcctcctttgtcggagtcagcgtctgctgactacgagttacataatgaaacttaaggagtaacagtgcgtgtcaggatggccgagtggtctaaggcgccagactcaagttgctacttcccaggtttggggcttctggtctccgcatggaggcgtgggttcgaatcccacttctgacacagctattttgcccctttaatcctaggattgggggactgggtgccgtggtttacacctgtaatctcagcactttgggaggccaagacaggtggatcacctgaggtcaggagttcgagaccagcctggccaacatggcgaaaccccatttctactaaaaatacaagaattagctgggagtagttgtgggtgctcgtaatcccagttacttgagaggctgaggcaggagaatcgcttaaacccgggaggcggaggttgcagtgagccgagatcatgccattgcactccagcccaggcgaccaagcaagactccctctcaaaaagccaagaggaaaaaaaaaaaaaaaaaaaaaagcaaaaaaccactaggattaggggactaagcggggaggattgtttgagcccaggagttccaccccgtctatagaaaaaatgagcggtgcttggtggcgcgcgcctgtagtcccagctacctgggtaggagaatggcttgatcacttgagcccaggagcgcgaagcttcagtgagctgtat

SEQ ID NO: 4681 - DNA, 1210 bp, Homo sapiens
tgaaatcacagttcggatagtctgaggagaagggggaatgcctagaaatccatgtacagaacagccccactctgttgctatggcctcctcttgtccagaaaagttcccactggccctggggcagcatcaagttggagctactgcatcaggacttaagtcacaaagagcaaagtgaccccacagggtcagggtcgtaagcagaggtctatgcgagtcaggaggcctgggtcagagggagagggcagggccgagagcggggagttactggaggaaggggagaggtgacgtggaaacgtctccttcatatcttgttcctcaattcccatcttggtctccagtactgtaagaattattcaattccgcactaacagttgtattcttctacctttccattctgtaatcagtgagttcggagctcctgtttagtcgggcaaattccagagagaacttttgcggctgggattcagccagaaggcgagccgtaagccgtgattactcatcatgtatagtttcaaggatttttgtcacagtgtcaggatggccgagtggtctaaggcgccagactcaagcttactgcttcctgtgttcgggtcttctggtctccgtatggaggcgtgggttcgaatcccacttctgacacagcctgatcttttgtttttccctaccagatttgtaccgaaagtttcgccaaggaatgccacaatagttcagccgtttctacctccaagatttccctccccaaccgatgttcgccaaacagggtctcgcaaagagagaggcatctctcttacatcaaaccaatcgacaaaggaaaaccccacatttacagaatcctgggatattttcagtgccatttggacgcagtcccgcagcactgttggagatcattttctcctgcgagaaagtaagcagcggatttccatctattggtctgtgaatccgctaacataaaaattaaacaaacaaaaaaagaaaagaaaagaaaaaaggcacgagaaaaaggtctccgttctcagagagccctgtaggaatgttccagattcctgtatatcgtctgtctctctgaaaggggagtcggacattgatctgaccagcaactgtcgtaaactcacaccgctctagcaacgacggtaacacccagttcttttccttagccgttcaactgatcagtcaactgatcagtgactaaaatcttcactgcttttctgca

SEQ ID NO: 4682 - DNA, 1219 bp, Homo sapiens
agttccttttcagttacgacccactctccccagatggaagtactattgtgacttctggctggacagcggaatgttgcctgctttataatttaaatcagtggagccacagagtacgtccttttctgtctggtttactttagtcgacatctctgtgagattcatccacatagttgtagattgttcattcttgttgcaatagattatttcatgtgagttcattcctgcatctgctgatgggtgcttgggaagtttccagtagtttttattattctgaataggttactgggcattctggtaaatatatttggtgaatatatgtaccaatttgtggtaggcaaataacaactgtcaggatgtgatatctttgatttcaataagtggaaagtctgaaagatatggaaagaaactaccagaaaaaaaaaatctgagtaaaaaatatagattttctacagccaaacctggattgtctcaccctaggtgcttcaattctcactcccaccagcagggttgtttccgtagtgtagtggttatcacgttcgcctaacacgcgaaaggtccctggatcaaaaccaggcggaaacaagtggttacccttcttacgtcttgttcctgatcctgagagtctctatttgaaccagataggacttttgtatatgaacaagcacctaaatcaaaggatcttatatcttcctttttttttatttgagccacctcaggaacatttttgctccctcctttgtcctgagccgcggcgaggcccacatcgccccatcttcccgcgccccagcatgtcgctgtcccagctccctccccttatgctctgcatggcctgtaggttctagggcccaaagcaagctctcgtggtgcaggaccccgctatactgtgcaggcgagactggcttccttgaaatttccaaagccacttgtgcaggttcttcgcaaagagattttcctcaggagtttctaaaaataagcaatgcttaggacacagacccgtgagaaaaaaataaaaaaagaaacagggccatgctttgagccaagtgaataactaatattctattgtctgccctttacccctaagtgcagagagaatttttcacaaaataggtaagaggcaatttcaagtggatacttagaaactgttaagtgttaaaataaataaatcaataaataataaaaaattagatactggcctggcctctatgggtactcaatgcca

SEQ ID NO: 4683 - DNA, 1209 bp, Homo sapiens
cccgtctttactaaaaatacaaaattagccgtgcatggaggcacatgcctgtaatcccagctacttgggaggctgaggcatgagaatcacttgaacccaggaggcggtggttgcagtgagccgagatcgcgccgctgcactccagcctgggcaacaagagcgaaactccgactcaaaaaaaaaaaaaaaaaaaaaaaaaatcaaattcaggtaaaagcagctgattggcctgaaaaataagtaacaaaaagctaaaaagtaggcacacacatgaaagagaagatagaaacaccaatattgctttgaaggaaagacattcatcttagctcatatataatgtttcaaagatgaaaaatggtcattattttcaataaagacactttatgtgaatgtctattatgccaacaaaccacaaaagaaaacatgctttccttgaatcagtgtggtttggggttttaatccctacctaaataaagaaacaatcttttttttttctggccccaatagtataatacaatataattatgaaaagagtaacagttaagacagcgttacaggcaggggccagtggcgcaatggataacgcgtctgactacggatcagaagattctaggttcgactcctggctggctcgcttgtgctctcactttttccttcttcaaagccgtattaacaatcctgtgaatgtccttttccagagtggtgctgttacttgaacgtgaaagagacaagcgtcgaaagagccaacttacaggattttgtttctacctttcatctcattctcaactggagaaaggagaaaggagaaaaagaccattagaaagcttaaaaatcaaagaagctttaaaaaaatgttttttcacgtatatcttcttcatcggtatttttttccattgggagaagtccacattcctggcgtctctgaggcacagctctttccctgggcatgactgttgtcaaaaagaaaggggacatctgaagaaacgttgaatcataaaggcagggctgtggggatgcaggatgcaagctgctccttgcatcagctgggccccctacacagagctcaaccctgaagtcggtggacccacctcagcctcaacatcgccccaatccaccactcccgccacgggcctcttctctgcctcccaggttcccaccacttttcctccgccctgagatcctagagaaatagaagacaggagaatcggc

SEQ ID NO: 4684 - DNA, 1226 bp, Homo sapiens
gggaaactcccgaggggcattccttttccccttcccttcgccccctcagttgagctcccaggaatgctgggattttcctccagtcttgtcttgcaagttcacttatttcagttttccgtaaacaccaacgtctcctctgcaacttgggaaaatctttccacgcacgtcctcaaacgcgccatacaccacccctaataaacgacgtttttttgtgaaagcaataggatctgatcacaaagcagaataaaagatctcaggtctctcacaggctcctcacctgtaaaataaagacaatagttcgcatctcaccaggttactgtgagcgttccatgaggtaacaatacagaacactagtcacaaaacctggcacacgataagggctcggttttgttcgacgacttcactttttttccagtgaagaaacagaagcccgagggggcaccaagtttctgaaccccctggaaggaaaggtctggggtgcgaagggtggggtgtgctgacattggaaaaccacatcagactttagaaaggaagaactaggtcatgaaagaattcagggaaaatcgctaagaacttggccccatggtgtaatggtcagcactctggactctgaatccagcgatccgagttcaaatctcggtgggacccagtctgctgtttcaagtttcagtcgtatgacttctctgtgatataaaggcaatcatgcaatttctacacacctttctcattccatcctggagcttttattcacaaacacacgagttaaatggtgtgtgggaagatttatcccttttgttaaatgatgtattttctttttttttttttgtaaggcattataaatgatatattttcaacacaattttattttttatatatttataagtacttatcaaatattatatacttaatttttattgattacataataccaccattaaatttaaaaacaactaaagccagaggaaaaacacttaaaatacagataattactggtaggggctaaaaattatatatcaattttaaatctgtttcagaatgctatgatggagtgatcagtcagtcatagcctttaagcataaacgtgtaatatagtgggcttaaaattctatggaagatatggaatagaaatatcttttaaagatagaaaaagaatttatgcacgttttcaactgttaaatataattatgctaagtatatttttaaagaatcctagtacatgccaggtt

SEQ ID NO: 4685 - DNA, 1407 bp, Homo sapiens
gcccatggccttcgatgagatgccggtgtcggggtggacttgcttcagcaccttgtacacgtagatagagtaactctctttgcggctgcgcttgcgcttcttgccgtcctttttctgggccttggttacggctttcttggagccctttttgggggcaggagcagatttagccgggtcgggcatggcggaggagagtgaaagagcactcaaataacaagaatgaggacaagctgggttatgccctatttatttacaagtctatatgcagatgagattgagaaattcttctgtctgattggaagttactcagatgacgttaatatcaatatagtccaatcaaaacacgtatattcagaaagctcatttgcattaagaggaagctgcaagcttagccaatggcccagcttctttttcgcgcccagcagctgctataaaatgcgcgtccctgtaggttcctttcactcactttctgacttaggccacaggtcgttttaccatgtctggacgtggcaagcagggcggcaaggctcgcgccaaggccaaaacccgctcctctagagctgggctccaatttcctgtaggacgagtgcaccgcctgctccgcaagggcaactacgctgagcgggtcggggccggcgcgccggtttacctggcggcggtgctggagtacctaactgccgagatcctggagctggcgggcaacgcagcccgcgacaacaaaaagacccgcatcatcccgcgccacttgcagctggccatccgcaacgacgaggagctcaacaagctgcttggtaaagttaccatcgctcagggcggtgttctgcctaacatccaggccgtactgctccccaagaagactgagagccaccacaaagctaagggcaagtaagggctgaactttaaaaatgtaaacttacaagacaaaaggctcttttcagagccacccaccatttctacggaagaactgagcactctgttctccaaacctatcagaaatttgtggccgagttcaagcactgaggccattactttcctattgggtaaaataaaagtattgaatcaggcctagtaaatactatccaactgctaccttataacatgaaggaacctccttaattgtcccctccccacaaactgtcctgggtctttaaaaaacttggggccgggcgcggtggtttatgcgtccttagcattttgggaaactgaggcaggtgggtggggaggggagaaatctctagggacctggagttcgagaccaccctgataacgagacccctgcctcttaaaaaaaaaatgactgggcgcggtggctcacgcctgtaatcccagcactttgggaggccgaggagggtgtatcacaaggtcaagagatcgagaccacccaggcaaacatggtgaaaccctgtc

SEQ ID NO: 4686 - DNA, 1149 bp, Homo sapiens
gtcctacaggaaattggagcccagctctagaggagcgggttttggccttggcgcgagccttgccgccctgcttgccacgtccagacatggtaaaacgacctgtggcctaagtcagaaagtgagtgaaaggaacctacagggacgcgcattttatagcagctgctgggcgcgaaaaagaagctgggccattggctaagcttgcagcttcctcttaatgcaaatgagctttctgaatatacgtgttttgattggactatattgatattaacgtcatctgagtaacttccaatcagacagaagaatttctcaatctcatctgcatatagacttgtaaataaatagggcataacccagcttgtcctcattcttgttatttgagtgctctttcactctcctccgccatgcccgacccggctaaatctgctcctgcccccaaaaagggctccaagaaagccgtaaccaaggcccagaaaaaggacggcaagaagcgcaagcgcagccgcaaagagagttactctatctacgtgtacaaggtgctgaagcaagtccaccccgacaccggcatctcatcgaaggccatgggcatcatgaactccttcgtcaatgacatctttgagcgcatcgctggcgaggcttcccgcctggcgcattacaacaagcgctcgaccatcacctccagggagatccagacggccgtgcgcctgctgctgcccggggagctggccaagcacgccgtgtccgagggcacaaaggccgtcaccaagtacaccagctccaagtgagctctcgcagctgccagcaatccaaaggctcttttcagagccactcacgcttccagagaaagagcctgtgcattttgcttgtagtcttttgggtggactccggccggcctccattaggagggaagacggcgggaaaaggtaagctaagctccctaggctttttgcgtgtgagtatagacgctccatcagacaaatttagcttgggttcttagatacccttggggaaaaaggcttgcagttgtgctttaagctataattacaagtttgctttcggttttcggttactctttccttttgtgttgttttttttttttttttttaaatggagtcttggctctgtcgcccaggatagagtgcagtgccgcga

SEQ ID NO: 4687 - DNA, 1267 bp, Homo sapiens
gcctctaatttttgtaaaaaaacatgttctcacctgttgctgatttatcatagactgatcaacaccaactcctagagaaagtaacaaaagagaaaggagggcatctcctggccctcgggcatattacagaagcaaatgaaaaggaattacagtcaggtttctggtacgtcacagaaaacaggaatctaaggacaaagtttagatcgggaagcaaatcaaccctttgaatgcagaataaagtggcagaaggacccggcgaaggtcccagcgtgtctcgaggggcatacagggcggccagctggagccgggtcaacaaaaaagcaggtgatttttgtctaccaatgaatgccggcactggttcaacctattattagatatttgccaagtaacttcactactctaagtgacagtcgtcatttttatggtggttgtgaaatgtgtcttaattaagacacctgactcagactgtggttatggggattaaaccaggaaaaacgattagatcatgtttctacaagactcactgggagcactacacagacgaagaaattcaagttgttgattctttgtgtgacgaggtggccgagtggttaaggcgatggactgctaatccattgtgctctgcacacgtgggttcgaatcccatcctcgtcggctgcatagcaagccttttgttccaggaatcacaaatgatatggtaagcactttatttggcaaattcattccgtattcaccagccatttcaataattccctctgatctttcctgctctctgcttctttagtaacacttgtcttagctgtgaatgtaatttgttagttgatttatttgattcaggcttcattctcatgcaaattttcattccttcacaagttttgcttagcgggattccccattgaggaaacaattgaagatttaattgagggctatagaaaaacattgcctgaaaaatttaaaggtacttataaaatcataaagagttacatatgcaacattatgggtattgaaccgtatgggttacttaaggcattttcagcctaattgtatatctctactgaaattttcatttattatcttaatgctaacttttaaagcagtcactattgcctaaggattccatctttgaaaaaggaaggagagtgagagtgtctcttagagatatagcaaaacttacaaatacattccatagaacatttctagttagtactaaagcatttcctcctgagaaaggaaagaagaatgtcagtattatgtagtttccatttgt

SEQ ID NO: 4688 - DNA, 1198 bp, Homo sapiens
ttcttgcagttactactttgccctttagatacaaaatgctcagaattaattccttctgagtgggcggcagaggagatgcagggcaaatttagctctcccattcaaagggtgatcttgagggatacctgcaccatctgaaaactggatttggagacatgaacttactcttggtgagtaaggcttatgatttagaagaaatataaaattacctatgaccttttatccattctttctattctcattttcctctctaaacagacagctaaaattttactttttctgacaagcagtccacaattactgagctcttattgcagtatatttttgcttctactcagtcacacccagtacacctctgtttcaagatttatgctgtaccttctacctgaatgctctttccccaaatttcacatctccttccttctctttattcaggtctttactcaaaatgtcactttatcagtgaggacttcgtcaacttctttatataataaaaatccttttagcatgccttatatccctttgtgctgagttattattctctctagtacttatcactacatgacccattagttatttatctatgtgtctggcgtctgttccctccaactgcactgtaagatctggaagggcaatatctattttttccaattgtgtacccctagcacctagaatagcgaataatccttaataggtgctcaaataattcttatcgaataaataatttcctaaagtataaatatttctaaagcatggtccaaagaccacttgcatcatctgaagtaatggttgaaaatacaaattcctgggtccaccaatgacttacagaatcaatatctatgaagatgcaaggcatgaatatatattttgaacatttacattaaacaattacaacacaaagataaaatggcctaattaaatgcataatccaaaacccagtaagaacaaactaacataataaagagtagatacattggttcataggtggataaaacaagaaaaaataaaagaataagcagatttgcatagaattaatcagaagaatttcttgggtttggcatagttatccaaagtggcataaataatgtaattattggcttggagctggatgaaaggcagaccagctgggtaaggagtatgtgatttctataaagaaaactgctccagcttcaagtacaagtgcaagataagaagagac

SEQ ID NO: 4689 - DNA, 1149 bp, Homo sapiens
aatccaacatctttagcctttaaccgtcccagttgctaacggagtggaacgagtttatttttataacagaaattccttcactacctccttgttttctaagaaaaggcgtgtagcggtttctggagtttgggaataggacgcagagatggggtaaggaattggaggcagttcagtagtttccctaagtaaagacagtagttggtaaaacatttgctatcttttctggaaggatctttcctgtgtcctgaaaatcttttttacaaatgagaaaagcattcagaaaaggaaggtctgggaggatgtttcttaactgaaatttcctcctctagtctgttcttaatccttaccaaatgtctgcaagatgctggttaatcaaaatttcttggtgatagagggctacaaaaaggggaaatgaaaattttaacgttcgttcatgaaagaataaataaatgtttaaaaaaaaaaaaaactgaggtaaatttctatattctttcataaaagcagtttaaagacgaacgtttttcgaggtggggatgtagctcagtggtagagcgcatgcttagcatgcatgaggtcccgggttcgatccccagcatctccagtgtttttgtatttatgctccggaaccgtctttcttttacagatacagtcacagcctatttctgtagaatcggaaaattaatcatattgcccccactcccgtatttatatcttgctttggttacgcctgtagctctttcatttttaaaatttcattcctgcctggccaacacggtgaaaccccgtctctactaaaaatacataaattagccaggcgtggtggcaggcgcctgtaatcccagctacttgggaggctgaggcagaagaatcgcttgaatctgcgaggcggaggttgcagtgagccgagatcgcgccattgcactccagcctaggggacaagagagagacttcgcctcgaaaaaaaaaaagaaaaagaaaaaaaaatttattcctctccattctcagccgcatttacatatgatgagtgactttggaccctgttccattagggcggtgctggaaggaacatttaccaataaaaggacaattatcaataaaaatcctaaatggatgttttgtgaacgaattcatcttttcactgagttttgc

SEQ ID NO: 4690 - DNA, 1185 bp, Homo sapiens
gcttcggtgtcaggtgagctagatggtatgtgtggcccgagccattgcatgtggggagaaaggtcaggcaggattttcacgttttcatctatttggacagttccttcttcgagcggggtcgagagcgagaggagcgacagctcccaaggtacatttcatcattcaacgtactcagatgcagggaatttgggttgcattttccatgagccttcggctagcagaaaatctgtcaaaagatcttgaacaatcccttaattctttccgcctgggattcaattgcgccaagaggactaattgtgctaaagctataaaagtgtgctttgctctcagtaacgacacaagctggatgttgttagtgtgtcccggaaggaggttactcaggtgtaatctgggttaggctttaggtggaattcatcctcagagttggtcactccctggtcgagcacgaggtaatataaaatgcttcgcgtttttaacatgacaggaattctccgttacaaccgacttgtgccaggggatgtagctcagtggtagagcgcatgcttcgcatgtatgaggccccgggttcgatccccggcatctccaaggcgatcacgtagattttgtttaattcagcctctggaacagaatataagaaaaacaaagaaaaaactattttagtcctttctcatttttgccattatcatttcctttaaatcgatcaatttcctgtctttatgtttgtttctcttctatttggttgactagccacactccatattcctgtttcctggaaacttccaaggtgttttattatgtggtgagtaatacaaagtcagagggacaattcagaaatgtactgttcctatgaatgcatccaggaagagggaatagagctgaatatccaagaatgttttaagatctactaaatgaggccctaatccattcccagtctccagtgaaaaactatcagtaaaaataaaatgtctccgtatcatagttttttttttgcggggtggggaaagtggaataggatggaaaagaggaaagtagcatgctttttttagttttagtattcaggtgggagttgctttcaacttaaggtccactctatcaccttaagataatgtagatcttgtcctacagttactaacctggtaaccattttctcactgcacgttttcaaggtttttgtgtgggaaagct

SEQ ID NO: 4691 - DNA, 1199 bp, Homo sapiens
ctccatttaaagttgatggagttttgaagtcgctgttttaaaacccgtttgtggatataataatcgtcaagcgagaaatagagatggggtgtggaatcagagcaggacaatctcagaacctgggactcacgaaaagagctggaaaatggatgttggcagagcctccgacccagcatggtgtgaagatcaaggaaagcccgcggctgcctctggactgaaaaacacttttttctgagtcattatcgctgctatatatgttggagacttgagactgtctcaggaccttcctggtggaggcaagaaactctcaccgagtcgccggcaagtggaccttggagcaagttaacaggaatgggaaggtcctagaatcaaaaacggtgctattcagactaaaatctgttactcgtctaatgaagccactacacagtatccagtcttgtaatttcagagataatgaaatttaatccagtggactttctctacctaactcttaagttaaaaaactataacaaaacaaaaccaacaagaaaaatagcaacaacattttataaaagaacccaggaagtttgagagtcagggggtgtagatcagtggtagagcgcatgcttcgcatgtacgaggtccctggttcaatccctggtacctccatttttccttcagccaatccatcctctcattatggacctccattgatttgggagaagcagatctcatgtctgtttgggtgagtgattggaagaacttggataacccaaaccgcgtttcttaaggaatgcggagcttgccaatgtgaactttgaaaactcatttgcggccggacgcggtggctcactcctgtaatcccagcactttgggaagccgaggcgggtggatcacgaggtcaggagatcgacatcatcctggctaacacggtgaaaccccgtctttactaaaaatacaaaaaaattagccgggtgtggtggagggcgcctgtagtcccagctactcgggaggctgaggcaggagaatggcatgaacccgggatgcagagcttgcagtgagccgaaatcgtgccactgcactctagccggggtgacagagcaagactccgtctcaaaaaaaaaaaaaaaaaaaaaaaaacagaaaaagaaaactcatttgcaagtttgagggccagatgctatcagcatgcagggagaattagatatggtagggggctt

SEQ ID NO: 4692 - DNA, 1199 bp, Homo sapiens
gcctggagctgttttctttctggtcttcgctctctagggatctcagccagtgagcagcgtcttggacagaatgccgcttccacgcttccgtagacgctgggcccagcggcttgggagggttgtgactgacacatgctttacacttcatttcacgctgatattgtgaattaattcccctccagtcttatctcctctcttggacctccgttccctgagtagctctcctagtactggtcttagtattccctagtagtaccgtttatgtttttctgggagcactgcagacagaaaagtaggaagttgactgtttaagataatatttctacctgggattctccttggtggtggacaaaagctgccattcgggaagttccctaggaacagtctttggagggtccgccattatgaaagaccctaatagcactaaagggatctttcggtccagaatgcaacttgagggtttcagaaatagtagagttggatagagtagactttgacctcggtttaaatcgtagaacactagcagataacagtgacagccagttataaaatatagcaaaaaagctagctttaagggggtgtagctcagtggtagagcgcgtgcttagcatgcacgaggccctgggttcaatccccagcacctccatgtattatgctcatttgcctagcggcccagagcagggacccttggcagaaaacagcacgatttgcttcatgagtggcaacagactcaaaagtagcctaaggtctacgttttgggtggtatgtctaaataatgctgcattgaagcgtgggattaggaagaaccaaggcccttggaattaaaatgaatagcagtaatccactttcatcgtttgtttcttacccacagtcaaccgcgatctgagattactacatgaaaaattccagaaataaacaattcataagttttcaatttctctgttgtgagcagcatgatgaaatgtcgcctcatgtgctccatcccgcctgggaagtaaaccatctatttgtccagcatatccacgctgtgtagtaagccacccactagttagtcagtcagtagccatctgagttatctgagctactgtcctcacgttgcttgtgttcaaataacccttattttactcaataaaggccccaaagtgcaagagtagtgatgctggcagtttgggtatgccaaagagaagccctaaagtgct

SEQ ID NO: 4693 - DNA, 1214 bp, Homo sapiens
agcctcccgagcagctgggactgcagctattaggatgcattaacgaggattgagagtcagctggaaaatggatgttgtcacactgtccgacaaatacagtgtgaattcagctcgccgacggctgcctctggactgaggagcacttcatttgagttagtattgcgggagaaaatagaagtgtggcaaacatagctcaattggaagagctctggactaaaggtctagactaaaatcagggatccttctccatgactgaacagtcctcaatgttggaagtttgtgctttttgctggtggaggaaagtagctttcatgcagtttgcttgtgaatggagcttgaagcaggctaacaggaactggaaagtccgaggataagaaactgcgtcatttggactataatcttagtgtcttagtatactgttataagtatattaggatactgttagctgccaaacagtatccagttcagtgatttcacgaaagtagtggaatttaatccagcgatctttctccaaccaacagaaaatgaaaccaacaaactgaaaacaagtgatattttatatataagccaacagaactctcatgcggtcagggggtgtagctcagtggtagagcgcgtgcttcgcatgtacgaggccccgggttcgacccccggctcctccagttgtccattttcttcattctcctttctggttctttgcatgcgtttgtcactttttctcctactcctataaaaagaggacagtgtcaaatgtgttgcttttaatactatgctatttattctggcactcatctgtggctttttataaaacttagcttgagaagaatgtcttgctaacgtgagtgaaacaagcagacattgaaagggggacacaaattaccccacaaggagttcttctttatattttttccagacgcaaatatcttttaaattatgttgattaaggttaaaactttctaggcttacatcaaagctgtgtgtgggtcatggcatcatttctaactgtatgtagatatcgacttgtagcccagcgtaaaaaaaaaaaaaaaaaaaaaaaaaaaaaaaaacctaaatagataaattttccatcaagatctccttggcaggaagcacgaaccctgcaatctcattacggacccatgcactttgagttccgtttggcggtatcgctaaagagatagactaaaaaagaatggaaataagaaaaaataggc

SEQ ID NO: 4694 - DNA, 1202 bp, Homo sapiens
tcatactcaagaaaccattgcctaaaccaatgtcaagaatattcccccctgttttcttcaaggaattttacagtttaggggcttaagtttaagatttaaattcgtttttagttgacttttgtgcattaacatcttgtcttgtctcctcacctggatctacgtttcctctgcagcactcacagaactcgtctttatattctctggcactatcgcgcgcgcgtgtgtgtgtgtgtgtgtgtgtgttggcagctccatagaggaggtttttttaaaaaggagagaatctgaagacataccagaagattcaatcttggaacttcgctccaggtggacggaaactgacaaagaaagttggctaacagcagtccttgaaatagatgacggctgtgagaggatccaagggtctttcggtccagaatgcctttctcctcttgacacagcgtcaagacaagattccattcagaagtttcagaaacaggagttaaaacatagcggactttaacctatcatgccttaagccctcacctttagataatagcatataataaatcagtaagaaaacggcattgtaagtgggggtgtagctcagtggtagagcgtatgcttaacattcatgaggctctgggttcgatccccagcacttccacaagtacatttccttatatctatcgttgaacatttcgtttcagtctttgaatacttagttccagtcttttcttttttctttgtgcatacactagcttgtgtttttcctactcacagcgaaggtaagccatttggtactcattcatttgtactatgggtcctaacactccttcagcctcccaacctgactgcttcagcacagctttatagttatttactgaaatagagaagctgcttattcaagatcccctgagagtgaagcaacaggcatgccggtcatagaagactcgttctcctagaccatcctggctaacatggtgaaaccccatctctactaaaaatacaaaaaaaaaaaaaaattagccgggcgtggtggcgggcacctgtagtcccagctactccagaggctgagacaggagaattgcataaacccgggaggctgagcttgcagtgagccgagatcgcgccactgcactccagcctgggcgactgagcaagactccatcacaaaaaaaaaaaaaaaaaaaaaaaagactcgttctcctttgctgccgttt

SEQ ID NO: 4695 - DNA, 1231 bp, Homo sapiens
ctaaaacctttagactgtgaccagcaaaagcggcactaaatactaaaccaaaagacactgttacacgcggttttcctctctggccagccagaccgccggtctgaggtccacttgccaaagtgatgcctggctggcagtttcatccaccaacagaaaggggtccattatggaatgttctcttgcatcttcaaattcttcctccttcgtctctcttaccctctgcctacaaaggcttcaagaaagagatgcaagacaatactgagggatacgaacaaaagtagctccacagttgcctcgagaagtttaggttgcaggtaattggcgagaatgaaaccctctgtatctagcaactccgcagtgctttgtgtagaagacgctccatctcaggttacgaaaatctacagaaaggaaatgtttaaaaagagaaaaggaaaatattcctagggattataatgtctctcttaagcagggtcttcgaaaagaggataattcaagtaatatgatttacaaattgcaacatgaaacaaaatgaactgaacaaatggagaaatctagattacatactccgtgggttgcgtctacccagggcctggatagctcagttggtagaacatcagacttttaatctgacggtgcagggttcaagtccctgttcaggcgaaatatttgtgtgttttactctagctccggagtccccaacctccagtaaacgtaaccgcgtatcaggcagcgcggcaggcgagccagagaagtttcatctgtccttatacagcaactccccaacgctcctgcgaccgcctgagctactcttcctcccagataagcgggggcgtcagattctcacagaagtccaaaccctattgtgaactgcgtatgaaagggatctagattgtgggctccttatgagaatctaatgcttgataatccgtcactgttttccatcagtgccagatgggactgtctagttgcaggaaaacaaactcaaggcttccagtgattctacattatggtgagttggatacttatttcattatatattacaatataataacaatattaaaaaagtgcacaataaatctaatgtgcttgaatcatcccaaaatcatcccccccaacccctgctccctcatccatggaaaaaactgtctttcatgaaacggtctctggtgccaaaaaggtggggaactgccgcccaagatagtttataccaattaagcacaggaagaagttc

SEQ ID NO: 4696 - DNA, 1216 bp, Homo sapiens
tggcgtgatcatagctccctgcagcctccagctcccaaggtcaagtgatcctcctgcttcagcctctggaatagctgtgagtacaggcgcaggacaacacaccagctaaagacccttaagatgaaatgctgagtgcatcgctctcaggttttcttctgactgtgattttcctcaatcaaatctaacctttaatattccggctgagtaaacaacaaatatgaagcattttaggtaagaaaaagctgaatttcaataactttgcgtcatctctgaaagaaatcgaaagaatgaaaaaccagaatttgattccttgccaagcataacagaagaaggagatcctgacaactcaacgttttaaagccacattggaaacttcttttggcggttatctgacacttttctaatactttgctttccatttcaagtcctgtacagtatactaaagaatctgtatcccctcattagtaccgagtatcttctactcagagcagctgaaggcgctccatgatactaaccactactaccagcatgctcacggagccagtctcagaaaatgaaagttacctcctgaaaattattacaaaacagtctttcaggaggggggtgtagctcagtggtagagcacatgctttgcatgtgtgaggccccgggttcgatccccggcacctccaaatggtggttttgctctggcagtgcttaaatgtaattctcaagcaacatagccttctgcctcctcacctttttctatcctatttctgcacgtatagagagtaaaaacgtaacccaatggattgccttcacttatctcccatctctataatgtaagcctcaacatcacctaaggcgattgcgacggcagaaggaagaggagaaagaagaatgaggtcgcaacagggtctcttgaaagcaaacaaaagcgtgcacatcaacaggcggctcactttggcttcggttttgtactatgattaaagagaaggaaaggctgagaagaagaaaggcagaaaagcccccccccgccccccgggcatttcgttttggtcgttgtttttgttttctgagccaaatccagagtcaaagcatctgtccactgatttctctccctgtcgaactgcgcagagagcacagccacaagtgcgatccaaagctgagaaaatgtggctctccagccgcttgagatgagagtggcaggacgctggacaaccgaacgaagactgtc

SEQ ID NO: 4697 - DNA, 1166 bp, Homo sapiens
tacaggcgtaagacacagcgctcggctgatacaacccttatacaacacttgcatgccaatcccagaaaggtgtatagaactccaattttttgctgttgaaaatccgataaaggtaatacacacacacacacacacacacacacacacgcatatatatatatatgcatcactctctgctttggttgcatattccagtgaagtcttccatgaagcgctgacattaaataaattatttacagtctgaaacctaggaagtgattttttttttttttgagattgagtttcgctccgatgcccaggctggagtgcagtggcgcgatgtcggctcagtgcaatctccgcctcccgggttcaaggattctcctggctcagcctccccagtagctgggattacaggcgccttccatttcaagtcgtatactgtattctaaataatttgtatcccccgttagtacctagtatcttctactcacagcagctgcagacgctccacaatactcagaaaaagaaagttacctcctggaaattattacaagaaggatttttttcaggaagggggtgtagctcagtggtagagcgcatgctttgcatgtatgaggtcccgggttcgatccccggcacctccaaacggtgactttttgctctggtagtgctcaaacctaattctcaagcaacatagacttacttctgcctccgcacctttttctgtcctatttctgcacatatagagagtaaagacgtaacccaatgggttgcctccatttataacccatttctatgccgtgagcttcgacatcactgaaggcgattgtgacggcagaaggaaggtgaaaaagaaatgaggaagaaagaagaatgggatcccaacagggtctcttgaacccaaacaaaagtgtgcacatccacgggaggttcacatttgctctcattttgtgctatgattaaagagaaggaaagacaaagaagaagggagaaaagcgccccgcggccattctttttttttttttttttttttttttggagacagagtctcgctctgtagcccaggctggagtgcagtggcttaatcttggctcattacaaccgctgcctcccgggttcaagcgattcttctgcctcggcaggtgggtttacaggtgcgtgccatcaggcccgggtaatttttg

SEQ ID NO: 4698 - DNA, 1247 bp, Homo sapiens
ctacaatcgctaactcccaagttcaagcgatcctcgtgcctcagcctctggagttgtgagtacaggagtaagacaccacgccagctaaggacccctgtgaaaaaatgttgagtgcaccgctctcaggttttcttctgatcatggctttcctctatcaaatcttacctttgatattccgactgagcaaacaacaattatgaagcgttttaggcaggaaaaggctgaatttcaatggctttgtgttatatctggaagaaatcaaaagaaacgaaaatcagaacttgattcttgccaagcataatagaagcagaccctaagaactcaacgtcttcaggccacaaaggaaacttcttgtggttattatctgacacttttctaatctttcgtttttcgtttcaagtcctacacagtattctaaagaatctgtatcccccattagtaccaagtatctcctgctcagagtagctctccacgctctatggtactgaccactattaccagcatgctcacggagtctcagaaaatgaaagttacctcctgaaaattattacaaatgggtgttatagtaagggggtgtagctcagtggtagagcgcatgctttgcatgtatgaggcctcggttcgatccccgacacctccaagtgatggtttccctctggcagttctcaagcgacagacctctgcctcctcacatttttctattctatttctgcacatatagtaagtaaaaatgtactccaatgcattgccttgaactatctccaacctctatgctgtgagcctcaacatcacataaggcgattgcgacagcagaaggaagacaaaaaagtaacgagggggaaagaacaggatcgcaacagtggtctcctgacccaaacaaaagcatgaacattcacaggcggcttgcgttcgctcccattttgttttgttttgttttgtttttgtttgtttgttttgttttttgagacggagttttgctctcgttgcccaggctagagtgcagtcgcaccacctcggctcactgcaacctccgccttccggtttcaagagattctcctgcctcagcctcccaagtagctgggattacaggcgcccgccaccacgcccagctaatttttttgtatttttagtagagacggggtttcaccatgttagtcaggctggtcttgaactgccgacctcgtgagccacccgcctcggcctcccaaagtgctgggattacaggcgtgagccaccgcgcccggcct

SEQ ID NO: 4699 - DNA, 1247 bp, Homo sapiens
ctacaacaactaactcccgagctcaagcgatcctcgtgcctcagcctctagagtagctgggagtacaggcgtaagacaccacgccagctaaggacccttatgaaaaaatgctaagtgcatcgctgtcaggttttcttctgattgtggctttcctccatcaaatcttatctttaatattccgattgagcaaacaacaattatgaagcgttttaggcaggaaaaggctgaatttcaatggctttgtgtcgtatctgggagaaattaaaagaaacgaaaacctgaacttgattcttgccaagcataatagaaggagaccctaagaactcaacgtcttgaggccacaatggaaacttcttgtggttattatctgacacttttctaatctttcgtttttcgtttcaagtcctacacagtattctaaagaatctgtatcccccattagtaccaagtatctcctgctcagaacagctctccgcactccataatactgaccactactaccagcatgctcacggagtctcaggaaatgaaagttacctcctgaaaattattacaaagagaccttatagtgagggggtgtagctcagtggtagagcgcatgctttgcatgtatgaggcctcgggttcgatccccgacacctccaagcgatggttttgctctggtagttttcaagcgacagacttctgcctcctcacgtttttctatcctatttctgcacatatagacagtaaaagtgtagcccaatgttcagccttgaactatctccactggttatgctgtgaacctcgacatcaccaaaggcgattgccacagcagaagggagacaaacaagaaatgagggggaaagaagaacgggatcgcaacacggtctcttgaacccaaacaaaagcgtgcacattcacaggcggctcgctttcactcccattttgtactatgattaatgagacgcaaagacaaaggagaagggagaaaagcgccctgaaggcatctatttttttttaagttatttttgttttctgggccaaagaacagagcgaaagcctctgttcactgatttctccaccagtctctccctgtctacctgcgcggagaacacagctaccagtgtgatccagtactgagacaagggctgtggctctccagtcgcttgagatgggagtggcagggcgctggataaccacacgaagactgtcggggaattagaggccttcaacgtgcgagaagcagaaaccaatacggatcaaca

SEQ ID NO: 4700 - DNA, 1238 bp, Homo sapiens
tggtggtccctgtggagaccttcccagccgttcccggctaccacttttagagcccaagacaaacttcgacgagtggcaaggcagtgacaaatggaaccaaaatagaggggctaaaaggggaccttcctatagaaccggggtcttttgttagggttttgttttgttcctcaccatcttccaaacaatgaagtcctgggggaggctaaccacgatcaagatttcagtaaacatcagacactggagagccgacccagcgaccgaagaagcaaaagatcttctttccttcctgaaatctgggcaggctgggagcaaaaaaaaaaaaaaaaaaaacccgcacacgtttttcgagatggcgataacagttataaggcccgtaagagacttgatccagttttatgcagaaacattttctagtcctgcgaacccttttgctttttcaatccacaagtggctttctgcccttctgttaccaagcaaccctgacgtcatcgcgtttctgcgtgcgtgcacgacacagaatcattgcttgttgatctctattttagtgcaaaaatcagggctgttatgcagtgtgtcaggatggccgagtggtctaaggcgccagactcaagctaagcttcctccgcggtggggattctggtctccaatggaggcgtgggttcgaatcccacttctgacacatacttttctttttcctctccttactttagagatatcctgatctcagcagtaggcataaacaattaccaacgtatatttttaagaatcggcttttaggtaccgggcgcggtggctcacgcctgtaatcctagcactttgggaggccgagacgggtggatcacgaggtcaggagatcgagaccattctggctaacacggtgaaacctcgtctctactaaaaatacaaaaaaaatagctgggcgtggtggcgggcgcctgtagtcccagctactcgggaatgaggcaggagaatggcgtgaacccgggaggcggagcgtgcagtgagccaagatcgcgccactgcactccagcctggggacagagcgacactccgtctcaaaaaaaaaaaaaaaaaaaaagaattggcttttaaatttatctcaaagggcttgtccaaactaaaaacattaaaagcggaagcatcgcgatatttttacgaagccgcgagatttgggccaaaaaacgcctaattaaaggcagaggttactagcgattggtctctgtgctgcagtgcgagat

SEQ ID NO: 4701 - DNA, 1168 bp, Homo sapiens
cctttaaacatgaatattggacctcactaataatcaaatcagaaaaaaaagggggggcgctatatcatttgttacctattaaaatgtgccaggagcggtgggtcacgcctgtaatcccagcactttgggaggccgaggcgggcacatcatttgaggtcaggagtttgagaccagcctgaccaacatggtgaaaccctgtttctactaaaaatacaaaaaaaaattagctgagtgtgatggctcatgcgtgtagttccagctactcgggaggctgagacgagaatcacttgaacctgggagataggttgctgtgagctaagatcatgccactgcactccagcctgggcaacagagcaaaactccgtcaaaacaaacaaacaaaaactggataaacattgatgtaggccgggcgcggtggctcacgcctgtaatcccagcactttgggaggctgaggcgggcggatcaagaggtcaggagttcgagaccagcctgaccaacatagtgaaaccccgtctctactaaaaatacaaaaattagccgggcgtcgtgacgggcgcctatagtcccagctactcgggaggctgaggcaagagaatggtgtgaacccgagaggtggaagttgcagtgagccaagtcgtgctactgcactccaccctgggtgacagagcgagactccgtctcaaaaaaaaaaaaaaaaaaaaaaaatttgatgtaatggtttcacttttagaaatttaaggaaataatcgtggatgtttgaaaatatttatgtaaggatagtttttacagcattgctgatgaaaataaaaaattagaaataatccagttttcaagaataccactttgatatggaatatgtgcaggaattaagatttatgcaaaatatagtacttagcaagtatatattcataatatattcatttagaaagcaagttagcaaattatttactacacatgaccatttttggaaaatgtataccatatgaaagactaaatatataaaaatgttaatagttacctctgactagtgagattatggatgattttaatttttgacatgtttgtatgttctacaatttgtgtgtactttgcaattagaaaaaaataattatagttagggtaagattacagttgccatgttgggaatcacttcctggacaatttcct

SEQ ID NO: 4702 - DNA, 1246 bp, Homo sapiens
agtcaactcctgttactcacatcgacagtcatttttcatgttcaagacccctgaaccgctctcatcccccactctccgctaactctcctgcttcgcttcaggtctacattgcctcgctcatttcttccctgctgagctctttgattagtttgctaagcagcatctcgggaacagcccccgtgctatgtgttctttcttgtcatggatatgtgttttttcttgtcatgctatgtgttctttcttgttcaaggcagagtcgcggctgggttgttaggatgctcgcgcccctgtacccggggcgtgcagggaagtgtaagaagggggcgaagggcgagaaacgctgaattctagcctgaattggtaggagagcctcgcaagctgagtcacggttcctgattccatttaaatagaacgttttgttcacttgtaggaatttccttttccatttctttcattaaatcgcgaacgtagtaatgacttaacgctggttacgcattcattacaatcgaagattatattaatttgcgatggtaagtgtcccaggtgtcaggatggccgagtggtctaaggcgccagactcaagcttggcttcctcgtgttgaggattctggtctccaatggaggcgtgggttcgaatcccacttctgacacaactatcttattctccttttactctactttctcagccatttctgtgttttcattctttctacctcaactttttttattctaactaaaatgatacactctcaatgaggtctgcccccttgcttttcagtcttgttcgctgtttagtagtgaatcacgttttgccccgctttggtcagttcgttaaaaggcgcattcatttaccacatgagcactcacccagaggcgtactgggaggaaactagactaggtaggaatagaaagacatgtatacagactccatcattacatactggccctgagctcataggttattgggaccgcagattacatgtttttcctcacggccagaaaccatcaaaaataaaagtgatgaaactgaaattgaaagcagcaaggttcacgctcaaggttatcggaaacaaggcaaaaggagagaaatgaaaggttccaccgagatttgaactcggatcgctggattcagagtccagagtgctaaccattacaccatggaaccctacttaacaaaaaatggatactcgatccacctggggtctctcttgtcttctacttactaattgatttaaagtaattttgc

SEQ ID NO: 4703 - DNA, 1197 bp, Homo sapiens
gacttcaggagtaagcaaggccaaccgtttggtttgagcctgttgcttctaagaaaagcgaggaaaaatcctgagacctcctcccctcgcccttcatccacttcaggggaccgagtgtctccacggaacttcacaagggaggaaaagagtgaactcattattatttgtcttgtcttcgtttcagaggcggtacatctacgaaagccctaatcatagagggaaagactcctcgttcctggcccagaaatgagatgagaaatccagggccccgtacaggaaggcctttcgcaaagtccagactcaattgccttcgcagcccttaaagtttccttaggaaggtctgtgggagaacgaggttggtttaggaattggcccctgccttgtactacgtagttttgtcatccaaagtgttttagaagtgaattgaatcatagttacgccttattttgaaacactgtaattcagagaacgtaaaaccttattaaaatgcctcataatcatcttggtagagccgttggttaagcgggagagacagttgcctccttagcgcagtaggcagcgcgtcagtctcataatctgaaggtcctgagttcgaacctcagagggggcaaggcgtctgttttgccattttacttcttcttgatccaaaatgagtaagacaacaaaggaagttgacaaaacgttgttctttctctgctttctctatagaaaagtgtacaatatgtctggtaagggaaaaaaaaatctaaggacattgctttgatggaacagaacgggtaattgctgtttaatagaaccatgttcagttacaaaacagtgattttcactaagaattaaattctccaaaattctcatctcccctcccgccctgcataccaattggagatagagctggtagcattttcaaatgtttttcagatatgcttggcaattgtctttgttttaacaacaccagagtcaagaaacttgccagttttagagtgctgagataagaaaaagtgggtggagggttgtactaggggtgtggaaggtatagaatctaattatcaattactgacttggttatcttttaccattcttctggaatggcttaccaccaggttgccaccaataacattccatatgaaaaaagaaaggaaacaaaaaactgacaaaaaactcccccctcagtctcattgcattggaccttttctcttg

SEQ ID NO: 4704 - DNA, 1181 bp, Homo sapiens
ccgggttgaagcgattcccttgcctcagcctcccgagtagctgggactacaggcgtgcgccaccacgcccggctaatttttttgtattttagtagagacgaggtttcaccatgttggccaggatggtctagatttcctgaccttgtgatcgcccgcctcggcctcccaaagtgctgagattacaggcgtgagccaccgcgcccgtgtgccaggtgttcttaaggtcgcagggaagactggagcataacctttgaagactaaagacaagacaaacccggcgattacgtctgtagttatacattgcttttacaagtaattgtttggagtacattacacaaagatgggagttaattttttccatgagttggggacaaaaataactgtgagccatattcaaagtgggcaaaagcatagatgggaataaagaaaaggaacatggataggatttaagttggacgatatcaagtttctgcacctttttactcactagaatgtgcaggaagaaggcttttgcagggagcccggatagctcagtcggtagagcatcagacttttaatctgagggtccagggttcaagtccctgttcgggcgggagtggtggcttttagtacctgattctggtatcatgtttgaaaaagccaaaaaggatactatcgttttatagggacagatttcatatactgcaaaaattcaccaaaccctgtagaaccccaaattttaaaccacgaataggcgagtaactctgatgccaaataaaagtagtaaggtgaatacatgggccctctacagtgagatagccccagattttctgaagaaaactaacatttaaggacaaccttagaatacgaagtatttaatattttatgattcctgttactctgcttacaggtgccaaagtaatcttctgttgttacttgctttccagtgcagagtttattttacgtaggagggaatatactgatcaattatcaagaaagttataatatgttcatattctggcttggcatatttctggcatttagttaccgtgagtcagccctgcaagtcttaaaaactctaggtgaatttaaaaatagtttccggccgagcgctgtggctcacgcctgtaatcccagcactttgggaggccgaggcgggcggatctcgagaccatcctggccaacacggtgaaaccccgtct

SEQ ID NO: 4705 - DNA, 1100 bp, Homo sapiens
ggataatgagagatcttggggcaccttatggaacttgggtcctgaccttcccttcccttatagcattgtggcctctaggatgtgagaagggaaatgggatgtagggattagggaggtgagttgagggagagagagaaggtaagcaaatttgggtccaggggtattaggggatagcttataatgaggttttttttcccacccctctcccctacatgaataattgggggtgcagggaaggatgtgacacagggaaggagatttaagatctcaaatttatcttcactgacatgtggccccagagacttaaggaattgggttagggtgaaatagagtacacaaggtgagaatttggtgatcttaccaaatatcaaccttggggtgatccaaggatttatattcatttttagaacatcactatacacctagaaataggtgtgtgtctgggataggtgtgtgaggggacagaagtgaggttgaaggtagggtgcttgaagagaagagagcacaaggattatcaggagcttggcaagagaacttaaaatcctttttgactgttactttctcgtggttctcagccttcagtgtacataagaatcaccagaggagtttgttaaaaatacagattctagctccttggtcagggatgaatcccaagtatttatctgtatttttactaatagacatcctatcttggtggattcctgagctgtaagctaaccccagaatgcctatgggaagagcagcagggtacaggaaaataattaggtattagggtacgggaggcaggaagagaagtagaggatcagatctggtagagggtcagacttgggacagtcagagagatcattggttttggggagtggagtgtgaagaaaatgacagggagagatgggtgcaggctttatgataggggatcacaggagataggggaggcctggctgtgagctcaaactcatccaccatgacaggtgattccctggaggtggcggggagcagacgtgggacctgggagaagggaactggagaacatcagaggcatcaagcggggtgggatgggaaggcagaagaaccagaatgtgtcaattggaatgagtcggttt

SEQ ID NO: 4706 - DNA, 1230 bp, Homo sapiens
ctgatcccgccctgggtctgcagtcacacatttctggaaacttctctggggtccaagactaggaggttcctctaggaccttaaggccctggctcctttctggtatctcacaggacattttcttctcacagatagaaaaggagggagttacactcaggctgcaagtaagtatgaaggaggctgatgcctgaggtccttgggatattgtgtttgggagcccatgggggagcccacccacctcacaattcctcctctagccacatcttctgtgggatctgaccaggttctgtttttgttctaccccaggcagtgacagtgcccagggctctgatgtgtccctcacagcttgtaaaggtgagagcttggaggacctaatgtgtgttgggtgttgggcggaacagtggacacagctgtgctatggggtttctttgcattggatgtattgagcatgcgatgggctgtttaaggtgtgacccctcactgtgatggatatgaatttgttcatgaatatttttttctatagtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagaccaccccacccccatgtccaccatgaccctcttcccacgctgacctgtgctccctccccaatcatctttcctgttccagagaggtggggctgaggtgtctccatctctgtctcaacttcatggtgcactgagctgtaacttcttccttccctattaaaattagaaccttagtataaatttactttctcaaattcttgccatgagaggttgatgagttaattaaaggagaagattcctaaaatttgagagacaaaataaatggaagacatgagaaccttccagagtccacgtgtttcttgtgctgatttgttgcaggggaggagagtagatggggctgtgcccagtttctgttctggccaccatgggctttatgtggtcacagctcacctgggtcatctttgctgctccattgtccttggcccttcagtagaaccttgtcccaccaagacctgtgatcacagggagttggatgtcacctagggtggtccctgcatacaaatctccttgtggtatcaagagacaaattttcagacctgtccaggtcttgccttcctcccagggc

SEQ ID NO: 4707 - DNA, 1380 bp, Homo sapiens
aagctagaaaaggcatttgctaagtgggaaagggatggtgttctaggcagaaggaattacattgtcgaagggcttagccaggaaagagcatagcactttgaggcatggagagcggtttggtttggctgtgagtttgaggtggggagtggcaggaaatgagcctggagacacaggctgggccatgattatctgggaatccagctaggatctcctgggacagcctcctcacagaagaaaggaaggacaggagttttgactttattcctggagcaccagaaagccattgaggggtttaacctggttggtcacccgggcagattggcagtttaacacgtgaccgagtgtgtttgaggatcaaaaggccagagtggctgcagcactggggcagcaaaggggagaggaggtttatgtaaatcaggaaacccttgagggtttgatgatcccacagttggatctgatttcagcttctaaaggattcctcaggtcactggatgtaagttctggtaggacagggagtttgccacttttgttctctgctgtaacctcggtgcctgacacatagtcggcacctaataaacatctgctagctgttgaataactttcaacatcctgctgcttaaaccctcaatggcttcccagggctgttaggataaagtccaaaattcttaacctgggtcacagtcttgcataatctgttccctcctgtttctccacccttcctctgctcgcctcactgcactccacctgtggccaattgtcagctcctcaaattcaccgctaccctttctccggcggatgatttcctctgcctgtgaggctaaccctccacagcactccatatgggcagggaagagttcattttccaggcaccaaagtgcagtgtatggtggaatggaaggagcccagagctgggaggtgcacctcaccccacctcgtgctagtgctggccttgctgccagccagctctgctgctgggcaaatgagtccgaggctctggcactcactgtcctcctctgtaaataaggggttctagtgattcacagtcctggatagactttagaatctcctgggaagtttgttttttaataccagagcctgggccacctctggagatcctaagtcagttggtctaggtatgttttgaagactcaccagtttgaagactacaaatctgatgtgtagtcaaggtttgaaccattccacaagatgataaaggattccttcctatatttggtgcaaagcaccaagtgacacttaggaatattttagacaagagagcttggttcatgattcaacattagacagatattctggcacaaatatgaagaaccctcaattttcccctgtgggtcagccacaagaccagggcaatttaacgcc

SEQ ID NO: 4708 - DNA, 1236 bp, Homo sapiens
cggggagggtgggtaagggaaagagagaaggtgggacattgaggaaagtactgagtgctcatttccctcaggttctggcagggatctaccctatcgcccagatccaggagccctacactgctgtgggctacctggcctcccgaattcccgtgcaggccctgctccacctgcgccacccagaggctgaggacccctcagcggaacacccctggtgtgcctgggacatctgtgaaggtgagttccatgtgcctggcttcgccccacctggtttcagctgctcttccttacctgcctcgccttttacccttccctgtctcctttcctctcctcagagattctgccattgatgaagctgctgtccactcacccctagatttttgttgcatagccagtaagatctctggcctggaatgttttggggaaaactggaaggactgtgttatgggagtgggagtataactggtacctggttaatgctttccctttccattattcttttcttcctccagcctgggcagagaaacgtggttacaagacagccaaggcggctcggaatgatgtgtacagagcagccaacagtctcttgcggctggcagtggacggccgcctcagcctgtgttttcatcccccaggctacagtgaacagaaaggtcagagcccagatattcttccccagccccctgctatagcgtaggtaaaagggtgtgggctttgtggccagagagagggtcaaacctggattctgtacctgttggctagctctgttacttaacatctgtgatattttcctgatctgcaaactgagggtaataattgacccttagcatagtgattgtaaagattgaagttgatgtgcacaaaggttctgttcagcaatctgcacataggaagttgaatgaatggatgaatgaatgaatgccagcagctctaaagattattgttattcctagtctttgcctcttccccatctttccttggctttagttcttgctcaaaactctcctccatttttttcttgttttggttccccaggcacctgggagtcccatccagagaccacggagctggtggttttgcagggcagggtggggccagcaggtgacgaggaggaggaggaagaggaagagctgagcagctcctgtgaggaggagggagaggaggaccgggatgcggatgaggagggagaaggggatgaggagaccccaacctcggctccagggtccagcctggctggcc

SEQ ID NO: 4709 - DNA, 1099 bp, Homo sapiens
caaggagctcacagttgagttggggtatcccttccagggaaataaattctatagactctcttttcttcccttcacagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagagggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagcgacactgatgcggaagaagagaggatcccagcaaccccagttgtcattcctatgaagaagaggaagatcttccatggagtaggtacaaggggtcctggagcaccaggcctggcccatctgcaggagagccaggctggtagtgatacagatgtggaagaaggcaaggccccacaggctgtccctctggagaaaagccaagcttccatggttatcaacagcgatacagatgacgaggaagaagtctcagcagcgctgactttggcacatctgaaagagagccagcctgctatatggaacagagatgcagaagaggacatgccccaacgtgtggtccttctgcagcgaagccaaaccaccactgagagagacagtgacacagacgtggaggaggaagagctcccagtggaaaatagagaagctgtcctcaaggatcacacaaagattagagcccttgttagagcacattcagaaaaggaccaacctccttttggggacagtgatgacagtgtggaagcagataagagctcacctgggatccacctggagagaagccaagcctccaccacagtggacatcaacacacaagtggagaaggaagtcccgccagggtcagccattatac

SEQ ID NO: 4710 - DNA, 1226 bp, Homo sapiens
gccaggtgtggtggttcatttcacatctgcagtcccacctacttgggaggctgagccagatgatcacttgaacccaagagttcaagattgcactgatctatgatcatgacactgcattctagcctgggtgacagaatgagaccctgtctcaaaaaaaaaaaaaaaatcaaataaaatccaattgtgtgctctggagatggatggtagtgatgattgcacaacagtgtgaatgcacttaatgccactgaactatacacttaaaattattaaggtgatacattttgtgttatgtgtattttataacagtaaaaaaacatccattgtggatggatggggtatcgcatatactctttcagtgcctagatgtcctagggccttttatttttctaatgcatatggaggccttgagtgagtagtagagtacctaataggcactttttcctaatgacaggccaggactctgatcttggagcttatctacctctctaattcttagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtaggtaagtttgtatattggcagggagaatgaggagacaggaataatgagtgtacaattgtcaactcattcctttctgttcttgacagattttctttctgaaaggcgtatggtaaaaaaatcaaggaccacatcttcctctgtgatagttccagagaggtgagtgccaaagagtcagacacctgagtcttcaaaatgaggaagaaccaggggctggaggatcaatctctaaaagagatgattatcatgagagttggggctggggaaccatacatattcattcactcagctgaatttttatggagcacatctgatgtgccaagtggaaaacaaattggaaacagaagaagaaa

SEQ ID NO: 4711 - DNA, 1738 bp, Homo sapiens
cagatgcttaacgtgcagaacaagaacagcagctactttgtggaatggatccccaacaatgtcaagacagccgtctgtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggaggcctaaggcagagcccccatcacctcaggcttctcagttcccttagccgtcttactcaactgcccctttcctctccctcagaatttgtgtttgctgcctctatcttgttttttgttttttcttctggggggggtctagaacagtgcctggcacatagtaggcgctcaataaatacttgtttgttgaatgtctcctctctctttccactctgggaaacctaggtttctgccattctgggtgaccctgtatttctttctggtgcccattccatttgtccagttaatacttcctcttaaaaatctccaagaagctgggtctccagatcccatttagaaccaaccaggtgctgaaaacacatgtagataatggccatcatcctaagcccaaagtagaaaatggtagaaggtagtgggtagaagtcactatataaggaaggggatgggattttccattctaaaagttttggagagggaaatccaggctattaaagtcactaaatttctaagtatgtccatttcccatctcagcttcaagggaggtgtcagcagtattatctccactttcaatctccctccaagctctactctggaggagtctgtcccactctgtcaagtggaatccttccctttccaactctacctccctcactcagctcctttcccctgatcagagaaagggatcaagggggttgggaggggggaaagagaccagccttggtccctaagcctccagaaacgtcttcttaatccccaccttttcttactcccaaaaaagaatgaacacccctgactctggagtggtgtatactgccacatcagtgtttgagtcagtccccagaggagaggggaaccctcctccatcttttttgcaacatctcatttcttccttttgctgttgcttcccccctcacacacttggttttgttctatcctacatttgagatttctattttatgttgaacttgctgctttttttcatattgaaaagatgacatcgccccaagagccaaaaataaatgggaattgaaaaaagctgcgagatgtgtgcttatttagggaaacacggctggctgatggaggcatggggcctgagttcagttgcactgctctccttaaattgacacttaatattgagtccctgtcctacggattcaaccaactggatattgggaaaagagttgtactggacatgtatagacttctcattattccctaaacaataatagtataaattatttacataatatttgcattagattaggtattacaagtaacgtagagatgatttgaagtacacaggttatatgcaagtactacattttatatgagggacttgggtgtctgccgatttggtatctcagggaggtactggtaaggacactgactgctttata

SEQ ID NO: 4712 - DNA, 1174 bp, Homo sapiens
agtgtctattgatctgaaaacacatgctatgaaacattaaaacgctacctgagaccatgtgtttcttttatcaagtgagagattcctttataatttggataatttcactccgtttgcaagtaggatgctctagaactgatgttataaagtcagtttaatgatttaaatcccattgtggagaaaatagatctctgcagaaaagtacatccctgccctttcccagctccccagtcaagggggggcttcctgctgagcctggagaatgcctctaagaaggtgactaatgtaccatatctggcccctagtgtgggcagcaggcaagtagtcaggtgccttctcaagtggagaaagttgaacgctattttccagagacattggatgtgagggtgatctggctatgacatctgtcaccccagtgattgccactgttgattctgctgatctagctggctaggtggtgtccccttcttccctcaccactccatgtgcatccctcctgaagctgtgtgctcagttgaagaggaggaccatccccaatagaggaggaccagtcttcggctaagggtatacgagtagctgcgctcccctgctagaatctccaaacaagctctcaaggtccagagacaagatgtgaacttcatgtctcaattgatgatcacgtggttgtgtggtggtgcagattgtgtttttgatgtgcagcaggatttgggcagtacagaggatgatgtcagcatatcaccatcatcctcaggtggggcagatcattatgaagtccttgcctctggtttccctggagtctaggtgagaggtgcatgagatatcccttgggtacctccctcctcccctcaaggtgaatgtttcatcaacaaaatcaagctaatagaagtctcaggttgtcacttttggtgtcttgaataggatatttgtgtgagagcccctttgattaacccattgccagccccctcccaccctgacctctgaaccttcacaatatccatcccttaccctccccgctgaccaagtggctctggatcccagtcaggcgctaaaaatctgctatttgtgcttaggttagctttacccatagctgaatggctctgaggttcacggtggaagatctctaagggggacagttttgctgctcctgggatggaataggtatgatggtgatcca

SEQ ID NO: 4713 - DNA, 1176 bp, Homo sapiens
cactcttgtatcccaggctggagtgcaatggcgcattctcagctcactgcaacctccacctctcgggttcaagcgattctcctgcctcagcctcccaagtagctgggattacaggtaaccgccaccatgcctggctgatttttttgcatttttagtagagacagggtttcaccacgttggtcgggctggtctcgaactcctgacttcaggtgatctgcctgactcgggcctcccaaagtgctgggatgataggcatgagccactgcacctggtgccctatgcaaactcttattttattattattattttttgagacagagtctccctctgtcacccaggctggagtgcagtggtgtgatcttggctcactgcaacctccacctctcaggtgcaaacaattctcctgcttcagcctcccaagtagctggggttacagacgcgcaccaccacacccagctaatttttttctatttttagtagagatggggtttcaccatgttggctaggctgatctcaaactcctgacctcaggtgatccacccacctcggcctctcaaagcaaactcttaataacaactgttgtggaatgacttgggaggtggcactcagagatcccaagtgacacatgagaagtccacagagagagatcatgtttagtggagtttggatggttgcttttatcagtgggcctgtaccttacagatgctatctcattatcttctaaacagactctgggccagtgaccattatctccctcttactgatgtagactcagccaagagaagccagatgttgagtcggaaccttaactctccctctcagacgcagagccctgctttctcccctcccatttgatactctgcttcctcttgcatgctgtgagaggcggcctcattactcctcttccctcctccagtccctccaagcctaattcatcacctttggctttgggatcatagtttccaaaccaaggattgtctgaacattgtctgacaatgccctttttttttttttttaggcagggtcttgctctgttgcccaggctggagtgcagtggtgcaatcatggcacactgcagccttgacctcccgggctcaggtgatcctcccacccagcctcctggtgcgcatcaccacatccagctaattttggtattttttgtagagatggggttgt

SEQ ID NO: 4714 - DNA, 1194 bp, Homo sapiens
ggttccatgtggcctgtgttggctgcagcatccaggctgccagggaggccgacttccgatgcccagggtgccgggctggcattcagacctaaggtccactgccaaggcaccatcggacacacctgcccatgagtagacacagcagcgagcaaataggtctgataaataccccccttcccttccctccccaggagggaatgactacagggaagaaggatggattgatgtggactcattcagggcctggagcagaccctggtggccaagacagaagagatggtttcctgccaaagatattgccacctccaggaaattgccagtgagctggaagttcccactattacaagccataaggccatgttgccatggacaccagaatatctgtagtcagagcacctatcagttgcaaaagccatgcctgcaaccgatggaaaatgtaagagggagttcttaaggttcttggtggcatcacccaaggcattctgggaaaacctagggcctggccccaaaacttccctactctgtggctagtcctgctgccaacaaaatcgtagcgacctggcttttcacagctttgcttttatttccaagtcaaggacaagccgcttcattcactcctgggcatttactcttcttgtgggtctgtgatattccttgctttccagggagaatgtgcttggcaaggtctggagaactaattcagaatcttaggggaaggggagagatggaaatacaaacctgcttactggaaaggtgcaaatatatgggttgagctggaggtaggaatacaggtaattaaggtttctagtttaagggaaaacagatctattgccatttaaataaggtaactgggatttggttaagttcacaaagatagcagaagatttatttacaggcttcacctgtactgtcagggcaagagaaagcctggtaaaccagctacagcagtttaccagtgtgatggctgtgacacagctccactccacgggtggacacagcagagggcaactgggctggcctggttcagtgtgaatcaaaccgcttaacccacacatggtacatgtgattttcttttgtgagccttacaccaagccaaactattgtcaaagcatcatttctatagaaataaagccttatcttgacctgttctattaaaacctgccacacccgccctttcctacctagatttaatga

SEQ ID NO: 4715 - DNA, 1166 bp, Homo sapiens
cgctaagaaataattaactgttaggtgagggggaatagatcctgttcaaggactttgtggactgtgctgttgtgggtgggggtggggtgagggaagggaaccctgaggtctgggctgggggaggtggggagaggagttggtagctgaactaagaaaagagctgcaggggtaggcatggtgtggggtggtgcagggtgggattgagggtttttttttcccacaccccagtgtaaattctcacaccctctgttcctacctgtggtgccacttaccctgggaggggacgtcatcttcccatttcctctggagctggtctgctcttccatgcttgctttggggttttgggagcagcacccatgggagccctggggtgccaaggaccaggagggcagaaggaggcgaaggaaatggtaccgagagagccagggcagagggaggaccatggcgggtgacctggcagggagctgtgtgagctgtccaacggccaccaggaactggttcgctccaggacttggcctcacttgagtgcctggccctgcccaggccccagcccccagccctgcccctgcccctgccccactctgccccacgtctctcccagcctggccccagacagagtccaggaacaactcctgttcctgatgtgaaaaatgtccctgccagtttaggcagaacttgctttagagcactggtgcccagcctaccacaggtctgtgattttttttttttgatctagtgtttattaggtatgaattttacaaacattagcggtagctgtggagctggagagtattgcaccttctccaagctgcatggcgagaaccaccaatagtgtggtagaacttacagccctttccaaggccgtggctctcttggcctgcagatagcctacgcatctccctatgcttgttgtggaccactgggtgtcaggtttccttctgatagtgttatggaatggatcaactaggatagcctcaaaaactttgtatgtggaatctttaaccagcccagtgagaattcaggactcagagccccacagtggcatccagcttgctcttctgtaacagactgaaggctttaagcaaactagctggttaacaccatgatagacaggcttgctgttaagttgccttcttaggaactagattttcagccaccgtggcgct

SEQ ID NO: 4716 - DNA, 1166 bp, Homo sapiens; identical to SEQ ID NO: 4715

SEQ ID NO: 4717 - DNA, 1167 bp, Homo sapiens
tcgactttttcataaatcacaacatttttgaacctcttctccctttgggggagggcaggatttttctgccctaccacccacccatccatcgtctcttacatgcaccctacagccacgcaccctcaaggtggcatcgagcgtacagctggagccttctgctcaccaaaactcctacttcccggtggcaggagagcaagagagggacagacagatggcagggcatgtccaaaagaagagcatcagcacaaatgaatcctccccttccccacctccaggggtgggggcctttggcacctcaatccccgataccctactccttcccacccacatctccttgcacccatctggaacctcggttgatgtgagccggcaacagagaagcaccgtggcgcggcgagggaatgcagacggcacccagcggtggatggcggcagcggaggccgcggggaaacctgaccaggaagctgaggaccaaaccagcctctttttccgttcccggtttttttcctgaacccaacgcgtgccgtgccccgtttcccccaatatgtgttggggaggggtgtcctgaatggggtggtagattttttttcttaaaaaaatttttttgttttttttaatactcagaggagagggacataggaaaggtaaagtggatgtaatcgggtggttgttagggtttggggctaggtggggccaattgcataagcagtggagtgtgttcttcccctccctgcagtgttccttcccgtgggatgatcactctttagctgtatttggggctagaatgagatttgaaggaggccatggaacttctctttagaaagcctgccttggctgggcctggtggctcacctctaatcccagcactttgggaggccaaggtgggaggattgcttgagcccaggaatttgagactagctggggcagtgtagtgagactttgtctctaccagaaaaaccgggcgtggtggcgcatgcctgtagtcccagctacttgggaagctgaggcaggagggtttgcttgagcccgggacgtggaggtggcagtaagctgtaattgtgccactgtactccagcctgggtgatagagagagaccctgtatcaaaacaaaacaaaaaacaaaacctgccttctgggattgggcttctggtttttttcccatgacac

SEQ ID NO: 4718 - DNA, 1167 bp, Homo sapiens; identical to SEQ ID NO: 4717

SEQ ID NO: 4719 - DNA, 1093 bp, Homo sapiens
tagggaaagcggagtcttcctttgaggacttttcaggactctacttgtcatctccattttccactttactaagttattagtcgtattttaccttttattatctattctatttcctcactgttactttcagatcaagaatttataagttggtcttccccttccaacttttctggtttccgctactgtgattgctaatcttgttgggaacctctgtcctaaccactttccctggtactgctttttctgttctgttatatttgcttttcgtttttatgttttgtatctgtttttctttccaggtaaaagtttcctggtttagggaaagtgggaactggggatggaaaagaggtggtgaaggctgtgctcgtgattaagtcttgcttttttttttcccccctccagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaaggtaaattttctcttgggcatgtagtgctcattgggctctttaagggtacaatacaaagatgtgtttgtcgttgctcaggtggtggtaagggtttatacttaaggctagatcagggccaggtgcagtggctcacgcctgtaatcccagcactttgggaggccgaggcaggagggtggccacttgagctcaaaagtgcaagagaagcctgggcaacacagcgagactcctgtctctacaaaacgttcagaaattaagcaggtgaaggttgaggcttcagtgagccgtgattgcaccactgtgcaccagccggggcgacagtgaggaagaaaaaatcaggggataagtatc

SEQ ID NO: 4720 - DNA, 1093 bp, Homo sapiens; identical to SEQ ID NO: 4719

SEQ ID NO: 4721 - DNA, 1129 bp, Homo sapiens
ctgacgcccttttccggcgcgggagaggtggtggcggtggcggtggcggcggcggcggcggtggtgggccggggggaggagaagctgccattagccgccgccattttgtcctcctgctgccgggcctgcttgcccctccccctccggtacctctactccgggacccgcacctccggcagttcattcaggatccgtagtctgcccctaaccacccaccgtcttggcttcagggggtgacccctgcgcctgggtccgtaactccctaccctccgctgcgctcctggcttttcacccccatttgtgggccccctccccggctgccgccccgtggtggtgggccgcgcccgacggttctctcggaagggcgcttttcctccatattggaccccctcctatcatccagcgctgtgttcccccctctggacgcccctcttcgtgtcgagccactcccactctagaatcctgcttttatcccagcatctttgctttctatgttgctcagtcgccctatgtctgctttttcatttttcctgttcctcgtctcctttctcccccaaccccgtttttcttcttgggcctctgcccccttacttcgttgtctacatcctttttttttttgccattcctgtttccatatattttccacctgctttcgtattcattattttctgttagttttggtctattcgctacatgactcttgtattcgttttcccttcatatatttatcttcacagattggcctcctcaaacacctacgaagcaacatccatcttatctctagcttgtcataaagttctttctccccaattttagctttcattctgggcctgtctggatttccctgctttcttccccactatttctcatctctttacactgttcccgtccataaacgaatgcctggtcactctggaatggactgagagacctgtcgtccggcttgcttagggagctggaggtatcgagtaaagaaacactggtgatggacatttttaatgaggataggaaaacgaagatggctctggccttggccctctgttttctggcccatggttacagggtgctaaggtggctccataatgctttttctcagttcttcatatggtaaaacagtatttcatctgga

SEQ ID NO: 4722 - DNA, 1240 bp, Homo sapiens
aaggagggaacatggcatttgagctatgagggagctaagtagatcatggttgcttgagaagagtgggcagtttacatagactggaggaaaagacaccagagggcctcatatctgagtccctaatgataatgcaatggagtttttaagtttctgttatggtctgtacaggggacagagactgagacacttgctgtctggcccacaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctggtgagagtcctgcaaagatgcttctgatggttgaaagctaggcatgcatggggcatacgttttagagctctttaaagggaagtggctgtagtagaaataccaaaagactagaggagatttcccaactttacactgggtcctttaaagggggtgtgggctctgggtgaacaccagttatcctcctacaaaggcgtgtctgtggttccctgtctttggacacgtaagaattggaggaaaataaatgtggatttgggaaactttgaggccagcttgcttcttgcaggctcatgatcaaccaatctcacataaaagtattgaatgttacatatctcagccttcttgatagggatttcatagatttttttttttttttttttttttttgagaccaagtttagctcctgttgcccaggctggagtgcaatggtgtgatcttgacttaccacaacctccacctcctgggtttaagcgattatcctgcctcagcctcctgagtagctgggattacaggcatgcgccaccacacccggctaattttgtgtttttagtagagacagggtttctccattttggtcaagctggtcttgaactcctgacctcaggtgatccgcctgcctcggcctgccaaagtgctgggattgcaaagtgtgagccaccacaatcagcgcgatttcagagattattaagggcaggggaaggaatcccttctaagagaagtttggaggaagtaggtaataaaatattcaacatgtataaatgtgtcccaggataggaggccatcagatctcccacatgaggcattttcgaccctctctccgtcttgttctccagttgcccctcgccatggcctgcagagtctcg

SEQ ID NO: 4723 - DNA, 1240 bp, Homo sapiens; identical to SEQ ID NO: 4722

SEQ ID NO: 4724 - DNA, 1107 bp, Homo sapiens
tggctcacgcctgtaatcccagcactttgggaggccgaggcgggtggatcatgaggtcaagagatcgagactatcctggctaacatgatgaaaccccgtctctactaaaaatacaaaaaattagctgggcatggtggcgggcacctgtagtcccagctactcgggaggctgagtcaggagaatggtgtgaacccaggagacggagcttgcagtgagctgaggtcgcaccactgcactccagcctgggtgatagagcgagactctgtctcaaaaaaaaaaaaaaaaaaaaaaaaacaaaaattagccgggtgtggtggcaggcaacttaatcccagctacttgggaggcagaggcaggagaatcgtttgaacctgggaggcggaggttgaagagaatagaagctctgctggtccagagaaggattgggccagggctctgggagaccagggagaaagagggcacatgtggtccctgttgactgtgagggtgggaatctgaggaaggctttggctcattgccccttgggtttgtccacagccatccttcccctgcggagtatgtcgaggtgctccaggagctacagcggctggagagtcgcctccagcccttcttgcagcgctactacgaggttctgggtgctgctgccaccacggactacaataacaatgtgagccctttgatggccctgccctttctcctcagccccagtactcccaaaacagaacaggctgaaatgcagataactctttccctccctggaaaaacattgcaacagggccaggtgcagtggctcacgcctgtaatcccagcactttgggaggccaaggtgggcggatcatctgagattgggagtttgagaccagcctggccaacatggtgcaaccccatctctactgaaaatataaacattagctggatgtagtggtgcacacctgtaatcccagctactcaggaggctgaggcaggagaatcgctagaactcgggaggagggggttgcagtgagccgagattgcactactgcactctagcctgggtgacagagcgagactgtctcaaaaaacaaaacaaaacaaaaaaacacacattgcaacaaaacaatttctctc

SEQ ID NO: 4725 - DNA, 1177 bp, Homo sapiens
agacaccagtctgggcagctcagggagtgctggcgtcaccccttccctaatcccaggctgcatggctaacggttcctatctgcagtcccagccttccacttccgagttcttctctcagaccacagtcccagcaacccagaatttggattggagtctggaagaaatgcagaatgattaaacgaccacctttccatttgaagtccccatccctgaatcttcacgggtgtgcccaagctgttagtgtcaagttttttatatgagggtcagtcgggttgtactcagattaatgaagcagggaaactgaggcagaaaagagtcctgtgttcaggagaggtcggagaaacaaggaggttttcaggactcctccttaacacccccatccccatcctgtgggagatccgaggattccccttccggactcactccctacatcgtcgagtcccgcccccctccagtcccctccccaggttcagggcggggccggtcggtgagtcagcggctctctgatccagcccgggagaggaccgagctggaggagctgggtgtggggtgcgttgggctggtggggaggcctagtttgggtgcaagtaggtctgattgagcttgtgttgtgctgaagggacagccctgggtctaggggagagagtccctgagtgtgagacccgccttccccggtcccagcccctcccagttcccccagggacggccacttcctggtccccgacgcaaccatggctgaagaacaaccgcaggtcgaattgttcgtgaaggtaagaacacttctctcctcagccacccaaattcctggaagccaactctcacctttcccccggtccagccttaactccccaatcccttccctccttgactcccacccccaatcccacgtgcactctttggttgaggggtggttttgagaggggaagacattaacttgttagcaagtaatgagaattctaggatcaaccctgaaaagtttgtaaaagtgcaagtttctagcagactaaaggaagggaagtggagaaaaaggagaattcccaaaagtgagactggggtggggttagagggcgagctggtgaagggacagtgggggcccagcagggtttagaagggacagaggggaacctcagttaggacatgtgtccctacaagatctgagggtgagtagtgcagtagg

SEQ ID NO: 4726 - DNA, 1190 bp, Homo sapiens
tgctttggactcatcagactctggatgaagatttgcccatgactcctgcccccatggggttctggcaccctcccctggcccgccggctgatacaccctctctccccaagcccggaggccatgagagcctggtggaccgctggatccgcagccgcctgacagaggctgtgaggctcagcaatcaaggcttccaggcctacgacttcccggccgtcaccactgcccagtacagcttctggctctatgagctctgtgatgtctacttggtgagaaggagcacagcggggcaggggatggtgggggcaggtgggcagcagagccctgggctcagttttgccagagttggccttgagacctaagccaacccatccccttcccagtcctcacaggcacagcgagggctcaaggctagacctccagccgtgagccctgtacctctcgtcccctaggagtgcctgaaacctgtactgaatggggtggaccaggtggcagctgagtgtgcccgccagaccctgtacacttgcctggacgttggcctgcggctgctctcacccttcatgcccttcgtgacggaggagctgttccagaggctgccccggaggatgccgcaagctccccctagcctctgtgttaccccctacccggagccctcagaggtatggcatggcctggagaggggagtctgacctgccctccaggccccctcaccccctcctccaccccacagtgctcctggaaggaccccgaggcagaagccgcccttgagctggcgctaagcatcacgcgagccgtgcgctccctgcgggccgactacaacctcacccggatccggcctgactgtgagcctcaggcccccatgtccgccccatcccactgtcccctcagcctactctgggacccagtgtccggcagtgactgcttggtttcctgtctccatggagctaggcctcacctttctccctccctggcaggtttcctggaagtggcggatgaggccacgggcgccctggcatcggcggtgtcgggctacgtgcaggccctggccagcgcaggtgtggtggctgttctggccctgggggctcccgccccccagggttgcgctgtggctctggcttctgatcgctgctccatccacctgcagcttcaggggctggtggaccctgcacgggagctgggcaagctgcaagccaa

SEQ ID NO: 4727 - DNA, 1197 bp, Homo sapiens
gttcatgccattctcctgcctcagcctcccgagtagctgggactacaggcgcccgccaccacgcctggctattttttttttgtatttttagtagagatgaggtttcaccatgttagccaggatggtctcgatctcctgacctcgtgatccgcccagaagtatttttattgtgactatttgagtgaagaaatgggactcagaggtggtgatttgtgagagtggggtggagggaggccacatggattgggttgtggtgggagatggaggtgggccaaaccttgtctcacacttcttccccttcctgccaggctgtgctgggggccctgggcagggccctgagccccttggaggagtggcttcggctgcacacctacttggccggggaggcccccactctggctgacctggcggctgtcacagccttgctgctgcctttccgatacgtgagtcaccaggcctggggaagaacaagactgctctcctcagacctcactgtagggtgactgagaagagtcatttatttcctgttccaggtcctagacccacctgcccgccggatctggaataatgtgactcgctggtttgtcacgtgtgtccggcagccagaattccgagccgtgctaggagaagtggttctatactcaggagccaggcctctctctcatcagccaggtgaggaagggcgaggagttggaggataggggcttccctggggccttccatgcaactcactttctttttttcctagaaatggcagaatcactggggcagggtcctgcgggagaggagggagaggggggaggtcagcatgggcaagacctcgggcatctaaaataccccatctgaaacctagtatggccgtccaagagggtccccagctggctgagtctgaatttctgcacctctctctaggccccgaggctcctgccctcccaaagacagctgctcagctcaagaaagaggcaaagaaacgggagaagctagagaaattccaacagaagcagaagatccaacagcagcagccacctccaggggaggtgaggcgagggtggagctggaaggaaagttgatgtgtgcggtgatgggttggctgatgcctgggcctatgtcttctccctcccaagcagaagaaaccaaaaccagagaagagggagaaacgggatcctggggtcattacctatgacctcccaaccccac

SEQ ID NO: 4728 - DNA, 1201 bp, Homo sapiens
cattgtaacgtggccgggcggtgtcaacacaaacgcccccaccctcccctggacgcgcgtaacccgctccccgcaccagccccctgcccacaactgcgcaggcccagcaagcccccacaattaaaagcccagcgccgacccttcctgtcaattaggcgctgaagcgcaggcggtcagcatcgccatggagaccaacacccttcccaccgccactcccccttcctctcagggtccctgtcccctccagtgaatcccagaagactctggagagttctgagcagggggcggcactctggcctctgattggtccaaggaaggctggggggcaggacgggaggcgaaaaccctggaatattcccgacctggcagcctcatcgagctcggtgattggctcagaagggaaaaggcgggtctccgtgacgacttataaaagcccaggggcaagcggtccggataacggctagcctgaggagctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagcggagccgacagagagcagggaaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgattggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacgg

SEQ ID NO: 4729 - DNA, 1315 bp, Homo sapiens
ggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggcggacaagaagaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattcaagtgatgccttttattcctttatttgggggtcagtagggtctgcataggttgtttttcccatagcgtctaaaatggaatggcatttttgcttccagtaagggcagattttgcagaggtgtgactattgtaatgtgatccatttgtgttagacaaatggtatcctccagtaaagcttcttgattctggccaggagtggtggctcaagcctgtaatcccagcactttgggaggctgaggtgggcggatcacttgaggtcaggagttccagaccaacctggccaatgtggtgaaaccctgtctctactaaaaacacaaaaattagctgggcgtggtggtgcgtgcctgtagtcccagggaggctgaggcaggagaatcgtgtgaacccaggaagcagtggtagcagtgagccgagatcacgccattgcactctagcctgggcatcacagcaagactccgtctcacacacacacacaaaaaagtaaagtttgttgatgctgattgggtttagcctgaggg

SEQ ID NO: 4730 - DNA, 1290 bp, Homo sapiens
atcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggcggacaagaagaaggttctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctggcggcttcggggctcagggtcccaagggagggtctgggtcaggccctaccattgaggaggtggattaggggcctttgttctttagtatgtttgtctttgaggtggactgttgggactcaaggactttgctgctgttttcctatgtcatttctgcttcagctctttgctgcttcacttctttgtaaagttgtaacctgatggtaattagctggcttcattatttttgtagtacaaccgatatgttcattagaattctttgcatttaatgttgatactgtaagggtgtttcgttccctttaaatgaatcaacactgccaccttctgtacgagtttgtttgttttttttttttttttttttttttgcttggcgaaaacactacaaaggctgggaatgtatgtttttataatttgtttatttaaatatgaaaaataaaatgttaaactttttcttgtctgttaatatgtgaagataatggatatttgcggagggatagtgtctgaataccatctatctttatagtctgaaaagaacagtactgctgaagagttatacgtgtaggagttagagctacacatatttttgtttgggcttaattgtgggccttaagagaaattgcaggtgcccgtcttgattagagtggggcttgtttcagggaaaagtcggatggcagctgcaaaacggtattggaggggtggttgaggtgggttcactggggcggggaggggaggggtggtgctgagatgggattatggtggttttctctccctcttctacttagtgagcggagtccacaaaaaaatgctgactttttttttttttttttttgagacggagtctcactctcactcttgtcgcccaggctggagtgcagtggcgcaatctc

SEQ ID NO: 4731 - DNA, 1207 bp, Homo sapiens
tgctggaattacaggggtgagttgctgcgtctggtgttggtgactttctagagattactttttggtttacatcattttccttgtgactatttttacttttttggggggcggggggacagtcttactctttttagtttacatcattttccttgtgactattctatttttacttttttagggggcggggggacatgagtctcactcatgttggtcaggctggtctcaaactcctgacctcagttgatccacgcccttcggcctcccaaagtgccgggattacaggcgtgagccactttgcccggcctgtatttttacgttttaataaatccccgtatttttgttaaaggctgggtaacctgactcctcccctcatttctactgcaaaataggagtacactggggcctcccagtggagctgttctctgctgttttaaattactttctactcctccctttctaacgtccactcctggactcatttgttagatcaatatatactgggactgttgtgttttctttgagtgtactagatctctttccagaagagcttcccttgatccagatctccctaattgggaatgatgatttcacagactagagtctccgatgctggtcatgatgtcaaaactaagttctgactcatttagggaactggatacttgggtctccagaagggccaatgggagggccataattctgtttattttcaaattgtcttgttttcaccttgttagaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggtgagtatcttttgttttggctctcagtgggagtggtaatgatgatctggttggacaagagtctctgagcttttctctgaggatctttgaacccacctgatccaccttcatcctgccggcaatctcctgtaattcatgtttttatggccagttacttacatgatgaggtttaattggctatggttctgcaggatgtacaggaagcatggtgttggcatctgctcagcctctggtgggggcctcaggaaactatattgcataaggtacagaggg

SEQ ID NO: 4732 - DNA, 1207 bp, Homo sapiens; identical to SEQ ID NO: 4731

SEQ ID NO: 4733 - DNA, 1251 bp, Homo sapiens
actgcagatggagaaatggggttggtctccataaattaaaggcaaggaagtcgtactgtactatacgactacggtcatggccatagttggggagggaggctgcctcctaggggaaaatcaggtaaactgtataagcagtataacaaggttaaactttgaaccctacaaatgtgggctgacaggaagaaagagttacgaaggaaagagtttccaccagcatggagaaagttcttcccacactctaacctttcccacctctgaggagcagtagcagggaatgtttgaaagaagggccccttccctagcgtgtttgagtagagaggaaaaacctctctggctatgtaggtgggtcaggaaggcaggggaatggccatgtgagctttgggtaaatcattccttggggtttgagagcatagtctccttctgccaactcatctgtcattcttttttgaccttccgggtgcctaggcaaagctgctgaagcggcagcagcgaatgatcaagaaccgggagtcagcctgccagtcccggagaaagaagaaagagtatctgcagggactggaggctcggctgcaagcagtactggctgacaaccagcagctccgccgagagaatgctgccctccggcggcggctggaggccctgctggctgaagtaagaccagtctgtccctgggagaccaacaggaatacagcctccttggaatgattcccctttttcttgtctccttctttgtaccttagaacagcgagctcaagttagggtctggaaacaggaaggtggtctgcatcatggtcttccttctcttcattgccttcaactttggacctgtcaggtgagaccttccttgcttcactagaaccttccaggtggagcccacgttacagcctcctagctgcctgctttggcccaggccatttccttctgcttatatacaaatggttctggtgtccttggcaccgatgatgtgtctggccagccccttcctgctccattatttgtctttttttcttggagatggagccttgttctgttgcccaggctggagtgcagtggcacgatctcggctcactgcaacctctgcttcctgggttcaagtgattctcctgcctcaacctcccaagtagctgggactacaggcgcacgccaccatgcccggctaattttttgtattttttagtagagacagggtttcactgttgttgcccaggctggtctcgaactcctgagctcaggcagtctgcccacctc

SEQ ID NO: 4734 - DNA, 1103 bp, Homo sapiens
tcttactgatttaatttaatttttcactccccagagtctaatatggattctgactcttaagtgcttccgccccctcactacctcctttaatacaaattcaataaaaaaggtgaaatatattgatgggatctcttcccaagttcgcccccacccccgacagaagcatcttctccccaacttgagtagatgtttggtatagtatggtgaagtatgggggtgagtccctttccttcagggccctcaagggtataggggtgaggttgtgtctcatacacacacacagacacacaagagcaagatgtgtcaggtgtttaatcatcattgtggggggctctggttgtagaagaaagcttggcaaggtggggttatacaggagagagattatacaggagagagttggtctgaggccagaacagttcaagggaaaaagaaaagggagctgatggatgggatctgtctgtgggcccctcaaggccctccagtactactctcgcctgcctcaggttcctccgactgattcagttctgcacgctcctcctcttcctcctggttttctggggccttcctgaggagaaagattggggggaatgcggcacgttgtcgttccaccccccgacccctcttcgcttgctgcctggaagccctaggtctgaggggtctggctttctccactcacctctcctctcctcggcgttgccgcctttgccacaagatgaccccaatgagcagggcggctgtccccaggcctcccaggatccccagggccagggctagagttcccagccctgatcctcccacagagcctgtacggagacagggaaaattgagagcacagccaccaccactcaccattcctttcttgttgaccatccccccagtcacatgtgttgggggctatcttctgcttccctgactttatcaaacccctcacctgcagttggcccctcctcgcctggttctggaagacaaagttggatccagtcagaaaggaagacttcgggttgagagagggttatttagtgggagccccagtggagtctttccctttctttttttttttgagatggagtttcacttttgttgcccaggctggcatgcaatgg

SEQ ID NO: 4735 - DNA, 1103 bp, Homo sapiens; identical to SEQ ID NO: 4734

SEQ ID NO: 4736 - DNA, 1106 bp, Homo sapiens
gccgtgatccagcggcatcgcagctcgggcaaggaaagccggctgtcagggttctggaaacgtcctgccctgagggcctgcgactttctgtatggagccttggatcgcgtccctggaaagggacaccaaagatttccaattccggagagcgggcccgaggaagggtcactgctcgggcgcacgaaagctgtctaaggcttgggcgtatatggggaactctggcttttgccacgcacttttgggaatgggcaggagacctgcttcctctctccagaggttgcattttcccaagcttgaacgcttcatgtgcctactctgcaggactgaggagtttgctctgtggtgtgaaaacctaaggaatggggggcgggtgtcttgccacttgtgtgacaggcttaacctttttgtatgaagttcgtttgccttatcggccttactgtttgatagtttactgtgtctgatttcttcccccgtactttttcaactagtctctagtgatccctgaaaagttccagcatattttgcgagtactcaacaccaacatcgatgggcggcggaaaatagcctttgccatcactgccattaaggtaagtgaagtagggtaaggaatagggaatgtaaatgagaattgggttgtgaagacataagcaaaaatgaagcaaggctggggagacttgagtctcatccagatcaccttgactgctggattaagaaaagaaagtggtttagggagagactgacccctttagcatttaccacagaaaataagtgattaaagccaagatagtggtctaaggtcaagccaaaacatttcacctggggaagtggggaggaggtatggttgctcacccgaattcgctaagattttcctgaaccacgagcttgtgagatttcttctagattcggtttctttacccatcccaccatcataacagcaacccttcctgcgaaatttatattccctgagaattggaggattattgggcatcttgagggataagtagaaataccaacagataaaaagtgtgaagaagcctgtagatggagggtggaagaagtctgagtgggacatttactcagatgagccataattgacactcctttcc

SEQ ID NO: 4737 - DNA, 1179 bp, Homo sapiens
aaagatactgcctgctttcaaagggttgtctgtaatactaaattctgtgttcatgattcagtcatacccctgaacaaagttacttttttctttttttgagacggggtctcactgtcgcccaggttagagtgtggttgcgtgatcttggcttgctgcaacctccacctcctaggttcaagctattctgctgcagcctcccaagtagctgggattacaggcacctgccaccatgctcagcaacttttcttgtatttttagtagagacagggtttcaccatgttggccaggctggttttgaactcctgccctcaatgtcatctgcccacttgggcctcccaaagtgctgggattacaggcgtgagccactgcgaccggcccaaagttaaccttctgtcgaacggtttatatctggaaaggtgggtgaggaaagggtgacctaggggattgcaaaatagattattgcagatcctacctttgtgagctttttgaatgaggctataaaggaatttaaaaatcagattcaacactaattccgaaacccctcacttcattcagggtgtgggccgaagatatgctcatgtggtgttgaggaaagcagacattgacctcaccaagagggcgggagaactcactgaggatgaggtgaggacaaggaagggggctgggggtggggtcagcctcagaaaggggtccatctagatctgaccttggtctgcctgccaggtggaacgtgtgatcaccattatgcagaatccacgccagtacaagatcccagactggttcttgaacagacagaaggatgtaaaggatggaaaatacagccaggtgtgtactgaaatgagggcaggattagaggaagggtggagggtcctaacagaattgggcataggaggtcaggggataaaacatcccttgccccctcctctgaatccaggtcctagccaatggtctggacaacaagctccgtgaagacctggagcgactgaagaagattcgggcccatagagggctgcgtcacttctgggggtgagtggggggtctcatctccctgcctacctcgactcagcattcctcctactcgctcttctttttccccaaccttttgtttctgctgtgcatgacctgtgactcttctctttttacctgcagccttcgtgtccgaggccagcacaccaagac

SEQ ID NO: 4738 - DNA, 1174 bp, Homo sapiens
gtactaacatcttaattttgttataaaatctcacaaaccccctgacatagtctcagagatctgtagggccgaggttacatttggagaacccgtactctagggccaaatccattcttcttgccctggctcacttgtcccccccaccgccccgcgctggagccactgcctagttcttcagccctagatggtgctcgccagacctcctctcaatgctcatcacacacagggctattcctttcctccaatgaaccaaacgcctcccgcccacctccaggtcccagtcctctgttccctttgcctggtccacccttgccctccctgggtcgcagacgaggtcggcctcgtcattccccgcagaccgccgcgcgtccctcttgtgcggttcaccacagttgtatttaagtgatcgtgtgagtcgtcgttaaatgcctgtctccccgcggatcatgggctcctcgaggacagggactggcctgtctgtccactgctgtaaccccgcgccggcatagggacctaaggcccactggagggcgctcatcaagtagctgctggatgttgacgaaggaagcggcggcgcagctcagggatctccgagtcaggacggtcggccagacccacggggtaacgggtctaatcgtgtaggaataaagctgtattccagtgcttccaaacggttctctcattccaacccctttccaagctcaatgaatattccaatcacctctggtcccttccagtgaccctgaaccgctcagagaacgccccgtcgacaccgttcggggcgggcgccactactggcgcatgagatgcgctcaagcagagggtactccaccagcgaggatacaccgagccgacggggatctcggtctcggcgccggaagcctctgagagccgaatctggaaccggatgtggctgcttcctgccccgccccctgccgagggggcgggaatcgagggcccttcggaaaacccggccgggatttcggtcagctacattcgtgggttgtggtagggagggtaatcccgtggggatggagtgaccggctctctctccgcctgaaacgcttcccgcgggagttttagccgtgttattgttggggaagggaatgtcaaattctgctcctgccttcccccaggggctggagactggaatctttattccagttcattgcgg

SEQ ID NO: 4739 - DNA, 1174 bp, Homo sapiens; identical to SEQ ID NO: 4738

SEQ ID NO: 4740 - DNA, 1099 bp, Homo sapiens
ctctgcccctccacccaggacaatgcctccaagctgctcctggctctgatggagagccggcatgacagtgaaaatgctgagcgaatcctcatcagcctgcggccccaggagctggtgaggctgggcaggtgggcaggcgggcggaaccaggtggagtgtgttgggatggggatgagggcccggctggccctaccgccctaggaagagagcattggaacaggcactgcccctccaggtggacgtcatcaagaaggcctacctgcaggaggaagagcgtgagaactcggaggtgagcccacgtgaagtgggccataacatctatatcctggcgctgcaggtaccagttccacccgtggcaacggccatcacccccctggccaccataccccgccccagctgccatcatcccccagtcgccattgtcgccccccagccaccatgtcccccagccaccacaccctggtgactgtgctgccatttccctcagctctccaggcacaataaacagctgcagcacctgctgaagccggtgaagcgcattcaagaggaggaggccgagggtatctcttccatggtgggtgctggccccgagactggggtgggggtggggcctggaacccagggaggacacttgacccaagggcgtggcctggaacagagtgaggccctagaatatgagccaggctagaatttgggggtacagctcagggggctgattgggactggcagccgtgggtgaaacccagacagaaatggaagcaaggctcaggtgggtctagggtgggtctggaagcttcaagcaggacccgggctacacttgggcaggactgaggaggcccccgctatcctctgggattctctggtcatggctctcccactcccctccctttggcaccaggttctcaaggctcagtcctagttgggctgggcttggcctgctctggcttggcggggacactcgctgaagtgtagttcagagctaggcgaaggcctgggagggtgggggctgagtgccagcctggatgtggaggctggggcctgacctccgcgccctccccacctccagctcagcctcaacaacaagcagctgtcacagatg

SEQ ID NO: 4741 - DNA, 1235 bp, Homo sapiens
cagactctgccctgttgtgctggcagaaacggggagaagggttgagttttcatgaatagaaaacaagagcagcagctgtcaggcccagctgacaagcgtggggctggtgggctggggcatggccacgccagggagtctgtcacctgggaggtggggcagggatggtgtttcgggtggcgggatggggagcagcttggtccatgtgccttcagggggttgttacttgagagctccagggtgaagggagaaagcctgtgctctggctggctgggcctctatcctgaagagggaaggtgctagaaattagaacaagtgactgtaggggggaccgtctagaaacaccaggcccagacacacggtccctcaggtcaggaggagtgagcagccggcacagcctcctgggaggatcccgaagtagggactggggctgagagcagagaggagggtcgggcagccccagggcgggcgggcccgcctcagtgttgcttctcacagaagctgcgactctagaccaggcctgcagccagaacgccgattccgggagcttgggagccctgcgtcagggcccagagcctcgcacttgctgtgtgcgaagatcgccttgctttactgtgaccacagccccgacgcggggctgtttaacaagaacttcagcgcagccggcgtttctgttaccccggccgcggctcttggcggcgggagaggcgcagtggctgcaggctgccccctgccggccacaagggagcagcgtccgcgccgccgcccaccggccctcccgccagctcctcagcctgctccctgggaggcaggctccagaagcaccccgacggggggccttattaagtgcgagaagcctctccagcgagtcttccccgtgtgtcctcatctgcggcaggcaggagagggggagcaaacaggaaattccacagctgcctccagaaacattaaccacccctctctagtcttactggtattttttgtttccttaataaagctccagtctccctcatttgagcaatactctcatttcctctgatgtctggatgatcggcagggcaggaatctgagcgctggccccgtggtgaggccatgttctcataatcaggctccagccagaaaaataagaaacaccgcaacaggcttcagtatcagggctgaaactgctggatgaataaactatttattaaaaacggatgtttcttgcccatggttctttcccttcccccaaagctatg

SEQ ID NO: 4742 - DNA, 1193 bp, Homo sapiens
aggagtgggcggtcgactcgagttcgcagcccaggcctcccacacgcccctccctgccgtcagcacccacccgcgcggcagcggcggcggcggctggcgggcggccgcccttttaaatccccgggctcatttgcatggccccgccccctgagtgacacggctggcgcgggcgggcccgtcccccctgcccctgggtcgctctttttaagctcccctgagccggtgctgcgctcctctaattgggactccgagccggggctatttctggcgctggcgcggctccaagaaggcgtgagttcgcggccgctccggtggcttcttttttttatatctataatttaattaaattatttatttattgaggccgcgcacgggccgtgcccagcttcctgcccctcgccatccttcgggggagggggaatatttttgtccccccgcctggctgtgacacataaataccccgcgggggcctgggcggcgagcacgcggcggcggcggtctctgagcgcctctgctctctcccggtttcagatccgcatttgctaccagcggcggccgcggcggagccaggccggtcctcagcgcccagcaccgccgctcccggcaacccggagcgcgcaccgcaggccggcggccgagctcgcggtgagtcgtccccggggcccgcggcggcggcggcggaggggggcgcccgcgcccccgcccgcacgtcgcccctcctgcgagccgcccggggctgcagcgcgcgccgccggctttattcccaggccggggcggcgcgagccggcggcgggggagggccgcgcggcgcgggggcgggcggcggggcccggcggcgcggggaggacgcccgcaccccttcccccgcgccgcgggcgccctgcggggggcggggacccgggaaaggcgcgcggtgggggagggggcgcgcagctgcggcgagcgcgagttgtgcacccggcggagcccggaggagcccggcgcacctcgcgcggcggccgctcccgctggagccggagcccgagcccgagcccgggcccgggtgaggggcggggagagacacgggctgcggcgcggcaggagagtggggggtcgggcgccccccgcagctcagggaagttctggaagtgagggagatggggaggaacccccaaattcggccctacgccctctcggcctttctctcgcgcccc

SEQ ID NO: 4743 - DNA, 1311 bp, Homo sapiens
atagtggggcctgggagggttcccctggccttaaaaggggcccaagccccatctcatcctggcacgccctactccactgccctggcagcagcaggtgtggccaatggaggggggtgctggcccccaggattcccccagccaaactgtctttgtcaccacgtggggctcacttttcatccttccccaacttccctagtccccgtactaggttggacagcccccttcggttacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccgccactcagccatttccccctcctcagatggggcaccaataacaaggagctcaccctgcccgctcccaacccccctcctgctcctccctgccccccaaggttctggttccatttttcctctgttcacaaactacctctggacagttgtgttgttttttgttcaatgttccattcttcgacatccgtcattgctgctgctaccagcgccaaatgttcatcctcattgcctcctgttctgcccacgatcccctcccccaagatactctttgtggggaagaggggctggggcatggcaggctgggtgaccgactaccccagtcccagggaaggtggggccctgcccctaggatgctgcagcagagtgagcaagggggcccaaatcgaccataaagggtgtaggggccacctcctccccctgttctgttggggaggggtagccatgatttgtcccagcctggggctccctctctggtttcctatttgcagttacttgaataaaaaaaatatccttttctggactggagtctcctgtggtgtgtgcccctaaagcctggggcaggtaggatgggtgacacttgtgttctggcccccatccttcaggctgcaggaagggaggggaaatagcactggaatcacctccggggaaggtcattttaagcctcttgatgaaatcaaaacccctagccacaaaacattttatttacaaaatatatactgaatactatacatctggccccatcaccatggaaacaactccaaagcctgcctggggatttgtgcccaagcccagcccaggagggctagagaaagcaaaggtgtctaccagccgcccccatcccagaaggaaagcctcttcccatgagtgcctgtgggtgggcggtgagctcaa

SEQ ID NO: 4744 - DNA, 1411 bp, Homo sapiens
cattgcttctgttcctccagcagtcagttgactctaggtttcctttggtttatatccccagttcttaatactaaaacttatttgacttcctatcaggaagcacacaaaaaaagcgtcatttaaaaccctggatataggctttaaaggatacaaaaacagcagcattgtcgttttgccaggttcatcaccattttgatgtgctacccatccttccaccctccctttcctgcccccaagcctcccagccaggccagatgtgaagattctattaatcactgtttcagagaacattaattcttgtatagaataattatctactaaattgcttattatctgtgactaccttgcagagaacatctcaacagtgcagtaaaatagctctcctagacttgagcttccagccaggcatttagatcactcttaagcctttgtggaattctgaggaaaaaaagcaagatgcctcaatgccaatgctgggccataagattctactcccctccctgtagggtggggcgcgtggctcagctttggaaaatcattttgccagtaatattgcctgtgaatccctttaagaagtcgtcctgatctgagcctgtctttctgagcactttggtgctgaattgaaaatggtaagctaaagcagtgacagatccacgtagcctctttaacctctttattatcttgccaaaaaaaaagtttctcaggttaaacctttgtctttaacctccctttgttgtggagaaaatgtgtcactaatcagtggtccaagggatatctagctttggttactcagttcctgcagcataacagatatgacttatgccagggaaggtagaggctgattatggagacacccaggaacaggaataagaagggataggtctgctccacgtagaacctccccagatcggaagttaagtcttggagagtttccaaagtgctgaagtaaaaaggagacttggagggcctttgcttaatgagcaagaggcttgtgtcctcccaagaacatgagggagttcagaagggagctatagctcacagacagaaacctgcccgctcaccccatccctcgtgactgggagcatgtttgctcagaattttctaagaggactctcccttcaaaaatccaatttgctcccagaatgttgtttagcctctgagaatctcactctttcatttccatctgtgaatggacatagatgtgttgctcagggatcagaaacatcagagtccagggcccagtggcatggtgttgcattagtagttagaaaagtaattggtcagctctactgtaaaagaaataagtatgtagtacagttttgtaaatgtcaggtctgttctattgttttgtgatctgaagactgtcaaactggttgataatcaaagaaaaggttggtggttagaataagta

SEQ ID NO: 4745 - DNA, 1411 bp, Homo sapiens; identical to SEQ ID NO: 4744

SEQ ID NO: 4746 - DNA, 1156 bp, Homo sapiens
tgatgacaaaatgaccaggaaagattcttggtttcactctgcagagcatcagaacagctggagtcctttgtgcttctttcttcatgcagtgatttcatagatgagaattaggaggaggctgggattttttaaaaaacaaaactcaggccgggctcagtggctcatgtctgtaatcccagcactttggttggagggggggggtcgaagtgggcagattacttgaggtcaggagttcgagaccagcctggccaacatgacgaaaccctgtctctattaaaaatacaaaaattagggcggtgtggtggtgggcgtctgtagtcccagctacttaggaggctgaggcatgagaattgcttgaacctgggaggcagaggccgcagtgagccgagatcatgccattgtattagatctatggctcacactgggcacgaggatagggggaggaaagcaaatgccaataacaaatatggtttcagtaattgttaaagttgtcactccagcctgggtgacagagcaagactgtctcaaaaaaaaaaaaaaacctcttcggtaaaatgtggagcttttgttagtatttttgcaaaggaataataggattcaacttttttttttttttaattttctttcatttttgagacagtctcgctctgtcacccaggctggagtgcagtggcaagatcttagctcactgcaagctctgcctcctgggttcacgccactctcctgcctcagcctcccgagtagctgggactacaggcgaccgccgccatgcccagctaattttttttgtatttttagtagagatggggtttcaccgtgttagccaggatggtctggatatcctgacctcatgatccgcccgcctcagcctgccaaagtgctgggattacagatgtgagccaccgcgcccacccggataaagtcactcgttgttgattgtaatacaaaagcaaggtgtacaagaagagtttttactaacttctaccactcttagcttttttctgtcatcttttggagaagtgaccacttgacctgagtaccatacagggtagtagaaggaatgaatttctccagcccttggttcagaggaagttggtgatactggaagtttaacgattatgggccaggcacagtggctcatgcctgtaatcccagc

SEQ ID NO: 4747 - DNA, 1156 bp, Homo sapiens; identical to SEQ ID NO: 4746

SEQ ID NO: 4748 - DNA, 1178 bp, Homo sapiens
gatccaccacctcagcctcccaaagtgctgggattacaggcgttagccaccgcgcccagcccataatacgtctttttagcaaaagttgtctactacatcttggaatctcctgggagaaaaaaataccagtgcctatctgtgcttgatatattctgatttagttgggcctgacatttgtttttgccactcattacatgattaatttatttctgctctaaaaggagttcattctgcctgagtgcagtgactcattcctgtaatcccagcactttaggaggccaaggcaggaagactacttgagtccaggagtttgagaccagctaaggcagtatagtgagactccgtctacaaaaaaataaattagccaggcatggtggtgcacacctgtggttaagcccaggaactccaggctgcattgagctgtgattgtggccatggcactcagcctgaacaacaaagcaagacactgtgtcaaaaaaaaaaaaaggagacatagttcatattctaatcatatggactccgggtaagttccagggtaactggctagagaaaatacttgattaaattgttactgattgtgtttgtttgtttgtttatattctgtcacctaggctggagtgcagtgtcacgatcccaatttactgcaacctctgcctcctgggttcaagtgattctcctgcctcagcttcttggtagctgggatcacaggcgtgcaccaccacacccggctaatttttgtaattttagtagagacagggttttaccatgttggccaggttgttcttgaactcctggcctcaagtgatcacctgccttggcctcccaaagtgccgggattacaggcatgagccactgcgtctggccatttatgataatttttttaaggtagctcttaaagtttgtgccttagggtgtggtggctcacacctgtaatcccagcactttgggaggccaaggcgggaggatcacatgagaccaggagttcaagaccagcctgtctaacatggtaaaaccctgtctctactaaagataccaaccaaaaaaaattagcctgggcgtggtggctcgtgcctataatcccatcactttggaaggccaaggcgggagggtcacttgaggtcaggagttggagaccagcctggccaacaggttgaaaccccctttctactaaaaataca

SEQ ID NO: 4749 - DNA, 1178 bp, Homo sapiens; identical to SEQ ID NO: 4748

SEQ ID NO: 4750 - DNA, 1148 bp, Homo sapiens
gaggatagatctcgggtgacgtgggattttctaagcctgagaggtgtccttctgcacacccttgtaacaattaaaattgcttttcttccatgtttctcttggcagagagaaatgccatcatgcttactgctcttttggattcttcatgcagtggcttcccatttgctctgggaacagtgcctctgtgctggttatatgtatgcaccacatgtgcacacacgggtgttggtgcaactcaccagcaggtgtgcagtaggcaagcttgaaggtggcccatgcttctctgttgtcacacaacacctttccctgtttctcttcagttgtcctctgatattttcacagcctgttagtggcggctgatctgtagaggtatgaaaatacagccccaaagggggaatttgtcatggggaagggccagccactgactacttgatcttggagaccacatttagatggaaatgagaggacctccacagccccgcctccctgccaggatgctagattattggctgggaggtgggcaagtggcagcccagctgaagcaagaggctgattgactggctgctcactcaggcaggtggcctgccctggcatcctgtagattctgagcaggttgagatgtggatatctccatgggaagcttgaaccaggctagaacagctgtctgccaaagatacaagaatatgcaaagtccctcttacccccctccttccctcaagtcttagttggtttgagagccagggatatggatccagggtgctgttgcagggtcacctgcctgttaccacacccccatccagctgggtggtgggtgagggtgtgagacaggcagggagaccaggtaatgagtggctgcaaggagtcatatagcctgggtgtgggtgagggtctgcctgcctgtttctgtctgggtgtctgagttccaaaaaatgtgtgttgtttgttcctcctcatcctcttctgagactgttgtttttttagagcttgattgtgggagaaaagcttgtgtgaaattccctcttcacctccccaccccccaaaaaataaaagggggcataaactttattccactggagaagccctgggggtggctggagccagcctgctgagaagcgtggtgcagctgggtctgggacttcactagagct

SEQ ID NO: 4751 - DNA, 1232 bp, Homo sapiens
gcctctgacagagctggaggatgtagcagatgttcatatgcttgtacattccccggcccatgtccgcgtgaggcttgaccactaccagtacttggctctgcttcgcctgaaggaggtgctgcagaggcttcaggagcagctgactaaggatacagagtcaatgactgggtctcccctgcagaatcagacagcttgcattggagttctctttcccagtgctgaagtggctctgcttatgcatcctgcacccggtgctgtcgatgctgactctgcaggctcagatagcactagcctcgtagattcagagctatctccttcagaggatcgggaactgaagtctgatgcctcatcagaccagggcccagcaagccctgagaaggtcttggaggaaagtagcattgaaaatcaggatgtatcccaggagaggccacatagcaatggagaactgcaggactcaggtccacttgcccagcagctggcagggaagggccatgaggcagtagagtccctacaggccaagaaactgagcagaacccaagcctccagctcaccagctgcattgaagcccccagctggcagggagactgctgtgaatggacagggtgagctcatccccttgaagaacattgagggagaattgtcaagtgctattcacatgaccaaggatgccaccaaggaggctctacatgccaccatggacctcaccaaggaagctgtgtccctgactaaggatgccttcagtttgggcagagatcgaatgacctccaccatgcacaagatgttgtccctgcccccagccaagtaagtggctctgtacctccttcactcatcccatctccttctcctagttctgatcattgggtttaaggcctcttactatgtgcatttctagattgggaagtaccatatagtccaggagaatgcatagaatggcctatttaatgggcagttttcaagccaatatttattgcttcttagaatcagattatctcctttttcactgattcactattttttcccctcaagacaggccttaccgtgttagccaggctggtcttgaactgctgggctctgcaatcctcctgccttggcttcctgagtagctgggattatagacacctgccactgtacccagcttgcttcacaattattgatacaaatatgctatatcagaataataataatggcatatatataatattattttcagtgggctttcatctaattttttt

SEQ ID NO: 4752 - DNA, 1390 bp, Homo sapiens
tggcttctttgaaactttccaaccaggtccccaagcccctgaggctcccttcctgttcctgtcccctggatttgctcctcactctccagccctctaaaccagcttcacgtgaacagtggggcttgtcatcacctcctatgacatccctccttttgccttcttctgccccaggcccaagaggccactgccagcctaagcgagctgccactgggcaccattatcagaatggtcatggccaagaggccctctccccagcccccacctccacccccgtcccatctccctgcacagcactccatgagctgactgctgtcttggagttttctgcccagttgaagcagagccttaaacaggaggatcagtggagctgaggcttggaaaggaaaggaatcctcttagacaagtgtggatccagcctcctggactagctaaattctgtagtcacttaagaatgtaattcctcggtatcccaggaggaagaatgtaattccttgctatccaaggaggaagaatgtaattcctcgctatcccaggagttgatgctgcaccagggcctcaccatctctgccagactctcccttggtctcgggagcctgaccaagggcagcccttttagcaagtgagacaagggacaggctcatttggggcctatttccagcgagtgcacctcttgccccccctccctttcactgcctgactgcagcgcaggcattccaggtgaccagctggaatcactcaggagccctcctctgactgccccaggtactgctctggccttctccagtcccctttacagtagaaggaactctgggaacattctgaatgcctgttttcatgcctgctaatttgaccaactgctctttaaagtggagttggactggctgacagatcctcttccgtcgctcctgattgctggcctcgttgtgagcagcagcagaggcgtctttcctggcacctcgaatgtctaggtactcactcagccaaaccccgcattgcgggctctcagtacggtaatgtgcccactgtcacccctcaggtggcgtggagctgggactggcagccacgtccctggacctggagtggtgcttccacctcccaatcttcccttcccaggaagatgcagcccctggggctcatgctcatgtgccctcacaaggttggagcctggcactggggcccatcaggctgggtgagtgcatcacccctgggctggtccaggtcagacgtccacccactgcatgttgggagccattcaaccataggctgagaaaggagctggcaaggaatgagatgcagttcggctctgtgcactggctcaggccccccaggttcttctgggcctgtgcagccaccaccactgcctggcccgttgcttctacccgcctcctcc

SEQ ID NO: 4753 - DNA, 1177 bp, Homo sapiens
ctgtaccacagccacccggtctgtctgcagggaagcctgtcagggtgcctagtgctgctcggccctccttcctcctaccctgcagcccctcatgcacccctcccctgaagagcagcccctctaggtcctggaggtggtaggatgcagctgtgactccccagccacctttgcatgccctgcatgtgcagcttggggtgaagagagtgaggaacagaagagcagtgttttggggagggtcctggagtggcttcccggtggggtgggggcctccagcctctggctccaccctttgcccactcctcattttctctctcaccccaatctaggccgaaatgagttgattgcacgctatattaaactgaggacggggaagactcggacgagaaaacaggtagagagacggtttatgctgggcctgccacccacacactctgtctcagctgccccggtcaaccccttgcccctaccctgcccacctcctcgaggctgcccctgacctggactgccaccctccttgcctcatcacactccccttaccccctcgattttacaccctcccacccccaagcagctccattcacccttcccacttctcttggagagatggccccactgtcctctctgaccacctactaccctgcccagggcctgtggttcagggaccacagataagcccacggggctgctgtggctgctacatggtccctgccctgagtggctcactcaccagccagggagccagatggtcagatggatgggtacagagcaaggtggcggggctgagagagggtgggtgcagggcaccctgggacaagcagccaacccagacaaggctaggggagtggggagagagagctgggaaggctccctggaggaggtgacactcgggatatatttttaagaaggaatgggagttcgcaaggcagagaaaagggagaagacccttccttccaggctgaggaagttggatatacaactaataatcatggtaaacccatacagagcttcctttaagttaatttatttcatcctctcagtaaccttactagataggtacagtaattgtcttttttactatgaggaaactgatgcatagggaagttaagtaacttcttcaagccccccaggcaggaaagagctgtgcctgtgggcagcctgatgtggtggagggagggtg

SEQ ID NO: 4754 - DNA, 1207 bp, Homo sapiens
tggtttttggtaaactagtacaactacttgggagtttgtcaatacctagtgaagttgcagatgcttagaccctatgtcgactttcatacatggacacaaggagacaggtgtacaaggatatgtgtcgtagcactgttcacaatagtaaaaatgtgggaacaacctaactgtgccccaagaatggaatgaatatagttgataagttgtctcttaaaaaaaaaaagcttttccgccatcttcccacgacgccaccatggtgtgcgtgaacgtcctggccgatgctctcaagagcatcaacaatgccgaaaagagaggcaaacgcccagtgcttattaggccgtgctccaaactcatcgtccggtttctcactgtgatgatgaagcatggttacattggcgaatttgaaatcattgatgatcgcagagctgggaaaattgttgcgaacctcacaggcaggctaaacaagtgtggagtgatcagccccagattcggtgtgcaactcaaagatctagaaaatggcagaataatctgcttccatcccaccagtttggtttcattgtactgacaacctcagctggcatcatggaccatgaagaagcaagacgaaaacacacaggagggaaaatcctgggattctttttctagggatgtaatacatatatttacaaataaaatgtctcatggaaaaaaaagaaaaaagacagggtcttgctctgtcacccaggctggagtgcagtggcacaatcatggctcactgcagcctagaactcctgggctcaagcgatcctcccacctcaacctccccagtagctgggactacagaggcatgccaccctaaccgcctaatttttaaattttttgtagagatgaggtttcactatgtttcccaagctggtctcaaactcctggactcaagtgatcctcccacctcagctctctagtagctggtactataggcatatgccaccacacgggctaattttattttattttattttatttatttatttactgtttatttattgagacagagtctcgctctgccacccaggctggagtgcagtggtgcaatctcggttcaccgcaagctctgccttctgggttgatgccattctcctgcctcagcctcccgagtaactgggactataggcgcccgccaccacacctggctaatgtttttttttcttttttgtatttttagtagaga

SEQ ID NO: 4755 - DNA, 1261 bp, Homo sapiens
ttttctaaggcaaactataataaaattacctcttttattgtacacttctgaacacacatctgaattttgtctaattttgtgtggtgtgatttttcagaatattgctttaagcttcttgtcctcttttcaggcaaattaaagcgaaatcaaaggaaacttttagaaaatgcgttgtatcactaagtaaagagtctatgatttttgtcagttagcacagaaactttaagggaagtaatttcttatgaaaaatactgagtaggccgggcacggtggctcaagcctgtaatcccagcactttgggaggccgaggcaggtggatcacctgaggtcaggagttcaagacccacctggcgaacatggtgaaactctgtttctaccaaaatacaaaaattagctgggcatggtggcaggctcctgtaatcccagctactggagaggctgaggctggagaatcacttgaactggggaggcagaggttgcagtgagccgagattgagcccactgcactccagcgtgggggacagagccagactctgtctaaaaaaaaaaaaaaaagatactgtctaaaagaaagagaaaaagagagaaagaaaaagaaaggaagaaagaaactggatgaacaatttaaggtatgattgtatttattatactaagcctcaactttgaagaggctgtgaatgtagtttatgtttagagtctaaaagggtgtaattgttcacattctattataatgaaaaactgacttgttttatgtttttatctggatgttttagaactgtagaattgaaaggaaccatagctgattttcttcacaggtatcaaagtgacgtgcggtgagctaatggaaaggttattgcaacagctgtgcttataaaggtcaatcagatttttcagtaaaagatgaagtcgaatcttacttagattggataaatctaaaatcacctgtttataagctgtttttaaaatgtataaagacatttcatacattattttacttttcatgcatgtttagcttcctttaatgcacattcctaattgctgttgatctttttgtatttaaaggagacaggactacatatgactagtttcatgtagactatgggaagagatttgaacagagaagcaggaaggaagggatgggaaaggagagagaacagctgataatgtggaaagactattgttctaaagtcaattctgagtcatttcttagaaaaatacaaatcacagattacccagatgtctaaggaaaactgctgcaacc

SEQ ID NO: 4756 - DNA, 1267 bp, Homo sapiens
aaacagctgtggggcttgggcccagcttaggagattgcccagatggcaagaggtcctgggctccttcttgaggggctgcctggcccgctccatcctactcccactaactacacctcagggcgggtgaggttccgacactgatcccagagatgccgtggatacgccagggtcccagggggaatctccccaagctcacactctctcccgcttatcgcctattctcacacctcttctcggtcccatcttctgcacccattgcccagtcttgctttctctttcccatattccttttctttttctcttgtgccaaactgacagaaaccgtcaccacactggtctttttctttaatgtctcattccccttgaggccagctgctatgccaggtggtgtctctgccaggctcctcaggcccagacagaggccagcccacaacctatgaccccctcccccaggacaccacctcccacccacagaccttccctttagctgttgacacaacttcccagctctgcaagtgtgccccctggatcaaggcgggtcccctcttgtttttttctttgctgccacgaggtggtccaagccttcagggtgggctcctatcaggctgggtgtgcgagtgtccatctgtccacatggatgtcgagggtggtttgtgtggagctgtgctcgtcagctgggtctgccctcttcccccttttctccttcttctctcctcatggactttttctgcaattgcagtcttaagcttcactctccaccacctggatggcatggcgcctgccaccaaacatcttcctggcctgcgctctgccctgccctgcctagcctctgctactcccacttcccaactccagggaatgcattacttttatttcaaaccctctgcctccttccttctttctcttcaaccccctccccaccttcaccttctcaaaaatggaaggaaaaaaaaactgtgaatggggaatgctgactgacaaaccaacacaactttcagaggcttcagtgtctgttctctggacatttcttttcacctcctgagcaccaaagtcgcagggccagttgcaggccgctgattgccatgttgatttttaacctgatattctttttaattgttttaaatttttcataggggagttttggacaaaacagtcactggggagatcactgccatttttacacacttgactttttaaaaatacaaccaaccaaccaccacaacttcttatacatttgggacatgagccagagtttaaaagggaacca

SEQ ID NO: 4757 - DNA, 1228 bp, Homo sapiens
tttgacaggagtatgtacagaaaattcaagttttgtttgagacttcataagcttggtgcatttttaagatgttttagctgttcaaatctgtttgtctcttgaaacagtgacacaaaggtgtaattctctatggtttgaaatggatcatacgaggcatgtaataccaagaattgttactttacaatgttcccttaagcaaaattgaatttgctttgaacttttagttatgcacagactgataataaacctctaaacctgcccagcggaagtgtgtttttttttaaatttaaatacagaaacaactggcaaaaattgaactaagatttacttttttttccatagctgggatataggctgcagctatagttgaacaagcagtctttaaaaactgctgtgaaacacaggccatcagggaaaacgaaatgctgcactattaaattagaggtttttgaaaaatccaactctcatcctgggcagaggttgcctagttggtatagaatgttaagtttcaagaaagtttacctttgctttaggtcataagttccttatttgattgctgtatatggatacatggctgttcgtgacattctttatgtgcaaatttgtgatttcaaaaatgtcctgccagtttaagggtacattgtagagccgaactttgagttactgtgcaagatttttttttcatgctgtcatttgtaatatgttttgtgagaatccttgggattaaagttttggttacaaattgttctttaacttgaaagcctgtttttccttgcaaactcaaatctgtgagcttggtaccaagtccaggtataacattcctattggaagccatacttatattttcttgtaaagtgcttttgaattaataaaatattagcataattgtgtatagtcagttgaacccactgttaccattgttcttatcccatgggaagcagttggttacacgattcttattttataagaaacagctgagaggcactatggattagtcttctgaagtgaaggaaatatagatgtcacctaagtgatagttaacccattttttttttttttaggcatagaagccagttcagggtccataatatttagtgaccaacattttaaagtatagcagcaacctggttcttaaacacaaagtaagttgcccattaacaaatggcttttatctttagcatgaaaactttccacaggtctaaaaattgcttccattttataatttgag

SEQ ID NO: 4758 - DNA, 1144 bp, Homo sapiens
tgaaacacaactgtgtccagccattttcctgtctccacattcttccagatgtgtgacagaggagggactctgctcaattccagttgtgggtccccttggagtttacatcacttgtttttcaattcttggttttctgttcccttctaccaaaacccagcataggactcagtgtacacttactttaaaacaaaaactcacatttcttagctgcaggtgatggcctcagtcattttaatacagcctggaatgagtttgcttattacccagtcactttcgtagtgaatgttcaaaccccaaagcaaatgtttgcatctccttgtccataaaggagaaagccaggttataggagaaagagagagaaaggcgcatgtctgtttgcacagagagaggcaattttgtctacctttcgagaatcagttataaacagaagggcctcttaggattttgagctctcctgacaatgaaggaaaagctctcttgagtatacaagttccacactcattacctttcagtggtgacccatcacccactacaatttgttgaaggaagggagtgtcagagatatgctttaaagttgtactttaggctgaaattctctctgtatttggacctgcagatgttgtgtacagaaccgatgcatggcagggtcaggaagctaggagagtgaaggcgcttgtggagacagctctgtagcaaatgaaacacggaagcctccgggaatgtgtttgtgtcaccagcagcaggcatttccctgtcctccccacccccagtctccacatccccagcagcctcttccagaagcatgtcagggagacggacaggtgctctccttctcgtgcaccacatccaagtccacccaccgtggacgcagtgtgactaaatgctggccttgaagagaaaccctcagccagcttgtctgttgtccaggtccctcagtgtctctggtttccctgccctgcataatttaagcattagtgccaaatacatctgtcatattcctctccctggagactgcgaaatgtccagactttttcagactagtggagggaaggaatgttacataactaagtggaggcctggaactgtcaggatttgacagggctggaccagagacccttccgcctctgcctagtgtgtctgtcag

SEQ ID NO: 4759 - DNA, 1212 bp, Homo sapiens
gtgctggggagtggagtgagcgctggggagtgggtaggagaggaagcttgagcaagacgcagattttgtagggccttgtaggcctttgaaaggactttgactttaactcactgtgagaggaatgaggagtgggctttgagcagagagtgacatgatctgacttctgttttctcagttcgctatggctgctgtgtgaggaagagacagggtggcgaggctggaagcagggagtccacggaagggaaatacaggctcctcatttatttatttctcttctttttctccaaagcaaagagattgttctgaagaccgtgctctaagggcatttgaaagactgccaggtagtgcgagcctgagatggtctggaggattctctctagccgtgactccgctgctctgaaggtcaactgagaagtcttgtgggacagagacttgagttaggaagccctcagtcacttgccttccacggtggccagccctgctgccatcattggctgaagcaccaccaggattcacggcacccaactgcttcagggtacttcgtagactctgcctcactacatgtcgaaagagttatttgagttctcttctgtttttttttaatttgttgttgttgttactgttttgatacctcggaaacacctccgttgacagttgttttggataggttgggtgtaccccatggctgcctctgaaggcagtgtctattttgagaggatggcttacctcttctttgtgaaaatactatctcatttcctggaaataaaatgtaaaacctgtcagttgctcagctgggctttggtgtatttaccttccttcccttcctgctcccagacagtctcacaagtaaacaccagcagctcatagattacaaccaagaaagtgactgtatcagatgatagacttcaagtgaatgtcagcctaagaggccaagctgcagatcgtggcaacagatgagctctgttaacctcctgactgtcgtgtttcctttttattacagaggtgggtcactgtttaccttgtttcaggggtgggagaaactcctttccttcagctggcatttgaatgtttccaaatctattttatctgacgtcatgaacacacaggcaatgattttatgacaacttgatgtgcttttttctttatttttcttttacattagaagttttctctcttttctccacctctcctttatttttaattttaatttta

SEQ ID NO: 4760 - DNA, 1210 bp, Homo sapiens
gtgttgatggtaaaatgcaaatgatgcaaatctagaaatcggagttgagccttagttaagcctgtaaatagtcaaaagtgaagcctaaattggagaggtgacagcccctaattttgtattcgtattaaatatgctttgtcacaagagaaaaacaaaacagtgtctaaaattagtactgattttattagccaggtgatattttgacctctaataaaatggggattattctatttttatccccaagagggtgatgatgtcttagaatgtcactgttaatcgctgttggactttatcacattttgaagtatcagtggtaagcgtttgtcagcatcttaacatatggaaaggtataggattctaggtgagagattacatctgaaaaactaaaattgaacatatttaactgcttacccagaatcctttgagagttccatgaaacatgtttttactcttcttacatacgtagcagaaatggaatgtcttggtttgaaattttgactagcttattccactatcccttacctttatttacttaaatattcacattttgttgagactgggaaacccttttactgttatttacacttagtacatcagttggtttctgcaagactagaaataagtcagttggcacgtaaggagtatggggaaattggatcttatattaacctttaggttcactggttctataccagtggttctcaaatgtggtccaaagatccatagaagtccccaagtccctcttagggcatccatgagatctttccttttccaactacatatttatgtaatagtgtgctttcttcatattcatataaatagattaaatacagatatagacatgaaaatccaagtagcttcctttaagccaggccactctcattattttttaagttgcagttatttttcataaaagagtaagtttttatgttgacatctaattattttaattttaaatgaaaacatttttgtcaagttataatttcatatgggataaatatcaatgatgtaagatacataaaaaaagtttcttagtgtccttagtaatttttaagctttaaaagttctcaagacagaaaatactagcatgaggactaccatgctagtaaagaagttacagaagaaaagcttggagttagcagaggttggttcatgaggctaagaaaagaagccatctccataaaagtgcaaggtgaagcagcagttgctg

SEQ ID NO: 4761 - DNA, 1130 bp, Homo sapiens
taaacagaatgaaattgcccagataaaaacccttgtccccatcaggcaccacttcattcttagttcttcacttagatttgctggtgaaagtgaatgcaaaccctaacttttgttgctgtggtcactgcagtgagcctcactcaacctgtcactatgaatgctcatcttttgactgagtatatcatattaatgtttgaattcaggtagaagtacagttgtcacttgaagggagtagatgtggaagggcgttcggggaggagtgggaagtggggaaagccaggctaaagaatgagggttatagctttagcaatgttgatgagccacatttcccacacagatctgtagcatttgctgttgacctcttttgagatgaactctcccataggccctgccaggcagcactgagacatggaggaaattcagacaaaaaatggctcaccctgatagggaaggagtgactatattttaaattaaacttgctttttccaacactgtgaggtttctgtaatatttagcttttatttggaagcgatagcgtatggcattttttatgctgtttggtttatattgtctactgcaggcttctttgtataagctttgcctgggctcaccctctcctggacactgttttaaagtgtcaccgctgtccatgctgccagaggctctgatgtgaagctgtactctcaagatccacgtttttaagtcggcatgattagtaatgactttttgtggcaatagaaaagcccattaactcaaaaaaaccaaggagagtaaaaaggaaaggaaactatgaatcgtgcctcatctttcattgaatcctatatttattattctagaaaaaaagaacttacaagatagagaagaactaatagagcatctactttacccctcaggctgtccagtggggataattattaataaacatttaatggaaaattcaaagatcttccaatttaatttttaaaaatagttttataccaaatattataaggatttattaagcagattaaggactttgtgaaataagtgcttaacttagctgagcacgcatatatcaaagtaataaaagaaactaacatcagagtctccactgagctacacatttgtgaaaggtgcccactgcagttaca

SEQ ID NO: 4762 - DNA, 1177 bp, Homo sapiens
caccacacccagctaatttaaaaacatttttgagacgggatctccctatgttgcccaggctggtctcaaatgaacttcatgtctcagcctcccaggtagctgggattatatgtttatttttatcactggtcatggtggatatcaattgctcatcacaaaacatccaaataaatcctttcctgtcttttgcatcttgccttgcaggtgtgagcgacgtctcctcaccacagtgctgtgtggtctatacctcagccagggagaggatgtgaaaccccccgccctgcacatgagtggtacaggccaacaggaacacctggctccagccacgttcacagacatgtcagccgtggagtagtgctgacacttttctctcagcttctcagggtttcagtccttttgggtttgttttatttaccttttttatggttttgtggctggacgttcacaaccaaggcagacagcatgggtgaccagcaactgtacaagaccaaccatgtggcccatggtagtgagaaccttttctaccaacagccaccacttggcgtccacagcgggctgaaccacaactatgggaatgcagttacagggggcggaatggatgcccctcaggcctcgccaatctccccccacttccctcaagatacacgggatggtctgggcttgcctgttggctccaaaaaccttggccaaatggatacctcgaggcagggagggtggggaagtcatgcagggcctggaaaccatgtccagctacgtggaaacctggccaactcaaacatgatgtggggggcaccagcccaggctgagcccactgatggctaccaatacacctactcccaggccagcgagatccggacccagaagcttaccagcggtgtcttacacaagctggactctttcacccaggtgtttgccaaccaaaacctgcgaattcaggtcaacaatatggcccaggtgctgcacactcagtcagcagtgatggatggagcccctgacagtgctctccgccagctgctgtctcagaagcccatggagcccccagcaccggctatcccttcccgctaccagcaggtgccccagcagcctcaccctggtttcactggtgggctgtccaaaccagctcttcaggtcgggcagcaccctacccaagggcacctgtattatgactaccagcagc

SEQ ID NO: 4763 - DNA, 1202 bp, Homo sapiens
cggcagatgcacagacaatgcatccctgattttaccaatagacttgactcccaacaatgcatactcttgaaggcaatccacaggttgaataaaccaagtccatgagcgctgggtctggaatctttctacaatcagggtcagaaggagggtgactgaaattaaaatattagcttggatctttgaaatcagagtcaggctgaaaaagtcccaatcttagttcaaaacctgtcctgcatgactgaagccctcctagggctgcacaaagtataatggaattattattattattatcattagatcctagtcttaccattctcagcacttatccccatagcaaaagaccattttttaatgtaatttattcttttggaataggttgaatgcattcacatggttccaaattcaaataaacagcaagaagtctccctcccaccctgtctgccacccacttggttttccttctctggaggcaacctgggttagtggtcagaagatgcatttaactgttttccagctgaggccttgtgagaactcctcggacaccaatttaaatctttatgtccagaactcctttctccaatccaggtagagccactcccctatcctatccccactcccacccttccccccttcagcctcaatcctaagcaggctctattaacaatgatgagccaccatttcctcgagctactaacaaatgcaaatgtttaaatactttgtggttctttttcctcttctacattaattgctaacatttatcgagggctttccgtgtgccacgcactgtgctaaatactaggcatgcatattcttatttaatctgccccaaatcttcatcattatccttatttacagatgcagacagaaatgaaagttcagagagattatgtaatttgcaccaatttgcatccaggccaacctgaatccaaaccctatctctttttactttttctttcctttttttttttttttttaaacagggtctcactcttgtcagcccagatggcatgcagtggcacagtctatggaggcaatcagggttagctgtcagctcactgtggcctcaacctcccaggcgcaagtgatcctcccacctcagcatccccagtagctgggactacaggtgtacgccactacccccagctaatttttgtatttttttgtagagatgaggttccaccattcttgcccagactggtttc

SEQ ID NO: 4764 - DNA, 1228 bp, Homo sapiens
gagtttcaccatgtaggccaggctagtctcaaactcctgacctcaagtgatccacaagcctgggcctcccaaagtgctgggattacaggcatgagcaactgcgcccagctcttgtgtaccttatgtgaggaagtcctgctcaatcaggatcggtcacgcaggccctgatcttgctactctggttccatgtcctatggaagaccaaagtttaccaagatagatttttcccttcatagtggcagatagtgttaacccctgcaccatctgtaactcagaaatccccaccatttcttcccctgggcttcagaatagaattgcctggtttctctgatgatcagcatggttccttaaaacccaaatcagcaaggaatgaacaattttgtttggcatggatgaaattagcactgtttggctcgttaggccccaggcaggcaggcaccttaattttttccttgcatattctagtcttcagaagcattgccttttgtcctactggtagtgacatagaccaataacagggcatctggggattttaatcctgaaaacagtgagtctgatactgcttgtgtttttcatcagtgtccaccccaagtgggtcttcctgctattctcttcacttagttgcccctcacttgccatctgagcaattggcaaggatgtgccaggcctaggttaaacttggaaacatgcttgaccattctattccctggtcctttaagatcagtttggctgcaattttggctccttggaccctcaagcatagctggtaaatcaagttagagatgtaactgccttaaaacatgccagcttaggctgggcacggtggctcacacctgtaatctcaacacttcaggaggctgaggcaggcagatcacttgaggtcaggagttcgagaccagcctgaccaacatggagaaattctgtccctactgaaaatacaaaattagccggatgtggtggtgcatgcctgtaatcccagctacttgggaggctgaggcaagagaattgcttgaacccagggaggcagaggttgcagtgagccgagatcacaccattgcactccaccttgggcaacaaaagcaaaactctgtctcaaaaaaaaaaaaaaaaaaagtgccagcgtatgaggtaattagattggttctctccagaggtaacctgccaagaagagatgctatagatgttactcctatactgtaaaacattgtgaaatcagattactttaaaa

SEQ ID NO: 4765 - DNA, 1401 bp, Homo sapiens
acacctgaggtagggagttcaagaccagcctgaccaacatggagaaaccccgtctctactaaaaatgcaaaaaattagctgggcgtggtggcgcctgcctgtaatcctagcaaatcaggaggctgaggcaggagaatcgcttgaacctgcgagggggaggttgcggtgaaccgagatcacaccattgcactccagcctgggcaacaagaatgaaactccgtttcaaaaaaaaaattggccgggcacagtggctcacgcctgtaatcccaacactttgggaggccgaagcgggcagatcacgaggtcaggagattgagaccattctggctaacgcggtgaaaccccgtctctaataagaatacaaaaaaaaaaatttatctgggtgtggtggcacgcgcctgatatcccagctactcaggaggctgaggcaggagaatggtgtgaactcgggaggcagagcttgcactgagccgagatcgcgccactgcactccagcctgggtgacagagcgagactccatctcaaaaaaataaataaataaattttttaaaaaattaaaaaagacttttcgccatcttttgtctttctgtggagctgtcgccatgaaggtcgagctgtgcagttttagcgggtacaagatctaccccggacacgggaggcgctacgccaggaccgacgggaaggttttccagtttcttaatgcgaaatgcgagttggcgttcctttccaagaggaatcctcggcagataaactggactgtcctctacagaaggaagcacaaaaaggggcagtcggaagaaattcaaaagaaaagaacccgccgagcagtcaaattccagagggccattactggtgcatctcttgctgatataacggccaagaggaatcagaaacctgaagttagaaagactcgacgagaacaagctatcagggctgctaaggaagcaaaaaaggctaagcaagcatctaaaaagactgcaatggctgctgctaaggctggagtgcaatggcacgatctcggctcaccgcaacctctgcctcctgggttcaagcggttctcctgcctcagcctcccaagtggctgggattacaggcatgtgccaccatgcctggctggttttgtatttttagtagaggtgtggtttcttcatgggcaggctggtctcaaactcccgacctcaggtgatctgcctgcctcggcctcccaaagtgctgggattgcaggcgtgcaccaccacgcccagcctgagatttatatatttaagatgtgataaaatagtagtaatcaaaacttacatgtgaagaataggcttctacttctacagaaaggtcatttttacctgccaacctgtgccaagttgcaaggatgcaactggacaaatcagagtcctctttagggaa

SEQ ID NO: 4766 - DNA, 1288 bp, Homo sapiens
ggtggggtgaggcattcctggtgagggtaaggtggaggggctgcctggttggctctaagcaaagcaggaaaggcaggttgggatgttgactgacatgtatacacagatctcaggtgcctggacactgcaatatacatacatacataaacataaaccggaaatccatatgagcttggaggtagaggagtgggtggtgttggatttggtggtgggtgggttctgattgttcaacctagtaggtctcttaagtaagaggtggctgtgggtggttgacctttaggaagttggagagactggtgtgtttttagcttggttcaaacatcccttagcttgggctgagggccccctcttctttctgtctcttattgttggccttccaggtgggagctgaatgccatgaccaccaacagcaatatcagtcgccccatcgtctcctcccatgggtaggaggaagtttctgccacctcccctcctgagcctgctgtcatcttcactgcccctgcccatctgtcacccacctgctcctttgacccctggacttggtatacctccatgtggagttgttgggcgagaggtgttctctgtgctgtgaattcagtggggagctgtagcggggtgggggctaggttcctccccccttgggccgagggccccttccccttggtgctctgtccccatccacctcctttcagctgctcctgggcctcagctctgcccagggccagccaggttctgctgggaagggaagggaatggggagaagggagaagcaagcagtgtctgagcctcaggagcttccccctccccctttgcctatcccctcccctctgcttgagccttgagccttgactgggagctgaaaggagttgcagctgttggcatgagacctccttctccccgtcttggggaggtggggaccagcagataaatcccacccttccttgagctgtcgctgtactctgaagttcagccagctcagattttataaaaattaattaaaatctccaaacgtgttgtgtgtttttgtggaatatggtggagaaggctggagtttgcagtgggggcagggtgccgaggacaagcaccctgaggttctggcttctcagccaagggtattaggaaaccaaatgccaccaaggcctggtccaagcttctcgggcgtggaacccagcaccctgcgactcgggcagaaggttgcgacaatgtctccagagcgggttatcctttgggcccggctccctggccctcgaccgcgcagttttctgcccattcgtcaccacgttgagacc

SEQ ID NO: 4767 - DNA, 1177 bp, Homo sapiens
agcgaggacgtggaggcctaacgaccccgaggtcactgagtcagtcggtggcgcagggggcggggcaggtcgtctgtctatctgtctggacgccgaggggcggggaagaatcgcgaagggcggagttttggaggctggagttttgtaaggttggttggagggggtttgttcatctttctggtagtgcgagaataagagatggcagagaccttaaccttcagccccaggataccctcaaagactcacctgcaatctgccggtgtggctgccgctcttgccggtactgcccctttaaatccatgatggctgccgctcgaggcaattgttttgacgggtctgggggggcggggcctgtttcctagtcacgcgacattagagctgcccgcggattggctctcacggcgttcaggtaggaaaggaggtgtgtatccagcttgggctccagttttctgcccgcctccttttacgttattgcggagcgacggcgccggacagtcaacgtcatctaggagcaccgagcagcttggctaaaagtaagggtgtcgtgctgatggccctgtgcgcactgacccgcgctctgcgctctctgaacctggcgcccccgaccgtcgccgcccctgccccgagtctgttccccgccgcccaggtaatccatcttacccgggaagaaggctgcttccattcgggctgccggagatggggtctgcgggcatgcgaggcgggagttgcgagtctggtcaggagtcatgcaggtccgtgaccttggataaggcacacttagcctcagctttttcctctacaagtgttgctttctcatagggcgaaattcttcagacgagatacttaaggtgaaagtgctttgcagatcaccggttgtgcaggtttcagtaataacgtttcgagtgcctatgataagccaggtataggtaatagacgtttcaaataaatgaactcctttcaaatactctataaggcagttactattcccattttatagatgaggaaaataaggagtccaaggtcacacaccaactatcagagctaaacagtctgtctttcagagcctgtgctcttaaccattatgatatgatgcctgcaaggatgagttactgctgatattagagaatgcagggcaagataccaagaacagtggcctcaggggaaggtatcctgaggt

SEQ ID NO: 4768 - DNA, 1209 bp, Homo sapiens
aaatcatactcctgtcttgatatcccatcaaatatcaatgtttacatttagcgtttggatgtctggcaggacattaaaaaattggcagagctgtcccacacatgcagaacatctatagcgttcttgcctcctcaaaggtaatcttcatggtgacaacaacaacaacaaaaaaaaaaaaaaaagaaagaaaaaaaacacctccagaaatttcttaaaatcccctagagggcgatactgtcccttagcctcagagccatcctgttcagcaatttcccctcccttcagcccctggctccagggtagtagactttgtctcttagagttgtgcagtgagtgttgggccctgctgggaggtggggaacctcagattcccataggtcttttgcaacccaaatgtctgatggggacaggcctgtcttcataggtggctgccacactcaacaatttggctgtgctctatggcaaaaggggcaagtacaaggaggcagagcctctgtgccagcgggcactggagattcgagaaaaggtacccatgccctctctcccttcttctcttgtcgctgtgacccttctctacatggctcctctggtctaaccctcctccttcactttttttttctcacccccatctctgctttgttctctcttccttcattccctttcctctgctttccacatgtgtgtgcctacatgcaaacacacgtgtgcttgtgcacacacatgttatcatagccatttatccactcctttgttccctttcaggtcctgggcacgaatcatccagatgtggcaaaacagctgaacaacctggccctcttgtgccaaaaccagggcaagtatgaggccgtggaacgctactaccagcgagcactggccatctacgaggggcagctggggccggacaaccctaatgtagcccggaccaagaacaacctggtatgggaggagggacaaagtaggtggaagaaacggagaggggggcacagaggtggggggagggggggcaggcggagaggccacttgggtcctagagtcaggaagcatcacagtctggcacactgctctcatcaactttgtgctcatgtctggggctgcctttgcggatgaaggatctgcttcattccagttatagaagttccacagcttcttgggagtgggctgggaatacccttgaccctacacctggagaaggaggtgtgagaaagatct

SEQ ID NO: 4769 - DNA, 1199 bp, Homo sapiens
tgggctgcagagcatttgcggatgagattcaaagcgtcccatctgtggccacctctgatgctggcaccgtcgaggggcatgagtgaagccatctttccagggtgctgtttgggtcatgatttaactttactaaacctcctgagtctgtattgggggaaggtggcctgcagtgtccccggctcctcagcctggcatcaaaacctcctgtgatctcaccctgcaggcccagactctcttttgctaggaagcctccctgtgcagccagcccttaggggtcccttcttccttcgtgctcaagtcactactgcctgcccaccccattcatttggcatttatgtgactgtaactgtgttctgtgtgcccctctagtcttcagacctcttgaggagaggctactgtgtctttgtatcctacagagcactcagcacagttgaaaagctcttcagggggctgggcgtggtggctcacgcctgtaatcctagcactttgggaggccgaggtgggcagatcacctgaggtcaggggttcgagaccagcctggccaacatggcgaaaccctgtctctactaaaaatacaaaaattagctgggtgtggtggctcatgcctataatcccagctactcgagaggctgaggcagaagaatcacttgaacccaggaggtggaggttgcagtgagctgagatcacaccaccacattccaacctgggtgacaagagcaaaaaaagaaaaagaaatctcaaaaagaaaaagaaaagtttttcaggggactcttgcaattgtggcatcatgatccttcacacctgcacttactggacgcctcctgtgtacacagcccctttcctcctgtgcacaaggtggcctgtgttaggacagaggctgcagctccccctgaccctgcctctcccctgtttgcatctacaggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctcctt

SEQ ID NO: 4770 - DNA, 1182 bp, Homo sapiens
ggtcagccccctggtgcagaacatcacctctcccggtaaccatgctgacacctggccccactaaccagttccttgtccttattcccagggatcacctgagttaatgctcttggttcttttggttcctgtctttatccctgaaggcctgtcacctcagtgttcctctctccttcctgccccaggcactgctccctgagactctggtatttgaatctttcccactaccccatccccaccctgttaacatttcccctgactccagctgaaacaaaccttggtgaggggaggactagggccccactacccctcaagcctttttgtacaattgatctttctccctcctctgccctgagctgtctgttctcccatctcccatggagacctgttcctgacctgtcttctttcagatgcggaaggcgtgagtgccctgggatggctgctggatcagtacttagaacagagagagacctctcggaaccccttgagtcgagcagcgtcctttgcttctcgagttcgtcgcctttgccacttgctggtgcatgtggaacctcctcctgggccttctcctgagccatccactcggccctgtaagtcccagctgtggccagtggagctgactctgcggacagtggtgtatctggctccctcctccctgggtcttactcttgctgctttgctaccggcctttccaggcccctgagacctactggcctttccaggagatcactacccaagaccggtgtactcacccagaggctgagatgaaaccccttccttctccctctgtctctacagtcagcaagaacagcaagggtcgggaccggagcccggcgccttcgccagtgcttccaagcagcagcctgaggaacataacccagtgctggctgagcgtggtgcaggagcaggtgggcagaagcaagcagaagtctgcagaggggaggggctgctccttttatgtcatttcttgcctttctcctcaggtcagcagattcctggctgcagcttggagggccccagactttgtgcctcgttactgtaaactctatgagcacttgcagagagcaggctccgagctgtttgggcctcgggcagccttcatgctggctctgcgcagtggcttctctggcgccttgctgcagcagtccttcctcactgctgctcacgtgagtcccaccagctccc

SEQ ID NO: 4771 - DNA, 1204 bp, Homo sapiens
aatacaaaaaattagctgggcatggcagcaggcgcatgtattcctagctacttgggaggctgaggcaggagaatggtgtgaacccgggaggtggagcttgcagtgagctgagatggcgccaccgcactctagcctgggcgacagagcgagactccgtctcaaaaaaaaagaaaattagggaatggtgtattctggggaagcaggtttttcaggataggcagtgggtgaggcctagcccataagggattcctttaagtccttagagtccttttggaaagcaaaggctttaagttatggctgctgtgaagttcattgtcacagaaaaattgggttctctttaaaacccatccaaattgagaccttgacacaacagcagaagctctcaattgtgaggaaactgttgtgggtacagataagtcttcacaaagtcctgactttctgttgctgctcctggacagcactctgctctgtgtgtgttgctgacatgtacattctccctagccttgacctctcagaggcctgtgcaccctgaccataagagatacagactgcagacttttttttttcctcccaccagcaccactgggagtctgagtgcgattcagaagatgacgcgggtacgagtggtggacaacagtgccctggggaacagcccataccatcgggctcctcgctgcatccatgtctataagaagaatggagtgggcaaggtgggcgaccagatactactggccatcaagggacagaagaaaaaggcgctcattgtggggcactgcatgcctggcccccgaatgacccccagattcgactccaacaacgtggtcctcattgaggacaacgggaaccctgtggggacacgaattaagacacccatccccaccagcctgcgcaagcgggaaggcgagtattccaaggtgctggccattgctcagaactttgtgtgagttgagcccaggcctctggttgcaggactcgtgaatggagcagttctgagaaccacccttttgctaagggagcttgggagccacatggctgctcccttcacactgggtaacagtgtagtatcctgtgagagaataaatgtattcatttatgtgtttttccagagctttctgggatgtgggaaaataaattacactgaagcagttgaaaggtggcttacccgagtctggccacacggggtagcattctttacatggagcag

SEQ ID NO: 4772 - DNA, 1181 bp, Homo sapiens
agaaaagagcgagggctgggtaggggtcgcgtactcacccccaggcgcagactcggctccggctcggagccccgggttggggcggggcggggctgggggagggggagggggagtcgctgggcggctcgagctccgggctcctgcggcggccgcggcagtgtatgggggagggggagcggggggagggagggggagggggcggagccccgcaggtcccgccccgcacgccggcgcacgcaaggtgcgcgcgcactctcagatcgcgtccgccgggctgggcctggcgcgcaggcgctaggaagaggccgcgtggggcgaaggcggcgcttggctggtggggcccgcggcgggattttcccgggcggcgagagcggtatggtggggggcaggggtgggcgttaagtcctcattccctccttctcctcttcctttctctgcagtaggggaggcccactccccggggtgagtgaggagaggccagagtgggaggcagagcgtcagtgggaggggtcccgacggggaggggggggtcccgacggggaggggggtcccgacggggaggggaggccccttacccggatcctcctcccttccgctctccgtgggctgcttctgcgacccccaagtccgtggccggcgctcacctgctttccccgggttgcggcgtcgacttggggagggcgggctgcgttcagccgtcgctggtcactccggagcgtctcctccggcttctccgctttccgcgctcccctcccctttcccaacttaggtctggagatgagttagccagacgcctctgtggtgtgaggattgagtttttgctttcactctgtcaacgctgatgagtgcgccctcccccaggccagggggttccctggtttcttatttcaccagagactgcatctaccagtgattaagactggaaagatgaagggagagactgagactctttctatatatcacccacacaaatagatcataaaggcacaacgggcaccaacctggtcatttaatttctggttcctggaggggacaaaaaggaagtattgctttccacagccgacgataaatgaactttgccaccgtaagagacggacgggactgaatttataaagaggttaaaagggcatatgacagacacctcaggctacttgggaaactctgggagtttgggagataat

SEQ ID NO: 4773 - DNA, 1261 bp, Homo sapiens
agagcaaaatcttgaaagtcattcgcaaaaacattgttaagaagtgccttgagctcttctctgagctggcagaagacaaggagaattacaagaaattctatgaggcattctctaaaaatctcaaggtaaaaaggcaaataatgcttattccctttaccactttcttagtaataacaataaattattccattcacattgaaagtgaagttattgtagttaagctggattgtttttcctcttcccacccttcaagcttggaatccacgaagactccactaaccgccgccgcctgtctgagctgctgcgctatcatacctcccagtctggagatgagatgacatctctgtcagagtatgtttctcgcatgaaggagacacagaagtccatctattacatcactggtgcgttgactctgattgaagcctttttggaggagtggggagcacaattagggcttcctgggaactggcagtatgaggcattttagtcactgagttcatttaattaccctacaggtgagagcaaagagcaggtggccaactcagcttttgtggagcgagtgcggaaacggggcttcgaggtggtatatatgaccgagcccattgacgagtactgtgtgcagcagctcaaggaatttgatgggaagagcctggtctcagttaccaaggagggtctggagctgcctgaggatgaggaggagaagaagaagatggaagagagcaaggcaaagtttgagaacctctgcaagctcatgaaagaaatcttagataagaaggttgagaaggtaagccattctggggctaggatatattttgtaacatcttcgaggtgggctccctcacaagcatgtttctatacaattagtggtttgaggcagcctatttactgtttcatgccttcttgcctcttgttctcttctctagtcaggtttaaggctattttaataaaatttggcacagattaggcattgcttcagttaacttctgagagtagataaaataccatcattttcttttttttttctttttttgagatggggtctcgctctgtcacccaggctggagtgcagtggcacgatctctgctcattgcaagctccgcctcctgggttcacgccattctcctgccttagcctcctgagtagctgccactacaggcgcccgccaccacaccccggctaattttttgtatttttagtagagatggggtttcatcgcgttagccaggatggtctccatctcctgaccttgtgattcgcccac

SEQ ID NO: 4774 - DNA, 1176 bp, Homo sapiens
gctctgcgtgccaggcaacagtgggcagacaaagggctccctggctactgggaagatacagaaccatcctgtgaaaatcatttcagcactggagaccttctttgctattacttctttcattaacaatgacctctaatttaaattgggccctgctggtttgttgatgaattgagcaactgagaacgtggcgggcactaaactgacagttccttccttcatggagcctgcttcatgtggaggaaacaggaaataaagcaaaagaagagggtcaggcttggtggctcatgcctataatcctggcattttaggaggctgaggttggagaatcgcttgaggccagaagtgcaagaccagcctgcgcaaacagcaagaccctgtctacaaaaaaaaaaaaaagtaatctttatgcctcagcctcccaggtagctgagactacccacaccttggtcccagctacttgggaggctgaggtgggaaaatcactttgcccaggaattcaaggccgcagtgagctatgattgcaccactgcactccaggcaacagagtgagaccctgtcttaaaaaaaagaagggagaaagtgtcagatggtgatgaggtctgggggggaaatagagaatggggatcaggagtgtggatggtgatattccctcaccaagaggtgacatgtgagcagggagctgggaggtgagggtgtgacccgtgtggaaatcagggaaaagcattccagcctgagggaacagccaatgcagaggccgtgaggtggccagtgccactgagcagtgagctgggataggggcaggtgaggaggctggagagcggggtcagacaaacaatatgcttattaaaacaagttgtacagcacctgcctcaagcctgagctgaagctgaaaattggcacttcaaagcaggaggaagcagagatggaggaaagccctccttccctaccagaatgagtccacctcagacagccagactttggacctctgcctttgttcctagatctctgttgctagatgaaggaaagggcctcaggggatccatcttcaaatcaagggctccctggctaccaaattctgtctagtaaaaattattcgagcagcgtgggcccgcctggcatcattttctgcagtttctcattctaattaaggcactgatgatttgctggtaaggcact

SEQ ID NO: 4775 - DNA, 2245 bp, Homo sapiens
tgtgttgtccaggctggagtgcagtggtgtgatctaggttcactgcaacctctgcctcctgggttcaagcgattctcccacctcagcctctggagtagctgggactacaggcgtgtgccaccttgcctagctaatttttgtatttttaatagagatggcgtttcaccatcttggcaaggctggtcgtgaactcctaacctcaagtgatccatccacctcagcctcccaaagtgttgggattacaggtgtgagccaccatgcccagcctaaaaatcccttcttttagctattttgaaataaacatgattctgtgattaccatgctatgtaatagatcaccagaacctattcttccgtctaactgaaactttgtacctttgaccaacatctcccctttccctatctaccctttaccccagtatcctctggtagccaccattgtactctctacttctatgagattaacatttctagattccatatacaagttaacatcatatgatatttggctttctgtgcctggcttatcatagttagcagaatgtcctctgtgtccatctgttgttgcaaataacaggatttcctgttttttaaagactgaatagtattccgttttatgtgtataccatattttaaaaatccgtgtcttggctgttgtggataatgctgtaaagaacgtggaagtgcagacatctctttgacatactgatttcaattcctttggatatgtatagccagaagtggaatggctggattgaatgataattctgttttcagttttttgaggaacctccatactgttttccataatggctgtactaatttacaataccaccaacagtgaacaggggttctcttttctccacatcccttgccaacacatactgtttttcatttttttaaataaccagtctaacaggtgtaaggtaataccttattgtggttttgatttgcatttctctgatgattagagatgttaagcatttttttcatgtacctgttgaccacttgtatgtcgtcttttgagaaatgtctattcaggtcctttccccattttaaaaatagggttacttgttttttattgagtagtttgaatttttttgtttgtttgtatattttggatattaaccccttatccaggccgggagtggtggctcacacctgtaatcccagcactttgtaaggtcttgttctttttttttttttttttttttttgagacagagcctccttctgtcgccaggctggagtgcagtggtgcgatctgtgctcactgcaacctctacctcctgggttcaagctattctgctgcctcagcctcccgagtagctgggactacaggcgcccgctaccatgcccggctaatttttatatttttagtagagacgggatttcactgtgttggccagaatggtattgatctcttgatctcatgatagacccacctcagcctcccaaagtgctgggattacaggcatgagccgccatgcctggcctactctatgccttttgattggggaatgtaatccatttacagagtaattattgataggtgaggacttaaccagtgccaattgttttctgtttatagatcctttgttctattcctcctctcttgcttgtgtgtgtgtgtatgttgtgtgtgtgtgtgtgtgtgtgtgtgtgtgtgtgtcttaatggctttctgtagtggtatgctttggattttatctttttatctcttgtctgtctgttacagacttttgctttgtggttaacttgaggcttacataaaacagcttatataacggtattttaagttgataacaacttaattttaattgcatacacaaactatacacttttacacccctttctcccatattttgtatttctgatgttatacttaaaatttttatataatatttattcccttaacaaattgttgcacttcagttgttaatagttttgccttttaacctttatactagagatataattgatttactcactgccattagagtattagaatgtttggatatgacaatgtatataccatgccctggcctggataaggggttaatatccaaaatatacaaaaaaagttttatactttaataaattttcatgttattaattagtgttctcttccttcagcttgaagaactccttttagcatttcctgtaatgcaggtctagtggtgataaagttagctattgattgaaaaagtctttatcatccatttggttttgaaatacagggttgct

SEQ ID NO: 4776 - DNA, 1166 bp, Homo sapiens
taactttagttacaaatacatttcctttcaaatacttacttagctcacaatccttaggctgggtctgcatggagccactggcttggatgttttgatccaaaccttttatctttctttctttttttttttttttttttttttttggcaactgtttattcaccaagaaagaaaatgttttgaaaggcaaataaacatttttatggttagacttttctatgcaatgtaaggcttgatttagtgaacgcatcttcctctattctgaataagaaatctaggagagaaacatgaatggcttaatgttaaacatgtattacttagtaatagttttgtgtgtttggacatctctcataagtttgctgtgaaggttaaatgagataatatatagaagacatgaagcataggataataaattctataaatgttagcataaaaaacgagtgtcagcttcctgttaaatacgggtagtacacatgcttcaaactctgaaaactccactaaataacaaaataattttaagtgtataaacttacaagatgtagaaaatgggagaggactaaatagcaggtgagaactgtcaaaaaaaaaaaaatctgaaagcttaaagtgggtagacaggcttaatagacctgaggaaaatgaaactttggaacatggaaaagtttgggattgaaggttcctctgaagaaagaagtcttgtgtagactaaaaacaggaagattggtaaaaggcataattttatcccagtaccctatccaaaccatgtaggccattagctacccctgtgccattctggcaaaatagtataactttactttgtggaaaggtgaaataaaatgatctccagtattagaaatcctagacacaagtccaccagcattcatttaatagacatttcaggaaaacaaacaaaacaaaaaacagacaatagaaattttcaaaatagtccaagaacatttttcaaatgtaaaggacaagaacatacaggttgaagtattgttatgagtatttagaaaaatatttcaagatagaccttcaaagaagcatcacgaattttcagaacttgaagtataaaaagaacaatagtaaaagtttctcagactaggggaaaagtcacacaaaggcttaggaatcataatgtaatcgacttgtcaacagcaacattttaa

SEQ ID NO: 4777 - DNA, 1150 bp, Homo sapiens
atactaaaaatggcttttgagaaaaatacttcctctgcttgtattttgcgatgaagatgtgatacatctttaaatgaaaatataccaaaatttagtaggcatgtttttctaataaatttatatatttgtaaagaaaacaacagaaatctttatgcaatttgtgaattttgtatattagggaggaaaagcttcctatatttttatatttacctttaattagtttgtatctcaagtaccctcttgaggtaggaaatgctctgtgatggtaaataaaattggagcagacagaaaagatatagcaaatgaagaaatattttaaggaaacctatttgaaaaaaaaagcaaagaccatttgataaaagcctgagttgtcaccattatgtcttaagctgttagtcttaaagattattgttaaaaaattcagaagaaaagagagacaagtgctcttctctctatctatgcttaatgcctttatgtaagttacttagttgtttgcgtgtgcctgtgcaagtgtgtttgtgtgtggttgtgtggacattatgtgatttactatataaggaggtcagagatggactgtggccaggcttccacattcctgaagcacacagatctcaggaaaggttatttttgcacttcatatttgtttactttctcctaactcacaagttaaaatcataacttaatttcattaacttttatcatttaactctctcatgtttgttgtaacctgaggtatccaaatgctacagaaaaatttatgacccaaatacaaatctcaatttgactgggacagaatgaggaatggagatttttgtatttatctttgggactttatgccttactttttaggctatagaatagttaagaaattttaaacaaaatttagtatcttttggtctttcacaccattcatatgttaagtggcagaatagccttagtgctacctccacttttttctccagtatttgcatcacagaaataatccctctgtttaacatgtttgttcagagccaagggtttattgtgaagaactgtcatcctgcctttgctagctggtaccttctagtaatcaaaattaatatgaagaaactaggttgtgacagactagattatatttagtaggggaaaaattgggctcaagaaccattca

SEQ ID NO: 4778 - DNA, 1099 bp, Homo sapiens
tttgaaagacataatctgtgtaatatggagaaatctattaagatttttcaggtttcatatgtcaataaaatattgcttgaagtctatgcaagctacttctgttctagggaaactgtcagcaagatactaacttttccaaaaaccagtggtaagatttaatattcacttcccttccccacattgttttctcttggaaaaggtatactaaggttttgtgtcaggtggtggtcattgaaaagtcttatataatgtaagtaatgttcatgaacttgtctgaatgttattattttaattattcaggacgttttctgtataaggttatgagctctatcttccttatgtaggccgtttagcttaactgtattaaggtaaaaggtctgtatctaatttaaaacttaaaaccaaaaaatttttccaaaatacagttagtacttgtaaggaggccatgagtaggcgatgcatataatttagtgctggaaaaataattccatatatgctttaattgaaaggatattgagcttatgacccttgcatataaaagacaacattataaactccattacatcttctgtatctcaaacattatgtcagtcattcatctgcatgtgaacatcacccacgaaattatagagttcagcttcatctagcatttgttatagtacataagaatatatagtgcagtattctaatgttacattagatctcaaataatcatggctgcagtcaagaggatagcacacaatatggtactttaaattatttcccattgaaaagcaaaaattaatgactaacagatattaaagttaaatttctgaatagaaagaacccaaggcttgtcattttaatttttattgttaatgtttgttttttttttttttttttttttttttttttttttttttgctagtgatccaggatgctcttgcgtagtgattcttaaatttgggactgtgtgagaatcaagtttctaaaccctcttcaacctactgaattagaatccatgggcacggggctaggaaatttctaatttttaaaatctccctagctgattctgatatattctaaaatttgagaacaaccagtcttgggaaaatattac

SEQ ID NO: 4779 - DNA, 1128 bp, Homo sapiens
ttaaggttgcccttggttttggtgtaagaatgtgagtttagtggttcagttccatttttgccttccacatgaaggtgccattagggtctttatgaaaatgtgcaacacaatttattcttaagccccaagggtcatcttatctttgattatctggcctagcttggagatgaccagggaaaggagggaatgtatagatccccaaatatggaaaagctcttcccccctccttactcttttttctaggcatgaactcaacagaatccaactcttctgcctctgttagaccaaaggtactgagtagcatccaggaagggacagtccctgacaacacaagctcagcaagggggaaggaagacgtgaacaagaccctcccaaaccttcaggtagtcaaccaccagcaaggcccccaccacagacacatcctgaagctgctgccgtccatggaggccactgggggcgagaagtccagcacgcccatcaagggccccaagaggggacatcctagacagaacctacacaagcattttgacatcaatgagcatttgccctggatgattgtgcttttcctgctgctggtgcttgtggtgattgtggtgtgcagtatccggaaaagctcgaggactctgaaaaaggggccccggcaggatcccagtgccattgtggaaaaggcagggctgaagaaatccatgactccaacccagaaccgggagaaatggatctactactgcaatggccatggtgagccttctctcttctctccttgctcacagatctctctaccactttttccctagtccctgttttctgaaggaatgggaatgcgtagtttgtggaatctcctttgtagaccaaacactacttgatctagtcgtgttatagaaaaagagattgaccgtctcattagaagtaatgcattcagagagaataatctctcttcctccttttcccctggtacctttaaaacagaagaatgttgtggaatcagagacctgattgactcctagggactttgtttgaccttgtcatttaacaaatgagaaatttgagtttagagaggtttggcaacattgatccaaacaagaggctagttgtttttgaggacagatgggacgagactcctgactgttg

SEQ ID NO: 4780 - DNA, 1235 bp, Homo sapiens
aggcaaaggtcaggcagtgaaaccaaagcatcacagccagtagatcaagctgtagggtgggatccaagtcttcgtttctctcgttctactgtgttgcagcatgctgtcaagaggatgcagtcctggtcggatctttaacaggaatgatgatggtggtgctggaattgttggccctttttctgctctgctcctatgtaacatcttcttggtttttgttcctttccctccccttctgtttctttcagcttggattccttagcaccaccacagctcagccagaacagaaggcctcgaatctcattggcacataccgccatgttgaccgtgccaccggccaggtgctaacctgtgacaagtgtccagcaggaacctatgtctctgagcattgtaccaacacaagcctgcgcgtctgcagcagttgccctgtggggacctttaccaggcatgagaatggcatagagaaatgccatgactgtagtcagccatgcccatggccaatgattgagaaattaccttgtgctgccttgactgaccgagaatgcacttgcccacctggcatgttccagtctaacgctacctgtgccccccatacggtgtgtcctgtgggttggggtgtgcggaagaaagggacagagactgaggatgtgcggtgtaagcagtgtgctcggggtaccttctcagatgtgccttctagtgtgatgaaatgcaaagcatacacagactgtctgagtcagaacctggtggtgatcaagccggggaccaaggagacagacaacgtctgtggcacactcccgtccttctccagctccacctcaccttcccctggcacagccatctttccacgccctgagcacatggaaacccatgaagtcccttcctccacttatgttcccaaaggtaacttaacctcatgaattatttatttgaggaaggctttgagcccagtggaggtaccaagagtgggcttataccaaagatgttttctccatttcgtgtattccaaagtcaccccttggagagaggccttcatatggtggctaattaaatctggcttttttggacttaatagaaacatgtagactcagaatttttctgttaggggagatcagatatctaaaaactaggtcacatcaagctataaaatatgaaccaagagaaacaaggacagcgtgtgaccttatgtaagttacttaacctcttcaggcctcagtttcaaacttgtcaaacaaatgaat

SEQ ID NO: 4781 - DNA, 1152 bp, Homo sapiens
ttagtagtagaagatgactggattttcatgtgcttttgtattctgcctgcggtgatagcctgtgttgtgtgacctttggaaaactccattgtgcacttatgggaaaacaagagtaaaaagacaaataatgactaagtattatcacaagaataattttgacttcacagacccctgaagggtcttgggaacctccaagagtcctgggattactctttaaaaccttgatctagggcaacaggcaaaaggcagcatatgtgggttcagattctggtaggtgggtagatattgggaggccttgtgattgtttcgtgatagtagtgcagtagaaacagtgaggatagagggagatgttggaggtttcaagagagaggagaagttatgaaatgctctattttattgaatatataaatatcaataaaatgaatatgaaataaaatctaaaacagcatattttagctactactaagaaagaaaaaattgccaaatataatccatatcattaattgaaaatgcatgttaattccacagatgttaaaatgtaaaaaaaaaaattgtctcatttcatggacacatctttaaaaaaaaatgcctcaggacttaaacaaatatgatagctctccaggaaagtgggaggttgaacggactagagaagcgtagtttggtggttggacagcattaaaggcccacttcatattcatagtcatatatttaattcaagtacttcccgaaagtttttttctgtaattgtcacttgtttatgcaaataccagcagacactggaaagcttcttgcttcagcataccactaattaaatcatctttaaaatttttttaaatttagtaatttaagttttttaaaatgtagtaatgaggaaaagataccactgtgactcttagaatatgatatcaataaaaataaggagaaattcaaattttaggttgccatatggatatggtttgtttggccccagcaagctatggttttagatatggtttgtttggccccatgaagccttatgttgaaatctgatccccattgttggagatgggcctcatggaaggtgtctggatcctgagggcagatccatcataaatagcttggtgccattctcataggaatgagttctcacttgtagttcccatgagaactgtt

SEQ ID NO: 4782 - DNA, 1224 bp, Homo sapiens
gctaatttttgtatatctagtagaggcggggtttcactatgttggccaggctggtcttgaactcctgacctcatgatccgcctgccttggcctcccaaagtgctgggattacaggcttgagccaccacgcctggccccttcaggcttcttttgtggctaaatctgctctcctgaatgaagttaaggttatctgtcatctggaagctttacactatttcctaaggccatgattccaccgtttcttttcattccacagagcattttttaggggttgggggacagagaagaaaagatcacttctaactctgggcttccattctcaggtaaccacctgctgttccaacaagtgcccatggttgaaattgacgggatgaagttggtacagacccgaagcattctccactacatagcagacaagcacaatctctttggcaagaacctcaaggagagaaccctgtactgtggcccctctcgagtgttgtcacttgtcagcttactgatgccttagctgattagcaacctctgtagcacaccacatttactttatgtcttacatagttagtgagatcagggaacaaaaacccaagaaggtcacgaagaccagttggaacttcagtagagagagtctgagtaaaacaaaagaataggattcagatattgaatattatatctagggtgtcattgtttcagatttcaacatttttaaatgctttgatactgctttttccctttcttgcacattcactattgttaagtattaggaatgaggagctgctgtgacattcaaggcctgggagagtgagcattagattataatttgaaatcaaagcctggtccttgcaccccttagatgtatgaccctgggcaacgtgggtataagaatagtacatttctcatagtgtcatgtgatttaatgagataatggatagagagtgtttagcaccatgcctggtacactctaagcactcaataagtggtattcactatttttataaagttgaagtttgacccatacgaagagaccaaaacatggatgctggggtaaaagtggaggagtaggatgccaggagagagagcactcatgactgtcaagctgtctgatctgtgacagatttttctgagttacaactagaattgaccttatatctttgctcttaagagacaggtataggtaaatgcttctagggacttaagttgcagcatctttaaaaaaaaaaaaaaaag

SEQ ID NO: 4783 - DNA, 1125 bp, Homo sapiens
aatccacacattatagtttctcccatattcttttcaacttgtggttttactagctattgatcatcatcattgttagggattacaaaatggcaattctttcaatttccatcatttcacctatgtttatgaactgtgattctcttctaagagagtacttgtcactcattaactatttaattactttaaaatatgcttcatataggaaaggcgaggtaaatgcttgattataaattttcacaataatgcgttgttgccctagcaacctccaaagatgcaaatgtgagttgttgggttatgcgttttgtgtttgttctttgtttttattttttgcctatgacaacttgccacatggtgttttacaattttctaaatgagttgacatcattttcatatgcaaattctgatttctgacttgtctttagaaattggaagatgtggtgatcctgagctcattttcacagggcagcaattgttggatctgaataaggactgccccacctcgccctcttgtttcagggtgtgtttgctaactgttaagaggaaagtgaaaaacattcatggtcccctgaacctgctcaacttcacttgtgtctgtcatttttctaacccccataggcttctgagtttgtaattcttgatttatttcataggttttgaatggatgtcttatatatgtatgcaatataaccctttgtcaaatcttctctcttcattctaccctgcccctcctactcacctatgagtcaacatttttagttacagtaataaaaactcaaccctaaataagttaaacaaaaaaagaacatgagtcatctgacccacctaccccagtccaatcacaggaacaggctgatcaggtagagtaatgagcccactcctcagaccagactggatgaagctagattggtctctctcccagggtgaccacatggtttacaaggtggtggggaggggccctccccgtctctttgccagctaagtttgtgctcacatagatctgagacagtcgggagggaccagctggcagccaccagacaagtccatgattctcaatatcccacgattgggttgaacctaaagttgaagcacacacatctgagtaactaggtcactaaaacctactga

SEQ ID NO: 4784 - DNA, 1445 bp, Homo sapiens
ggagcaggaggacaaaggacaagaggaagaaaagacaagagaaggactgaactgggggagtgagggaagaatgcgagagtgagactcagagagtaaaggggagggaaaaaaaagaagagagaaagggcgaggaagggggcgaccgcaggagggagacagacctggagtccactcggaggcctggagccgcacaaagcgccaggtcagcggtcccggctgggtgagaccagcaggcggctctagcgcgcgggagctgggcgaggctccgggacgacctcaccaatggagactgcagtatttagcatgccccacccatctgcaaggcattctggatagtgtcaaaacagccggaaatcaagtccgtttatctcaaactttagcattttgggaataaatgatatttgctatgctggttaaattagattttagttaaatttcctgctgaagctctagtacgataagcaacttgacctaagtgtaaagttgagacttccttcaggtttatatagcttgtgcgccgcttgggtacctcggatgtgagggcgatctggctgcgacatctgtcaccccattgatcgccagggttgattcggctgatctggctggctaggcgggtgtccccttcctccctcaccgctccatgtgcgtccctcccgaagctgcgcgctcggtcgaagaggacgaccatccccgatagaggaggaccggtcttcggtcaagggtatacgagtagctgcgctcccctgctagaacctccaaacaagctctcaaggtccatttgtaggagaacgtagggtagtcaagcttccaagactccagacacatccaaatgaggcgctgcatgtggcagtctgcctttcttttgacccattacccatctaagttagatgcttttttaaatgttttttaatttttaaatttttaatttttttcattatttattttttatttttgagacggatctcggctcactgtaacctccacctcccgggttcaagcgattctcctgactcagcctcccgagtagctgggattacaggcgcgcgccaccatgcccggctaatttttctatttttagtaaagacggggtttcgccatgttgaccagggtggtcttgaactcctgacgtcaggtgatcctcctgcctcgtgctgggattgcaggcgtgagccaccgctcccggcccttagatgctttttaatcagcaagtacgcaatgctttcctgacaggaatgtcaagtccgtcaggaaatccacataagggtgttaagcaggcaaagtaccacatacagattaaaatcaaaagcactgtcaacgcttatttaatttatacagtagaccctaacttttctaattttgtgtatacatatatatacatgtatacatgtatacaaacatacatattttcttctttctttcttcatctcagtgggacatcttgagat

SEQ ID NO: 4785 - DNA, 1217 bp, Homo sapiens
ttttattccctagagaccctgaaatatggcgtctggcctgcttgaaagtttggggcagaagctgtattaaacttgttccgtacacgtcctggagagagatgtttttagaacggcctcgtgttcggtttgatggtaagttggattctgtagaactcagcagaaatactgatctataatgctgatttttataaatacgccgtttaaattttctgtgatgaatgtgagtactgtaagcatgtttaaaggaaaccacagtaaatataatgctgggaatatctgaatattataatttttaactttttaaaattattttcataggcgtgtatatcagtaaaaccacatatattcgtcaaggggaacagtctcttgatggtttctatagagcctggcaccaagtggaatattacaggtacaactgtagtacactgagtgagtggaaaattctctctctccatgtattagttaaatggacatctgttctttgttgcttttgattgacccgcaaaatggccctcagtatttttatctagtactcaatgtaggaattgcactaaaaaaaaaaataggctaatataaattacagaatttcttctggcctcttttagatttcttcttgtcttttgccctgggtgtatttacttgccttttcaaatagcttgtgcttttattccaccttattgcttgccaaatattattgtcatttagaaaaaaatagacatgttaaccgttgtgtgtggctctcactttgtttgaaattgttgctttgggaaaaacacagaactttaataaaacaatatttgacttttattcagtgagtaaaacttaaaagttcaacagtttcccctgaggaagataaaatatctttggttctttgttgctggactaacaggtagtcagtaatatttgttttaatgttttagcagttctttagcccgtggtatttcagtgttggtttcatagctatgaataggcataggtactaatagataaggacatattttatactttgtgtggggggtgtgttttggtcttccttttcttattacataggtacataagattctttcctgatggccatgtgatgatgttgacaacccctgaagagcctcagtccattgttccacgtttaagaactaggaataccaggtagcatttgttttttaaatggctttccatccagtctatgttttatatggttccttgcaggttaaagtaat

SEQ ID NO: 4786 - DNA, 1201 bp, Homo sapiens
tccctgaagcctagagaagaaagggcttccagaaggatggagtggtcaacttgccaaatcccacagagaggtaaggtaaggacagagaatggaccattggctttggcaagatataggtaggtcactgatgacctcagtaggagctgtttagtagagggatgccatggaaagcctcgtaagagtggactgaggatgtgaataaatcaactacagtcaactcttttgagatggagtccagtttcatgcctagactgaaattcaagattcataatgaagaattcacttttatcaagcattgacaggagttagacacatctcaaaccatattttaaaatacagccagattacaatgttacctgattctgagactgcctgtaacttgattcataatagtgacagacagcacttggactaggacactagagctgctgagaaggaaaattgcacccagcttctttgcttcctgcaaagatgcaccaggatcagagaagaaaagaccaagttctataattacctggcaggggagataccatgaacacaaagatggttttcccagggtgagtctcatccattgccctccggatgtgctgacccctgcgatttccccaaatgtgggaaagtcgactgcataatttgtgttaatgggggactgtgtccacgctttccgccggaaaaaaaaaagaagaaaagaaaaaaaaaaagaaaagacaagacaagaccaagttctgagagtgcttgaagaagcggtactaggagaagactgcactgccctaaaacctttgaccagagattctgggaaggcttggacagtgacaggcatgctggaccctgcagctgttgacaagggagaaatcttaattatattgggtgaaattctcctatagagaaaagaagataaaactatatgtttttgaccagaaatgcccaagagagctctgctaccctcaagaatctattcttcctgaaaatgtgaagataatggcttagatctggaaaccaaagatagtctcagatgtggctgtgaattttagtgggtgggcaatgtggggtggagtggggatagagggctgttgtggaaaaggcagcccagcctgctcagaggtgtgtatatagacccacattgctggcaagcaactcatctcactaccacacaatgtttttttgttttttgtttttgttttttttaagacagagtccactc

SEQ ID NO: 4787 - DNA, 1104 bp, Homo sapiens
cagtcagtttaactttttaacagatcttatttttttattttgagtgccactattaatgtaaaaaggggggggctctacagcagtcgtgatgaaacttaaatatatattctttgtcctcgagattttaggaagggtgtagggtgagtaggccatttttaatttctgaagtgctaagtgtttttatacagcaaacaaaaagtcaattttgctttccaccagtgcgagagaggatgtatacttttcaagagagatgattgcctatttaccgtttgacagagtcccgtagatgagcaatggggaactggttgccagggtctaaatttggattgatttatgcactgttatctgttttgacacagatttccttgtaaaatgtgcctagtttaccaaaattaacaaagggggggaaaggaccttagaactttttaaggtaaaatcaaatatagctacagcataagagaatcgagaaatttgatagaggtaacttgtttaatgtaaatctaatagtacttgtaatttctttctgcttagaatctaaagatgtgtttagaacctcttgtttaaaaataatagactgcttatcataaaatcacatctcacacatttgaggcagtggtcaaacaggtaaagcctatgatgtgtgtcattttaaagtgtcggaatttagcctctgaataccttctccattgggggaaagatattcttggaaccactcatgacatatcttagaaggtcattgacaatgtataaactaattgttggtttgatatttatgtaaatatcagtttaccatgctttaattttgcacattcgtactatagggagcctattggttctctattagtcttgtgggttttctgtttgaaaaggagtcatggcatctgtttacatttaccttatcaaacctagaatgtgtatatttataaatgtatgtcttcattgctaggtactaatttgcagatgtctttacatatttcaatacagaaactataacattcaatagtgtgctgtcaaagtgtgcttagctcacctggatatacctacattgttaaatgtctaaacagtaatcattaaaacatttttgattacctgtgcctgcatttt

SEQ ID NO: 4788 - DNA, 1147 bp, Homo sapiens
gcctggtttgttgaaaaaagactccagagcttggagctagcagaacttaattggatacttttgttattcttgcctagcaaaatataattctgattctctctgctataatagttctgtttattcttaatcttttaaaaatcattatctctgatatttattagaaggaaataaaatgcaatattgataaaaatgactaatgtgctgttttttacgataactctaaaatatttgaatcattcattgctaatcataaaacgtattagacaatccaaaaacctccaagattgagtgctctatgttgactgtgatggtaaccttattttcatgcctacttgcttaaagtttgtctccttttcactgctatcctgcctactatcgatactttgggtaaattttaagtgaaaagtaaaagaaaatttgtgaccacacgggaaaataagcatgtaaaatagtgatttgtgctcagattgcattattttgtgaaacaaataaataagtggaaacaattggcactttgcaggtggctcagcgagcagcccagctgcaggaggccttgctgcactgtgggaggttccaggatgccctggagtccctgctcagctggatggtggacactgaggagcttgtggccaatcagaagcccccgtcggctgagttcaaagtggtaaaggcccagatacaagaacaaaaggtaagttagtcatgcttttgtattgcgtttcatattaaatcttaataacaagagaaaaaatgcaaattgtgactcttttaattaataggataacctagttaaccggttgttgctgctgtagacattattttgttagtcattcgacaaatatttattgaacatctaccatgggccaggccttgttccagttgctgggaatatatccttgaataaaaaagatgaacatttctcattgagttcaaagccaagtgggaagggtgtgccaggattgaaagacaataagtaaagtaaataaatgaatggtgataagttagcaagtgatgaataaagcagggatcggggagaggcatcaggaagcaatagagcaaagatgagggacctaaagtgctggaatggagggagggagggggtgtgtgtaattttaaatagggtcatgaagggaggtcactgacaaga

SEQ ID NO: 4789 - DNA, 1198 bp, Homo sapiens
tctctaaaaatttttagtagtaattatttaccaaacttaaaaacatttctataaatataaagcttttctttatatttaagacaaaatataaaggctagaatttggttccttctctgtaacactaaatattttagtgtgaaattgaatttttttattactatagtcttttcaatctataatttgtgtttttaatttcttgatatgtcacttctgttcctccctgcttgcattttttaaaaactagacattgtggcttgagaatttatcaatcatctttccgaaatgaccacattgtgcttttagtttgtatgtttaagtggtcaagcaaggctctaggaggtagtcactgagctggaccttaaacacatctgcaggagctcacaaaatgggagcaaaagaggcattccagaaagaagagtagttaagcagatgtgggggcagggcaagaggagacagcaccttgttgccagagattctacacaaaggtgtgatggacactgatgctctattaagaagcttttgtggtgtgtgtggtagagaataattaaggcttctgataagacaggaaagggatatttcatcatgactgttaagaaaaggtaactgggttgtttaatgttttaattgataattgtcactgatcgtatttctacttgttaaataattaaaaatcatcttaaaattcatactttgactttaatttagacacaaggagatgtaatcgctgtgtaacatcagagaaagctatatggattatcgtcagaagtaaatgtttctaacattgacaaagatgcttatcttttcattacatcattcactcattaattcattcaatcacaaaatattgagtacccaccatgtgccagcaactgttctaagcacttggaatataccagtaagcaaaacaaagcccttacccctctgtggagcacatattggtggagaggaggggattgtacaatgttagtaagcaaggcaataaaactgcatatctgatggtgatacgtgtaacgacggaaaataaagaagggaagggaataaatagtgcagggacagggagttggggggaggcttgctatttttaatagggttgtcagaaaagatctcactgataggtaaacttgagcaaagacctgaagaaggtgagggaatgaggatgaaaatacatatcgggaagagagttccaggtggaggaggt

SEQ ID NO: 4790 - DNA, 1334 bp, Homo sapiens
acattgtgcaatgcattaagaaacccatccagctgtcatggtatgttacaaggttttcagcagactttgctcctaatggctctctgaaagtgacagacttaaatattgctctgcagtgcttttcagaatgtagagtgagacctctggtggaaaaattattgccctgtggactcctttaattttttttacattagacgaagcttctcctgtttgtaaaggaatgctataagaaatttcaaacacaggttttgcggaattttaaatgctggaaaacataaatgaaatgcctaaatatattgttacagattttaatactgtggatcaaggaaagatagcaagcattcttttcctgaaattggtcatgtagcttttctgcgaaatagtattgaatctgaatactttcacaaaataatactgaaaggtaaaccctaaatcttgccagactgcattagtattttggcattgaaacttgtgcaatatctgtgtaatgtagaatgtggggtgtgcatgcagatgtctggtactggagtaagctgaaggtatgtgcagtatttaagaaaatgtacattctaattaattcacttataaaaccatttacatattgtgtatatgtttttattttcaaatgataaactctagacatatattttgcaaaatgagcttgggtttaaaaagtgctttgtgccaaaaatatcatacctaatttttatagtgctttactatcagaatttatattgtttattatatcttttaaaagcagtaagcagttttcatctgacagcgtagataaaagaggagtataggaatttgaatgctagagcatctcccaggtgagccttattgcagatctttttgatatagtcacccataagcatggtgagctcctgctctcataaggtcagccaaagccccttaagaaggtacacagcacatctgcagtcattcaggaggtcctgtgaagtgtggtgatgcatctaacaccttttgctgctcactgagaacccagctttgaacttacaagattacactaaccatttttaaagtgcacaaaaatattattattagtcttaactaaaattacatattttataatgccctgcaactctaaaccatccttttgtttacacatttttgtatggtattttaagattatcaatcacttcaacatttctataaccttgtttgtatagcactttctcaagagctgtcagtcccacatacagaatcatttcttttacaaaatgatttaatatgtaatcatgtgtcaggacataaattttgtcacttgggacagtagctttccagctaagataattgcgtgaactctgttaaaa

SEQ ID NO: 4791 - DNA, 1225 bp, Homo sapiens
aggcaacgcgctgagggactaggcagagccgtggaaccgccgccaggtcgctgtcggtccacgccgcccgtcgcgctgcccgcccgctcggcgtcggccgccgccatgggagtgcacgtggaaaccatctccccaggagactggcgcaccttcccgaagcgcagccagacctgcgtgatgcactacaccgggatgcttgaagatggaaagaaatttgattcctcccgggacagaaacaagccctttaagtttatgctaggcaagcaggaggtgatccgaggctgggaagaaggggttgtccagatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttggatctgccatggagggatctggtgcctccagacgtgtgcacataaatccatatggagcttttcctgatgttccactccactttgtatagacatctgccccaactgaatgtgttctgtcactcagctttgcttccgacacctctgtttcctcttcccctttctcctggtatgtgcgtttacctaaactatatgccataaacgtcaagttattcattttactttttcattttggggtgaagattcagtttcagtcttttgaatataggtttccaattaagtacatggtcaagtgttaacagcacaagtgataagttaacgttaggataggaattggtgttgagggggttgcaagaatattttattttaattttttggatgaaatttttatctattatatattaaacattcttgctgctgcgctgcaaaaccatagcagatttgaggcactgttgaggactgaattattctccaagttgagagatgtccttgggttaaattaaaagccctacctaaaactgaggtggggatggggagaggctttgcctccaccattcccaccccaccctccccttaaaccctctgcctttgaaagcaggtcatgttcactgcgatgctggacactacaggtatctgtccctgggccagcagggacctctgaagccttctttgtggccttatttttttttttttttttttcatcctgtggtttttctaacggactttcaggaattttgtaatctcataactttccaagctcc

SEQ ID NO: 4792 - DNA, 1213 bp, Homo sapiens
ttttacgtgtttccatgtatctcactttgtgctgtattaaaaaaacctccattttgaaaatctacgttgtacagaagcacatgtctttaatgtcttcagacaaaaaagccttacattaatttaatgtttgcactctgaggtgcaacttaacagggagggcctgagaaaagaatgggagggggctattaattatttttagcaaaatgttgcctttgtcttgtgcaaacatgtagaatatgctctttaatttagtaaaatatttttttaaaaggtagagatgctttgttattgtaatcataaacttcctgaaattcttgtaatttttttcccatacttatcagaagtgtgtttaccaacttatttttgtttgaaagtgtgattttttttttccttcccaacctctcttgcaaaaaaagaaatgggtttctgctaatgaattgagcagacatctaatattttatatgccttttgagctgtgtaacttaatatttggatacttgacaatttgttttattatgtaattgataaaatggtgatgtgtattaatgttagttcaaccatatatttatactgtctggggatgtgtggttatagttctgtgggagaaataattttgtcagtgttcaccagcttgtaaaaacttagtgcgagagctgaaacatctaaataaataatgacatgcatttatcatcattgagattggtttgcttaaaattaacttattttgtagaagacaaaatgaattgcacttcacttaatgtgtgtcctcatctttttacaaataaatgaaggattataaatgatgtcagcattttagtaaacttttagacaaaatttgttagggtcattcatgaaaactttaatactaaaagcactttccattatatactttttaaaggtctagataattttgaaccaatttattattgtgtactgaggagaaataatgtatagtagaggacagccttggtttgtaaagctcagttccactagttcatggttttgtgcaacttctgagcctcagttttctcctttgcaaattaataattacatacctttatagattttgaaattaatttaaatattagtatttggtacatgaaggcttaatgttaagtttcctttaatgatccacaataatccctttgatcacgttaatctaaatctagatgtctttgtctaattttttttgaatagcagttataaatgtaaa

SEQ ID NO: 4793 - DNA, 1103 bp, Homo sapiens
taactggataaacaaactgttgtccattcatacagtggaatgttatttagcaataaaaagaaatgatcagtgaagccatgaaaagacatagaggaaacttgaaagcatattgcaggctgaaagaagccaacctgaaaaatctacatatatgtatgatttcaactatacgacattctggaaaaagaaaaactatggtgacagtaaaaagatccgggttgtcaggggctctgggggacagagggagggacaggtaggtagagcacaggggatttggggggcagtagaagtattctgtatgatactgtaatggtatatatatgtcattatatatttttcaagccccatgtaccacaccaagagtgaaccttaatgtaaataatggactttaatattgatatattaatattggttcatcagttgaaacaaatgtaccacagtaacacaagatgtaaataagaggggaagctggatgtgtaggggtggggaagagggcaatatggaaactcttcgtactttctgatcagtttttctgtaaacctaaaactgctgtaaaaaaaaaataaagtaactttttaaaaaattgcctacttattcaaacatttcaattatcttggtgtctctttctattggctgattttatctcgattgtagattatattttcctgatgctttgcctgtctagtgcttgttcctcagtgcttgaaaaagtcacttcatgtattttaaccagttttacagttgtttgcagaaggaagagggtaagttctcctctcatggtctcagttgacattaaaatagaagttttcagccccggctgtacatttgaatttcttgggaacttagatcagtgctgaatgaggtccagacctagggaactttttaaaagttgtgcaagtgattaacagggttagggtatccctgagtaactgtgctagaaagagtgggaactgaaatttggcctgtcctccttggagtctagttgcatctgcctgtagaaggagcatgtttttgaaatttatactttaaagctgccatatggattagcaggatcctagattctaatgtggacccattaccttccagtaaggaaaccagagtgtcag

SEQ ID NO: 4794 - DNA, 1233 bp, Homo sapiens
acatggaggaacgttcaatgcatattactaagtgaaagaagccaatctgaaaaggctatatgctgtatgattccaactatatgacattctggaaacagcaaaactatagggatagttaaaacatcagtggttgccaggggttagggagaaggagggatgatgaggcagaacccggaggatttttagggcaatgaaactactccatgtgatactattattatgtgaatatgttatacatttgtcaaaacccatataatgtacaacaccaagattgaaccctaatgtaaaccatggactttgggtgataatgatgggtcagtgtaggttcgttgattgtaaccaatgttccagtttggtgggggatctcaatagtggagaaagctgtaccttgtgtggagccaccgggtatatgggagcgctatacttttgctcaattttgctgtggacctaaaagtgctcttgaaaatgaagtttattttaaataaaagaaaggaattatgaattaatatgagaattgcaaaaaggatataattgtgggggaattatagaaatcagctacgtaattccatggagtagctctgctgaaagtctaacgatatgctatgtccaaaggactgaagcaactatctggggtatgctatgggggccaacacagaagacatggaaaaaaatcttaaattttaccacatcctgttctatcaatgacctttccaccaactgcttattttggttttactctgcttcatctctattgcttctgaacttccttttcatttcataacagaaactctgagcctttgccgcctcactaaatttcattttaaaacctattctttcttagaaatgataatacagaaaccactttttacaaatacaacatttaaagaaaatcacagtcacctaaataatctgtttctgtatcagagaaggcagtggacctacagacggtctgttcagtcagctgaggatttaggactgaggaactgttaattcccacagcagctctactgactattcgatagtcccaggacctgaagtctttcagagtctgcttcatgcactataaatatataaaatgagaaaataaaattaattattgtgttttaagaatatttatagcactgtaagtttaggctattatattaattatctatctctgggtaacaagataccataaacttgctgcctcagaggcacataaatttattatctcacagattctcgaggtcagga

SEQ ID NO: 4795 - DNA, 1105 bp, Homo sapiens
gaccaaccttggcaacacagcaagatcctgtctctacaagaaataaaaatctagctggatgtggtggtgtgcacctgtggtcctagctacttgggaggctgaggtgggaggatcacctgagtcatggagcttgaggctgcagtgagctatgattgtaccactgcactccaccctgggtgacagagggagaccctgtctctggaaaaaaaacctaaacaactgatttaaaaaatgggcaaagaatttgaatagatacttctccaatgatataaaaatagctaacaagcacatgaaaagatgctcaacatccactaatcatcagagaaataaaatcaaagccacaatgagatatcacctcacatccactaggatggctactatcaaaaaacagaagatgacaactgttggtgagtatgtggagaaatgggcaatcttgtgcactgttgaagggactgtaaaatgatgcgatcacgatagaaaacagttcctcaaaaaattaaaattagaactactgccaggtgtggtggtgcgagcatgtagtctcagctactcgggaggctgaggcgggaggatcgcttgagcccaggagttctggactgtagtgctctacgctgattgggtctccacactaagttcagcatcaatatggtgacctcccaggagtgggggattaccaggttgcctaagaaggcgtgagccagcccaggtcagccaaaactcctgtgctgatcaatagtgggatctgtgcctgtgaaaagccactgcactccagcctgggaaacatagcgagatcctgtctctaaaaaaaaaaaactaagaaaaaaaaaaaaaaaacccacagagacctacaactaccacatgatgctgcaattccacttctgggtatacactcaaaaaaattgaaagcaggggccaggtgtggtgggtcatgcctgtaattccagcattttgggaggccgaggcaggtggtcaggagttcgagaccagcctagccaacatggtgaaaccccatctctactaaaaatacaaaaagtagctgggattactggtgggtgcctgtaatcccagctacttgggaggctgaggcacaagaatagctggaacc

SEQ ID NO: 4796 - DNA, 1102 bp, Homo sapiens
tctcaggttggtgggattaataattctaggtttctttatcccaaaaggcttgctttgtacactggttttgtcatttggagagttgacagggatatgtctttgctttctttaaaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacgtaagtggctttcaagaccattgttaaaaagctctgggaatggcgatttcatgcttacacaaattggcatgcttgtgtttcagatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtaagttggctgtaaacaaagttgaatttgagttgatagagtactgtctgccttcataggtatttagtatgctgtaaatatttttaggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtaacaatttaaagtaacattaacttattgcagaggctaaagtcatttgagactttggatttgcactgaatgcaaatcttttttccaaggtgattatcctgaaccatccaggc

SEQ ID NO: 4797 - DNA, 1188 bp, Homo sapiens
aaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcctggcttgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaaaactacccctaaaagccaaaatgggaaaggaaaagactcatatcaacattgtcgtcattggacacgtagattcgggcaagt
